United States Patent 9,029,636 (ISOLATED NOVEL NUCLEIC ACID AND PROTEIN MOLECULES FROM SOY AND METHODS OF USING THOSE MOLECULES TO GENERATE TRANSGENIC PLANTS WITH ENHANCED AGRONOMIC TRAITS) - sequence listing, part 44

SEQ ID NO: 200161 - protein, 217 aa, Glycine max
  Coding DNA Sequence Number=SeqID_83383
  Homolog annotation: Hit_ID=Q1ST47; Match level="QueryCoverage=63%, HitCoverage=44%, E-value=1e-12, Identity=33%"; Hit description =Bromodomain
  Pfam annotation: Domain name=Bromodomain; Domain location=121-211; Score=19.7; E_value=3.1e-05; Accession=PF00439.15; Description =Bromodomain
MAKAEHPRRKLVIKIFPPGSKVSYSCGTNTPKDSIVSKVCELKNKKGYYAMTMWVNTENPSESCVTDSRISRTEMATWVNTKNPSEVCESKKKKEDSVRVECKNREKKKRKVEHVMTMDRCKKMQCWAMLKRLMVGRDAWALQKDVLHPKIFYVLDKSEAMKKPKGLEDIESKLKNSDYSEAYEFVDDVRLVLSYALQYPPRSEVHRTATRITEGFG

SEQ ID NO: 200162 - protein, 170 aa, Glycine max
  Coding DNA Sequence Number=SeqID_83384
MIKEVRPHGAVEMMDPTTGNLEKIWIVNGQHLKIYSGGQLERLTSIQNSSLFPLTTFILSKFINEKMASWKRRVVPAQGGDSTWDSSCFTFETTWHRYQDNVHLQNILPKRNMELALALGTPGGGFVLNVDGAPWKLLRKDLTTLAQTWSVLSYFSLALTSHISDLVLGF

SEQ ID NO: 200163 - protein, 273 aa, Glycine max
  Coding DNA Sequence Number=SeqID_83385
  Gene Ontology: Mol. function=RNA-directed DNA polymerase activity; Cellular component=chromatin; Biological process=chromatin assembly or disassembly
MADSTRSKSAMDRLEEAFTKLASHVTEKIDDLLLRVAALETHAHHSPSPSSSSAIPIPNPYTLSHSQMKLVVPRFDGSDPSGWVFKITQFFEYHATPEPERLTIASFYMEGPTLVWFQWMMRNHQLTTWPGFFQAIEARLPPSFLLSCFVSGLDPDIRREVQALQPMSLVHAAGLARLQEEKLLEGHRAPHSRVSPVLNPYSPSPTPVPLPNPNLSLSPSPPKSPPLPVRRLIPEELASRRERGLCFYCDERFTQGHRCASRFSLLVTDKEQP

SEQ ID NO: 200164 - protein, 515 aa, Glycine max
  Coding DNA Sequence Number=SeqID_83386
  Gene Ontology: Mol. function=RNA-directed DNA polymerase activity; Cellular component=chromatin; Biological process=chromatin assembly or disassembly
  Pfam annotation: Domain name=rve; Domain location=396-515; Score= -4.5; E_value=0.014; Accession=PF00665.16; Description=Integrase core domain
MTFRTHHGHYEFLVMPFGLCNAPLSFQATMNSTFGPFLRKFIIVFFDDILIYNKIFSEHIKHLQIAFQTLQDHSFFLKLPICSSATQQVEYLGHIVSEQGVEPVPTKVIAVHQWPPPTSIRVLRGFLGLSGFYRCFIKGYATLVAPLTALLAKDSFHWTQAADQAFRKLKEALCTTPVLRLPDFSLPFILETDASGTGMGVVLSQQHHPIAFFSKSFCLKLLCASTYVCELAVITVAVKKWRQYLLGHHFTILTDHRSLKELMAQAIQTPEQQTYLGRLLGYDFNIQYRANTANSAVDALSRRPELLSGELLMLTIPSCIFLQDLKDKLRASQEFLYFKQRILDDPQTHPDCLLRQDLILQNGRIWLPRNAPSIPTILAEFHSTPTGGHMGMTKTLARVPDNFTCSNMQQDVRKGHSVILVVVDRFSKGVHLEMLSTHYTVANVTTTFMEIADKLHGIPQSLQLFKLSGTKLRMSSAYHPQTDGQTEVMNRVTEQYLRAFVHQRPSTWGRHLIWA

SEQ ID NO: 200165 - protein, 104 aa, Glycine max
  Coding DNA Sequence Number=SeqID_83387
MAESRLERRSKYRSGNSKSQTSEFVRDKESTFSSSIISSGLGSGRISVIPYPPLLTFSVIGENPNPTPNPVNTVFIRQSRGRFDLVPTRLDSTAMPTQTHDTVM

SEQ ID NO: 200166 - protein, 294 aa, Glycine max
  Coding DNA Sequence Number=SeqID_83388
  Gene Ontology: Mol. function=hydrolase activity; Biological process =nucleotide metabolic process
  Homolog annotation: Hit_ID=UPI0000E69956; Match level="QueryCoverage =74%, HitCoverage=86%, E-value=5e-77, Identity=64%"; Hit description =conserved hypothetical protein
FVVRDAEQGADGAAQVGLLRLQVGLQREAAAKNKQRHLRLFRQNTAVRAIVVHAVVGGDHHLITGGQPAGHPLRQIAIRHSCPVTVLRRRQAVLVPGIVDVHWVNQQEIGIVLQAQAFGILEQMRVGVTVVPVEMAVLDRQVGRVSVAIARSVERRAVIQFAHPVISGSGGSESGVARVVEDAALIAQAIDAVVNDAAAHRRNAGQNAFVQRTRQRRQFADSPWRAAPPDYSAHRVPPGLFSSPLPQVRMNAHPVKIGDRYRRNVLRIAGKRMRDTSRRYGMCDWQNVCVTASC

SEQ ID NO: 200167 - protein, 145 aa, Glycine max
  Coding DNA Sequence Number=SeqID_83389
TYQGNPCGVYPDLSSLIGSGVIQTSVACIKRSAPTQTYQGNPCGVYPDLSSFTGSGVYPDLSSFIGSGVYPDLSSFTGSGVCPDLSSFTGSGVYPDLSSFIGSGVYPNLSSFTGSGVIQISVTCIKRSAPTQVHIMGLASTRVRP

SEQ ID NO: 200168 - protein, 49 aa, Glycine max
  Coding DNA Sequence Number=SeqID_83390
MGERKREKKERKLLIKDRKNRRNVQKGLWTGQYLNNTELSPNVHPKEGK

SEQ ID NO: 200169 - protein, 166 aa, Glycine max
  Coding DNA Sequence Number=SeqID_83391
  Subcellular localization annotation: CTP_CleavageSite=80; ConfidenceScore=5.05e-01
MCRVSSLVSRKPVLIHYTPLLSSPSISPAAAHGRIPQNPTLPPAAQPPAESLPVVVSDKPCRRVKRRYPPVVLAGLVTPSAAAEGRAAAAAATTPAEKSCLQKVRISVTYSGSLFIHCCVSLSLICEPSAVNWSSHHVLLHYTRFWVHHSAPLSKINYSDAKLNIQ

SEQ ID NO: 200170 - protein, 128 aa, Glycine max
  Coding DNA Sequence Number=SeqID_83392
MAKFVATREENFIEVEAHEESLVKEHDSREKDEEKSEERTQQQLEKCSQVEIQQESILQVNTPAHQLIVKEERHGEHDKSLSVILSLTTSTSLAMIWKMFPGYIGFMESLTKRRKCKEDVFYMTFMPP

SEQ ID NO: 200171 - protein, 183 aa, Glycine max
  Coding DNA Sequence Number=SeqID_83393
  Homolog annotation: Hit_ID=Q1ST47; Match level="QueryCoverage=42%, HitCoverage=24%, E-value=8e-11, Identity=44%"; Hit description =Bromodomain
  Pfam annotation: Domain name=Bromodomain; Domain location=1-74; Score= 14.1; E_value=0.0001; Accession=PF00439.15; Description=Bromodomain
MHGLLQKDVLHPKIFYVLDKSEAMKKPKGLEDIESKLKNSDYSEAYEFVDDVRLVLSYALQYPPRSEVHRTATRITEGFEVNWKTMKEKWMREEEETNKICKRELHVCPNEGSQVFQLVLSYALQYPSRSEAYRTATRITEGFEVNWKTMKEKWMHDEREIKKIFKRELHVCPNDDDGEVHGK

SEQ ID NO: 200172 - protein, 120 aa, Glycine max
  Coding DNA Sequence Number=SeqID_83394
MFATTFNTQPSAYNLAPSSSCYRSSLPTQIRDKSHEDEDEDEDNDNNNDDDNDGEGDDDDDKGGHHVSQQQWTITCEHPRTRGGRGRRPRGQQTQTKPVKQDERPRRISRRTCCGTSSHY

SEQ ID NO: 200173 - protein, 101 aa, Glycine max
  Coding DNA Sequence Number=SeqID_83395
  Homolog annotation: Hit_ID=Q7FMW1; Match level="QueryCoverage=77%, HitCoverage=5%, E-value=4e-18, Identity=49%"; Hit description=MRP -like ABC transporter
MDKRESRIEMCASIMELIMTAFMQMGSNYWISWATKQKGRVNNKQLMGTFALLSFGGTIFILGRIVLMAANAMETAQHLFLGMITSFFRAPVSYFDTTPSS

SEQ ID NO: 200174 - protein, 142 aa, Glycine max
  Coding DNA Sequence Number=SeqID_83396
MRSFTKLIYERILVNLSMIDPGRHMNNLRLDYLQLDPVEEQRLRSQCWVAIAGPKRKGCLYGIRDLAHTYKYGDENFMQHIQGYSSRAQDATEINLLREELHQSKEEMNVFQSVALQFLPPEIRNIIHQYQQPYQQHQDQQQ

SEQ ID NO: 200175 - protein, 64 aa, Glycine max
  Coding DNA Sequence Number=SeqID_83397
MKGAGNNNKNTRNHNHSSMVKMELAQHCSQQERRSNKLITKAQWQKLNVLKLGLAGSQLNNHQL

SEQ ID NO: 200176 - protein, 135 aa, Glycine max
  Coding DNA Sequence Number=SeqID_83398
MMVMITTTIMLVVATVVMVVAVDNHRGDCGVGHDSCGSNDHDSDGVMPNLFHPLSVYSFHKPFSLERSVSGPLSRVHSHSHSQPVSLPLTANLTLGGHSRKQLYPVRCDLSAATSFYKIDVDGTLTIVSPSHATM

SEQ ID NO: 200177 - protein, 100 aa, Glycine max
  Coding DNA Sequence Number=SeqID_83399
  Gene Ontology: Mol. function=zinc ion binding; Cellular component =intracellular
  Homolog annotation: Hit_ID=Q6Z8A4; Match level="QueryCoverage=96%, HitCoverage=46%, E-value=3e-20, Identity=56%"; Hit description =Putative zinc-binding protein
  Pfam annotation: Domain name=PLATZ; Domain location=11-97; Score =45.0; E_value=2.5e-10; Accession=PF04640.4; Description=PLATZ transcription factor
MAGTTIVNHILHHVRKPHQHTQKRMQHIRRSSYHDVVRVVEIQKVLDISGVQTYVINSARVLFLNERPQNQPKTNSVVGKGISWTLFVSVLWDARFVSHH

SEQ ID NO: 200178 - protein, 451 aa, Glycine max
  Coding DNA Sequence Number=SeqID_83400
  Gene Ontology: Mol. function=lyase activity; Cellular component =anchored to membrane; Biological process=pathogenesis
  Homolog annotation: Hit_ID=Q52PJ2; Match level="QueryCoverage=90%, HitCoverage=93%, E-value=0.0, Identity=76%"; Hit description =Ripening-related pectate lyase
  Pfam annotation: Domain name=Pec_lyase_C; Domain location=183-368; Score=330.1; E_value=3.9e-96; Accession=PF00544.9; Description =Pectate lyase
MKVLSPKLFTLSILLAALVLASANAVSGNEMQKHEATESRDVVEEEKLQVQSLKNSSMAERSGSALNEHAVDNPEEIASMVDESIRNYTARRNLNFFSCGSGNPIDDCWRCDKRWYARRKRLANCGIGFGRNAIGGRDGRYYVVSDPGDDDPVNPKPGTLRHAVIQDRPLWIVFKRDMVITLKQELIMNSFKTIDGRGVNVHIAYGACITIQFVTNVIIHGLHIHDCKVTGNAMVRSSPSHYGWRTLADGDGISIFGSSHIWIDHNSLSNCADGLVDAVMGSTAITISNNYFTHHNEVMLLGHSDSYVRDKQMQVTIAYNHFGEGLIQRMPRCRHGYFHVVNNDYTHWVMYAIGGSANPTINSQGNRYLAPLNPFAKEVTKRVDTGSSVWKSWNWRSEGDLLLNGAFFTSSGAGAAASYARASSLGAKSSSLVGTITSGAGVLNCRRGAMC

SEQ ID NO: 200179 - protein, 283 aa, Glycine max
  Coding DNA Sequence Number=SeqID_83401
MSLQFRFEVPDPLHLSESILYAARGAEHHRHTRCAPGDRNCHVELHIVREQGGGGRKRSILGLLSQLESPIQHRQAVAARVPMRFGTGERRRRATIDLKLVLFFKNNNKYSGRPYILISNKIFLLLSRVIFRDHSGGWSTGFCFKSSNLSSLSIPSTSRGGPSELTHINCVALTARFPVGKPVVPTALMNRPTRGERRFAYWALAECILAYYVGTDEGVSEVLHVAGEKRLHRCVSRICDTGYIPLPRSLTRYARSFDCGERKWLTIGAEISWKMPRRYLTGK

SEQ ID NO: 200180 - protein, 111 aa, Glycine max
  Coding DNA Sequence Number=SeqID_83402
MWKVAEEEDRVDADASQAEKRTKKNMDAPLSKVAPVPLCSPPSLVAPKAISAMYHLGEIDDDEDDLVFRKRKVAPPSDEATVPQMNKVKPTPQVPPPSTQTRTDKREKRGA

SEQ ID NO: 200181 - protein, 37 aa, Glycine max
  Coding DNA Sequence Number=SeqID_83403
MASYGVLPKSWVLPEVDVVDLLSEDEVEDLEEDTSYE

SEQ ID NO: 200182 - protein, 128 aa, Glycine max
  Coding DNA Sequence Number=SeqID_83404
MSHTQENCYLLHGFPEKVAQVSKSEKSESGFSNEEYQEYLRLKSEKSSNQASSSSAPCFSTTCVSQSIGSPSPWILDSGAFDHISGNKSSFSSISFPKVPHLVTVANGSKVASQGSGTWDGSTDWRRT

SEQ ID NO: 200183 - protein, 175 aa, Glycine max
  Coding DNA Sequence Number=SeqID_83405
MGEAEEVQERMKADMEAMKEQMATMMEAMMSMKKIMEANAVIVAATSVVAKVNPMLPSGLKQMNHPTSNMVGKHEIPHHDLVDFEPWLGYATEGQAVGGISFENTLEGPQFRPQPHPLHFAVGRAPPAMAEKGMADHLKERLRAIEGGEDYAFANLEKLFLIPKHGHSQVQGAGL

SEQ ID NO: 200184 - protein, 92 aa, Glycine max
  Coding DNA Sequence Number=SeqID_83406
  Subcellular localization annotation: CTP_CleavageSite=56; ConfidenceScore=5.05e-01
VVHVSSTFEFGAEFHDCLSADPQGNPPYSTFVGAPCMSLPSAVHVSPLSSAKLLVTRKHKKKEGMETRVIITERVGRTKSVSYLCFPLISDE

SEQ ID NO: 200185 - protein, 105 aa, Glycine max
  Coding DNA Sequence Number=SeqID_83407
  Pfam annotation: Domain name=zf-CCHC; Domain location=61-78; Score =24.8; E_value=8e-05; Accession=PF00098.13; Description=Zinc knuckle
MSLATLFGKLQGHEMELMRLNQHEENDKKKKGIALKASSSIQEESDKEDLNEIGEDDDFSFFCYECNQPGHLRVDCPSFKKRMEKSDRKTFKDKKAKRSLHHLGR

SEQ ID NO: 200186 - protein, 90 aa, Glycine max
  Coding DNA Sequence Number=SeqID_83408
  Pfam annotation: Domain name=zf-CCHC; Domain location=18-35; Score =31.1; E_value=3.8e-06; Accession=PF00098.13; Description=Zinc knuckle
RRQNFNHGKRFQEDSPTLRCYKCNQLGHIKANCPSNEQWPERNEKKSHEERRSKKAYIAWDDNDSSDGLEKEINLLSKDYESDENISQED

SEQ ID NO: 200187 - protein, 184 aa, Glycine max
  Coding DNA Sequence Number=SeqID_83409
MADQGEWASFIDVLALLVFGVVLFPNVDGLVDLVAIDAFLAYHHNKESLIVVVLVDAYDTFGRRCEKSGARIVYCTPALYLWLVSHIFHHESRPTCFLQGHRMCAEKGKANWEQLLAGMVGASINWFLSQRALRGRARARLTGALSKGGKMRGVATKVYLWKTSEKPKETGQNKNSKFGSCIYA

SEQ ID NO: 200188 - protein, 248 aa, Glycine max
  Coding DNA Sequence Number=SeqID_83410
  Subcellular localization annotation: CTP_CleavageSite=66; ConfidenceScore=5.68e-01
MEQNPPSPAEDSAAAAPSSGEAKPSLFPLFPLTASSSLQTTTTSSTPQWLSNTSFTTDISVINDAVASQLNREITQSPPQDDEDENRAQANPLPSSRYEILESSESDGGGRDRERKKRKKRKKRKCDSSVERGGFHGFGSRKSRVRAWADSEAKVAKDYYIDSHGDRDNLAFGCIYRMVVLTSVLLALLMNLLGSPPRAEAIIIHKYFMMIIRVHMLYIFASPLYPWDTPLESTTRNTFAILLIRVDH

SEQ ID NO: 200189 - protein, 814 aa, Glycine max
  Coding DNA Sequence Number=SeqID_83411
  Gene Ontology: Mol. function=3'-5'-exoribonuclease activity; Cellular component=intracellular; Biological process=RNA processing
  Homolog annotation: Hit_ID=UPI00006112E1; Match level="QueryCoverage =82%, HitCoverage=52%, E-value=1e-51, Identity=27%"; Hit description =UPI00006112E1 related cluster
  Pfam annotation: Domain name=DUF1740; Domain location=100-353; Score =359.5; E_value=5.6e-105; Accession=PF08424.1; Description=Protein of unknown function (DUF1740)
MDIALYRPYNPLKLSGLHVRGLYWWNRSGSLLERDGDIDSLDAKMKSAGRYCSGKYMALERHKSFKRIRLVAPESSPVSMQDEFIPLSETDAGASHGAVDSDLVSKTSTSLEESWEDETLNKTREFNKLTREHPHDEKVWLAFAEFQDKVAGMQRQKGARLQTLEKKISILEKAVDLNPDNEEILLCLLKAYQMRDSSDVLIARWEKILLQHSGSYKLWREFLHTVQRNFSRFKVSEVRKMYAHAIEALSASCSKHSRQVLQATDPSSPDPVFVQLELGLVDIFLSLCRFEWQAGYRELATSLFQAEIEFSLFCPPLLLTEQSKHRLFEHFWNSGGARVGEEGALGWSAWLEKEEETRQKVMNDELSRENEGGGWTGWSEPWSKDNEGIVNVENETINDVVMEDIQDEEEYKEVEPEVDTENLLKMLGIDMNDGDGSEVNDTSTWIKWSKEESFRDCDQWMPVRRKSGTTSLANETHKTDEDEQLLRVVLYEDVNEYLFSLSTTEARLSLLSQFIDFYGGKMSQLFCSNSPTWADNILSLEDLPDSMLEKLKCIHEVLTKTQNSPTGYSFEYLSGSFSRNADFMKFIQNAVLLCLTVFPRNYMLEEAVLISEELYVTKMNSSGMVTPCRSLAKSLLKSDRQDVLLCGVYARREATYGNIDHARKVFDMALLSVEALPVELQSSAPLLYFWYAEVELASTANDRESSSRAIHILSCLGSGTKYNPFKSQASSLLLLRAHQGFKEKLRTVWSSWVRGIINDQSVALICSAALFEELTTGWDVGIEVLNQAFSMVLPGYVSSVIDLLLENMGPLRQV

SEQ ID NO: 200190 - protein, 814 aa, Glycine max
  Coding DNA Sequence Number=SeqID_83412
  Gene Ontology: Mol. function=protein serine/threonine kinase activity; Cellular component=cytoplasm; Biological process=protein amino acid phosphorylation
  Homolog annotation: Hit_ID=Q9FX38; Match level="QueryCoverage=99%, HitCoverage=76%, E-value=0.0, Identity=55%"; Hit description=Protein kinase, putative
  Pfam annotation: Domain name=Pkinase; Domain location=539-805; Score =157.8; E_value=2.8e-44; Accession=PF00069.15; Description=Protein kinase domain
  Pfam annotation: Domain name=Pkinase_Tyr; Domain location=539-805; Score=-125.9; E_value=9.6e-05; Accession=PF07714.7; Description =Protein tyrosine kinase
  Pfam module annotation: Pfam domain module=Pkinase::Pkinase_Tyr; Domain location=539-805::539-805
AENSDVRASVKEQVDEVGRALYLGKLQGSSGSLSFPLAPENQKEEFPRLPPVKIKSEDKPFTFNWGEKFECDGLAVKLAGADNTLLIGSYLDVPIGQEIKNTGVRKAIGGSWLSVSHGITEDTSDLVSGFATIGDGLCESVDYPNEYWDSDEYDDDEDVGYTRQPIEDEAWFLAHEIDYPSDNEKGTGHGSVPDPQERGPAKDEEDDQSFAEEDSYFSGEQYILPKNVEPVTASDDPIGLTITEMYGRTNGNDVMPQYDRQLMDVEELNLMHMEPVRQGFVTHKNDLIMMGDGKVLNHSARSRIEDMEDDQHGSVRSIGVGINSDAADIGSEVHGSLVGGSSEGDLEYFRDHDTTTHSLDKNSINKSFKNNKKNDKTESNKYVIDSDKDACSQIKAHTDGNFSFPQSLRDSQMIHAGSSKTLWSSNCNVEEADDCINAFVGSDDMLTSWKRKSSDSSPVKSSRDENNAIAVRSRNSSPTTVSNYGYTDGELVKLEKDEKVSIVREDDLGASLEDEEAAAVQEQDKNFHVVLNSVLAGRYHVTEYLGSAAFSKAIQAHDLHTGMDVCVKIIKNNKDFFDQSLDEIKLLKYVNKHDPSDKYHLLRLYDYFYYRSITIQCLEALQFLHSLGLIHCDLKPENILVKSYSRCEVKVIDLGSSCFETDHLCSYVQSRSYRAPEVILGLPYDKKIDIWSLGCILAELCTGNVLFQNDSPATLLARVIGIIGPIDQGLLAKGRDTYKYFTKNHMLYERNQESNRLEYLIPKKTSLRHRLPMGDQGFIDFVAHLLEVNSKKRPSASEALKHPWLSYPYEPISS

SEQ ID NO: 200191 - protein, 105 aa, Glycine max
  Coding DNA Sequence Number=SeqID_83413
MGSTNFHQTETKNKKERFLQSGDFSQRKPQLPIANCQLPSRSGIYVPERISRLCRDERKNWGPKKMAKEIEICLEGTLRSLVPSFPAASADELRVVNGDDGGPKL

SEQ ID NO: 200192 - protein, 601 aa, Glycine max
  Coding DNA Sequence Number=SeqID_83414
  Gene Ontology: Mol. function=binding; Cellular component =intracellular; Biological process=metabolic process
  Homolog annotation: Hit_ID=Q67UW7; Match level="QueryCoverage=99%, HitCoverage=100%, E-value=1e-138, Identity=27%"; Hit description =Putative pentatricopeptide (PPR) repeat-containing protein
  Pfam annotation: Domain name=PPR; Domain location=160-194; Score =26.9; E_value=7e-05; Accession=PF01535.11; Description=PPR repeat
  Pfam annotation: Domain name=PPR; Domain location=195-229; Score =45.5; E_value=1.8e-10; Accession=PF01535.11; Description=PPR repeat
  Pfam annotation: Domain name=PPR; Domain location=24-58; Score=45.0; E_value=2.5e-10; Accession=PF01535.11; Description=PPR repeat
  Pfam annotation: Domain name=PPR; Domain location=296-330; Score =43.2; E_value=8.8e-10; Accession=PF01535.11; Description=PPR repeat
  Pfam annotation: Domain name=PPR; Domain location=331-365; Score =19.5; E_value=0.012; Accession=PF01535.11; Description=PPR repeat
  Pfam annotation: Domain name=PPR; Domain location=367-400; Score=7.4; E_value=1; Accession=PF01535.11; Description=PPR repeat
  Pfam annotation: Domain name=PPR; Domain location=433-467; Score=7.0; E_value=1.1; Accession=PF01535.11; Description=PPR repeat
  Pfam annotation: Domain name=PPR; Domain location=59-93; Score=35.1; E_value=2.5e-07; Accession=PF01535.11; Description=PPR repeat
  Pfam module annotation: Pfam domain module=PPR::PPR::PPR::PPR::PPR::PP R::PPR::PPR; Domain location=160-194::195-229::24-58::296-330::331 -365::367-400::433-467::59-93
MYLKCDRIRDARKLFDMMPERDVVVWSAMVAGYSRLGLVDEAKEFFGEMRSGGMAPNLVSWNGMLAGFGNNGLYDVALGMFRMMLVDGFWPDGSTVSCVLPSVGCLEDAVVGAQVHGYVIKQGLGCDKFVVSAMLDMYGKCGCVKEMSRVFDEVEEMEIGSLNAFLTGLSRNGMVDAALEVFNKFKDRKMELNVVTWTSIIASCSQNGKDLEALELFRDMQADGVEPNAVTIPSLIPACGNISALMHGKEIHCFSLRRGIFDDVYVGSALIDMYAKCGRIQLSRCCFDKMSAPNLVSWNAVMSGYAMHGKAKETMEMFHMMLQSGQKPNLVTFTCVLSACAQNGLTEEGWRYYNSMSEEHGFEPKMEHYACMVTLLSRVGKLEEAYSIIKEMPFEPDACVRGALLSSCRVHNNLSLGEITAEKLFLLEPTNPGNYIILSNIYASKGLWDEENRIREVMKSKGLRKNPGYSWIEVGHKIHMLLAGDQSHPQMKDILEKLDKLNMEMKKSGYLPKSNFVWQDVEEHDKEQILCGHSEKLAVVLGLLNTSPGQPLQVIKNLRICDDCHAVIKVISRLEGREIYVRDTNRLHHFKDGVCSCGDFW

SEQ ID NO: 200193 - protein, 164 aa, Glycine max
  Coding DNA Sequence Number=SeqID_83415
  Gene Ontology: Mol. function=DNA-directed DNA polymerase activity; Cellular component=nucleus; Biological process=DNA replication
  Homolog annotation: Hit_ID=Q9C577; Match level="QueryCoverage=99%, HitCoverage=30%, E-value=1e-51, Identity=63%"; Hit description=DNA polymerase epsilon subunit B-like protein
  Pfam annotation: Domain name=DNA_pol_E_B; Domain location=10-164; Score=4.8; E_value=4.2e-06; Accession=PF04042.6; Description=DNA polymerase epsilon subunit B
MEKGTVNDMFVILADIWLDNEEALRKLETVLDDFESVEVVPSLFVFMGNFSSKPCNRSFHSNSSLSITTSSNNIAIKKRYFIIVLKGEMIASHPRLKEHSKLLIIPGPDDAGPSTALPRCALPNYLTEELQKHIPHAIFSSNPFRVKFYTQEIVFFQHDLLNRM

SEQ ID NO: 200194 - protein, 140 aa, Glycine max
  Coding DNA Sequence Number=SeqID_83416
MEGVINKPNTSVTILLAQSFVAELVRVFQSVAFCVDFSAHATVNHLSTTLRFEQSQYGKITLFYHQGKDVLTIERMRMSYIKHFLGDGIQFPVLILQYKASFSGLTPVPQIVSPAKSFCGISNFIRTNQTTKQGILTDSI

SEQ ID NO: 200195 - protein, 177 aa, Glycine max
  Coding DNA Sequence Number=SeqID_83417
  Gene Ontology: Mol. function=metalloendopeptidase activity; Cellular component=membrane; Biological process=proteolysis
MSEEQMYLIVDIKSTSTSPRTSEKIIKTQAFIYRFKNARKHSKTEVKVVHSFAISNLQGRKLALPKQQGKTLKVGNSQQVEKEADYIGLMLMASAGYDPRVAVEMWEEHGKLLEEEDRISVILWEKKLDRISDILWEKLDKMFGWNYFSTHPSEIERAQLLAQPKIMEEILTIYIEM

SEQ ID NO: 200196 - protein, 604 aa, Glycine max
  Coding DNA Sequence Number=SeqID_83418
  Gene Ontology: Mol. function=GTP binding; Cellular component =intracellular; Biological process=RNA-dependent DNA replication
  Homolog annotation: Hit_ID=Q6Z7U2; Match level="QueryCoverage=80%, HitCoverage=89%, E-value=1e-164, Identity=56%"; Hit description =Pentatricopeptide (PPR) repeat-containing protein-like
  Pfam annotation: Domain name=PPR; Domain location=271-304; Score =21.5; E_value=0.0031; Accession=PF01535.11; Description=PPR repeat
  Pfam annotation: Domain name=PPR; Domain location=305-339; Score =37.2; E_value=5.5e-08; Accession=PF01535.11; Description=PPR repeat
  Pfam annotation: Domain name=PPR; Domain location=340-374; Score =36.4; E_value=9.9e-08; Accession=PF01535.11; Description=PPR repeat
  Pfam annotation: Domain name=PPR; Domain location=378-412; Score =30.7; E_value=5.2e-06; Accession=PF01535.11; Description=PPR repeat
  Pfam annotation: Domain name=PPR; Domain location=413-447; Score =30.2; E_value=7.5e-06; Accession=PF01535.11; Description=PPR repeat
  Pfam annotation: Domain name=PPR; Domain location=448-482; Score =38.1; E_value=2.9e-08; Accession=PF01535.11; Description=PPR repeat
  Pfam annotation: Domain name=PPR; Domain location=483-517; Score =30.1; E_value=7.5e-06; Accession=PF01535.11; Description=PPR repeat
  Pfam annotation: Domain name=PPR; Domain location=518-552; Score =20.9; E_value=0.0047; Accession=PF01535.11; Description=PPR repeat
  Pfam module annotation: Pfam domain module=PPR::PPR::PPR::PPR::PPR::PP R::PPR::PPR; Domain location=271-304::305-339::340-374::378-412::413 -447::448-482::483-517::518-552
MVFLRPLFFVETKQQHPPQYIINSLKNPSFSSLTHHHCQVFRNKVLQQIETTLQHTRFSPFHHLAHCQRPSLSDNKSSCVHLIQYSLPLNYYYIACHVSNRHYCSETVSMNKDLSCSESGVVEGNGFESDVDKVYSIVMDNLAGFNNMENALGQLGIPLSTPLVTGGLHRLRYDEKIALRFFTWAGHQEDYSHEPCAYNDMMDILSSTRYKVKQFRIVCDVLEYMKRNNRTMVPAEVLLVILRKYTEKYLTHMQKFAKKKRIRVKTQLEINAFNLLLDALCKCCLVEDAESLYKKMRKTVKPNAETYNILVFGWCRVRNPTRGMKLLEEMIELGHRPDNFTYNTAIDTYCKTGMITEAVDLFEFMRTKGSTISSPTAKTYAIIIVALAQHDRMEDCFKLIGHMISSGCLPDVTTYKEIIEGMCMCGKIDEAYKFLEEMGNKSYRPDIVTYNCFLKVLCDNKKSEDALKLYGRMIELNCIPSVQTYNMLISMFFEMDDPDGAFETWQEIDNRGCRPDTDTYCVMIEGLFNCNKMEDACFLLEEVINEGVKLPYKKFDSFLMQLSVIGDLQAIHRLSEHMKKFYNHGMARRFALSQKRKSLSLRGK

SEQ ID NO: 200197 - protein, 191 aa, Glycine max
  Coding DNA Sequence Number=SeqID_83419
  Gene Ontology: Mol. function=ion channel activity; Cellular component= integral to membrane; Biological process=response to nematode
  Homolog annotation: Hit_ID=Q9LD37; Match level="QueryCoverage=85%, HitCoverage=21%, E-value=9e-24, Identity=38%"; Hit description =Probable cyclic nucleotide-gated ion channel 20, chloroplast precursor
MANFEKDEVPIFSDIHPKLSNELVDSKFPRRVPRTRSVSISIPATLTEPYERDTNLVGYTGPLRSQRKTPFDQMSGPLYVTNKPGNLFRQNRVAPEYQTAESKTENFPSCCGMGENDLQNNYAGKNEHLIRSGPLGMCNDPYCTTCPTYFKATQQMTSKASGIFNPKYQAIKCNEMWNTGVGPKIGLHVIV

SEQ ID NO: 200198 - protein, 71 aa, Glycine max
  Coding DNA Sequence Number=SeqID_83420
MMDSISKHLKVKHGIKGEETLTDIGKDCKGAMSENREKVNNMVTESESLRQLSRQFPEYCLNKAESKQLEP

SEQ ID NO: 200199 - protein, 90 aa, Glycine max
  Coding DNA Sequence Number=SeqID_83421
  Homolog annotation: Hit_ID=Q9LDR2; Match level="QueryCoverage=95%, HitCoverage=9%, E-value=2e-17, Identity=52%"; Hit description =Putative cyclic nucleotide-gated ion channel 19
MTKMLVVLRSMNDFIHFLNIVLQVLEFEDQYKPPEREKKREFFWLAYVAPESRVVGAGELVDHPKKIALHYLRTSFVIDLFVVLPLPQHA

SEQ ID NO: 200200 - protein, 125 aa, Glycine max
  Coding DNA Sequence Number=SeqID_83422
  Homolog annotation: Hit_ID=Q9LD37; Match level="QueryCoverage=44%, HitCoverage=6%, E-value=2e-08, Identity=51%"; Hit description =Probable cyclic nucleotide-gated ion channel 20, chloroplast precursor
MTSEFLALKDRSVHVVMPHSLPQFSPLGELYVTKVLVKTPHKYTGNIMSLKVINTVTIGKKNKVNSFIIDPIWKTIFSKTRTCFRIAPPIMQGWVILIFFSLTMPTINEFCAFIMFFDYFLADIS

SEQ ID NO: 200201 - protein, 161 aa, Glycine max
  Coding DNA Sequence Number=SeqID_83423
  Gene Ontology: Mol. function=ion channel activity; Cellular component= integral to membrane; Biological process=response to nematode
  Homolog annotation: Hit_ID=Q9LD37; Match level="QueryCoverage=99%, HitCoverage=21%, E-value=1e-57, Identity=68%"; Hit description =Probable cyclic nucleotide-gated ion channel 20, chloroplast precursor
  Pfam annotation: Domain name=cNMP_binding; Domain location=45-149; Score=11.1; E_value=0.028; Accession=PF00027.19; Description=Cyclic nucleotide-binding domain
MLLENLPEDLQRDIRRHLFTFIKKVRIFALLDEPILDAICERLRQKTYIKGSKIFYDGGLVEKMVFIVRGKLESVGEDGISAPLYEGSVCGEELLTWCLEHPLASKGCGKARIPRQKLVSNRTVGCLTNVEAFSLRAADLEEVTSLFARFFRSPRVQGAIR

SEQ ID NO: 200202 - protein, 449 aa, Glycine max
  Coding DNA Sequence Number=SeqID_83424
  Gene Ontology: Mol. function=ion channel activity; Cellular component= integral to membrane; Biological process=response to nematode
  Homolog annotation: Hit_ID=Q9LD37; Match level="QueryCoverage=96%, HitCoverage=50%, E-value=1e-108, Identity=49%"; Hit description =Probable cyclic nucleotide-gated ion channel 20, chloroplast precursor
MQNYQGSMANFENDKLLMLSDTDAQPYDEPLDAKFRRTVTRTQSASISISMSSLESYDKETSLVGHTGPLQSKRKTPFMQMSGPLYATTGTGNPLQKHIVSGNKAEERKTDNFATLRDTGSNYWNNDYDRKNEHLLRSGQLGMCNDPYCTTCPTYFNASQQRNPKPSTRWDPKAIGSRPVIKHVFVRKKRMGPGTSKNQTNFHNALYGDAKSFVRKLLSFCYSYVPGVMNPHAKVVQKWNKFLAIFCLIAIFVDPLFFFLLYVEKDNKCIVINWPLTTALVLFRCVTDFVYFLNILLQSSSVIDSMFLLICVLSFVKFRLAYVSRESRVVGAGDLVDHPKRIALHYLKGYFLIDLFVVFPLPQIMILFVLPNSLEGANYAKNLLRAAILVQYIPKLFRFLPLLIGQSPTGFIFESAWANFIINLLIFMLASHVVGSCWYLFGLQVGDII

SEQ ID NO: 200203 - protein, 201 aa, Glycine max
  Coding DNA Sequence Number=SeqID_83425
  Gene Ontology: Mol. function=ion channel activity; Cellular component= integral to membrane; Biological process=ion transport
  Homolog annotation: Hit_ID=Q6ZHE3; Match level="QueryCoverage=85%, HitCoverage=22%, E-value=3e-61, Identity=65%"; Hit description =Putative cyclic nucleotide-binding transporter 1
  Pfam annotation: Domain name=cNMP_binding; Domain location=46-150; Score=22.5; E_value=0.0015; Accession=PF00027.19; Description=Cyclic nucleotide-binding domain
MTKLYAYSSWNQTATCQKPKHINNPVRIFSLMDEPILDAICERLKQKTYIKGSKVLSQGGLVEKMVFVVRGKLESFGDDGTIVPLSEGDACGEELLTWYLEHSSVSTDGKKLRVQGQRFLSNRTIRCLTNVEAFSLHAADLEELTILFTRFLRNPHVLGALRNVSPYWRSLAANRIQVAWRYRKKRLSRANTSQSNQTLMS

SEQ ID NO: 200204 - protein, 122 aa, Glycine max
  Coding DNA Sequence Number=SeqID_83426
  Gene Ontology: Mol. function=DNA binding; Biological process=DNA integration
  Homolog annotation: Hit_ID=Q1S1B7; Match level="QueryCoverage=54%, HitCoverage=10%, E-value=2e-12, Identity=52%"; Hit description =Integrase, catalytic region
MEQPPELTTTGSRLVCQLRHSHSLHDLLGKVYMEQPPKYFLRIEVCESHGKTQGIVGYAYMRTKITCYSDANWTRSPSEKRFTSEYCVLVGENQISWRSNKQDLVVRSIAKVEYRAMANNCV

SEQ ID NO: 200205 - protein, 170 aa, Glycine max
  Coding DNA Sequence Number=SeqID_83427
  Gene Ontology: Mol. function=ion channel activity; Cellular component= integral to membrane; Biological process=ion transport
  Homolog annotation: Hit_ID=Q6ZHE3; Match level="QueryCoverage=99%, HitCoverage=22%, E-value=8e-59, Identity=66%"; Hit description =Putative cyclic nucleotide-binding transporter 1
  Pfam annotation: Domain name=cNMP_binding; Domain location=15-119; Score=35.1; E_value=2.4e-07; Accession=PF00027.19; Description =Cyclic nucleotide-binding domain
MDEPFLDSICERLRQKTYIKGSIILSQGSLVEKMIFIVRGKLESIGENGIGVSLSEGDACGEELLTWYLEHSSVSKDGKRVRLPGQRWLSNRTVKCLTNVEAFSIRAEDLEEVTTRFMRFLRNLRVQGSLRYESPYWRSLAAVRIQVAWRYRKKRKNCVDTSKLDQSFNS

SEQ ID NO: 200206 - protein, 168 aa, Glycine max
  Coding DNA Sequence Number=SeqID_83428
MQSEVEIGGRERGIYRGKGGGEGATCHLDAWRSWGRVRGRRLRWLERVREWTVGWGLRVKIPESAVPKDLPMVDEKVTRDGCDCSRVVTGLSVGRKVLVRLGLDTCCAIAECKHLRHSRNLFLHIRKNPLPHMIFLFSGYQIYRHKLTGRVDDKEEANKDGEESDCES

SEQ ID NO: 200207 - protein, 608 aa, Glycine max
  Coding DNA Sequence Number=SeqID_83429
  Gene Ontology: Mol. function=ion channel activity; Cellular component= integral to membrane; Biological process=response to nematode
  Homolog annotation: Hit_ID=Q9LD37; Match level="QueryCoverage=95%, HitCoverage=75%, E-value=0.0, Identity=55%"; Hit description =Probable cyclic nucleotide-gated ion channel 20, chloroplast precursor
  Pfam annotation: Domain name=Ion_trans; Domain location=255-528; Score=48.5; E_value=2.3e-11; Accession=PF00520.21; Description=Ion transport protein
MNQQGKVANFEKHGEPAPSETHAQHDELENSRFGKVISRTKSASISIPMVSMEPYERETSLVGHTGPLPSVRKSPIMHVNGSLSATNGTENLLHQSIFVKGNKVVESKTEKISTLDRKDENHWNNNYDRKNEHLLRSGLLGMCNDPYCTTCPTYFRASLQRFSKASTVFDPQFHFHNALYGDAKGLGRKIMSFFSSYVPGVINPHSKVVQQWNKFLAIFCMVAIFVDPLFFFLIYVQKGGKCISIDWDMTKVLVVVRTMNDVIYFLNILLQFRLAYVSPESTVVGAGDLVDHPKKIALHYLKGYFLFDLFVVFPLPQIMIFLVLPKHLGTSGANYAKNLLRAVILVQYIPKLFRILPLLIGQSPTGFIFESAWANFIINLLIYMLASHVVGSCWYLFGLQRVNQCLRDACGNSDIDRCMTVIDCGRHGHTRNNYSDQTSSLWSNNSDAIACLNPSSSGFRYGIYVNGVPLTIETSVANKYIYSLFWGFQQISTLAGSLTPSYFWGEVLFTMAIIGLGLLLFAVLVGNIHNFLQGLGRRRLEMQLRGRDVEQWMSHRRLPEDIRRKVRQAERYNWAATKGVNEEMLMENLPGDLQREIRRHLFKFVKKV

SEQ ID NO: 200208 - protein, 205 aa, Glycine max
  Coding DNA Sequence Number=SeqID_83430
MTTRREKRWKLKEKKREVTETERGLTVKFMQILFSNEWNGKRSGGGKKDQGEVEDPSRLERQLDNIFVEKIKLDINLPRFEKSDPGSAKNTKFEKYGRGDIGRKTTGHQGREETQSKGQDVGKGKEVVYQNAGQKTGRHNNARSYARLVSTRVIPVGQTWRPKNGNKGRGETVLGRETVTPMQYGMAKQEYGGEDEKPRRRIQSE

SEQ ID NO: 200209 - protein, 62 aa, Glycine max
  Coding DNA Sequence Number=SeqID_83431
  Subcellular localization annotation: CTP_CleavageSite=46; ConfidenceScore=5.10e-01
MAMQDFESVQHNPQAVWVWTTGFMGLPANPQLLTKTGPSTTNVNLREASRPAYPLLILTVDG

SEQ ID NO: 200210 - protein, 186 aa, Glycine max
  Coding DNA Sequence Number=SeqID_83432
  Gene Ontology: Mol. function=RNA-directed DNA polymerase activity; Cellular component=nucleus; Biological process=RNA-dependent DNA replication
  Homolog annotation: Hit_ID=Q1SFJ7; Match level="QueryCoverage=97%, HitCoverage=20%, E-value=4e-41, Identity=45%"; Hit description=RNA -directed DNA polymerase
MEYFQTRFQEIGEERPILDGVHFERLNEEDNIFLCQPFKDEEIEEAIWDYGSDKSPGSNDMNFHFIKKCCGTMKNEFVDMMKDFWANGVISRGANASFIVLLPKKDYLLGLEEYRPISLIGCLYKVISKVLAKRLGKVLGKIIDMRQSAFVGGRFMLDGVLLSNEVIDEDKRCKKDCLIFKVNFHY

SEQ ID NO: 200211 - protein, 92 aa, Glycine max
  Coding DNA Sequence Number=SeqID_83433
MASLEYARVMISTSSYDNICSTEWVKIHGNPYSFRVVEELKESGNLKMIWWSRYCHHRFKSGERKHHNGSQSKGGIFWGDFWKKGEVQESFL

SEQ ID NO: 200212 - protein, 58 aa, Glycine max
  Coding DNA Sequence Number=SeqID_83434
MLSGERRTRTNNQQNQQPPNQNHNQIEVAVASEDNRKSEVVTEIVDLKDKVSKSKRGV

SEQ ID NO: 200213 - protein, 74 aa, Glycine max
  Coding DNA Sequence Number=SeqID_83435
MLMHGWLWKGWYILSSGRFLADPNGQNLGGIDGDPVLRGMRIWATWEYVSSVEGGQLGMVDLRGICGCGESTCT

SEQ ID NO: 200214 - protein, 68 aa, Glycine max
  Coding DNA Sequence Number=SeqID_83436
  Homolog annotation: Hit_ID=Q0K9C3; Match level="QueryCoverage=99%, HitCoverage=28%, E-value=2e-11, Identity=50%"; Hit description=AroM protein
  Subcellular localization annotation: CTP_CleavageSite=44; ConfidenceScore=5.08e-01
GRRPPGRRFGAALPQGWPGGAAASPGRRLPYGRAAGMRDHGGARLALRGRRGTRGGQFQAGRPGPGRL

SEQ ID NO: 200215 - protein, 229 aa, Glycine max
  Coding DNA Sequence Number=SeqID_83437
  Gene Ontology: Mol. function=receptor activity; Cellular component =outer membrane-bounded periplasmic space; Biological process =glycolysis
  Homolog annotation: Hit_ID=Q0K9C2; Match level="QueryCoverage=68%, HitCoverage=52%, E-value=2e-54, Identity=63%"; Hit description =Probable extra-cytoplasmic solute receptor precursor
MAAQQVGDDRRRAAIGRVRHLHAQLVQHGFGDQVIGDAHAGGAVVGRHVLVDDDHVGLHRRQRDGREVGRLVAGALGVEHVGDGHGTGRSDADGVAVRLRLRQAEGHDVAAGARQVFHHHGLAQALRQRLGQQARQRVGRTAGRKAHQQAHRLGRFPGVGGQGRRGRQGAGGEQCARGALQSTAEHEVDSLIPIFARAPARPGGWTTAPGDPMPVPPPAACARRNPCNA

SEQ ID NO: 200216 - protein, 115 aa, Glycine max
  Coding DNA Sequence Number=SeqID_83438
MLLRGVYADLPRAPASWLVEIWVHGRLRRDKMVDEPRSRPITCEPVSSGPIDDPLRARTLPTRPQSGEASSVADRVQVPWKGAPERVRAPSCPDPVALRGAVGESGCLGMQPQSG

SEQ ID NO: 200217 - protein, 332 aa, Glycine max
  Coding DNA Sequence Number=SeqID_83439
  Gene Ontology: Mol. function=protein binding; Cellular component =chromatin; Biological process=defense response
  Homolog annotation: Hit_ID=Q6V406; Match level="QueryCoverage=93%, HitCoverage=92%, E-value=7e-97, Identity=60%"; Hit description =Polygalacturonase inhibiting protein
  Pfam annotation: Domain name=LRRNT_2; Domain location=23-62; Score =34.8; E_value=2.9e-07; Accession=PF08263.3; Description=Leucine rich repeat N-terminal domain
  Pfam annotation: Domain name=LRR_1; Domain location=120-142; Score =10.7; E_value=2.9; Accession=PF00560.23; Description=Leucine Rich Repeat
  Pfam annotation: Domain name=LRR_1; Domain location=144-166; Score =15.2; E_value=0.24; Accession=PF00560.23; Description=Leucine Rich Repeat
  Pfam annotation: Domain name=LRR_1; Domain location=168-190; Score =12.3; E_value=1.4; Accession=PF00560.23; Description=Leucine Rich Repeat
  Pfam annotation: Domain name=LRR_1; Domain location=216-237; Score =1.2; E_value=1.7e+02; Accession=PF00560.23; Description=Leucine Rich Repeat
  Pfam annotation: Domain name=LRR_1; Domain location=240-263; Score =5.6; E_value=26; Accession=PF00560.23; Description=Leucine Rich Repeat
  Pfam annotation: Domain name=LRR_1; Domain location=264-286; Score =12.0; E_value=1.6; Accession=PF00560.23; Description=Leucine Rich Repeat
  Pfam annotation: Domain name=LRR_1; Domain location=288-310; Score =5.9; E_value=23; Accession=PF00560.23; Description=Leucine Rich Repeat
  Pfam module annotation: Pfam domain module=LRRNT_2::LRR_1::LRR_1::LRR_ 1::LRR_1::LRR_1::LRR_1::LRR_1; Domain location=23-62::120-142::144 -166::168-190::216-237::240-263::264-286::288-310
MAVSSTKQTPSVISFETDPIPCHPQDKKALLQLKKDLGNPYIITSWNAKEDCCDWYCCVECDEKTNRVISIGISSSIPDANASGQIPPSVGDLPYLESITFHKLPNLVGPIQPTIAKLTKLKSLFITYTNISGPIPAFLGQLKNLELIKLSFNNLSGPIPSTLSQLPNLGSLQLDRNKLTGPIPSSFGAFKKPGPDLILSHNQLSGPIPASLGNLNPDRVDLSRNKLEGDASMLFSSKKTTQILDLSRNKFEFDLSHLTFPKQSLIWLDLNHNNIYGNIPVALTTVKYLQQFNVSYNPRLSGKIPQGGELQRFDKYAYFHTKLCGSPLPPCK

SEQ ID NO: 200218 - protein, 99 aa, Glycine max
  Coding DNA Sequence Number=SeqID_83440
MAQPAIASGGKGGEKGVLSLAVAIWPRRMERGGCRQWERPLLGQIFASEGCSNSRSRHVESKLPTTLNTQKFNIEESISVEEEEKVSFEESILKFAASI

SEQ ID NO: 200219 - protein, 98 aa, Glycine max
  Coding DNA Sequence Number=SeqID_83441
MPLRTLFLLPHQALIPEVSGVGSNGQIGSKNAISRSHRRPAYKTQVFINKETEAAAEPHRIGEGRREKNEKQKFIESRKKRLQKSCFRAPLFRNLKND

SEQ ID NO: 200220 - protein, 151 aa, Glycine max
  Coding DNA Sequence Number=SeqID_83442
MSIGKLTSKQDHSHVDVARIIDQTCSEDGDLDLNASPQALDKLLGHVFSFKVRIQSNFKNAVVLRYSKDLDLINAVLEMLPDSEACSKIDPSNVDCNDATHAESNHDPVAGLPLTPKKRMSSDETDDELRSSQISPAQLSSNKLTRHSHKS

SEQ ID NO: 200221 - protein, 104 aa, Glycine max
  Coding DNA Sequence Number=SeqID_83443
  Gene Ontology: Mol. function=transition metal ion binding; Cellular component=cytoplasm; Biological process=fucose metabolic process
MICDLGQESFQQAHALMYKGFQSDSKKPLYTRCKNSLSLLLAVLSLVNVKARYGWSEKSFSSLLQVVHNLLLEENMLPKSWYQAKKILCPMGMEYQNIHACPND

SEQ ID NO: 200222 - protein, 261 aa, Glycine max
  Coding DNA Sequence Number=SeqID_83444
  Gene Ontology: Mol. function=chitin binding; Cellular component =extracellular region; Biological process=chitin metabolic process
  Homolog annotation: Hit_ID=UPI000044A8F0; Match level="QueryCoverage =87%, HitCoverage=100%, E-value=1e-27, Identity=26%"; Hit description= PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
MHALSFIGLHSLTFRGLHILAFRGLHALAFIGLHALTFRGLHVLAFRGLRTLAFRGLHVLAFRGLHVLAFRGLHALAIRGLHVLTFRELHVLTFTGLHVLAFRRLHVFTFRGLHALAFRGLHALAFRGVHVLTFRGLHVITFRGLHVLAFRGLHVLAFRGLDASPSEDYMSSPLEGCMPSPSMGDTSSTSEDCMPSPFKGFLGSPLDPGGGPTVRAQPEEEAITQLLCILGQDFTRAVAKRDRAHKTPSEPEEVQQGPWGF

SEQ ID NO: 200223 - protein, 47 aa, Glycine max
  Coding DNA Sequence Number=SeqID_83445
MKEEVRKEVLKLLEVGLIYPISDIAWILERLAGHAYYCFLDGYSRYN

SEQ ID NO: 200224 - protein, 361 aa, Glycine max
  Coding DNA Sequence Number=SeqID_83446
  Gene Ontology: Mol. function=glutamate-5-semialdehyde dehydrogenase activity; Cellular component=cytosol; Biological process=proline biosynthetic process
  Homolog annotation: Hit_ID=Q3VJ24; Match level="QueryCoverage=88%, HitCoverage=76%, E-value=1e-101, Identity=56%"; Hit description =Gamma-glutamyl phosphate reductase GPR
  Pfam annotation: Domain name=Aldedh; Domain location=21-353; Score= -322.5; E_value=0.075; Accession=PF00171.12; Description=Aldehyde dehydrogenase family
  Pfam annotation: Domain name=LuxC; Domain location=3-350; Score= -153.7; E_value=0.028; Accession=PF05893.4; Description=Acyl-CoA reductase (LuxC)
  Pfam module annotation: Pfam domain module=Aldedh::LuxC; Domain location=21-353::3-350
MSDEDPKKDRLLLNGDRLRGLSDSVKQIAQLADPADQLLLKKVLPNGLEIEKITVPLGVVGVIYESRPNVTIDVAALCIQSGNVCLLRGGSDAQYTNAALLKVIYGILDEHGITRDIVQLLPVDRKHVSELLEATSYVDIIIPRGSQSLIDFVRENAKVPVIETGAGVCHTYVDRTADLDMAAKIVANAKISRPSVCNSLDTVLVDKDVAPEFLVRLAPYLEEAQVEVFADPVAYELLKGENFSNLKAAEEADFGREFLDLKCSIKTVDGLDEALEHIGKYSSKHSECIVSSNEFYIEQFLNTVDAAAVYANASTRFTDGGEFGLGAEIGISTQKLHARGPFALEKLVTEKWIVRGSGQIR

SEQ ID NO: 200225 - protein, 199 aa, Glycine max
  Coding DNA Sequence Number=SeqID_83447
  Homolog annotation: Hit_ID=Q2HRX8; Match level="QueryCoverage=56%, HitCoverage=16%, E-value=8e-17, Identity=41%"; Hit description=IMP dehydrogenase/GMP reductase
  Pfam annotation: Domain name=DUF1723; Domain location=98-147; Score =37.8; E_value=3.8e-08; Accession=PF08330.1; Description=Protein of unknown function (DUF1723)
MVDAAAQDTGAETDAQDTDAETDGDEPMGFPGGPRDPSVLTEYADHVAGSVWSGQERPELKLCSHGRKVHNLGRPIPAIEDMVARTGLSPLIACSIDIGDRGFISSFVERWHRETSSFHLPEGEVSITLDDVVSLLHWPIIGTFHDFQPLRTDEAVVLLVELLMVSAEVSMAETSQCGGPYVRLQWLRDIYQHRCQTQH

SEQ ID NO: 200226 - protein, 94 aa, Glycine max
  Coding DNA Sequence Number=SeqID_83448
MSVKMRTTCTWTERPYEASLFPGIGFGLFLRSLGGGQRRPPSGGARAIRPTGRGTVSGRQFLWGVGLPKGNGGVQRFPRARRRLAPRVQRQKGA

SEQ ID NO: 200227 - protein, 203 aa, Glycine max
  Coding DNA Sequence Number=SeqID_83449
  Homolog annotation: Hit_ID=Q3BAI1; Match level="QueryCoverage=18%, HitCoverage=30%, E-value=6e-13, Identity=85%"; Hit description =Hypothetical protein rps12
  Subcellular localization annotation: CTP_CleavageSite=60; ConfidenceScore=5.14e-01
DLPYSIVTAVEFNHQVRDGLMLSAVIRSALGYPAFTVGTITGTPEVRPSRSSRTRERSSQCSKRPHRIWTELSHDVLKPSSRTALMGEQPNPWEHTTAPGGEEPDIEVPNLPVDVSSWGRSAFKLPSAFALEGPISVWPEETFARLRYLLGGLRPIETVYLRLSLGPGISLMALAPPEGGLLCPPPKLRRKSPKPIPGNSEAS

SEQ ID NO: 200228 - protein, 212 aa, Glycine max
  Coding DNA Sequence Number=SeqID_83450
  Gene Ontology: Mol. function=transporter activity; Cellular component= integral to membrane; Biological process=transport
  Homolog annotation: Hit_ID=Q8P8A5; Match level="QueryCoverage=83%, HitCoverage=62%, E-value=8e-59, Identity=64%"; Hit description =Putrescine transport protein; permease
MAVAMILLLLRQGPGAGRAAARLRLPVPADPAVDVLFVQQLAAGDGLGRVLHPRLQRPVRRPRADGGDVDQPGGGVLDRLHGHRAGHAGGDGDDPLQALPRQAAVWRAGHRTAGDAGCDPRLLADGAAGFDGCDSRVPGAWLDHHLDRARHLHTVLRHRGGVLAPAGNGPVAGRSGDGSGRKPIDRVRTHHPADHRAGAGGGLAAGLHPVAG

SEQ ID NO: 200229 - protein, 163 aa, Glycine max
  Coding DNA Sequence Number=SeqID_83451
  Gene Ontology: Mol. function=chitin binding; Cellular component =extracellular region; Biological process=chitin metabolic process
  Homolog annotation: Hit_ID=UPI0000612705; Match level="QueryCoverage =99%, HitCoverage=91%, E-value=1e-14, Identity=28%"; Hit description =UPI0000612705 related cluster
FRGLRVHAIRGLHALTFKGLHVLAFRGLLVLAFRGLHVLAMRGLHALAIRGLHVPTFRGLHILAIRGLHALTFRGLHVLAIIRLHALAIGGLYAHAFRGQLALAFRGLHALAFRGLHRATRPHLQRTTLPYHEDYTSSPSEDYTSSPSEDYTSSPLEDYMSSP

SEQ ID NO: 200230 - protein, 68 aa, Glycine max
  Coding DNA Sequence Number=SeqID_83452
MERDEKRFEYRFCCSSEENIVEEDKEGGIGVVDALILIGEIKRKLKKKKIASYGSRFDEEMSKIGRFE

SEQ ID NO: 200231 - protein, 160 aa, Glycine max
  Coding DNA Sequence Number=SeqID_83453
  Subcellular localization annotation: CTP_CleavageSite=39; ConfidenceScore=5.76e-01
MAESSKKRKGSSTSASASRAHRSGATNASTTPIPPSLSSSTMFSSEEQQKRYSNLFSSRSIIDPKFIDMEFFSAESFDCIQAFQNLGLIPFMSFILNWLKLFIVFGIKMVIDQSLFHDLTQLSSDGVPFEGTLNDDWKFDFSAHDARQLVCTNHADMTGP

SEQ ID NO: 200232 - protein, 135 aa, Glycine max
  Coding DNA Sequence Number=SeqID_83454
  Homolog annotation: Hit_ID=Q1T283; Match level="QueryCoverage=85%, HitCoverage=55%, E-value=2e-09, Identity=31%"; Hit description =Nucleic acid-binding, OB-fold
MAPFTCACDKYNKEVVLRYRLEVMINQGNESTKFLLWDRECSELIGQSADAFNKLKIEDGDVDLNALPQALDKLLGYELAFKIKVQPKFRNFAVLKCSADSSLINVVMDMLADAETSSKMNIPVSDSNHSAQHES

SEQ ID NO: 200233 - protein, 122 aa, Glycine max
  Coding DNA Sequence Number=SeqID_83455
MLAIITKYQEELSLATAHEHRVADEYAQVYAEKEARGRVIDSLHQEATIWMDRFALTLNGSQELSRLLAKAKAVANTYSAPEEIHELLSYCQHRIDLMAHMIRNRQEVCIVAQILTSYKLSE

SEQ ID NO: 200234 - protein, 115 aa, Glycine max
  Coding DNA Sequence Number=SeqID_83456
  Gene Ontology: Mol. function=ribonuclease H activity; Biological process=DNA integration
MADALATLASMFQLTPHGDMLYIEFQCPSKPAHAKEAEWMLIEVHEGSFGTHANGHALVKKILRAGYYWLTIESDYCIYVRKCHKCQTFTDNVNAPPMPLNVLAAPWPFSMWGID

SEQ ID NO: 200235 - protein, 139 aa, Glycine max
  Coding DNA Sequence Number=SeqID_83457
MWLRMPPDSWVKVAKGGVVDKSRAFAPTYPQFVMRNSDLRSSCKLILFLNDHLEETLGPTKIGENHSKCINLTQVKVYDKLGFWLKACRTAGHDICQGLASGSGIKGTFHIISEILILGTDVVQDVTTLAFQDMQIYMT

SEQ ID NO: 200236 - protein, 412 aa, Glycine max
  Coding DNA Sequence Number=SeqID_83458
  Gene Ontology: Mol. function=RNA-directed DNA polymerase activity; Biological process=RNA-dependent DNA replication
  Homolog annotation: Hit_ID=Q8H6Q8; Match level="QueryCoverage=84%, HitCoverage=51%, E-value=2e-52, Identity=38%"; Hit description=CTV.20
  Pfam annotation: Domain name=DUF755; Domain location=129-228; Score= -37.7; E_value=0.034; Accession=PF05501.2; Description=Domain of unknown function (DUF755)
  Pfam annotation: Domain name=zf-CCHC; Domain location=238-255; Score =30.4; E_value=6.5e-06; Accession=PF00098.13; Description=Zinc knuckle
  Pfam module annotation: Pfam domain module=DUF755::zf-CCHC; Domain location=129-228::238-255
FSGQLKGWWDNYLTNEEKSKIYSAVKTDLNGKVITNDDDKEIPDAVNTLIFTIAQHFIGDPSLWKDRSAELLSNLKCRTLADFRWYRDTFLTRVYTREDSQQPFWKEKFLAGLPRSLGDKVRDKIRSQSANGDIPYENLSYGQLISYVQKVALKICQDDKIQRQLAKEKAQTKRDLGSFCEQFGLPACPKQKKKQTSRKEAQDHKPANRRRFSKRRYSQKPSTSREMENPKQKIKLKITCYNCGKQGHISKYCRLKKKLRNLNLEPSIEEQINNLLIETSKEETETETSSSVLSDENLNLIQQDDQLSSTNDDGQINTLTREQDLLFEAINSIPDPQEKKVFLEKLKKTLEVKPRQKDFITNNKFDVSNILKRLENSSTKPTTIQDLQTEINNLKREKQWPYLTQGLIQTAS

SEQ ID NO: 200237 - protein, 115 aa, Glycine max
  Coding DNA Sequence Number=SeqID_83459
MVGYTPSSFENLVSISERIKVGLKRVKGDHPALTNKKPGAKRENEKEEGTHVVTVVPTWPNFPPAQQCHYSANINPSHYPAPNYPQRPSLNQPQSLPLTQAKTPTKEGIFQQKSL

SEQ ID NO: 200238 - protein, 82 aa, Glycine max
  Coding DNA Sequence Number=SeqID_83460
MHTRQRISATSTLSALPRISKTVRDWRLAHPAAKPNYESSIPEWIWGLAQDNTLSAAINFSKEEVALSASSPPSPLLKVYFQ

SEQ ID NO: 200239 - protein, 284 aa, Glycine max
  Coding DNA Sequence Number=SeqID_83461
  Gene Ontology: Mol. function=catalytic activity; Biological process =cellular metabolic process
  Homolog annotation: Hit_ID=Q0Z1D4; Match level="QueryCoverage=97%, HitCoverage=75%, E-value=8e-38, Identity=34%"; Hit description=NAD -dependent epimerase/dehydratase:Short-chain dehydrogenase/reductase SDR
  Pfam annotation: Domain name=3Beta_HSD; Domain location=8-270; Score=- 138.3; E_value=0.009; Accession=PF01073.9; Description=3-beta hydroxysteroid dehydrogenaseisomerase family
  Pfam annotation: Domain name=Epimerase; Domain location=7-240; Score=- 10.5; E_value=1.6e-05; Accession=PF01370.11; Description=NAD dependent epimerasedehydratase family
  Pfam annotation: Domain name=adh_short; Domain location=5-121; Score=- 62.9; E_value=0.077; Accession=PF00106.15; Description=short chain dehydrogenase
  Pfam module annotation: Pfam domain module=3Beta_HSD::Epimerase::adh _short; Domain location=8-270::7-240::5-121
MNAKRQALVIGANGVIGRRLIEELTGQGWQVVGVSRRGGQPAPGVRHLQVDLLDAAATRDALRPLSAISHVFYAAYQDAPDWAGLVAPNLQMLQHVVEGLEPAAPALEHISLMQGYKVYGAHLGPFKTPARESDAGHMPPEFNVAQQQYLAQRQAGKRWRWSAIRPSVVGGFSLGNPMNLALSIAVYASISKALGLPLRFPGKPGAYHSLLEMTDAGLLARATLWAATEPAAANQAFNINNGDLFRWSEMWPKIAAYFGLECAPPLPMPLESMMADKAPLWREL

SEQ ID NO: 200240 - protein, 70 aa, Glycine max
  Coding DNA Sequence Number=SeqID_83462
MGDSAKVVIKQDMKGRRHKYGFNNNEREKAQKKRVVDDETADKHQLDEHQERLRKKFALEEERIFAANEQ

SEQ ID NO: 200241 - protein, 329 aa, Glycine max
  Coding DNA Sequence Number=SeqID_83463
  Gene Ontology: Mol. function=two-component response regulator activity; Cellular component=membrane; Biological process=two -component signal transduction system (phosphorelay)
  Homolog annotation: Hit_ID=Q8D168; Match level="QueryCoverage=68%, HitCoverage=94%, E-value=1e-123, Identity=98%"; Hit description =Positive response regulator for pho regulon
  Pfam annotation: Domain name=Response_reg; Domain location=3-117; Score=128.6; E_value=1.7e-35; Accession=PF00072.14; Description =Response regulator receiver domain
  Pfam annotation: Domain name=Trans_reg_C; Domain location=150-225; Score=87.5; E_value=4e-23; Accession=PF00486.18; Description =Transcriptional regulatory protein, C
  Pfam module annotation: Pfam domain module=Response_reg::Trans_reg_C; Domain location=3-117::150-225
MARRILVVEDEAPIREMVCFVLEQNGYQPLEAEDYDSAVTRLSEPFPDLVLLDWMLPGGSGIQFIKHMKREALTRDIPVMMLTARGEEEDRVRGLEVGADDYITKPFSPKELVARIKAVMRRISPMAVEEVIEMQGLSLDPSSHRVMANDQALDMGPTEFKLLHFFMTHPERVYSREQLLNHVWGTNVYVEDRTVDVHIRRLRKALETSGHDKMVQTVRGTGYRTSVVEEAGSGAGSFLSARLTAGADFRLSALVPAGLRAGGAGVEFLQPAQTLPLAVDRPQYDTAARPLELGAAVLWPVSDAAAQSPPPARAGVADQALSQRGRIAA

SEQ ID NO: 200242 - protein, 294 aa, Glycine max
  Coding DNA Sequence Number=SeqID_83464
  Gene Ontology: Mol. function=transporter activity; Cellular component= cell outer membrane; Biological process=transport
  Homolog annotation: Hit_ID=Q66DX4; Match level="QueryCoverage=95%, HitCoverage=79%, E-value=1e-100, Identity=65%"; Hit description=ABC superfamily (Peri_bind) high-affinity phosphate transporter precursor
  Pfam annotation: Domain name=LysR_substrate; Domain location=3-259; Score=-31.1; E_value=0.1; Accession=PF03466.10; Description=LysR substrate binding domain
  Subcellular localization annotation: CTP_CleavageSite=63; ConfidenceScore=5.11e-01
MLAGNLSSVGSDTLANLMALWAQDFSRHYPNVNLQIQAAGSSTAPTALAAGAAQLGPMSRPMKAAEVSAFEHRYGYAPLAVPVAVDALVVLVHQDNPLRGLNLQQLDRIFSATRRCGESKPLTRWGELGLSGDWATRSLQRFGRNSASGTYGYFKLRALCGGDFMPRVNELPGSASVVQAVAGSLNGIGYASIGFRASGVRLLPLAESGEDYVAPTAANVRNDRYPLSRYLYIYINKAPNQPLEPLTAAFLDRVLSNAGQSLVNHDGYLPLPPGALQRTRQALGLQPLAAATVQ

SEQ ID NO: 200243 - protein, 54 aa, Glycine max
  Coding DNA Sequence Number=SeqID_83465
MGGKLLRGVGGFRKISENLRKIELKCFRNASVSDYVEILHRSSPFFVRSSIFNR

SEQ ID NO: 200244 - protein, 66 aa, Glycine max
  Coding DNA Sequence Number=SeqID_83466
  Homolog annotation: Hit_ID=O52294; Match level="QueryCoverage=95%, HitCoverage=9%, E-value=4e-07, Identity=38%"; Hit description=Yme
MTARENDILATKKIFEMLSSAIESNAFKFQVIVLEHADQTIWGEIPHTYEAAQWKTAKDGLIPKEW

SEQ ID NO: 200245 - protein, 186 aa, Glycine max
  Coding DNA Sequence Number=SeqID_83467
MVDYEYLKIVVEGGVSSGNNSISVDPDDTDATTFEPENRTVGIEEFSYDPNSDTFITPNNYEPAYQPPSPNQPSPPSHPPLDSEVPIEKQNCHKRRRSEYGGSSSAVGINNQGNVLENLSVGIETIAVNFEKISNMMEKREKDRDRDRELEGIIWDVIKEIPNLDDITRFKTAELLNTKAKKDFFS

SEQ ID NO: 200246 - protein, 164 aa, Glycine max
  Coding DNA Sequence Number=SeqID_83468
GAGLNSGTGDNAVVKERFKTAAIIVEKECDELRDVAPPTAPTLERETKRARKEEWGRNKFRGALWGSNSELKLQRAIMDYSRVEGQKRNLWAIIDQYKEKLSLATGHEQRLEDEHAKVSVLQVKREARERVINSLHKEAIMWMDRFAFTLNGSQELPRLLAKSR

SEQ ID NO: 200247 - protein, 62 aa, Glycine max
  Coding DNA Sequence Number=SeqID_83469
ISIGEIKQKMKKKKIASYGSRFDEEMSKVGRFEGLGMEGRRKEEEVAQGFLKNVIFIDQDAL

SEQ ID NO: 200248 - protein, 42 aa, Glycine max
  Coding DNA Sequence Number=SeqID_83470
MVDQQATKSKAKGKRSTRTHLVAHDPGDLNKTSASSEGREIP

SEQ ID NO: 200249 - protein, 68 aa, Glycine max
  Coding DNA Sequence Number=SeqID_83471
MTFKSFKSKNMIQYHSYVHSAAPDVWNYNTSSSDSVLIKKNHSNKGLYYLQRAKYGRGQQEDSILEHQ

SEQ ID NO: 200250 - protein, 101 aa, Glycine max
  Coding DNA Sequence Number=SeqID_83472
MDPKKSNRVLGFPTLITGLCQFYGVHVAPSKVIRPPTNRAFIKKYCAPRQAQGETPQQPGDGRQRATDAPSPPLKPLNSSTKAGALPTTHGRPAGDKVQSQ

SEQ ID NO: 200251 - protein, 176 aa, Glycine max
  Coding DNA Sequence Number=SeqID_83473
  Gene Ontology: Mol. function=chitin binding; Cellular component =extracellular region; Biological process=chitin metabolic process
  Homolog annotation: Hit_ID=UPI000044A8F0; Match level="QueryCoverage =82%, HitCoverage=99%, E-value=1e-19, Identity=32%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
MSSPLEGYLPSTSEDYTSSPSEGYTPSPSEDYMSFPSEGSTPSPSEDYTSSPSEGYTPSPLEAYRLLPSEDYTSLPSKGYTSSPSKGYMSSPSEDYTSSPSEDYKWVHVLVFRGLHVLAFSGLHVLAFRGLHVLAFRGLHALAFRGLHALAFRALHILAFRGLHICTFRELNVLCP

SEQ ID NO: 200252 - protein, 117 aa, Glycine max
  Coding DNA Sequence Number=SeqID_83474
  Gene Ontology: Mol. function=microtubule motor activity; Cellular component=microtubule associated complex; Biological process =microtubule-based movement
  Homolog annotation: Hit_ID=Q1SGR1; Match level="QueryCoverage=97%, HitCoverage=19%, E-value=3e-34, Identity=54%"; Hit description =Kinesin, motor region; Prefoldin
MQLEKCSLKDNLIKALEEQLATAEKKLQELKGNIRVFCRVRPLLADESCSTEGKIFSYPTSMETSGRAIDLAQNGKSVVIMPKNSFTFDKVFTPEASQEEVFVEISQLVQSALDGYK

SEQ ID NO: 200253 - protein, 164 aa, Glycine max
  Coding DNA Sequence Number=SeqID_83475
MTKLGLCLSSALDDKRVRITVRYLRVSWVQNDQTWSLLVIGPPLDDKRVRITVRMTKLGLCVSSDPPRLNGKKVRITVRARRRKDPRTWVQNDQTWSLLVIPPPLDDKRVRITVRMTNLGLCLSSGPPPLDDKRVRITVRYLRVSWVQNDQTWSLLVIGPAASG

SEQ ID NO: 200254 - protein, 290 aa, Glycine max
  Coding DNA Sequence Number=SeqID_83476
  Gene Ontology: Mol. function=nucleoside-triphosphatase activity; Cellular component=membrane; Biological process=carbohydrate transport
  Homolog annotation: Hit_ID=Q1M4R7; Match level="QueryCoverage=94%, HitCoverage=60%, E-value=4e-96, Identity=69%"; Hit description =Putative ATP-binding component of ABC transporter precursor
  Pfam annotation: Domain name=ABC_tran; Domain location=2-119; Score =27.5; E_value=6.3e-10; Accession=PF00005.17; Description=ABC transporter
RYRLQYAVNAKYGLVDKRAIEQAAEKALARLGVEIDLDRPLKELPIAQRQIVAIARALVGEARLVFMDEPTASLTQSETDYLIDIVRNLSASGVAVVFVSHRLAEVLEISDRITVLRDGSLVGVFPVEGMTQSRVTELMTGRNFDSAVIAADHDDKPVVLSVRGLSRAGEFEDVSFDLRRGETLGITGLLGAGRTELALTLFGMHRPQSGEVLIDAAIHCRQSGHGLARPAAARRPDLTVEKGGCRFPLDFCARGEDRPARRPDPNAFGRQPAACGDRQVARDRAENPHP

SEQ ID NO: 200255 - protein, 204 aa, Glycine max
  Coding DNA Sequence Number=SeqID_83477
  Gene Ontology: Mol. function=transition metal ion binding; Cellular component=cytoplasm; Biological process=cytoskeleton organization and biogenesis
  Pfam annotation: Domain name=Transposase_21; Domain location=50-167; Score=-30.0; E_value=4.8e-12; Accession=PF02992.5; Description =Transposase family tnp2
MCGVSRYKVKDDDECNNDKSIKKGPSSKVLWYLLIIPRFKCLFDNGDGSKDPTWHVDGRNYDGMLRHLVDSSQWKKIDHLNLDFDKEARNLRLGLATNEMNHYGSLSTQHSSWPVLLKNSIHLTSTSSKTLSPLLAIEKTFNGSQEHESAPIPLTSQQVLKRVEDINTIFGKTQKKLTEKDVCDSVIDTLLKIQGKTNDGLNTR

SEQ ID NO: 200256 - protein, 186 aa, Glycine max
  Coding DNA Sequence Number=SeqID_83478
MANVIPPERASGVRRGEGRFVPGSDIVQGSGRPSLEDYKGSDAARVRAASEGNTALQFYEKQPSGCYKKVLERRVTAGLAILGIPVSGNKKIGMPESSNNKGAFINEFTIKPGQLISIIHYWTQPGYYQNTERSVSTRFIPQPNHDYDIVVTGSEFGGDSVSVRDLDPGAKIVGWEGNFCPSGIFD

SEQ ID NO: 200257 - protein, 105 aa, Glycine max
  Coding DNA Sequence Number=SeqID_83479
GLGGLVSALILAKEGLKSAYKCAKGGSQISKLLIRKLREYGADVHKHSEVSEMIFTEDVLVAVWNAYQYENETWPETYMLSSTPSKHHPEFAESMTAITYMDFDE

SEQ ID NO: 200258 - protein, 57 aa, Glycine max
  Coding DNA Sequence Number=SeqID_83480
MNKSVKVFHRSSPFFIHSSFFNRSDFLFDGGYVGEKVPLLSTLVRWLEVQRLSFLTK

SEQ ID NO: 200259 - protein, 114 aa, Glycine max
  Coding DNA Sequence Number=SeqID_83481
MWMDRFALTLNRSQELPRLLAKAKAMADTYSAPEEIHGLLSYLRIKSLPHFISHMRCMWVSSFVVGSRKIHIVFLTAHMGHCAPKCTVRRDDFLGPRVRKCIHIMHRINISSAS

SEQ ID NO: 200260 - protein, 80 aa, Glycine max
  Coding DNA Sequence Number=SeqID_83482
MNVLSPVVALSVFIFSVELSIELAKCGCALSEYCVWLLVKGRHHLQCPRLGMIAQDLYPKMPGTAMQTMSLAGRSFWKGM

SEQ ID NO: 200261 - protein, 168 aa, Glycine max
  Coding DNA Sequence Number=SeqID_83483
  Subcellular localization annotation: CTP_CleavageSite=70; ConfidenceScore=5.68e-01
MVKFLFLSFLLANTLLSLTNATNQPQIIFQSFSAPSSNPPSQSPSSGQRPRTSEPSIGRKLGMHRHNQIRSSDTKSPTPSEAPQSEKKMHSISEGSIPSHQRTSIEPHDGEVLGSHHGQVHLSKQRHHSFDKSRAGAGVILVGLATTFLVSVFCYIRATRRNKLETTA

SEQ ID NO: 200262 - protein, 56 aa, Glycine max
  Coding DNA Sequence Number=SeqID_83484
MRLHCYQASQRPSMTTNRLPLLMAHIDPGIGPNISTCVREEKVVKAFDLETISSDI

SEQ ID NO: 200263 - protein, 122 aa, Glycine max
  Coding DNA Sequence Number=SeqID_83485
  Gene Ontology: Mol. function=catalytic activity
  Homolog annotation: Hit_ID=Q4ADY5; Match level="QueryCoverage=55%, HitCoverage=23%, E-value=1e-16, Identity=54%"; Hit description =Spermine synthase
MEDVIGRGLECLKTMDGKARASIPESEAKCHSTVVSGWFPASQTCPRKSGKFVYFNNPMWPAPCRACRPWIFFINGVLCFLRINGNEMEKEERINGNEMEKEERERKRGEQNFERQKRKNEV

SEQ ID NO: 200264 - protein, 98 aa, Glycine max
  Coding DNA Sequence Number=SeqID_83486
MTLMQVQLLFQNLVTLVDEVMEEATKGNEDAESEDEVEFEENDEELGEDYEESSEEEDDGSSSDGFEEEEDLTTKIVSSKREIRYLASLLLVSFLDFR

SEQ ID NO: 200265 - protein, 293 aa, Glycine max
  Coding DNA Sequence Number=SeqID_83487
  Gene Ontology: Mol. function=hydrolase activity; Cellular component =integral to membrane; Biological process=transport
  Homolog annotation: Hit_ID=Q6AGT3; Match level="QueryCoverage=98%, HitCoverage=56%, E-value=1e-79, Identity=51%"; Hit description =Peptidase
  Pfam annotation: Domain name=Abhydrolase_4; Domain location=191-292; Score=105.1; E_value=2.1e-28; Accession=PF08386.1; Description=TAP -like protein
RIPLNYLGYSYGTFLGATYAKLYPQKAGRLVLDGAIDPAVPGLEVGATQALGFESALRAYMQNCLDSGECPFNGTVDEAMADLGALLASVDRTPLKNGDGRMLGADSLLTGIIAALYAQESWGALTQALDEALQGDPNTAFLLADFYNGRENGAYVDNSSEAFRAYNCMDYPVEDDPAAEAASEAKIAKGAPTIAPYWSGPDSSEVWPYPPTGTRDEITAEGAGPILVIGTTNDPATPYEWSESLADQQEEGVLITRVGEGHTGYNKGNVSVDDAVEAFLLDDVVPEDGLRCE

SEQ ID NO: 200266 - protein, 169 aa, Glycine max
  Coding DNA Sequence Number=SeqID_83488
VALFMMALSTYSNFDTTLQIPHLETNTFHEAMPEVAAPNLQHFLPHSDESLFLSNALFENYIDPTCDFLYTPEINPFTSLTHHDDIFPTHEDYNLLPCPKRQKCCYEKNQQQEHVFFSLQELTTSTLPSNFLDRYAVPYDNNFSFQAEELQQQLYEVPQYGSNLCGSSM

SEQ ID NO: 200267 - protein, 43 aa, Glycine max
  Coding DNA Sequence Number=SeqID_83489
MSKKETTTLHTTLINNQGAHVGGRDGPHRRPSQSNAPLDMFLT

SEQ ID NO: 200268 - protein, 75 aa, Glycine max
  Coding DNA Sequence Number=SeqID_83490
MVATGNRVLPYGDERKVPLATLSFQGYTLYWWTSLVRERRIHGDPSVEYWNDLKGALRKRRIPSYYERELMDKGV

SEQ ID NO: 200269 - protein, 175 aa, Glycine max
  Coding DNA Sequence Number=SeqID_83491
  Gene Ontology: Mol. function=sequence-specific DNA binding; Cellular component=intracellular; Biological process=regulation of transcription, DNA-dependent
  Homolog annotation: Hit_ID=Q1MF44; Match level="QueryCoverage=48%, HitCoverage=28%, E-value=4e-20, Identity=55%"; Hit description =Putative AraC family transcriptional regulator
  Pfam annotation: Domain name=HTH_AraC; Domain location=1-42; Score =32.1; E_value=1.9e-06; Accession=PF00165.13; Description=Bacterial regulatory helix-turn-helix proteins, araC family
  Pfam annotation: Domain name=HTH_AraC; Domain location=48-92; Score =19.7; E_value=0.01; Accession=PF00165.13; Description=Bacterial regulatory helix-turn-helix proteins, araC family
  Pfam module annotation: Pfam domain module=HTH_AraC::HTH_AraC; Domain location=1-42::48-92
MHEKPGHRWTLAELAGRAGLSRSIFAQRFRERVGQTPIEYLTQWRMMLAKELLTGGREPLITIANALGYESENAFNTAFKRVTGYASSSPSADSPQNARAPELRPFWRRSVFHEPGDLLMAGKPYKTGFPGETFTVKDEFGLNSERDGLNLALGSYRQFYRQPVQLAGDSHRSSS

SEQ ID NO: 200270 - protein, 410 aa, Glycine max
  Coding DNA Sequence Number=SeqID_83492
MMISGLGQLGNDIDVYLNPLIEDLTKLWDKAVVVFDGHCIDVMHVEKNVSDSVISMLLNIQGKIKNGLNTRQDLDEMVYVTSYIQRYMKILKGYTKNLHHLEASIVERYIAKEAIEFCSKYIEKAKPVGLPKSRHDERVGDDDSTLDTCLTPFSTQISNVNGEEEVDDIHANYNDHDEGELINIHMTTPPSSLPPPESAPSLFMPKKTRKATRLGSLATRPIEIERPKVHVDPTTGKADGPHIKKLRTYLGVVARDKVDVTFVNWKEVPTTQKDLIWEDIQAEFDIPEAFVQRTKKKILKMKARRRTMTLFVRRIISAKKSGTNFVKVVGSLLERIPLKSSQHREALSPIDVKMDELEQSIIEKVTRQLMLSLSKMQSQMQPQRLVLPPKLGVGPSATHVSTKESCVDTS

SEQ ID NO: 200271 - protein, 90 aa, Glycine max
  Coding DNA Sequence Number=SeqID_83493
MVIDQSLFYDLTQLSSEGVPFKGTLNDDWKFDFSVHDAHRLVCTNQADMSGRPLAGSLAFEICILHYLIVRILLLRSSNLAQAVKLIGHT

SEQ ID NO: 200272 - protein, 99 aa, Glycine max
  Coding DNA Sequence Number=SeqID_83494
NVDTDNHSGISARQRDSKVSMTDLVSAEDDVNLRVSTGLSAAIDEGCRMTIICLCMPSDTTVSEWQKGQYDRSCGAADKSKALAPTYPPMRNSDLRSSR

SEQ ID NO: 200273 - protein, 261 aa, Glycine max
  Coding DNA Sequence Number=SeqID_83495
  Gene Ontology: Mol. function=threonine endopeptidase activity; Cellular component=proteasome core complex (sensu Eukaryota); Biological process=ubiquitin-dependent protein catabolic process
  Homolog annotation: Hit_ID=O23708; Match level="QueryCoverage=84%, HitCoverage=94%, E-value=1e-111, Identity=93%"; Hit description =Proteasome subunit alpha type 2-A
  Pfam annotation: Domain name=Proteasome; Domain location=55-239; Score=250.3; E_value=4.2e-72; Accession=PF00227.16; Description =Proteasome A-type and B-type
PNALVCGLPNTKVETRTHFLTPSSQPRNPESPAQPRNLVHPSGKLVQIEHALTAVGSGQTSLGIKAANGVVIATEKKLPSILVDETSVQKIQLLTPNIGVVYSGMGPDFRVLVRKSRKQAEQYHRLYKEPIPVTQLVREVAAVMQEFTQSGGVRPFGVSLLVAGFDDNGPQLYQVDPSGSYFSWKASAMGKNVSNAKTFLEKRYTDDMELDDAVHTSILTLKEGFEGQISGKNIEIGIIGADKKFRVLTPAEIDDYLAEVE

SEQ ID NO: 200274 - protein, 62 aa, Glycine max
  Coding DNA Sequence Number=SeqID_83496
MDDLQGHRECCLPRKIIHHCYVKVSHDAKEFKVTPVRFDVRGNVLSWRFKSGMIFSENVLLM

SEQ ID NO: 200275 - protein, 104 aa, Glycine max
  Coding DNA Sequence Number=SeqID_83497
  Gene Ontology: Mol. function=RNA-directed DNA polymerase activity; Cellular component=intracellular; Biological process=RNA-dependent DNA replication
MPGIHPSIIYHKLAIFPKAKPISQKKRKMGDERRKMANDKWRICTDYIDMNKACPKYAYPLPSIGRLVSGASRFQVLCFLDAYSRYNQICMHAINEEKMTFIIE

SEQ ID NO: 200276 - protein, 220 aa, Glycine max
  Coding DNA Sequence Number=SeqID_83498
MEQLDIQGPSLDDEDEMVFVNDVTKEGLNHLLCLVDMFLTKKTIQVEGITTNKASKVIRQNIGSFLGEFLNYDDKHNSSPQMSFMRIEVLVNVNEPLKCTKRIKKVNGEANVISFKFMWNLFKVENDNDQRSWGSELRAYIRPLAMTEGSYYLREEGQPSLVASHDLGVTNSMPINVNLKQPNSEDMIGVDRKHSELLIVAFKSPEYSNIKSHQRCINGQ

SEQ ID NO: 200277 - protein, 58 aa, Glycine max
  Coding DNA Sequence Number=SeqID_83499
MGSEGVPLIVVEVMSVAVVELTDASSWWHEIDDSPACSVCSFYLLSERAEVEARGIGV

SEQ ID NO: 200278 - protein, 161 aa, Glycine max
  Coding DNA Sequence Number=SeqID_83500
MPDFMKPAHDQYVYRHANGLCVIGLAPSHIAFKDEGGITAVDFNVGKSDRSRIKVIGKQKKKLEMQLLNPLLWFRSQFLRSWRKFGRGNWRFYRIKYLAYTKNMDKGGHYCKNAILRRWKAGYNDGGRPSLYPMSWKIKPFNDGSKFYVVERDPLSKTLLT

SEQ ID NO: 200279 - protein, 97 aa, Glycine max
  Coding DNA Sequence Number=SeqID_83501
  Gene Ontology: Mol. function=DNA polymerase processivity factor activity; Cellular component=PCNA complex; Biological process =regulation of DNA replication
  Homolog annotation: Hit_ID=Q9ZW35; Match level="QueryCoverage=92%, HitCoverage=40%, E-value=3e-25, Identity=75%"; Hit description =Proliferating cell nuclear antigen 2
MLKKRGNVLGLSNMKVTMSLLSSTLMVMMTSIPAHGDVSIVTTVLEALRSEDEGDMAKVHGLEGELGGGAVEVRIIHELLNGFQNLLQEGALHETEF

SEQ ID NO: 200280 - protein, 103 aa, Glycine max
  Coding DNA Sequence Number=SeqID_83502
  Homolog annotation: Hit_ID=Q7GB25; Match level="QueryCoverage=43%, HitCoverage=2%, E-value=5e-13, Identity=84%"; Hit description =Multidrug resistance-associated protein 5
MPLLWARVVMRKWLNKASNEPDDNEDDPESDSDNEEFLPRLRRQKSLTSRSQYINKGTKVSIDQSVVDLDIPFRLGGFASTTIQLIGIVDVMTEDTWQVLLLL

SEQ ID NO: 200281 - protein, 63 aa, Glycine max
  Coding DNA Sequence Number=SeqID_83503
MDGTFDNEAEPVVTIREYLEEVEEREVMLSISLLQSYYFIAFLSGLALHIVLCIASILKNILS

SEQ ID NO: 200282 - protein, 196 aa, Glycine max
  Coding DNA Sequence Number=SeqID_83504
MAIDIQTLNKLFKVPLAKNTGSITNLPDFNPSMNLVHVEGNMYHFKENDSTEDSQITKVDKPPGTRHIVFLQHRKSSGHSSGIWVLVENNSNLQTHKRSKFFGKLLPFESELLALDIHTWYKQQTGSFLAKRLDRVLVDQSWQYWDFWRPMWRTYVGFTSTTAHCFSDMEGAPHPVEIVLSGSRLPGLYTGASNMW

SEQ ID NO: 200283 - protein, 74 aa, Glycine max
  Coding DNA Sequence Number=SeqID_83505
MKMQRKTNEKRARNKLVLESKRMGTDDIAECTKMQAWNWIRSCEVGICSFPPCITVSIGYVRDTYPTIIQFDAV

SEQ ID NO: 200284 - protein, 63 aa, Glycine max
  Coding DNA Sequence Number=SeqID_83506
MEDAPASHASPSRRRVGCDRGEEVREWESKVERRKRNLCPNVTSYQSNVSRHPSAQGSLKQFT

SEQ ID NO: 200285 - protein, 415 aa, Glycine max
  Coding DNA Sequence Number=SeqID_83507
  Gene Ontology: Mol. function=RNA-directed DNA polymerase activity; Cellular component=mitochondrion; Biological process=RNA-dependent DNA replication
MASLTPLSPKTDTQFKTQAYEDFLTRLGVKHLVTSVEHPRTNSQVEAANKIILKVLHTRVDKSKGLWKEELLSILWTYHYSPQTTTNETLYQLIYNKHIMIPVKVRESLTRRLLFLQQQNQENMRVELETTDEVQEMARIREEATKLRESRRYNTKVQPRAFQPDNLEWRVQGEARKDPQAGKLDPNWEGPLRVTTSLDNGAYRLQELDGKAIPRTWNLTHLKIDVAGRFSKDSQNPRFALGESWFSKGSQNPRSTLGESHFSKGSSNQVSPLVSLSSPKARKTQDPPLVKLAKTQDRHVFILFSKGLSNLRFTLGEPLFSKGLSNPRPALGSPLVSHSVAKFRLHKNSRKTSLQEHCKPKVHTWYKNPRSTLGMHFYKTQGTPLVSSLLKKHDDHSQRSRFHKTNYHQNGRQDL

SEQ ID NO: 200286 - protein, 215 aa, Glycine max
  Coding DNA Sequence Number=SeqID_83508
MCLWIASTPSAMLIHCGVFYQGLLPWKFGNFGGEWKVAPRGREQGGVLGGEGRQMDGYCSHCLGSGVPLAVKSNHQFLTKVGGVLAMLLCTRLDGDELFERCKDLQKEKDDFAGKEESTMVGKDEFAKLVADLEARLKELESRLEEFELLASKEREANKELEEELIMQAGFFAKDLNLGLFDPFKDVNDGILLDEKDIDVEEEQDIEEQGDDANA

SEQ ID NO: 200287 - protein, 178 aa, Glycine max
  Coding DNA Sequence Number=SeqID_83509
  Gene Ontology: Mol. function=4 iron, 4 sulfur cluster binding; Cellular component=integral to membrane; Biological process=protein -chromophore linkage
  Homolog annotation: Hit_ID=P56767; Match level="QueryCoverage=99%, HitCoverage=34%, E-value=9e-62, Identity=82%"; Hit description =Photosystem I P700 chlorophyll a apoprotein A2
WQGNFEAWVQDPLHVRPIAHAIWDPHFGQPAVEAFTRGGALGPVNIAYSGHLVHVAIPGSRGEYVRWNNLLSILPHPEGLGPFFTGQWNLYAQNPDSNSHIFGTPQGAGTAILTLLGGFHPQTQSLWLTDIAHHHLAIAFLFLVAGHMYRTNFGIGHSIKDLLEAHTPPGGRLGRGHK

SEQ ID NO: 200288 - protein, 156 aa, Glycine max
  Coding DNA Sequence Number=SeqID_83510
MDVDISRLLARALAEQLPLLPSIRLPFLGTGPSYRSMGTSIDSAIGKVRHGITLRIFEDIGVGLFFAPRKSFVNLVISTGAGLRAESDLGEPGRVTYFIPWAFHPIMGLECGSLARDGDFPSESAGVQFGCVLSDLFPFLSVVAWLTVACLLVLSD

SEQ ID NO: 200289 - protein, 88 aa, Glycine max
  Coding DNA Sequence Number=SeqID_83511
MCIFKLWRLCGQSCSYVNNHLYNIPHIQQLQYLMQRSQNPVLTLYSRKKVLPQEGKALPRMLVEDGRHVSSAGFCGRTIFREKEMERL

SEQ ID NO: 200290 - protein, 63 aa, Glycine max
  Coding DNA Sequence Number=SeqID_83512
  Homolog annotation: Hit_ID=Q9FR53; Match level="QueryCoverage=95%, HitCoverage=3%, E-value=8e-19, Identity=59%"; Hit description=PTOR
MEFEGACSKKMDANPVAVVEAFIHINNQLHQHERWDHALKAYTTKASQATSPHLVLDATLGLF

SEQ ID NO: 200291 - protein, 97 aa, Glycine max
  Coding DNA Sequence Number=SeqID_83513
MEITELFSVTTAPDSQFPSFYLCAHSITLPNIRYLGPPSNCQAFNSSYWSNASGGCQLLPHLAWNKDTQRWKVSSMLPSDLCNQYKIGPKITGMKGA

SEQ ID NO: 200292 - protein, 444 aa, Glycine max
  Coding DNA Sequence Number=SeqID_83514
  Gene Ontology: Cellular component=endoplasmic reticulum
  Homolog annotation: Hit_ID=Q2PGG7; Match level="QueryCoverage=86%, HitCoverage=65%, E-value=1e-128, Identity=50%"; Hit description =Generative cell specific-1
MALRSAITLIIIFILSSFHVVGIQIISKSKLEKCEKNSNSEDNLNCTTKIVLNMAVPSGSSGGEASIVAELVEVEENSSRKMQTLRIPPVITVNKTSAYALYQLTYIRDVPYKPEEYYVKTRKCEPDAGANVVKICERQAILRDEEGHIIEYTQPICCPCGPQRRMPSSCGNFCKCFDVATFFDKLTKGKANTAHCVRFPGDWFHVFGIGRRTLGFSVRIQVKSGTKVSEVFVGPENRTVISDDKFLRVNLIGDFVGYEAFNQQPNFCSSPFWTCLHNQLWNFRESAGSYSFSIGITEVLSTNLVLELSANDVEYVYQRSPGKIRSVSVPTFEALTQFGVATITTKNTGEVEASYSLTFNCSKDITLMEEQFLIMKPNEVTTQSCKIYPSTDQASKYFCAGKVEALDLYVIYSEDKEHINIYCVLFLGFLDEAVLKDSDYNEVD

SEQ ID NO: 200293 - protein, 623 aa, Glycine max
  Coding DNA Sequence Number=SeqID_83515
  Gene Ontology: Mol. function=zinc ion binding; Cellular component =cytoplasm; Biological process=apoptosis
  Homolog annotation: Hit_ID=O04261; Match level="QueryCoverage=57%, HitCoverage=81%, E-value=1e-135, Identity=59%"; Hit description =Putative zinc finger protein
  Pfam annotation: Domain name=PDCD2_C; Domain location=464-620; Score =33.7; E_value=2.4e-10; Accession=PF04194.4; Description=Programmed cell death protein 2, C-terminal putative domain
  Pfam annotation: Domain name=zf-MYND; Domain location=399-437; Score =48.9; E_value=1.7e-11; Accession=PF01753.9; Description=MYND finger
  Pfam module annotation: Pfam domain module=PDCD2_C::zf-MYND; Domain location=464-620::399-437
FFRGIPRKCHVFRLPLASAEETFFRPTSHDTFTHVKEANLPRKKARLLPRATKPSTDQTCLLPYGHHKRLKEKNEVRTLTYKAEHECKAGSKLQSADNGGRRARGEEEELKPGRGEKKSYWKLEAGSWKKKSFWSRKKSLNRPTHKPSSFRLRSNLTHSQETKTRTNHLELSAAPSIIVVVSVSSLLVADEVGRSETEPSNPHKHNPDTIIGWTSTFLFIPKYMDTDATGDPVDKLKAIQNDDVEYQDEDDDFDDEEEEEDDPITLGFVDKPKNEWSLRRQYFPSKTGGVPAWLDPLNIPSGRSSVCDICGDPLQLLLQVYAPTDKETTFHRMLFVFMCPSMKCLLRDQHEQWKRHPEKPSRSVKVFRCQLPRINPFYSPECPQYNESHEPAGSGAALCDWCGTWKGDKLCSSCRQARYCSEKHQAMSWRTGHKTACQQMKVSSPVFGPNKSGTTSLESHKVGSKNLWPEFEISIEDESEYNRDISEENSLANSLISRNRNDDTMNSLMDNFKGDDDKKSWASFQERIAEAPEQVLRYYRNTNAKPIWPVSSGRPSNADIPKCSYCSGPMSCEFQILPQLLYYFGVDNEVDSLDWASIVVYACEASCEASLPYKNEFAWDRLD

SEQ ID NO: 200294 - protein, 563 aa, Glycine max
  Coding DNA Sequence Number=SeqID_83516
  Gene Ontology: Mol. function=binding; Cellular component=membrane
  Homolog annotation: Hit_ID=Q6ZGV8; Match level="QueryCoverage=72%, HitCoverage=24%, E-value=3e-79, Identity=57%"; Hit description =Eukaryotic translation initiation factor 3 subunit (EIF-3)-like
PSRNNNNINNDRAAENIPMDKKKKNNVDETRNADTETTKQHDDPRGSLAFIRMITGEKIVVQGRRLSFRGDLRVSTWDTVMDVRQFLLESKEACFHHVLGLVAHEGWPLVEVTGITGCGVVLGNGSELDGPGYMEDISGLLSNVLPSSLKDVKCVESILFSSFNPPPRYRRLVEDSFYLDVTTLEGNVFCITGSTRMFYVNSCTTKTFDPRPSKATLEATTLATLLQKISPRFKKAFHEIWEQKAAAHCFEKEQPVLMPNLWLGSYPVPDRAENSVTLLYGSEPLGMPREWNEELQTCREFLHTTPLERLMRDRALYRVTSDFVDAAISGAVGVISGCIPSINPTDPEHLYMFLHNNIFFSFSVDTDLQKLSKKSTDDNSQTWSTGSPHSSSEKSCDFQGHNLQTQEGINSGKFHCYLPYYIASLFILLIGITEFVILLYPILTELGLHKQMASIVVVVRPLQDAPAQQSNGAYVVLLLSINDMEVIQDIPPEAELAESDVATYASLNNDLNGTKADQEADVPGLHNLAVAIIDYKIFSLGHYHHLKDSSASSRLEDFTIIPD

SEQ ID NO: 200295 - protein, 77 aa, Glycine max
  Coding DNA Sequence Number=SeqID_83517
  Gene Ontology: Mol. function=sugar binding; Biological process =protein amino acid phosphorylation
  Homolog annotation: Hit_ID=P93068; Match level="QueryCoverage=62%, HitCoverage=5%, E-value=2e-10, Identity=55%"; Hit description =Receptor-like kinase
  Pfam annotation: Domain name=PAN_2; Domain location=1-32; Score= -12.7; E_value=0.028; Accession=PF08276.2; Description=PAN-like domain
MYGDCSCTTYANSDIRGEGSDCTIWYGDLLDIRLIPEAGQDRYIRLAVSETEIIIRVKGKNNESQQEDFELPLFDFA

SEQ ID NO: 200296 - protein, 37 aa, Glycine max
  Coding DNA Sequence Number=SeqID_83518
MASGVRFGSFQPVLTDRRKTEMLDVLLHYPFRMRTMD

SEQ ID NO: 200297 - protein, 280 aa, Glycine max
  Coding DNA Sequence Number=SeqID_83519
  Gene Ontology: Mol. function=binding; Cellular component=membrane; Biological process=photosynthesis
  Homolog annotation: Hit_ID=Q6ZGV8; Match level="QueryCoverage=86%, HitCoverage=16%, E-value=5e-69, Identity=54%"; Hit description =Eukaryotic translation initiation factor 3 subunit (EIF-3)-like
MTTILTAESDVKIYIQQVPELDGPGYMEDISGLLSNVLPSSLKDVKCVESILFSAFNPPPSYRRKLIRFSVLFRLVEDSFYLDVTTLEGNVFCITGSTRMFYVNSCTTKTFDPRPSKATLEATTLATLLQKISPRFKKAFHEIWEQKAAAHCFEKEQPVLMPNLWLGSYPVPDRAENSVTLLYGSEPLGMPREWNEELQTCREFLHTTPLERLMRDRALYRVTSDFVDAAISGVVGVISGCIPPINPTDPEHLYMLVGPSILKLVLFIQYIIEAFSSQNL

SEQ ID NO: 200298 - protein, 181 aa, Glycine max
  Coding DNA Sequence Number=SeqID_83520
  Subcellular localization annotation: CTP_CleavageSite=25; ConfidenceScore=5.38e-01
MKAKILENVLIMSRLLRSFSRISFRSNSSSSSSSRNTNLLNDQDNQTQEVAPKHNLFDEEVRFEDINQNMDDWNIPEIPQDQLYVPETIKDKHNFDYIIKKVENNIPLGQDIGEEFHLLSKNSIYEHSRKYKYLHIGCIQVAIKPLIDMGIDAAVLMCLRDIRHNQFEDSLIGTVETSLGQ

SEQ ID NO: 200299 - protein, 148 aa, Glycine max
  Coding DNA Sequence Number=SeqID_83521
  Homolog annotation: Hit_ID=Q10LS9; Match level="QueryCoverage=26%, HitCoverage=3%, E-value=2e-07, Identity=62%"; Hit description =Insulinase containing protein, expressed
MEKGINLLEQILKLYKDYYHGGLMKLVIIGGGEDLFHYLVYGYSICIQEVTRKTYNVEEVIADQEPMFHFVSLFIEGKWTKEQLSYVVECSPRVTYRISGFCFCVQSSEYHPVHLQGRIENLLNGLEELLVSVPDSFNLHVLSVFASL

SEQ ID NO: 200300 - protein, 43 aa, Glycine max
  Coding DNA Sequence Number=SeqID_83522
MHIYEDQSQGILCYEDETGEIICEGYDEGPRYQRIPRPTHHRR

SEQ ID NO: 200301 - protein, 130 aa, Glycine max
  Coding DNA Sequence Number=SeqID_83523
  Gene Ontology: Mol. function=DNA binding; Biological process=DNA integration
  Homolog annotation: Hit_ID=Q1S9K1; Match level="QueryCoverage=95%, HitCoverage=21%, E-value=2e-29, Identity=44%"; Hit description =Integrase, catalytic region; Zinc finger, CCHC-type; Peptidase aspartic, catalytic
  Pfam annotation: Domain name=rve; Domain location=10-129; Score=19.5; E_value=0.00014; Accession=PF00665.16; Description=Integrase core domain
MKAQVDDSWLWHRRFGHFNTQALKLLYQKSMMKGLPYLKENNKACEVYFLKEKSKVFGIFKKFKAFVEKQSGKHIKVLRSDRGKEYNSHEFDKFCEDEGIECQLTVAYSPQQNGVSERKDQTIMEWPDQC

SEQ ID NO: 200302 - protein, 181 aa, Glycine max
  Coding DNA Sequence Number=SeqID_83524
  Subcellular localization annotation: CTP_CleavageSite=37; ConfidenceScore=5.11e-01
MKEGKEDARKRSGKLRRYRRRGKQSLLSRSCPLASPRSNRQAKSTRSSLVCLLIAVKPMLSFPGHQSTIGSTASIGRHRKRSFTQIDPSRIRWQPPVLEQQRQAWHDRQLRHKPIFKGYQTWGLQLKNKDNQESEQNSPSSSVLSRKVAWVQSPKLGGRPASENSSNAAKEGLGRLGIRLT

SEQ ID NO: 200303 - protein, 91 aa, Glycine max
  Coding DNA Sequence Number=SeqID_83525
MRTRLSRAVSESENERAGVIARMRAQSKNKMRTFRREELSLTVRERECSDGTVGMSYRKELSHNERVRVRVTRKRRMRVVALRGRGGEHKN

SEQ ID NO: 200304 - protein, 110 aa, Glycine max
  Coding DNA Sequence Number=SeqID_83526
MGDLLGHFLESMLVRTKHTEKSCVSLWGQSLILKAGRADYRGLGKGYLWKELSEVQPMKYCSVKAVEKLTIKNVTSLIKPGKVLMMLAQCTLYPECRFEMIEKRIVEVEG

SEQ ID NO: 200305 - protein, 363 aa, Glycine max
  Coding DNA Sequence Number=SeqID_83527
  Gene Ontology: Mol. function=helicase activity; Biological process =viral genome replication
  Homolog annotation: Hit_ID=Q1SN45; Match level="QueryCoverage=98%, HitCoverage=21%, E-value=6e-71, Identity=39%"; Hit description=AAA ATPase
MFAFTSPGIKFDKSYNTGKGPPTFRIHGQTHHLIGSLLPMPNNPPKFAQLYIYDTDNEIINRLSQNPLVFILMSHMMHDMLDERIIIAIKDMLDHHNHYAQNFRMARDKLHFVAVPDLKMKLISQRQTDGRLYNLPTTSEVAALIVGDEHSADKRDIIIEKQSGLLKRIHELHPAYLPLQYPLLYPKGEDGYRLNIPHKDHANIHAAKRKQTILHSRRLFQQWIVDGYCMIESQKLNYVRQHQQQLRVDKYINLTGSNDHPQTIGRDIGKRIILPSSFVGGQRYMEQLYFDGMAICGHLGFPDLFLTITCNPTWPEIQRKVTQSNLTPNNCPDIITRVFKIKLNQLMNDLKHGNIFGNIIGCK

SEQ ID NO: 200306 - protein, 61 aa, Glycine max
  Coding DNA Sequence Number=SeqID_83528
MVELVKNSRVMKKAQAKLVPQSSDETFNVTRAQKILDEDHYRLIDVKERMDLTLLENSVPQ

SEQ ID NO: 200307 - protein, 98 aa, Glycine max
  Coding DNA Sequence Number=SeqID_83529
MSNEELKLQDPRCRIQCPDILPENTGVDAQCISQDKMSNEALKLQDPRCRIRYFQENDRSHPAQAVAAQKRTLLYNHGGCTSSVPSPGLKSYFVSFGT

SEQ ID NO: 200308 - protein, 55 aa, Glycine max
  Coding DNA Sequence Number=SeqID_83530
MIDERASGVCKKWKQGVKESLARRHNLSFTGWKMDDDSTAHLVYHAYNLTKLDIP

SEQ ID NO: 200309 - protein, 181 aa, Glycine max
  Coding DNA Sequence Number=SeqID_83531
MDRLKKLIRNPHGPWAPRASPWTWAYLPTPMHQFGYVQSIPPHPVDSWESFDEIDVRWMHYSNHLALAGEMCVVPGQCVADYMDWFFVISHPFMTAAQPSNPPRDPLATHDASFVEPHIPQILKPAAASTHARSEVDEPRHAVACHAIAERLERNLNLRIVTPSTKTHEVMEQRLKIARVS

SEQ ID NO: 200310 - protein, 73 aa, Glycine max
  Coding DNA Sequence Number=SeqID_83532
MTMDELKRLSIPSEMLKFFNHSIFPHQGHPTRDIRQGQCTPHEHTQHAHVNAFPTSSTFHFHIILNINIISSL

SEQ ID NO: 200311 - protein, 39 aa, Glycine max
  Coding DNA Sequence Number=SeqID_83533
MKEREQEVFIPDKFSARNRVQNKVMVQLWFGIRVKHLPV

SEQ ID NO: 200312 - protein, 132 aa, Glycine max
  Coding DNA Sequence Number=SeqID_83534
  Homolog annotation: Hit_ID=UPI000065F7CF; Match level="QueryCoverage =69%, HitCoverage=16%, E-value=2e-08, Identity=37%"; Hit description =Homolog of Homo sapiens "Leucine-rich repeats and IQ motif containing 1
  Subcellular localization annotation: CTP_CleavageSite=21; ConfidenceScore=5.23e-01
MEDKPWNFNGLIKHQTTPLPSLQNGQGGPLGTSTLTFRGLHALAFRGLHVLALRTTRPHLQRATRPRLQRTARPSLHRTARPCLQRTISPRLQKATCPRFQTTTRPQLQRTKHPHLQRTTRPHLQRTTCPRL

SEQ ID NO: 200313 - protein, 211 aa, Glycine max
  Coding DNA Sequence Number=SeqID_83535
  Gene Ontology: Mol. function=nucleic acid binding; Cellular component= endoplasmic reticulum membrane; Biological process=DNA integration
MLSSPTLEPDSSLVSTPRRVRSLMDICETCNMAMLEPECYEEAPEQVVRQPGVNYNETFVPVSRLDTIRALIALIAQKWWNIYQLDVKSALLNGVLEEEIYMEQPQAFVSKGNEAKMLKLRKSLYGLKEAPRAWYSRIDQYFTDHGFRRSKSEPTLYIKTQDDLIYTSNNLKMLKEFKEDMMKTFEMTDLGLMNYLLDIDVRQQKEGIYIS

SEQ ID NO: 200314 - protein, 62 aa, Glycine max
  Coding DNA Sequence Number=SeqID_83536
MTMLSMREKTRIEPTLVRKMTKIVSLERIKRVLTTEKVQPRTKDDISVGGWTKHKSALKLRD

SEQ ID NO: 200315 - protein, 123 aa, Glycine max
  Coding DNA Sequence Number=SeqID_83537
  Gene Ontology: Mol. function=ion channel activity; Cellular component= integral to membrane; Biological process=hypersensitive response
  Homolog annotation: Hit_ID=Q94AS9; Match level="QueryCoverage=64%, HitCoverage=11%, E-value=4e-23, Identity=63%"; Hit description =Cyclic nucleotide-gated ion channel 4
MGLCHFKLYPNHYVFDAIAKIVLWVTISFLLKKESITLVVTVFLIMFLFQYLPKMYHSVCLLRRMQDLSDYIFGTVWWGITLNLIAYFVASHYFTDARPLEPERLKALRIQWAKYYMKLKHET

SEQ ID NO: 200316 - protein, 82 aa, Glycine max
  Coding DNA Sequence Number=SeqID_83538
  Subcellular localization annotation: CTP_CleavageSite=44; ConfidenceScore=5.34e-01
MVPTQSSMTTSRTSPSHPLTTMSPSPPQLDPRHPDAKSRRLATSDDEDEASRPQHTRKKMRLIEKDNDDDKNAITASAYGGR

SEQ ID NO: 200317 - protein, 112 aa, Glycine max
  Coding DNA Sequence Number=SeqID_83539
MKLPWSKTATPTNVHNNNSNGWRLVMSLLASDDPLDPFMINCIPFTSRCNFRMVNEEVAFLVAIKIGWKDYYSRIRLRCNFLGVLWRSRLRLRTCSTFSVRCCQLAVVVDIC

SEQ ID NO: 200318 - protein, 152 aa, Glycine max
  Coding DNA Sequence Number=SeqID_83540
  Gene Ontology: Mol. function=DNA binding; Cellular component=nucleus; Biological process=regulation of transcription
  Homolog annotation: Hit_ID=Q39811; Match level="QueryCoverage=43%, HitCoverage=15%, E-value=9e-30, Identity=89%"; Hit description=Alpha galactosidase
MAKPKCQVFGFNPLTFRYLTSGKLNWATKVGYWKTTRKDRAIKHNNRVEGMIKTLVEPLREIELIGLCMNLDLMTRCWLMKVYRRNQACGKTMPESLGREEQVAKTFASWGIDYLKYDNYENNNISPKERYPPMSEALANTGRPIFFSFCEW

SEQ ID NO: 200319 - protein, 79 aa, Glycine max
  Coding DNA Sequence Number=SeqID_83541
  Subcellular localization annotation: CTP_CleavageSite=43; ConfidenceScore=5.31e-01
MDKVVSRIFPLDLMMKYVQFQLSLANQWAKRASTAKCASGRVSASRLRAKREINALSTAGVFSQAQRTTDTKPESTYQR

SEQ ID NO: 200320 - protein, 100 aa, Glycine max
  Coding DNA Sequence Number=SeqID_83542
MAGRNDHVIANALQALAQAMGNHNKGEEQKVAFGVHTLIEEAGYWWENTRQCLEAEGQAMIGKWHLQSPFLLLHSATIDLQEAKDSIGEEDSRPASSTWS

SEQ ID NO: 200321 - protein, 107 aa, Glycine max
  Coding DNA Sequence Number=SeqID_83543
MKQWKKTKSIKYDFHPCTENLDFRHIPALLEDTIWCSQHGKRATSHWFTIVDLMLRISTYVRIEAEIRVPNKYALEQSELLQAQSVNPSHSPSIGVGQNSKRKQIFT

SEQ ID NO: 200322 - protein, 183 aa, Glycine max
  Coding DNA Sequence Number=SeqID_83544
  Subcellular localization annotation: CTP_CleavageSite=63; ConfidenceScore=5.34e-01
MFQMNKNLFGGTWIGLLNGLATSARDMVGLDKSRTPFSSQVFHSLGTQRKITLCLSPTSGIVQLGKVTHESQPESEIFRSLTLTGTYASNLRAIGREMVKIWRLNFRLQAWLQECSKECYNSDHRGRDPQGHKTCVVEANNNAKHKSKNKNKTNTSEKNEDDKHGEKCKGFNVREGRKAPSLW

SEQ ID NO: 200323 - protein, 67 aa, Glycine max
  Coding DNA Sequence Number=SeqID_83545
MGACFSSGNRYDEYLEGSGNGRRIFASDEDRAHWVAEPGIDRKASDFIAKYYATRVTDSQCQYVNTL

SEQ ID NO: 200324 - protein, 197 aa, Glycine max
  Coding DNA Sequence Number=SeqID_83546
MAFGDNHGHPHPLCYLETIKFGGTWGEITVIHTLFAIQRKSSPMAHGDKTWSSAPFLLSRDNQVHWHAKTKHDHSHPLCYLETIMFDCTQRQNMVIHTFFSIQRQSSPMARRENHGHPHPFGYTEIVMSDDTRRQSMVIRTPFAIQRQSSPMVRGDKTWSSAPFLLSRDNQVHWHAETKHDHPHPLCSLETIMFDCT

SEQ ID NO: 200325 - protein, 111 aa, Glycine max
  Coding DNA Sequence Number=SeqID_83547
MASDDHILSPRALLDSKKGADDHVCKKGSDEHVLSLRAIGLDCLQIAKRQMTMFCLHMPSDLIVPGMQRSEMGVDDHALSLRATKFHCLWIEKRRMTRFFLRVPSGLNVSR

SEQ ID NO: 200326 - protein, 229 aa, Glycine max
  Coding DNA Sequence Number=SeqID_83548
TRLSLGLKKGADDHVLSPHAIGLYCPFIDKKGADDRVLSLQAIGLDCFWIAKRPRMTLFCIHVPLDLIVSGSKNGADDHVLSSHSIGLDYLCIAKMGADDQVLSPRAIGLDCLWIAKGTLLSPDCKKGADDHVLSLRAIEHDWLVRMTIVATYPSAGGRRETRGMRVPRKEYARSRHQRLFEENVGKTGKDVIYELLSERFGSCIYARGRVFPFAPTYSSIWDEKIRPT

SEQ ID NO: 200327 - protein, 54 aa, Glycine max
  Coding DNA Sequence Number=SeqID_83549
MATARWALKHPVYGIVILRLGIYTDRPNVSKTTFLNGKLHTTPEFQKTLLTTTK

SEQ ID NO: 200328 - protein, 174 aa, Glycine max
  Coding DNA Sequence Number=SeqID_83550
METSYKGSDYTDPDIKCLLLLQLSSHIPHLRFEHGQRQSNSSRLGFPTLITALCRARGVICDSLTYESLSLAINLAYIKKNYWNMDDLTVNFRGARKARARLADVPSSSTPPAPPTYATPTPAPPGPSAQDSQCFESMLLSLYQGQILLMQSLQVVWPGTQPSLVREGGGSGAQ

SEQ ID NO: 200329 - protein, 106 aa, Glycine max
  Coding DNA Sequence Number=SeqID_83551
  Gene Ontology: Mol. function=kinase activity
  Homolog annotation: Hit_ID=Q2R441; Match level="QueryCoverage=70%, HitCoverage=24%, E-value=1e-22, Identity=66%"; Hit description =Uncharacterized plant-specific domain TIGR01627 family protein, expressed
  Pfam annotation: Domain name=DUF579; Domain location=2-106; Score= -51.9; E_value=8.4e-08; Accession=PF04669.4; Description=Protein of unknown function (DUF579)
MTDHRLKGSSHLVPIRTFVFSHEDVPARQQACKLTLENLPDKVYETDWDRIMIDASKGYFAEAPARMAAVFSATVMARNRKGSGVTHVFLHDGDRKVEKVFAEEFL

SEQ ID NO: 200330 - protein, 147 aa, Glycine max
  Coding DNA Sequence Number=SeqID_83552
  Gene Ontology: Mol. function=GPI anchor binding; Cellular component =membrane; Biological process=cell adhesion
  Homolog annotation: Hit_ID=Q5N9U4; Match level="QueryCoverage=68%, HitCoverage=25%, E-value=6e-14, Identity=46%"; Hit description =Endosperm specific protein-like
MQREDGGVGGEVRCGGADRDHDRLGVVGEVHRAEVVGGAASVLKECGDELARGVEVGLGEELEEDMVEKDVDEGGRGEVVVNGEVGVEDGENGEGGTVREICDQGVAKVRREVNWESFGTVERRAVRLLMFGDKCLEKETLNKTLYD

SEQ ID NO: 200331 - protein, 163 aa, Glycine max
  Coding DNA Sequence Number=SeqID_83553
  Gene Ontology: Mol. function=DNA binding; Cellular component=nucleus; Biological process=regulation of transcription, DNA-dependent
  Homolog annotation: Hit_ID=Q1SEQ4; Match level="QueryCoverage=91%, HitCoverage=14%, E-value=8e-29, Identity=44%"; Hit description=SBP
MTIIYLIGHKSNVVGTEAWKSAQDATGLTPYDYASMRGYYSYIQLVQSKTSNTCKSQHVLDIPGTLVDSNTKQKQSDRHRSSKVSSLQTEKIETTAMPRRCGLCQQKLAYGGMRRALVYRPAMLSMVAIAAVCVCVALLFKSSPKVYYVFQPFSWESLEYGSI

SEQ ID NO: 200332 - protein, 485 aa, Glycine max
  Coding DNA Sequence Number=SeqID_83554
  Gene Ontology: Mol. function=transcription regulator activity; Cellular component=nucleus; Biological process=regulation of transcription
  Homolog annotation: Hit_ID=Q7Y1W6; Match level="QueryCoverage=79%, HitCoverage=68%, E-value=1e-137, Identity=56%"; Hit description=PPR2
  Pfam annotation: Domain name=PPR; Domain location=129-163; Score =11.6; E_value=0.31; Accession=PF01535.11; Description=PPR repeat
  Pfam annotation: Domain name=PPR; Domain location=164-197; Score =19.1; E_value=0.016; Accession=PF01535.11; Description=PPR repeat
  Pfam annotation: Domain name=PPR; Domain location=199-233; Score =33.3; E_value=8.3e-07; Accession=PF01535.11; Description=PPR repeat
  Pfam annotation: Domain name=PPR; Domain location=234-268; Score=9.2; E_value=0.61; Accession=PF01535.11; Description=PPR repeat
  Pfam annotation: Domain name=PPR; Domain location=270-304; Score =18.4; E_value=0.026; Accession=PF01535.11; Description=PPR repeat
  Pfam annotation: Domain name=PPR; Domain location=305-339; Score =23.8; E_value=0.00063; Accession=PF01535.11; Description=PPR repeat
  Pfam annotation: Domain name=PPR; Domain location=340-374; Score =27.2; E_value=5.8e-05; Accession=PF01535.11; Description=PPR repeat
  Pfam annotation: Domain name=PPR; Domain location=375-409; Score=6.8; E_value=1.2; Accession=PF01535.11; Description=PPR repeat
  Pfam annotation: Domain name=PPR; Domain location=410-444; Score =32.9; E_value=1.1e-06; Accession=PF01535.11; Description=PPR repeat
  Pfam module annotation: Pfam domain module=PPR::PPR::PPR::PPR::PPR::PP R::PPR::PPR::PPR; Domain location=129-163::164-197::199-233::234 -268::270-304::305-339::340-374::375-409::410-444
  Subcellular localization annotation: CTP_CleavageSite=35; ConfidenceScore=5.82e-01
MASMSLSLSCSILPSPILHTKPKPNTNLTTLVSVSASKTSVSASSTRKPAPAPKPPKVREFPQTLFFENLEKTRIKKKKKMKEETKSGKAWVHSLPEVLSYRIHKRHWSIALELFDMLREQPYYQPREDTYMKLIVLLGKSSQPLRAHELFNSIHEDGCGSTELYTALIAAFCQNNLVDEALSILDEMMNLPSCQPDIFTYSTLIKALVDSLKFEMVELLFDKMAKRSIVPNTYTQNLILSGYGKAGRFDQMEKIVSSMMEGTTCKPDVWTMNTVISVFGDKGQIDIMEKWYDKFCSFGIQPQRSTFNILIAAYGSKRMYDKMSSVMQCMRRVKCPWTTSTYNNVIEAFAAVGDAENMERAFDQMYAEGLKADTKTFCFLINGYANAGIFHKVISSVSLAEKLQIRVNTSFYNAIISACAKDDALTEMERFFKHMKEKECHPDNTTYSVMIEAYRKEGMNDKIHYLEQEKRMMMSDDKKLNETGD

SEQ ID NO: 200333 - protein, 155 aa, Glycine max
  Coding DNA Sequence Number=SeqID_83555
MIDPGSHLMKLGRDIQILWCLGNVVVYYTEFDEFKEELERRHWDEKLTDFADNNIDIAIVKEFYANLYDPEDKSPKQVTVRGHLVKFDEDTLNTFLKTPIILEEGENLCTYSRFALLRPDPQELDAKLCIPGRGFELNADGQPLKILWKNMTTLA

SEQ ID NO: 200334 - protein, 1016 aa, Glycine max
  Coding DNA Sequence Number=SeqID_83556
  Gene Ontology: Mol. function=DNA binding; Cellular component=nucleus; Biological process=regulation of transcription, DNA-dependent
  Homolog annotation: Hit_ID=Q1SEQ4; Match level="QueryCoverage=100%, HitCoverage=85%, E-value=1e-133, Identity=46%"; Hit description=SBP
  Pfam annotation: Domain name=SBP; Domain location=147-225; Score =178.1; E_value=2.2e-50; Accession=PF03110.5; Description=SBP domain
MESQLEGKNQYLYGPVVPEMKSVGKRSLEWDLNDWKWDGDLFTARQLNSVPSDCRSRELFPTDPEILATGGASNSLSSAYDDANLGEGKRELEKRRRGVNDDGGVEMNDGAGSLNLNLGGQVYPIMEGEEKSGKKTKMTASTSSRAVCQVEDCRADLSNAKDYHRRHKVCDMHSKATQALVGNVMQRFCQQCSRFHVLQEFDEGKRSCRRRLAGHNKRRRKTLPDATVVNGGSLNEEKGSSYLLMSLLRILSNMHSNGSDNMRNQDVLSHLLRNLASLAGTINGRNIVSLLEGSQGLVKAGTSGAAQNVPNTNSDGPEPSRPFDSFIKMDDGLIHRDPPESMVQRETTPANDMAKKCIASGSDGVGSLKSPSVPQSSNVLLSRDGLPPQSVAAQTTVGRIGLSNIDLNNVYDDVQDYVENTRNSCPPLPSGNGSLDHPLWIQCDSLKSSPPQTSRNSDSTSTQSPSSSSGEAQSRTDRIVFKLFGKAPNDFPHALRSQILNWLSHSPTEIESYIRPGCIILTIYLRLENSAWEELCYNLESSLRKLAAPNDYFWRTGWIYTRVQHSVAFLYNGQVVLDAPLRLKSPQNCQILCVKPLAVSASSSAQFVVKGFNFLLSNTRNKYIFNNKEFRGETVLDNAMFVIWSWLKALEKGFNVPFQVWSSNARMNFVGGGRDRKALGGFFVVGTFFEGEEREGGIGRGFESSRSSLCEGMGEGCCTQPYPCICKEAVSGFEPMTNKSPRHNFTAAPGFALKNLLCEGKYLVQDSCYDLIDSADAVNGHQELQHLSFSCHVPNVTGRGFIEVVEDNGLSSCSFPFIVAEQEICLEICTLDNVIEAAEMADDNQIKTNLMEEKTQALYFIQEMGWLLHRSRVKVRLGPMAPVQDRFHFNRFIWLVGFSMDHDWCAVMKKLLNIIFEGTVDTGDHASVELALLEMGLLHKAVKRNCRPMVEILLKFVPVKASDGGDSNEKQVNKSPDRFIFRPDTVGPVGLTPLHVAASMHGSENVLDALTDDPGM

SEQ ID NO: 200335 - protein, 75 aa, Glycine max
  Coding DNA Sequence Number=SeqID_83557
MDPNNSYTPKTSKDARINPEIMEKQPMIAKSKHAASFIMGGGRSLQSKSEGKLKGREEEEEERQNRKWREMGEKE

SEQ ID NO: 200336 - protein, 133 aa, Glycine max
  Coding DNA Sequence Number=SeqID_83558
  Gene Ontology: Mol. function=DNA binding
  Homolog annotation: Hit_ID=Q1S0F5; Match level="QueryCoverage=91%, HitCoverage=23%, E-value=3e-15, Identity=39%"; Hit description=IMP dehydrogenase/GMP reductase
MLADLYDTFDRRCEKSNTRIVCCTPTLYVWLLSHLFRQEVRHACPLESHRSCTEKGGANWDQLLASKEGASVNWFPRWKEGRTGVLISCGGFPNVPLIGTRGCISYIPVLAIRQLGYPMRGAPIEEEIAPVIS

SEQ ID NO: 200337 - protein, 102 aa, Glycine max
  Coding DNA Sequence Number=SeqID_83559
  Subcellular localization annotation: CTP_CleavageSite=42; ConfidenceScore=5.12e-01
RPFPPASSCRRGIVLGSACRPQQGHQVPPTNRAFIKKFCVSRQAQGETPQQPGDGRQRATDAPPSPLEFTSAHPQKGLSIAYTTWPTNRRPSPKPKDAPSCS

SEQ ID NO: 200338 - protein, 108 aa, Glycine max
  Coding DNA Sequence Number=SeqID_83560
MWAIIDQYKEKLNLAATHEQRLEDEYAKVSVLQVEREARERVIYSLHREVMMWMDRFAFTLNGSQELPRLLAKAKAMADVYSAPEEVHGLLDYCQHMINLMAHIIRNR

SEQ ID NO: 200339 - protein, 89 aa, Glycine max
  Coding DNA Sequence Number=SeqID_83561
MLVSYLFLKIRVLIVPELDASLSMERPSFDGLEALLVLGTPETVAIKLRGGTGPFSHDVPPRSLRGKLFRSHFLRGRSFGKLVYKEMLF

SEQ ID NO: 200340 - protein, 83 aa, Glycine max
  Coding DNA Sequence Number=SeqID_83562
MAKFDPDIVLEFYANAWSTVEGVRDMRSWVRGQWIPFDVDALSQFLGDPLVLEEGQECEFSQWRNRVDGFDEEAIAQLLCTPG

SEQ ID NO: 200341 - protein, 211 aa, Glycine max
  Coding DNA Sequence Number=SeqID_83563
  Gene Ontology: Mol. function=DNA binding; Cellular component =chromatin; Biological process=chromosome organization and biogenesis (sensu Eukaryota)
  Homolog annotation: Hit_ID=Q9LTA2; Match level="QueryCoverage=71%, HitCoverage=54%, E-value=6e-14, Identity=32%"; Hit description =Similarity to AT-hook DNA-binding protein
  Pfam annotation: Domain name=DUF296; Domain location=87-210; Score =67.3; E_value=5e-17; Accession=PF03479.5; Description=Domain of unknown function (DUF296)
  Subcellular localization annotation: CTP_CleavageSite=79; ConfidenceScore=5.49e-01
MTNNSMAISTSQNSVSFDLDLTSSWLNHTSSSSQCPRCPPSPATNQPLENLPLTNPPTKKPHGRPAGSKNKPKITPFLVAQPVEPCMKVIIVNVTPSSDIIESILDVAHRGHVSLTVLSASGTITGVTLNNSSHGVDALTLRGPFTLLSLNGSYLYNNHYALHPGATPAPPLSFGISFSTSQGQVFGGAIGGRVIADNDVSLTICTFKNPV

SEQ ID NO: 200342 - protein, 74 aa, Glycine max
  Coding DNA Sequence Number=SeqID_83564
MPTQTLTPSSPPPTTSGCHHEPSLLATKPPQEEEHFNQSGILRIHLKDSVKNNPSIHYFVASLRVFLHFLGKPL

SEQ ID NO: 200343 - protein, 60 aa, Glycine max
  Coding DNA Sequence Number=SeqID_83565
MEMPIGMSALVILTSFVNVQVHEIMCRKLGLMMKHNLKWKRLQQITRNGHNTFYNLNIMN

SEQ ID NO: 200344 - protein, 287 aa, Glycine max
  Coding DNA Sequence Number=SeqID_83566
  Gene Ontology: Mol. function=electron transporter, transferring electrons within the cyclic electron transport pathway of photosynthesis activity; Cellular component=plasma membrane light -harvesting complex; Biological ...
  Gene Ontology: Cellular component=process=photosynthesis, light reaction
  Homolog annotation: Hit_ID=P56761; Match level="QueryCoverage=92%, HitCoverage=75%, E-value=1e-152, Identity=97%"; Hit description =Photosystem II D2 protein (Photosystem Q(A) protein)
  Pfam annotation: Domain name=Photo_RC; Domain location=29-286; Score =309.1; E_value=8.1e-90; Accession=PF00124.9; Description =Photosynthetic reaction centre protei
MTIALGKFTKDENDLFDIMDDWLRRDRFVFVGWSGLLLFPCAYFALGGWFTGTTFVTSWYTHGLASSYLEGCNFLTAAVSTPANSLAHSLLLLWGPEAQGDFTRWCQLGGLWTFVALHGAFALIGFMLRQFELARSVQLRPYNAIAFSGPIAVFVSVFIIYPLGQSGWFFATSFGVAAIFRFILFFQGFHNRTLNPFHMMGVVGVLGAALICAIHGATVENTLFEDGDGANTFRAFNPTQAEETYSMVTANRFWSQIFGVAFSNKRCNWFMDECSWGSRFGPEPTCL

SEQ ID NO: 200345 - protein, 174 aa, Glycine max
  Coding DNA Sequence Number=SeqID_83567
MAIKVQREYDELRDVNMATTEALERETKRAGKEEHGQNKFQGTLWGSNSELKLRRDEKDQSRLSETEGHMWAIIDEYKEKLNLAATHEQRLEDEYTKISAEREARERVIDSLHREAMMWKDRFAFTLNGSQELPRLLAKAKGMADVYSAPKEIHGLLNYCQHMIDLMAHIVRSR

SEQ ID NO: 200346 - protein, 144 aa, Glycine max
  Coding DNA Sequence Number=SeqID_83568
  Homolog annotation: Hit_ID=O04892; Match level="QueryCoverage=49%, HitCoverage=13%, E-value=4e-20, Identity=69%"; Hit description =Cytochrome P450 like_TBP
RGGRCKTQGASPGGAVVGADLGGTGEARLIALCARTPKGNRPAHPGNGSAGGRVQRLEEHRTSRASGRWNNVGKGSRQNGSVTSGKGLALRAGHGGPSPEPVGCRWTARAASAARAGRRVPVGGRIGTGPWGLFPGRRTVNSEL

SEQ ID NO: 200347 - protein, 89 aa, Glycine max
  Coding DNA Sequence Number=SeqID_83569
MLLEQSFRKHFLLMKREKEEEEKKKEEKGEGDTYLHEMRKGGGGVATRGTGVVAMGVLLKKGCHHEGVLSREMSSRVERREEGGVRVGR

SEQ ID NO: 200348 - protein, 82 aa, Glycine max
  Coding DNA Sequence Number=SeqID_83570
  Subcellular localization annotation: CTP_CleavageSite=64; ConfidenceScore=5.42e-01
MARKPKQDFSISKPKQKKIQTALPLPHVAFLSPSFSIEAPNKASTFGAHFCSKSRKEGIFGVVKCVATSGTSKFQGLGRYDG

SEQ ID NO: 200349 - protein, 253 aa, Glycine max
  Coding DNA Sequence Number=SeqID_83571
  Gene Ontology: Mol. function=5-methyltetrahydropteroyltriglutamate -homocysteine S-methyltransferase activity; Biological process =methionine biosynthetic process
  Homolog annotation: Hit_ID=Q6F6Z8; Match level="QueryCoverage=50%, HitCoverage=43%, E-value=3e-59, Identity=77%"; Hit description=5 -methyltetrahydropteroyltriglutamate-homocysteine methyltransferase
FDEPAFNVFFDEVNDWGIAALERAIEGLKCETAVHICYGYGIKANTDWKKTLGTEWRQYEEIFPKLQSSGIDIVSLECQNSRVPMDLIELIRVAATLRKALQFVDADKLYPSTNCGMTPLSRHVAYGLTRNALFVSYSVRRQREVIYAAAFHAALTLIQPACVNNSRIDSSVHAVFRAFILKGLPGMLQSQSSRLGSLLLLLAALIGFAVALYAWLTPLTGVTGTIGALGVTIASVVLAVLTFLLRAATGRTG

SEQ ID NO: 200350 - protein, 96 aa, Glycine max
  Coding DNA Sequence Number=SeqID_83572
  Subcellular localization annotation: CTP_CleavageSite=27; ConfidenceScore=5.01e-01
YGVPVAPSKIIRPPTNRAFIKKYCGPRQVQGKTPQQPGDGRQRATNALPSPLEFTAAHPQKATKSKAKGKQSTRSVTDKPSSIQLKTLKKRYWEAT

SEQ ID NO: 200351 - protein, 199 aa, Glycine max
  Coding DNA Sequence Number=SeqID_83573
  Subcellular localization annotation: CTP_CleavageSite=29; ConfidenceScore=5.08e-01
ASQGSFVAHGRQDVMTVAIGRPEHPGRVRAARVGVTIKQYFGPTPRTSCTSSSMAPKDLEQQMQKIRDQLEESITEKMQSKGLALPPEPEVGPSAAHVSTKKSCVDPSGNDPDTGDSEKYGLYIEENPPRLVALGKLYEGSTTVHNMPLRHDQVKVGVEEVRDAYVPILVPIKEVQLVGQTLNTFVVWPTYLEKRLSEQ

SEQ ID NO: 200352 - protein, 34 aa, Glycine max
  Coding DNA Sequence Number=SeqID_83574
MSAENISRGNVRSASSDDAPVLNLDRITFLADVG

SEQ ID NO: 200353 - protein, 107 aa, Glycine max
  Coding DNA Sequence Number=SeqID_83575
KHKGYVSGSLSDEGKVGLGGDSGKSESSLEKGLVDRSDASDVDAKVDNMARCFRTNQRILVLSAAKVAKKMKLKFTKEWIAYLRLPLPIDVYKELKHYILKHGANVM

SEQ ID NO: 200354 - protein, 105 aa, Glycine max
  Coding DNA Sequence Number=SeqID_83576
  Gene Ontology: Mol. function=ribonuclease H activity; Biological process=DNA integration
  Homolog annotation: Hit_ID=Q1SAS4; Match level="QueryCoverage=98%, HitCoverage=5%, E-value=2e-29, Identity=52%"; Hit description=RNase H, putative
MEVVLPFEVEIPSLRILVESGLKELEWAQAHFDQLNLIEGKRLAAMSHGCLYQRRVKNAFDKKVRPRRFSEGDLAFSERALVLTNMNDEELPSPVNADVIKRYYA

SEQ ID NO: 200355 - protein, 65 aa, Glycine max
  Coding DNA Sequence Number=SeqID_83577
MGAKHLTRTKEWSHVIEQRSPDEIRLEELGQFVYVDEVFQQTHLRKDIGQFVNDRSRRTHVRPLP

SEQ ID NO: 200356 - protein, 162 aa, Glycine max
  Coding DNA Sequence Number=SeqID_83578
  Subcellular localization annotation: CTP_CleavageSite=48; ConfidenceScore=5.08e-01
MGENALHLKYKSCTPNTPLFMLVVLTFLLVVLTFLLVAPFACFRDDVQASSPLGSICFHWRLIMVKTRELGRALARVMGRALGREDHHDLDDVLQRRRPTTSARRQREAAPIAEDDPMLTEDVHAHAEEVVDDVEGFPSGLCDPSVLTDYGDHVVVIVWNEE

SEQ ID NO: 200357 - protein, 224 aa, Glycine max
  Coding DNA Sequence Number=SeqID_83579
  Homolog annotation: Hit_ID=Q8ZL16; Match level="QueryCoverage=99%, HitCoverage=82%, E-value=8e-26, Identity=33%"; Hit description =Putative cytoplasmic protein
MKINIELDPEAFGAHRQELFRNADFAVSAHRCAERGPMLTLANCRGALTVLPYEGLAIWDAEFDGYSLKSGRRSARGLGRKRADDAAFCPAWPSHDGAPLQMQRVWLQLTGDELTLHGEGERLGGRWRIGPALRLAAQSAQFAIEMKVTNLAERPQPLRYVCRLNYDCIPDAVFRQNLPTPALLGDAIGQELLCSDDLTRYVDQAEFFMLTPQGRRYVTRFATG

SEQ ID NO: 200358 - protein, 79 aa, Glycine max
  Coding DNA Sequence Number=SeqID_83580
MDFLCLVGTSAKPTKHRGRARKASIAARPTKTIHARYAVPSLLYAVQTSCGILDHSCNSAQGGETSGGKIWFSSPERTS

SEQ ID NO: 200359 - protein, 105 aa, Glycine max
  Coding DNA Sequence Number=SeqID_83581
MIESFEQQQEMSVIELCVEVDVVGASAINFTNSLLSCGNNMSHNESGSARVGTNSEEDFDDDDDYLIYNSYVEDSLDEDEDIDEISDTNEAARLIEPLTVVQSGE

SEQ ID NO: 200360 - protein, 124 aa, Glycine max
  Coding DNA Sequence Number=SeqID_83582
MWAIIEQYKKKLSLAATHEQRLEDEEAMMWMDRFAFTLNGSLELPRLLAKAKAMGDVYLTPKEVHGLLDNLNTLTKHALRHPYQTHSKTGIMVEIEEVQEKTNVDIEALKDQMDSMMEAMLSMK

SEQ ID NO: 200361 - protein, 77 aa, Glycine max
  Coding DNA Sequence Number=SeqID_83583
MNATNNIKTNLPLIESAKEFMGLVGERSQTTDKSLARTLEEMRLKNQGSHLVHYVSHQGNQGVEKKFVKKHDKGKGP

SEQ ID NO: 200362 - protein, 124 aa, Glycine max
  Coding DNA Sequence Number=SeqID_83584
  Pfam annotation: Domain name=zf-CCHC; Domain location=72-89; Score =28.5; E_value=1.9e-05; Accession=PF00098.13; Description=Zinc knuckle
MTTKENDKKKKGIALKASSSSIHEENDKEDSNEKNLEEDDDFSLFVKKFNKFLRNKGNFNPKKKGENSSLVPKCYECNQPGHLRFDCPIFKRIWKNLIRKISMIRKKRNHTSIGKIMTWIHQVI

SEQ ID NO: 200363 - protein, 214 aa, Glycine max
  Coding DNA Sequence Number=SeqID_83585
  Gene Ontology: Cellular component=mitochondrion
  Homolog annotation: Hit_ID=Q8TGM6; Match level="QueryCoverage=56%, HitCoverage=97%, E-value=1e-09, Identity=43%"; Hit description =Protein TAR1
  Subcellular localization annotation: CTP_CleavageSite=51; ConfidenceScore=5.50e-01
MSRVDRRTGSHRSTSDRDTSPAPIRFPPDNFKHSLTLFSKSFSSFPRGTCSLSVSRQYLALDGIYRPIGAAFPNNPTRRQRLVVRQGPGTTGLSPSLAPPSRGLGPGPPLRTLLQTTIRTPRATDFHGGLFPVRSPVTKGNPCRRALGLMASGATCVQRLDGSRDSAIHTKYRISLRSSSMQEPRYPLPRVIVCKCCVVTTPAGHRLRAPGSRT

SEQ ID NO: 200364 - protein, 283 aa, Glycine max
  Coding DNA Sequence Number=SeqID_83586
  Gene Ontology: Mol. function=transferase activity, transferring glycosyl groups; Biological process=metabolic process
  Homolog annotation: Hit_ID=Q66PF2; Match level="QueryCoverage=97%, HitCoverage=84%, E-value=4e-47, Identity=45%"; Hit description =Putative UDP-rhamnose:rhamnosyltransferase
LPLPHVDQLLENVEATVDIPQHIVPYLKKAYDGLQEPLTKFLERCKPDWIIFDFAPYDTLKGSLVFALRSCMEIEGESLKLFESICGKLVIPVGLLPLSLQFSEDNNNADNWNTFLNWLDKQEKRSVVYVAFGSEVTLSDEEFTKVAMGLELSGFPFFWALRKQNTSAIESQDWVLSEFKRGMVWRTWAPQLRILVHMPQWLNARLIEEKRVGVKVPRNEHDGKFTRDLVTKALRLVMLEEEGKTYRSQAEKMSKIFGDKELPQNYVDEFVDYMEIHRPAVKD

SEQ ID NO: 200365 - protein, 77 aa, Glycine max
  Coding DNA Sequence Number=SeqID_83587
ANPLSGVFWKTREDFFRNFRKKVFWKLSGRRILPKVTKGHLEEHFFRKASKTPYSGNFPEEVVLPENFRNKVLPDDL

SEQ ID NO: 200366 - protein, 51 aa, Glycine max
  Coding DNA Sequence Number=SeqID_83588
MAGMIMVTITIVTMVVDNSDSSVHGNDKRDSGAMVVLAIMAMNVANCRKGQ

SEQ ID NO: 200367 - protein, 76 aa, Glycine max
  Coding DNA Sequence Number=SeqID_83589
MTRRLQEDLARDAGEGSRVLISLRWNLQSPFLLLHFAAIDLQEAKDSIDEEDLRPTSFTWSYVKTEEGREPSSSNL

SEQ ID NO: 200368 - protein, 389 aa, Glycine max
  Coding DNA Sequence Number=SeqID_83590
  Gene Ontology: Mol. function=oxidoreductase activity; Cellular component=membrane; Biological process=electron transport
  Homolog annotation: Hit_ID=Q2MIZ8; Match level="QueryCoverage=99%, HitCoverage=70%, E-value=1e-161, Identity=75%"; Hit description =Cytochrome P450 monooxygenase CYP711A12
  Pfam annotation: Domain name=p450; Domain location=1-381; Score=67.5; E_value=4.3e-17; Accession=PF00067.12; Description=Cytochrome P450
MQSFIESATQNLDSQKEDIIFSNLSLRLATDVIGHAAFGVNFGLSRPHSVCDSIKSVNVNNNNNNASASSSSNDNEVSDFIDQHIYSTTQLKMDLSGSLSIILGLLLPILQEPFRQILKRIPGTMDWKIERTNQKLSGRLDEIVEKRMKDKARSSKDFLSLILNARETKAVSENVFTPDYISAVTYEHLLAGSATTSFTLSSVVYLVAGHPEVEKKLLHEIDGFGPVDQIPTSQDLHNKFPYLDQVIKEAMRFYTVSPLVARETSNEVEIGGYLLPKGTWVWLALGVPAKDPKNFPEPEKFKPDRFDPNCEEMKRRHPYAFIPFGIGPRACIGKQFSLQEIKISLIHLYRKYLFRHSPNMENPLELQYGIVLNFKHGVKLRVIKRTETC

SEQ ID NO: 200369 - protein, 55 aa, Glycine max
  Coding DNA Sequence Number=SeqID_83591
MTRQITHWVILFGENAQTMWDRHMLKGALKPGVFIPKAYTPNSPSVPLPPDSGPT

SEQ ID NO: 200370 - protein, 53 aa, Glycine max
  Coding DNA Sequence Number=SeqID_83592
MSESQCRNPKLYCILIRNKLVEDNTEEEIMRSILKRQQEVDNTVRHIRRTMID

SEQ ID NO: 200371 - protein, 89 aa, Glycine max
  Coding DNA Sequence Number=SeqID_83593
  Gene Ontology: Mol. function=oxidoreductase activity; Cellular component=membrane; Biological process=electron transport
  Homolog annotation: Hit_ID=Q2MIZ8; Match level="QueryCoverage=90%, HitCoverage=14%, E-value=7e-20, Identity=65%"; Hit description =Cytochrome P450 monooxygenase CYP711A12
MVVFMDYLEWLFAIPSVPSASAMFTLLALIGGLLVYLYAPYWGLRKVPGPPSLPLVGHLPLLAKYGPDVFSVLAKQYGPIYRCLLASIQ

SEQ ID NO: 200372 - protein, 344 aa, Glycine max
  Coding DNA Sequence Number=SeqID_83594
  Gene Ontology: Mol. function=sequence-specific DNA binding; Cellular component=nucleus; Biological process=regulation of transcription, DNA-dependent
  Homolog annotation: Hit_ID=P41152; Match level="QueryCoverage=86%, HitCoverage=84%, E-value=1e-68, Identity=48%"; Hit description=Heat shock factor protein HSF30
  Pfam annotation: Domain name=HSF_DNA-bind; Domain location=28-144; Score=10.1; E_value=6.6e-11; Accession=PF00447.8; Description=HSF -type DNA-binding
  Subcellular localization annotation: CTP_CleavageSite=17; ConfidenceScore=5.20e-01
PATVSSFGTLTSSLPPSCLATSSTTISPASYDNSTPTKIDPDKWEFANEGFLAGQRQLLKTIKRRRHVTVTQTQSHEGGSGACVELGEFGLEGEMERLRRDRTVLMAEIVRLRQQQHNSREQLLSMETRLQATEKKHQQMMNFLAKALNNQAFIQQFLQRNAQNKELQGARRKRRLTATPSVENLQQDHFALSIEEGSATIESQMESFFSAACNDPLESNSELKDPILSSVPVASGSNLGEVSDSVWEDLLNQDLVAGDPEEEVVIGDFSQVDVPVEDLIADADEWSEDLQNLVDHMAAKMVILVEEVVDRYCLIIRILCKEYDVLVGYSKADVQWGVIDWEKK

SEQ ID NO: 200373 - protein, 203 aa, Glycine max
  Coding DNA Sequence Number=SeqID_83595
MAIITALCSDRFRRKKSPSPPPPSSDPIEIAQELDATIPSNNETENENNNNNNEEEEQVKELPLPPALQQHPKDPFISDRMKRVTSERKAPLSLSIKMPRSLSVAKNWEQKEDKNKGTNIGGKLKAEDSVWMKTIILGEKCVPDEEDDPVIFEGRGKRISAYHSKRHSTMSISRQTSFLEPDALPKPLSVPQSRTHDETTSSA

SEQ ID NO: 200374 - protein, 267 aa, Glycine max
  Coding DNA Sequence Number=SeqID_83596
  Gene Ontology: Mol. function=tyrosine decarboxylase activity; Cellular component=cytoplasm; Biological process=metabolic process
  Homolog annotation: Hit_ID=Q84MC2; Match level="QueryCoverage=76%, HitCoverage=95%, E-value=3e-93, Identity=80%"; Hit description =Lysine decarboxylase-like protein At5g11950
  Pfam annotation: Domain name=Lysine_decarbox; Domain location=55-188; Score=226.4; E_value=6.3e-65; Accession=PF03641.4; Description=Lysine decarboxylase family
MEEGYPRSKFKTVCVFCGSNSGNRQVFGDAAIQLGNELVKRNIDLVYGGGSVGLMGLISQRVYDGGCHVLGIIPKALMPLEISGETVGEVRIVSDMHERKAAMAQEADAFVALPGGYGTMEELLEMITWAQLGIHKKPVGLLNVDGYYNCLLALFDNGVKEGFIKPCARNIVVSATSAKELMMKMEHYTPSHEHVAPHQSWQMKQLGNIQMQSETVIDGRQKYLEMERDDKHFVSRISVVRNGLAPLCSALIRQDRLIKDNLQFWPT

SEQ ID NO: 200375 - protein, 187 aa, Glycine max
  Coding DNA Sequence Number=SeqID_83597
  Gene Ontology: Cellular component=membrane
MWESIVLTVVATAGNNIGKILQKKGTVILPPLSFKLKACHKGICFEQNLGDRFSNGYIWGTVDVKGISSCAWSSGLLPRFLSRTNRISRFLYRSEFEPKPKRVGAGGEEQEAAALSIFHIPWLAFVVFILFVETLVQIMLNGWLRIFKRNRREQEMMDIFHFLHLPQLLNVVIKIMTIKCFTLNVII

SEQ ID NO: 200376 - protein, 63 aa, Glycine max
  Coding DNA Sequence Number=SeqID_83598
MQDGICNIKDGVSVLGARLPQAVGSYLHHHKCLFKWYRLLLPAYGTFSNLWMLGRGDFQSNWL

SEQ ID NO: 200377 - protein, 158 aa, Glycine max
  Coding DNA Sequence Number=SeqID_83599
  Homolog annotation: Hit_ID=O64580; Match level="QueryCoverage=67%, HitCoverage=94%, E-value=1e-12, Identity=40%"; Hit description =Expressed protein
MEEFQRSRSYANGQMMQIESYYGAPRPYDLSLRTYSASYAQTQIGPPRDLKLKKGKSISAGSSFSKSWSFADPELQRKKRVASYKMYSVEGKIKGSFRKSFRWLKNKYSHVCLVCWLGESKYNNGCDIDEPGIFQYFTSFSCEIWLAVGMNWSGWREY

SEQ ID NO: 200378 - protein, 46 aa, Glycine max
  Coding DNA Sequence Number=SeqID_83600
MTGVNRYDVGTLVGQAAISRKIQGLLSWLGWRQKDHNLMLVNMMLR

SEQ ID NO: 200379 - protein, 91 aa, Glycine max
  Coding DNA Sequence Number=SeqID_83601
  Subcellular localization annotation: CTP_CleavageSite=24; ConfidenceScore=5.10e-01
MRTRSPLKARACSPLQARMCSPLMARTYSPLKVIGTSTQGSTFMRKHEIDSSRGPIDCPFEKGDNSCNLILSLANFSENSLRVYVLFDLVT

SEQ ID NO: 200380 - protein, 271 aa, Glycine max
  Coding DNA Sequence Number=SeqID_83602
  Gene Ontology: Mol. function=dopamine beta-monooxygenase activity; Cellular component=integral to membrane; Biological process =histidine catabolic process
  Homolog annotation: Hit_ID=Q1SA84; Match level="QueryCoverage=93%, HitCoverage=94%, E-value=1e-95, Identity=71%"; Hit description =Cytochrome b561 / ferric reductase transmembrane
  Pfam annotation: Domain name=Cytochrom_B561; Domain location=38-223; Score=-77.7; E_value=0.036; Accession=PF03188.6; Description =Cytochrome b561
MSVAGPQVKCIHRILTSLFHNFNSPMTCHCMAYEEEHHSSSHKSTNNKIYKVNQQKTSDIAVHGLLLWASTGFLMPLGILIIRGSIKAEPGSRRSIVLFYLHVGFQMLSVLLATVGAAMSLKKFENSFDNSHQKLGLALYGAILVQGLIGFFRPHRGKKERSYWYLLHWILGTIVSLVGIINIYTGLKAYHKRTLKSTTLWTILFTVEVSFIGLVYLLQDKLEYMKKQGVIIGSESSIVSSNQDIPQSQTQKELLPVACGRKRNALENLFD

SEQ ID NO: 200381 - protein, 373 aa, Glycine max
  Coding DNA Sequence Number=SeqID_83603
  Gene Ontology: Mol. function=oxidoreductase activity; Cellular component=chloroplast; Biological process=metabolic process
  Homolog annotation: Hit_ID=Q8FVZ4; Match level="QueryCoverage=92%, HitCoverage=76%, E-value=1e-153, Identity=79%"; Hit description =Aldehyde dehydrogenase family protein
  Pfam annotation: Domain name=Aldedh; Domain location=18-370; Score =364.4; E_value=1.9e-106; Accession=PF00171.12; Description=Aldehyde dehydrogenase family
MLQKNLIQKTDFYIDGAWRAPVEAKSIEVINPANEKPYAVISAGSAKDIDLAVAAARKAFPSWSETSAADRIGYIRRLVEIYEARLEEMAKAISLEMGAPITLARESQAAAGLSHTKAFIAAFENFEFEELLSPKFPNQTIVREPIGVCGLITPWNWPMNQIALKVIPALAVGCTVILKPSEIAPMSAMLFAEFVDEAGFPQGVFNLVNGEGAVVGEALSQHPDVDMMSFTGSTRAGTAVSRAAAATVKRVSLELGGKSPNIVFADADLEKTIARSLAHCFENTGQSCNAPTRMLVERSVYDKAVELARKVAEGTKVGDPAEEGDHIGPLSSSIQFEKVQKLIQKGIDEGARLVAGGTGRPDGFTEGDFVKPT

SEQ ID NO: 200382 - protein, 207 aa, Glycine max
  Coding DNA Sequence Number=SeqID_83604
  Homolog annotation: Hit_ID=Q47522; Match level="QueryCoverage=20%, HitCoverage=53%, E-value=4e-19, Identity=100%"; Hit description=LacZ protein
DLPSQWLLFLSAVPPVQLLTGWCVTAKAPPDISAGKCSGRVPFAIQAAQLLGRAIGAGLFAITPAGERGMCCKAIKLGNARVFPVRQAWGGAPLAGRGGRAPALSRPRRVAGALGTSVASVGNGAPRQDRGGRVPSARVPGSLDARGRLLPPRPPIKLIDTVDLEGGPVGKPVVPAALMNRPTRGERRFAYWALAECILAYYVGTDE

SEQ ID NO: 200383 - protein, 101 aa, Glycine max
  Coding DNA Sequence Number=SeqID_83605
MLPFDFRCVTETYGLCINIFLVFRHVLEFHKLPNDGCQAPHKDQRMVACHQAKDRTCTTLNGRACTLLKVRACSPLNARTCYPLNARACSPLKARTCIPLK

SEQ ID NO: 200384 - protein, 252 aa, Glycine max
  Coding DNA Sequence Number=SeqID_83606
  Gene Ontology: Mol. function=chitin binding; Cellular component =extracellular region; Biological process=chitin metabolic process
  Homolog annotation: Hit_ID=UPI000044A8F0; Match level="QueryCoverage =98%, HitCoverage=99%, E-value=1e-27, Identity=23%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
  Pfam annotation: Domain name=Leu_leader; Domain location=171-194; Score=2.5; E_value=8.3; Accession=PF08054.2; Description=Leucine operon leader peptide
  Pfam annotation: Domain name=Leu_leader; Domain location=18-42; Score= 7.5; E_value=1.2; Accession=PF08054.2; Description=Leucine operon leader peptide
  Pfam annotation: Domain name=Leu_leader; Domain location=51-74; Score= 4.9; E_value=3.3; Accession=PF08054.2; Description=Leucine operon leader peptide
  Pfam module annotation: Pfam domain module=Leu_leader::Leu _leader::Leu_leader; Domain location=171-194::18-42::51-74
RGPHALTFRGLYVLTFRVLHALAFRGLLVLAFRGLLVLAIRGLHVLTFRGLHVLTFRGLDAFTFRGLEVLAFRGMHALGFRGLDVLAFRGLHAFAFRGLDVLVFRGLDVLAFKGLHVFTFRVLYVLTFRGLDVLAFRGLHALAFKGLRAPTFRGLRALTFRGLHVLTFRGLHVLTFRGLHALAFRGLHVLAIRGQHVLAFRGLHILTFIGLHVLTFRELLVLTFRGLRALTFKGLHVLALRGLHAFTFKGRY

SEQ ID NO: 200385 - protein, 53 aa, Glycine max
  Coding DNA Sequence Number=SeqID_83607
MEKDEQILEQNGIDMKSLSLKAGEERSKRPKNGDIYREVAANVQNIEKRLKYL

SEQ ID NO: 200386 - protein, 134 aa, Glycine max
  Coding DNA Sequence Number=SeqID_83608
MNQKSTHVARVGGLCSSTDHHIDLCPSLQQSGVNEQPEAYDANIYNRPPQQQNQQQHNNYDLSSNKYNPGWRNHPNLRWTSPPQQQQHVPSFQNVAGPSKSYVPPPMQQQQQQSQQRQPATEAPPQPFLEELVR

SEQ ID NO: 200387 - protein, 84 aa, Glycine max
  Coding DNA Sequence Number=SeqID_83609
MGLREGDPMESFLFSIVAEGLSGMMREAIAKKLFHKYPIGRDDIEVDEFSFSILEDPSGSKSKGRGDLVTNLEGNRQEISKVEA

SEQ ID NO: 200388 - protein, 368 aa, Glycine max
  Coding DNA Sequence Number=SeqID_83610
  Gene Ontology: Mol. function=carbohydrate binding; Biological process= carbohydrate metabolic process
  Homolog annotation: Hit_ID=Q1SPM1; Match level="QueryCoverage=99%, HitCoverage=72%, E-value=1e-84, Identity=48%"; Hit description =Glycoside hydrolase, starch-binding
  Pfam annotation: Domain name=CBM_20; Domain location=71-159; Score =9.5; E_value=1.4e-05; Accession=PF00686.10; Description=Starch binding domain
MMKALTSSCSKAMVETLGPFSPRVPLCVSDRPEFCFTLRSKNEKKGWNLLLLKLVRNNDLYPVHAVPPKDQVDLETVEPQAQQSEQTIGGDPVLGSWDPLEALPMTWSEGHVWAVELDMPAGQTFQYKFILKGEGGDIIWQPGSDRLIHTWETMNRIVVLEDWENVELQEITEEDQLAEPNEEPQVDFEVPTLAEFLNNPQEELDSKALEISSVGDTQIHAVEEPLAETVRQQITGNSISSSMEKPMSIVVENISSSEDLISSISHKSNKKSILQPSEESADSPGNDDIIHDLGQNGNAASLENQEKTIVESSLFDLEEGPVLVPGLTIPPTEPTDEADQGEVQETTKKDTSVEAFETQDQNIAEVNT

SEQ ID NO: 200389 - protein, 253 aa, Glycine max
  Coding DNA Sequence Number=SeqID_83611
VCSHSNPSQKIRVGRRCNPQGDPTNQLPCALRVYSPVDSHTCQTPWSVFQDGPNGEPTGRRQERAGAEARQGRALPSTIAMMTSPRAYQQPGLGPPSQSASVNVPSRSADRLSPFHIRPGHIAGPHPLPSRQFQALFDSLFKVLFIFSLAGTCSLSVSRPVFSLGRNLPPDWGCIPKQPDSPTAPRGATGSGHDGALTLSGAPFQGTWARSATEDASPDYNSDAEGDRFSWWAFPGSLAVTKGILVSFFSSAY

SEQ ID NO: 200390 - protein, 255 aa, Glycine max
  Coding DNA Sequence Number=SeqID_83612
MDISEDIDILVILGRPFMLTASCIVDMGKRKLELGFEDQKIDFDLFVEDKLAPEHNVCLQLYSLCAFSTLKHQSYTVQMSSRKRKSGGSRPTTQYDTRRFHSFEAWTRYTDNVLGKHILAERKVEIYHTELDEFKGELERRNFHKRLTNLADSSIDLALVKEFYANLYNPKGPSPKQVRIRGHLIRIDADNLNAFLETPVVLAEGESFPVYSRYCRMPTDTREIEAALCIPDRGFILNAEGHPGKILRKDLTTLA

SEQ ID NO: 200391 - protein, 772 aa, Glycine max
  Coding DNA Sequence Number=SeqID_83613
  Pfam annotation: Domain name=Rho_N; Domain location=732-770; Score =24.7; E_value=0.00032; Accession=PF07498.2; Description=Rho termination factor, N-terminal doma
ASGSNYWSQHPECDFYFGCGRDLIEEDALNVESCVRVLRILITKADTEIEELERDLLFLQNELACAEHEKWPDICRAVLTERINRLDVAVSTLKNDHTDDAEMQPLLDSEPAETLHEILAQSLDMKMLSPIVNLDKDSSTFDSNIIIKGEEKELHGTSESSGSSELLLELHGKRSDNPEKIEELSEKSLVRSPDLGAIIHAPDHSVETKLSETFDNDVTGNEEVRRSQHISTDIGQVLDLFSAKDDENIPNGVKKGNEFVKEKDVSSDDFRPAIGVKGRKEYPHSRLVTSQQRKGEPDHSDWMKLSETSDSKLAGNEEVGRSQLINTDIGQMLDLFSAKDNGNIPSEVKEENEVVKQKDVSSDDFRPAIGIKGREEYPHSRLATSQQKSGPESPDHSDWMKLSETSDNKVAGNDVERSQLNDTDIGQILDVFSAEDNENIPSEAQKENEFVKDVSSDDSRPATDIKVRKKYPNSRLATSPQRKCRNSNLDKKLCDIAPKTARKAYKKQSKVAPDKDLNSMDLPLQVFYPQTFCSANTEFCSFKGSNGIQTKSALYTDLQLIDEDEEEQEAQDLKSQITTKFRKLNMSFPSKLKAREKQELELEAFSSREPYDSCTEVIQSTPIIVSTKRQRRSKPCNDVAILTEPMNRKKISRRAVQPDKHETEGGAIVPYDSNFSELQKRRKVSKLPITVDMETNSDRVSMDSGSQLVLHTSKLHSLVDSHDGTSSLLPGDLNSLSLTDLRAMAKDHKVKQYYKLRKGALVEQLAKQFRSC

SEQ ID NO: 200392 - protein, 86 aa, Glycine max
  Coding DNA Sequence Number=SeqID_83614
MRKGSTFVFYFFTWKTTKKAATENESGETEGSVVISYTATWARGSGGALFDWASSWAVDFFQVLFLSPNGVHTSTLFFATRLFYFF

SEQ ID NO: 200393 - protein, 383 aa, Glycine max
  Coding DNA Sequence Number=SeqID_83615
  Homolog annotation: Hit_ID=Q00M75; Match level="QueryCoverage=7%, HitCoverage=4%, E-value=3e-08, Identity=100%"; Hit description=PPR -repeat containing protein
  Pfam annotation: Domain name=MAM33; Domain location=194-369; Score= -47.9; E_value=0.081; Accession=PF02330.6; Description=Mitochondrial glycoprotein
MGGGESLSRKYGRLASNSEERSCRVQEMGHLEGDSWEMIDELMDLIQLKVPKKEIKHRRLWKGIKSKSYSVKEVYETLQQQSNNEESDFFKNLWSTPAPSKTKTKEALKKRRIVMENNDYMCMLCNQTEESIAHLLFESNFWYQEIEKVAYVIKTLVKSEGEVAVELSLQKMERTRSLGRESKKSFVFSSKTWLELEVEDKRDKKGKCKVGSFIDMRVETRGKGNESEEGELRREERVMNQKRVSEVAGGSGMRREEEGEALGERKGFPAKKRKEGEKEFLTIYPLWTLSPGAAVKLCLGDLLVMGSNPETASLHMQGTLDDELQDALKEYLIAKGIGVSLTNFLLHYLHKREHEQYMNWLKKGEAAFVAKEGSLRESSELHS

SEQ ID NO: 200394 - protein, 133 aa, Glycine max
  Coding DNA Sequence Number=SeqID_83616
  Homolog annotation: Hit_ID=Q00M75; Match level="QueryCoverage=21%, HitCoverage=4%, E-value=5e-09, Identity=100%"; Hit description=PPR -repeat containing protein
MVQYTAYFSFRPFGDMERQRPKEQYIAEVVEKEIGQAYPNALGYQVFLESILQLIIQCASHGCRQDNEQVLHKKKLRTPLPGGSSLCEGMGEGCCTQPYPCICKEAVSGFEPMTNKSPRHNFTAAPGLKVHKG

SEQ ID NO: 200395 - protein, 1011 aa, Glycine max
  Coding DNA Sequence Number=SeqID_83617
  Gene Ontology: Mol. function=hydrolase activity, acting on acid anhydrides, catalyzing transmembrane movement of substances; Cellular component=integral to membrane; Biological process=calcium ion transport
  Homolog annotation: Hit_ID=Q8W0V0; Match level="QueryCoverage=96%, HitCoverage=94%, E-value=0.0, Identity=83%"; Hit description=Type IIB calcium ATPase
  Pfam annotation: Domain name=Cation_ATPase_C; Domain location=847 -991; Score=76.7; E_value=7.4e-20; Accession=PF00689.11; Description =Cation transporting ATPase, C-terminus
  Pfam annotation: Domain name=Cation_ATPase_N; Domain location=85-164; Score=50.3; E_value=6.5e-12; Accession=PF00690.16; Description=Cation transporterATPase, N-terminus
  Pfam annotation: Domain name=E1-E2_ATPase; Domain location=177-418; Score=228.5; E_value=1.5e-65; Accession=PF00122.10; Description=E1 -E2 ATPase
  Pfam annotation: Domain name=Hydrolase; Domain location=422-751; Score=61.2; E_value=3.5e-15; Accession=PF00702.16; Description =haloacid dehalogenase-like hydrolase
  Pfam module annotation: Pfam domain module=Cation_ATPase_C::Cation _ATPase_N::E1-E2_ATPase::Hydrolase; Domain location=847-991::85 -164::177-418::422-751
MTWIEKPKIRDQPTPWECCPSRDRLEKTHWSSSEEKFRIALYVQKAALQFIDAGNRVEYKLSSEVRDAGFGIHPDEIASIVRGHDNKTLNDIGGVESIARKLLVSVDGGVNEESINSRQQIYGFNRYTEKPSRSFLMFVWDALQDLTLIILMVCAVVSIGIGIATEGWPKGTYDGVGIILSIFLVVIVTAVSDYKQSLQFRDLDKEKKKIFVQVNRDGKRQKISIYDIVVGDVVHLSTGDQVPADGIFISGYSLLIDESSLSGESEPVNINEEKPFLLSGTKVQDGQGKMLVTTVGMRTEWGKLMETLNQGGEDETPLQVKLNGVATIIGQIGLTFAILTFVVLTVRFVVEKALHGEFASWSSDDAKKLLDFFAIAVTIIVVAVPEGLPLAVTLSLAFAMKKLMNDKALVRHLSACETMGSASCICTDKTGTLTTNKMVVTKAWICEKSMEIKGNESADELKTCTSEGVLNILLQAIFQNTSAEVVKDKNGKDTILGTPTESALLEFGCLLGADFDAYAQRREYKILQVEPFNSVRKKMSVLVGLPDGGVRAFCKGASEIILKMCDKIMDCNGEVVDLPEDRANNVSAVINAFASEALRTICLAFKEINETHEPNISDSGYTFIALVGIKDPVRPGVKEAIQTCIAAGITIRMVTGDNINTAKAIAKECGLLTEGGLAIEGPDFRDLSPEQMKDVIPRIQVMARSLPLDKHRLVTNLRKLFGEVVAVTGDGTNDAPALCEADIGLAMGIAGTEVAKENADVIIMDDNFTTIVNVVKWGRAVYINIQKFVQFQLTVNVVALVINFFSACITGSAPLTAVQLLWVNLIMDTLGALALATEPPNDGLLKRPPVARGANFITKPMWRNIIGQSIYQLIILGILNFDGKRLLGLSGSDATKVLNTLIFNSFVFCQVFNEINSRDIDKINIFRGMFDSRIFLAIIFATVAFQVVIVEFLGTFASTVPLNWQFWLLSVVIGAVSMPIAAILKCIPVERDTSKQHHDGYEALPSGPELA

SEQ ID NO: 200396 - protein, 269 aa, Glycine max
  Coding DNA Sequence Number=SeqID_83618
  Gene Ontology: Cellular component=membrane
  Homolog annotation: Hit_ID=Q59IV5; Match level="QueryCoverage=77%, HitCoverage=56%, E-value=2e-68, Identity=78%"; Hit description =Plastidic phosphate translocator-like protein2
  Pfam annotation: Domain name=DUF6; Domain location=66-199; Score= -0.6; E_value=0.071; Accession=PF00892.11; Description=Integral membrane protein DUF6
MSTHGSYSMRSKASFENEAKATGKESGVVIKMEIQGGGGGSGGGGKSGKTMSPNSKENLFIVFLVTLWYSSNIGVILLNKYLLSNYGFKFPIFLTMCHMSACAVLSYISIVFFKVVPQQMIKSRSQFIKIATLSLVFCASVVGGNISLKYLAVSFNQAVGATTPFFTAVFAYLATLKREAWVTYGALIPVVAGVVIASGRHVNAASCSLCHSRSGVVLDRLGDGGLCDLVDLDCLKGRARVSLIWIHYVPKCNCRKSLQVCPSEHFTFF

SEQ ID NO: 200397 - protein, 79 aa, Glycine max
  Coding DNA Sequence Number=SeqID_83619
  Homolog annotation: Hit_ID=Q8W0V0; Match level="QueryCoverage=77%, HitCoverage=5%, E-value=9e-20, Identity=80%"; Hit description=Type IIB calcium ATPase
MERTLLKNFELEHKNPSVEALRRWRSAVTFVKNHRRRFRMVADLDKRVEAEQIKQGIKKSLRKLSLKTVKNKMELATRV

SEQ ID NO: 200398 - protein, 68 aa, Glycine max
  Coding DNA Sequence Number=SeqID_83620
MACNLAIFHGLKLAISRHIAQEMNALEDALANYGMSLDSGGLRILDCVLDFLYLHLLADDSATLFSNL

SEQ ID NO: 200399 - protein, 67 aa, Glycine max
  Coding DNA Sequence Number=SeqID_83621
MVWTWHTANIHMVLFHTYNEIEDCKVISGKATGKSMVMDEVDAIRLPMVIKSQSESSTLININSHLA

SEQ ID NO: 200400 - protein, 261 aa, Glycine max
  Coding DNA Sequence Number=SeqID_83622
MKSKGCWNEEIGKWEKSLRRMAKMWASQVSWLHNWLSWCCLEFEEYIKTSHKPVALEVTEESKQLEDTNFKSELYINKLWVLLTSALRALVKKLKRESIYVEIIGEHKKSHRQHDFAHSNKSISHFSFLTNAFRALVSICHKLFGKLQINDLRPDFDVYLPNSRFRKSSPGDPSFLLYLSRGIHAGRHATSLCGMCGWGWGLVRCWWVAMWLFYFSKGHPSRAEIEALERQCGGIPLKICLATEGRVSFFSFDKVELPVLP

SEQ ID NO: 200401 - protein, 244 aa, Glycine max
  Coding DNA Sequence Number=SeqID_83623
  Gene Ontology: Mol. function=transferase activity, transferring glycosyl groups; Cellular component=integral to membrane; Biological process=metabolic process
  Homolog annotation: Hit_ID=Q8S3B9; Match level="QueryCoverage=92%, HitCoverage=52%, E-value=7e-89, Identity=70%"; Hit description =Putative glucosyltransferase
PYLELIKRIISSKTHWALGPFNPLSIEKGVYNTKHFSVEWLDKQEAGSVLYVSFGTTTCFSEEQIKEVANGLEKSKQKFIWVVRDADKGDVFIEDGVRTSELPKGFEERVKGTGLVVRDWAPQLEILSHSSTGGFMSHCGWNSCMESITMGVPIAAWPMHSDQPRNRVLVTEVLKIGVVVKDWDHRDELVTASDVENAVRRLIATKEGPGMKGVFLAWNWMISLRTSLDSLVQIHVIYKPGVCF

SEQ ID NO: 200402 - protein, 151 aa, Glycine max
  Coding DNA Sequence Number=SeqID_83624
MSILSALSSSSLLHHLICHAAILKVEDSYFVALFTSSFLHCYHGTTKVTDELVQIILGQVWNLEFQRPFLSLLVTIPEYILSGSHNLQRYFWCRKRCWNPTCSSKPKSLIAVGDWMRPYWVLLIPVPPTVSLHQWHPRKHCFQEKSEEEAQ

SEQ ID NO: 200403 - protein, 96 aa, Glycine max
  Coding DNA Sequence Number=SeqID_83625
  Gene Ontology: Mol. function=nucleic acid binding; Biological process= DNA integration
MSNLTSKLKALKLELVSYNTEKDEWSINELISYCVQEEERLQKDRFESAHLSLTSHDKRKTKGALNKRKMKNSLATSIGTYEEKLYKVRCMACKER

SEQ ID NO: 200404 - protein, 96 aa, Glycine max
  Coding DNA Sequence Number=SeqID_83626
  Subcellular localization annotation: CTP_CleavageSite=55; ConfidenceScore=5.01e-01
MKSGDMRRYPSSYPQKRFLSSRPVKSGQRVKWQAVIPYGPPHLSSTEANEFDGIRMMLVFTLVVLRHSSPTTHEILLYWAGTIQFDSVWKRRGYPI

SEQ ID NO: 200405 - protein, 106 aa, Glycine max
  Coding DNA Sequence Number=SeqID_83627
MKLGGRRRHPSGYPYKHTFAIRQPKSPVMYEDTQAVIRTNGFCHPDPLSQVTCRDTQAVIHTNGFCHPDPWSQVTCGVPYGYPHLSLTSGKRARWRAETNIVFCTF

SEQ ID NO: 200406 - protein, 118 aa, Glycine max
  Coding DNA Sequence Number=SeqID_83628
MDRMGCRFTFPKQLAKHVGRGASLMCNILHLSSFLGRRSFWCECGITSFLIEESLMAHSTSLIFMGRSFSPLPKTKVSVSGRLVSRSSAGLRIQAVQENGGPRRLVDIIRLVPELSRN

SEQ ID NO: 200407 - protein, 165 aa, Glycine max
  Coding DNA Sequence Number=SeqID_83629
  Gene Ontology: Mol. function=transcription factor activity; Cellular component=nucleus; Biological process=regulation of transcription, DNA-dependent
  Homolog annotation: Hit_ID=Q38Q39; Match level="QueryCoverage=90%, HitCoverage=81%, E-value=2e-28, Identity=48%"; Hit description =Ap2/EREBP transcription factor
  Pfam annotation: Domain name=AP2; Domain location=10-73; Score=108.5; E_value=2e-29; Accession=PF00847.10; Description=AP2 domain
MASSSSSKRHPLYHGIRCRGGKWVTEIREPRKTNRIWLGTFLTPEMAAAAYDVAALALKGNEAVLNFPDSVGRYPVPASNSPSDIRFAAIAAAELMKPEANNNNNVNASTTNNAAVQSDSNDVLPSFETEFMDEEAIFSMPSLLVDMAGGMLLSPPRMSPPSDNE

SEQ ID NO: 200408 - protein, 541 aa, Glycine max
  Coding DNA Sequence Number=SeqID_83630
  Gene Ontology: Mol. function=drug transporter activity; Cellular component=membrane; Biological process=multidrug transport
  Homolog annotation: Hit_ID=Q1SB90; Match level="QueryCoverage=94%, HitCoverage=93%, E-value=0.0, Identity=68%"; Hit description=Multi antimicrobial extrusion protein MatE
  Pfam annotation: Domain name=MatE; Domain location=297-460; Score =156.8; E_value=5.6e-44; Accession=PF01554.9; Description=MatE
  Pfam annotation: Domain name=MatE; Domain location=75-236; Score =130.7; E_value=4.2e-36; Accession=PF01554.9; Description=MatE
  Pfam module annotation: Pfam domain module=MatE::MatE; Domain location=297-460::75-236
MRQLSPTSNFCERNEGHPNASNHKVQDEPNMLTTLIPKSPTCQLHQMQNPHNNINTTHLSLSLVEAKCIANISFSMILTGLLLYSRSVISMLFLGHLGELALAGGSLAIGFANITGYSVLSGLAMGMEPICGQAFGAKRFKLLGLTMQRTVLLLLITSCLISLFFWLNMKKILLLCAQEQDIANEAELYIFYSLPDLVLQSLLHPLRIYLRSQSITLPLTCCAAVSILLHVPVNYLFVSILNLGIKGVALSAVITNLNLVVLLIIYIVFSGTHKKTWPGISRECFNGWKKLLNLAIPSCVSVCLEWWWYEIMILLCGLLVNPHASVASMGVLIQTTALIYIFPSSLSFGVSTRVGNELGAGNPRRAKLAAIVGLCFSFVFGLSALAFAVSVRNVWASMFTLDGEIIALTTAVLPIIGLCELGNCPQTTVCGVLRGTARPKLGANINLGCFYLVGMPVAVWLGFFAGFDFKGLWLGMLAAQGSCIVTMMFVLARTNWEGQALRAKELTSSDPREEKKLVEEEHEEKGFLGSCATKEASDLVV

SEQ ID NO: 200409 - protein, 172 aa, Glycine max
  Coding DNA Sequence Number=SeqID_83631
  Gene Ontology: Mol. function=transferase activity
  Homolog annotation: Hit_ID=Q6EP89; Match level="QueryCoverage=56%, HitCoverage=21%, E-value=4e-24, Identity=56%"; Hit description =Membrane bound O-acyl transferase-like
MHHRSSNEVAKSEEEGEDAASRTIEEHGGVAKEHGDEEVEVGGEAEGEVGEGDADDGGVEVLGEAAGEEAAEEAEGHGGGEAEEEAEHGDRDSDGSGHRIHGHGSKKKKKKKKIYLWCFLQLKLSIAQNISEMTRLPPTKYHASLLCVTSTSYGSFLVRTLSCLLWKLRLFF

SEQ ID NO: 200410 - protein, 336 aa, Glycine max
  Coding DNA Sequence Number=SeqID_83632
  Gene Ontology: Mol. function=protein binding; Biological process =protein modification process
  Homolog annotation: Hit_ID=Q1S0J6; Match level="QueryCoverage=75%, HitCoverage=84%, E-value=1e-54, Identity=44%"; Hit description =Ubiquitin; Apoptosis regulator Bcl-2 protein, BAG
  Pfam annotation: Domain name=BAG; Domain location=201-279; Score =28.5; E_value=2.4e-05; Accession=PF02179.6; Description=BAG domain
MKKRLLILGKSRFFLLSSFSLPPREEPLQIHPFCPEKTLDHTALFHFTHKAWTAVKESTIHNMFSRGRGSDIGGHGNTNVAEWELRPGGMVVQKRNSDLNQNSASKFTIKVKVKYGSSYHQIQISSHASFGELKKMLTEPTGLHVQDQKLIYKKKERDSKSYLDVERVKDGSKLVLVVDIESRERRILETLKIAKEKTSKSLTEIKVEVDKLAKKVAALEAAASTGGVIAELDIETLTENLMRTLIALDEINGEGELKLQRREQVRRVQKHIETLDMLRMARENSISLKNEEKNLARESKVHCGDHMQGRQGNPKKQQPLKHSESVVVTTKWETFD

SEQ ID NO: 200411 - protein, 603 aa, Glycine max
  Coding DNA Sequence Number=SeqID_83633
  Gene Ontology: Mol. function=methyltransferase activity; Biological process=metabolic process
  Homolog annotation: Hit_ID=Q6X0N8; Match level="QueryCoverage=100%, HitCoverage=91%, E-value=0.0, Identity=70%"; Hit description =Putative spermine/spermidine synthase
  Pfam annotation: Domain name=Methyltransf_11; Domain location=65-168; Score=55.2; E_value=2.1e-13; Accession=PF08241.2; Description =Methyltransferase domain
  Pfam annotation: Domain name=Methyltransf_12; Domain location=65-166; Score=11.7; E_value=0.04; Accession=PF08242.2; Description =Methyltransferase domain
  Pfam annotation: Domain name=TPMT; Domain location=22-207; Score= -83.7; E_value=0.094; Accession=PF05724.2; Description=Thiopurine S -methyltransferase (TPMT)
  Pfam module annotation: Pfam domain module=Methyltransf _11::Methyltransf_12::TPMT; Domain location=65-168::65-166::22-207
MGSKGKKKGSPEDILETLGDFTSKENWDKFFTLRGDSFEWYAEWPNLRDPLLSLLKTVPLPLQLLVPGCGNSRLSEHLYDAGHTAITNIDFSKVVISDMLRRNVRDRPLMRWRIMDMTAMQFEDESFGAVIDKGGLDALMEPELGPKLGNQYLSEVKRVLKPGGKFVCLTLAESHTFYFPLLLLKDSWYKVSGLHEALQNENQIREKYSSGSNLLYSVEDLQEELTKLSQGRRLQLTLGGQGYSTFSYRAVILDAEEQASPFTYHCGVFIVPKTRAREWLFYSEEGQWMVVRSSEAARLIMVYLDASHSDTSMEEIQKDLSPLVTQLAPAENENGAKIPSVTSSLTGSIIVEDVIYENVDSESEALLKDEQSPTKLVSETGRKKNNASSKSRKSGSQRHSIGASSQLTVYHGYVASSYHTGIISGFTLISSYMENVASSGKMASLGAGLLSMFLHGCIPFLEIETVELDPMIVDIARDYFSFVEDKRLKVHVADGIQFVREIDSSGAPQIHGKSNDPSNTESALNASSTVSHAGVKVTKVDIIIVDVDSSDPSSGLTCPAPDFLDESFLETVKDKLSEDGLFVVNLVSRSQAIKDMALSKMKK

SEQ ID NO: 200412 - protein, 318 aa, Glycine max
  Coding DNA Sequence Number=SeqID_83634
  Gene Ontology: Mol. function=transferase activity; Cellular component= Rab-protein geranylgeranyltransferase complex; Biological process =protein modification process
  Homolog annotation: Hit_ID=Q6Z8L7; Match level="QueryCoverage=99%, HitCoverage=98%, E-value=1e-122, Identity=67%"; Hit description =Putative Rab geranylgeranyltransferase, beta subunit
  Pfam annotation: Domain name=Prenyltrans; Domain location=115-147; Score=2.9; E_value=2; Accession=PF00432.11; Description =Prenyltransferase and squalene oxidase re
  Pfam annotation: Domain name=Prenyltrans; Domain location=201-244; Score=54.3; E_value=4.2e-13; Accession=PF00432.11; Description =Prenyltransferase and squalene oxidase re
  Pfam annotation: Domain name=Prenyltrans; Domain location=249-293; Score=56.3; E_value=1e-13; Accession=PF00432.11; Description =Prenyltransferase and squalene oxidase re
  Pfam annotation: Domain name=Prenyltrans; Domain location=52-95; Score=52.5; E_value=1.4e-12; Accession=PF00432.11; Description =Prenyltransferase and squalene oxidase re
  Pfam module annotation: Pfam domain module=Prenyltrans::Prenyltrans::P renyltrans::Prenyltrans; Domain location=115-147::201-244::249 -293::52-95
MGELATEKHVRYILSVEKRKDNFESVVMEHLRMNGAYWGLTTLDLLGKLHTVDVDEVVSWLMSCQHDSGGFGGNVEHDPHILYTLSAVQVLSLFDKLDVIDVDKVTSCILTHILPRFEDIVSLQNEDGSFSGDMWGEVDTRGSSLCEGMGEGCCTQPYPCICKEAVSGFEPMINSCKNMDGGFGCTPGGESHAGQRSLDLVDKDLLGWWLCERQVKSGGLNGRPEKLPDVCYSWWVLSSLIMIDRVHWISKEKLIKFILDCQDTENGGISDRPDDAVDVFHTFFGVAGLSLLEYPGLKPVDPAYALPVDVVNRIIFTK

SEQ ID NO: 200413 - protein, 378 aa, Glycine max
  Coding DNA Sequence Number=SeqID_83635
  Homolog annotation: Hit_ID=Q1SYZ1; Match level="QueryCoverage=12%, HitCoverage=14%, E-value=6e-13, Identity=65%"; Hit description=Myb, DNA-binding; Calcium-binding EF-hand
MRTREKKCKPIACHVNSVHHVRDPVAYPWQWNWKDDSTKVQNMRHQYKDVFRGTVALAVGGHGGNELMGIEDGDHGDRDGDNGDGFLAGGGGMDMVEFGQMGHSGDGDFGAALDGVDNEVMGLGFEIEGEEGEVNYNGSGGREREDAAENGFLFEEEGEVTGSSLKKKRKVAKGMEKKAWRILANQLGQLREMETRFEQREVERERERQRRENLRVELDKQWERKLEEREKEREEREKERDKLRRQRMAEWEAMEKENEEMERKRREEELIHEREWEERMNCRRLEWKKRVDEMLSQHRAEMGQMQTRFLHEQQNLTNQLLGIFSQWPAQPSGLSDHTSASNHYLSQMMQNLHHVNGIVHGDARVEGDNQEDQFIVDG

SEQ ID NO: 200414 - protein, 91 aa, Glycine max
  Coding DNA Sequence Number=SeqID_83636
MFFLFFFLLLFSSSASTKTFSDSDSGCIENAKIVQQLTNRMILSETVKIRKKKKDGACLPFQSERRSGVIFRESEIFSRKEYRNNKSVGNE

SEQ ID NO: 200415 - protein, 981 aa, Glycine max
  Coding DNA Sequence Number=SeqID_83637
  Homolog annotation: Hit_ID=Q9LIR7; Match level="QueryCoverage=43%, HitCoverage=42%, E-value=1e-122, Identity=56%"; Hit description =Arabidopsis thaliana genomic DNA, chromosome 3, BAC clone:F14O13
  Pfam annotation: Domain name=Filamin; Domain location=77-174; Score =57.6; E_value=4.2e-14; Accession=PF00630.9; Description =FilaminABP280 repeat
  Pfam annotation: Domain name=RRM_1; Domain location=341-405; Score =58.1; E_value=3e-14; Accession=PF00076.12; Description=RNA recognition motif. (a.k.a. RRM, R
  Pfam module annotation: Pfam domain module=Filamin::RRM_1; Domain location=77-174::341-405
MGDRGSGAAKPIWMKQAEEAKLKSEAEKAAAAKAAFEATFKALENKHDKGGGSVADSDSDSEEEYEDLAHKPIGPVEPAKCTAAGTGIAGGTACAPSSFVVVTKDADERKVSGGGAQIKVRVTPGLGVGGTEQEGMVKDMGDGTYTVTYVVPKRGNYMVSVECNGRPIMGSPFPVFFSAAGNSTGGLLGLAPASSFPNLVNQTMPNMPNYSGSVSGAFPGLLGMIPGVVAGASGGAILPGIGASLGEVCRDYLNGRCAKVDCKLNHPPHNLLMTALAATTSMGTLSQAPMAPSAAAMAAAQAIVAAQALQAHAAQVQAQSAKDSAGSPEKASKDDALKKTLQVSNLSPLLTVEQLKQLFGFCGTVVECAITDSKHFAYIEYSKPEEATAALALNNIDVGGRPLNVEMAKSLPQKPSVANSSLASSSLPLMMQQAVAMQQMQFQQALLMQQSMTAQQAATRAATMKSATELAAARAAEISKKLNPDGVGSEEKETKQNSSIGGHLGGAAIIEYELTYLGEFLVDRSSSPPRGRSRSKSRSPISYRRRRRSRSYSPARHSKDHRSRSPLRPHHYSSYDRERRSYRDIREHSDRYRRRDSDRSLDHRSSASRRNRSRSVSPYTRKSPVSPKCHRETSPHRGRKQSRVDSGSPSHRRGSRPSPKIDEKKLRNRRRSRSRSSDDRLHSSKNEEVLHGKSKRRERRRSKSLSVDEKPHRRSRSSPRKVDESRSRHKKRSSSKSVDDRHDSPERLDENRNRRLRHSDKRHSRSRSTDNRDQTDVREDESKNEKSKHRDTKRSRSKSVEGKRRSKDKSGENRDKKSKHHDRRRSRSISLEDKHDKGGTSLHINLDERNFELTKSPEGKNHYSDKYGNRGEKSEHQKKTPSKSKSGQFDGSGPLRGNYKEDDSKGKSPSDSGSAEVKHHLNDGESATSEENSKLFGDVFQEPIINAKDSAILNDNGTLTSVNGNYKSEGSSENAGADDNP

SEQ ID NO: 200416 - protein, 271 aa, Glycine max
  Coding DNA Sequence Number=SeqID_83638
  Gene Ontology: Mol. function=protein binding; Cellular component =integral to membrane
  Homolog annotation: Hit_ID=Q5N7I7; Match level="QueryCoverage=97%, HitCoverage=73%, E-value=2e-86, Identity=60%"; Hit description =Putative NTS2 protein
  Pfam annotation: Domain name=DUF6; Domain location=19-124; Score=1.6; E_value=0.054; Accession=PF00892.11; Description=Integral membrane protein DUF6
  Pfam annotation: Domain name=DUF803; Domain location=3-271; Score =517.5; E_value=1.5e-152; Accession=PF05653.4; Description=Protein of unknown function (DUF803)
  Pfam module annotation: Pfam domain module=DUF6::DUF803; Domain location=19-124::3-271
MGASSDNVTGFVLAVCSSVFIGSSFIIKKMGLKKAGATGKRAGAGGHAYLYEPWWWFGMISMIVGEVANFAAYAFAPALLVTPLGALSIIFSAILAHFILKERLHIFGVLGCALCMVGSTTIVLHAPHERVIHSVKEVWQLATEPGFLIYMCIVVVVVCILIFYCAPRYGTTYLVIYVGICSLTGSITVMSVKAVSIAMKLTLEGNNQFIYFQTWFFTIIVIGCCLLQINYLNKALDTFNTAVVSPIYYVMFTSFTIFASIIMFKGKVKLK

SEQ ID NO: 200417 - protein, 188 aa, Glycine max
  Coding DNA Sequence Number=SeqID_83639
  Gene Ontology: Mol. function=transferase activity, transferring groups other than amino-acyl groups; Cellular component=cellular _component; Biological process=flavonoid biosynthetic process
  Homolog annotation: Hit_ID=P17957; Match level="QueryCoverage=77%, HitCoverage=50%, E-value=2e-43, Identity=56%"; Hit description =Chalcone synthase 2
  Pfam annotation: Domain name=ACP_syn_III; Domain location=117-168; Score=-18.9; E_value=0.059; Accession=PF08545.1; Description=3 -Oxoacyl-[acyl-carrier-protein (ACP)
  Pfam annotation: Domain name=Chal_sti_synt_N; Domain location=1-154; Score=123.6; E_value=5.5e-34; Accession=PF00195.10; Description =Chalcone and stilbene synthases, N-te
  Pfam module annotation: Pfam domain module=ACP_syn_III::Chal_sti_synt_ N; Domain location=117-168::1-154
MRVHTTNAGSISFSIQLCIILSFYVYIYIHQEQRAELNEEILKENPSVCAYMTPSLDTRQDMVIVEVPKLGKEAATKTIKEWGQPKSKITHLIFCTISGVHMPGADVPTRLLCRWLRLVENNKGARVLLVWSEITAVAALFGDGAAAGIVGSDPLPTILPDSEGAINGHLGLGEVGLTFHLLKVDRQF

SEQ ID NO: 200418 - protein, 192 aa, Glycine max
  Coding DNA Sequence Number=SeqID_83640
  Gene Ontology: Mol. function=transcription factor activity; Cellular component=nucleus; Biological process=regulation of transcription
  Homolog annotation: Hit_ID=Q9CAN3; Match level="QueryCoverage=86%, HitCoverage=26%, E-value=7e-50, Identity=57%"; Hit description =Transcription factor SCARECROW, putative; 52594-50618
LHKTLHDGSGGALRDFLGLIRSTKPSVVVVAEQEAEHNHTRLEARVCNSLKYYSALFDSIEESGLPIESAVRVKIEEMYGKEIRNIIACEGRERVERHESFGNWRRMMVEQGGFRCMSVTERELSQSQMLLKMYSCESYSVKKQEKEGATGVTLSWLEQPLYTVSAWGPVDAAAEYDIQTDTRKGRGQGRRV

SEQ ID NO: 200419 - protein, 311 aa, Glycine max
  Coding DNA Sequence Number=SeqID_83641
  Gene Ontology: Mol. function=hydrolase activity, acting on carbon -nitrogen (but not peptide) bonds, in linear amidines; Cellular component=mitochondrion; Biological process=arginine metabolic process
  Homolog annotation: Hit_ID=P46637; Match level="QueryCoverage=99%, HitCoverage=99%, E-value=1e-134, Identity=72%"; Hit description =Arginase
  Pfam annotation: Domain name=Arginase; Domain location=73-310; Score =308.9; E_value=9.4e-90; Accession=PF00491.12; Description=Arginase family
MSIITRRGIRYMPRLDAAKVSAALLEKGQNRVIDASLTLIRERAKLKASLHESNINAEVVFLQGELVRALGGAKATSTLLGVPLGHNSSFLQGPAFAPPRIREAIWCGSTNSTTEEGKELQDARVLTDVGDVPIQEIRDCGVDDHRLMNVIGESVKLVMEEDPLCPLVLGGDHSISFPVIRAVSEKLGGPVDVLHLDAHPDNYDAFEGNIYSHASSFARVMEGDYKLGEGVKGVYISIDVDCLDPAFAPGVSHIEPGGLSFRDVLNILHNLQGAVVAGDVVEFNPQRDTVDGMTAMVAAKLVRELAAKISK

SEQ ID NO: 200420 - protein, 170 aa, Glycine max
  Coding DNA Sequence Number=SeqID_83642
MSAIRGGGEVTDNDNPGLDVREVAGAEHEAEEGGSVERVVDLGGGDSKEAEAICVEAVKLAFIVEARDDGLGVRERRECVLVRELEDQAIETGGVREVRGVRVGEPSFFNFAIVKEGEKLMIADSEEVGAVARWKGESGCCKRVTFIVIVPSSGISSSNYLYQVILLSKQ

SEQ ID NO: 200421 - protein, 349 aa, Glycine max
  Coding DNA Sequence Number=SeqID_83643
  Gene Ontology: Biological process=regulation of transcription
  Homolog annotation: Hit_ID=Q9CAN3; Match level="QueryCoverage=59%, HitCoverage=30%, E-value=2e-22, Identity=37%"; Hit description =Transcription factor SCARECROW, putative; 52594-50618
LSVMNIRTPTPLRNGHISPTSLNGHITPYLCTVGCESDGVGAKGTTTYGDGDSARVDHGVVKKKKKKKKCIPQHGANACLKREVGLFNVYPLQMKDLFNVSTANMAFTISPQDYYYYYYFCHKLQVKKKQAALQKPKPQTMLAGCSSSTLLSPRHRLRSEAPAQFQACHFQLPSSMSTQRLDLPSCTTATFTRNNKDHHHHQPLRPVGLSVDQKHIEAKTSTCSLKQHIRLPPLAITASATPLVEESSIINDNNNKSLKKRLAAEHHDDSFAKRKKSSSTTECDWFQPDVVETTTLGGFNNNNTSLVSFSSEEQERVCFLPSEVVSHSAPFPLNPWLESCVTKITNFGE

SEQ ID NO: 200422 - protein, 653 aa, Glycine max
  Coding DNA Sequence Number=SeqID_83644
  Homolog annotation: Hit_ID=Q9CB00; Match level="QueryCoverage=79%, HitCoverage=89%, E-value=6e-65, Identity=37%"; Hit description=Ara4 -interacting protein
  Pfam annotation: Domain name=UBA; Domain location=4-44; Score=14.4; E_ value=0.074; Accession=PF00627.21; Description=UBATS-N domain
  Pfam annotation: Domain name=UBX; Domain location=573-653; Score =77.9; E_value=3.2e-20; Accession=PF00789.11; Description=UBX domain
  Pfam annotation: Domain name=UIM; Domain location=216-233; Score =16.6; E_value=0.091; Accession=PF02809.10; Description=Ubiquitin interaction motif
  Pfam annotation: Domain name=UIM; Domain location=259-276; Score=6.2; E_value=4.6; Accession=PF02809.10; Description=Ubiquitin interaction motif
  Pfam module annotation: Pfam domain module=UBA::UBX::UIM::UIM; Domain location=4-44::573-653::216-233::259-276
MARPNQEAVETFVSITGLTEAVALQKLEEHGGNLNEAVNAHFSEGDRNLTTGSRNSSAVFPQDDFMDIDDQHDAGIPRIPSLLPALAANVNPFSLLDPTIGRGIFGTRFDSTIEAPFVTHPREVREIPIEVKDGSQSTPQAGHVPSIEDVTGTVDAHGPDIHGTVIIDDEDDDDIPPAQIAHQDEQTQKILADTSLNSSVRPSAPESENLPDYSNDIEEEMIRAAIEASKQEAEENYRNHKLDRQIDLSESGSQPRQSYLEDPELAHAVSLSLKTAEQEKALRVHGGDSGSPTAGPSKSSEAGLGEVTSNGREKNTDAAWGVEGNWDTTADDCSPDWKVQFYVSPYVRTRSMLRELRRYFLKKRIIGVRKESRAGSLSFHDEAEDVEEQPLVRNRSRHMSSGSTGLGKDVELAEASTLPSTATVTATQDSSNPHHNGNSFPDEWGGISSEEHDEAVMLEAAMFGGIPEGTGYHYGYAPHEFMQNRGFNPRPQYRPPSPSLAAQRLIREQQDDEYLASLQADREKELKAMEEAEAAREEERQRAEDSRRKLQEEQELETKLAAKEVSLPPEPSSDDDNAVNLMVKMPDGNRRGRRFLRSDRLQSLFDYIDIGRVVKPGSYRLVRPYPRRAFSDGESAATLDELGLTNKQEALFL

SEQ ID NO: 200423 - protein, 87 aa, Glycine max
  Coding DNA Sequence Number=SeqID_83645
MYHGSPLLLTLLGPLTVRSHMLILKFLCYNDFEYVVDATELKDNPIIFYADVVSAMLICAAGEKLKVAYISSLQSLGLHNLTENSGC

SEQ ID NO: 200424 - protein, 106 aa, Glycine max
  Coding DNA Sequence Number=SeqID_83646
MGKASKWFRGLLGLKKTEYATSPAKPPKEKRRWSFVKSSYTEKDNTTAATCPPLRNNNNHAMAVAAATAAVAEAAVAAAEAAAVVVRLTSNSGSTRIKGNRIGLQE

SEQ ID NO: 200425 - protein, 165 aa, Glycine max
  Coding DNA Sequence Number=SeqID_83647
  Homolog annotation: Hit_ID=Q2NNE0; Match level="QueryCoverage=49%, HitCoverage=18%, E-value=6e-10, Identity=44%"; Hit description =Calmodulin binding protein IQD22
MGFFHLQALGSNVDPVPASCLAILIARRALRALKGLVKLQALVRGHIERKRTAEWLKRLQALLHAQTQVSAGLTLHASPSSSKLSSHLQGPETPEKFESPIRSKSMKHEHSPILKVLSCHKLPNDGEFVHYRIQVVYIHGSIYVIVEKWLQILCPDQWLSRDMWE

SEQ ID NO: 200426 - protein, 286 aa, Glycine max
  Coding DNA Sequence Number=SeqID_83648
  Gene Ontology: Mol. function=metal ion binding; Cellular component =integral to membrane; Biological process=ubiquitin cycle
  Homolog annotation: Hit_ID=Q6EPF2; Match level="QueryCoverage=77%, HitCoverage=60%, E-value=4e-65, Identity=52%"; Hit description=Ring zinc finger protein-like
  Subcellular localization annotation: CTP_CleavageSite=67; ConfidenceScore=5.42e-01
MATTTTRSPNRSSEDAAADPTPFLATSSDESTSGRLLLRRPSLREAARFLRQASGRRLMREPSMVVREAAAEQLEERQSDWAYSKPVVVLDILWNCAFVAAAATVLVLSRNENPNMPLRLWIVGYALQSVLHVACVCVEYRRRLRHREHSNAAAVSGDGSGDLSSPSMDGSGHYVSFDDDGISMAKHLESANTMFSFIWWVVGFYWVSADSEALVQDSPLLYWLCIAFLGFDVFFVVFCIALACIIGIAVCCCLPCIIALLYAVADQLTLLTLCSAKLAEKLVAES

SEQ ID NO: 200427 - protein, 177 aa, Glycine max
  Coding DNA Sequence Number=SeqID_83649
  Homolog annotation: Hit_ID=Q2R457; Match level="QueryCoverage=92%, HitCoverage=84%, E-value=5e-14, Identity=42%"; Hit description =Expressed protein
KPNVVIPPQIIAEAISMIHDIDIRAFRTLSDDGKKSPRGTLREPLFGNNLPEMDWTQLETSTLLDILNKKSSFPGSFISIPEIQAQNKVLKHCGLPDDEYLVLLKHWVSEAHRNYWRVLLDASALVLGKGRLYLGLHRPDFLVCCLDNTHSNPSRITCLLVRTKSFDTSTASSQVNG

SEQ ID NO: 200428 - protein, 66 aa, Glycine max
  Coding DNA Sequence Number=SeqID_83650
MIEPLNGFIPCKSNATLDYVVFLFQLHQLPMASLIESLDGFTPFSCKSNVIEQLEYNAIRLLLIED

SEQ ID NO: 200429 - protein, 39 aa, Glycine max
  Coding DNA Sequence Number=SeqID_83651
MATQRTWRRRKKRLGGSLLDVDTAIDTGGKLEPPVTMTG

SEQ ID NO: 200430 - protein, 161 aa, Glycine max
  Coding DNA Sequence Number=SeqID_83652
MRVPQIVSWLEMQLRALGQMTAKDVNQVETTEWCARVPQVVGWLETPQNATVWLAMQLRALPPNDIVQGGKKGGFVFDAITAAIHDTPGTTVSCDMTGFLGAGHRHDTPQHLYRVTDYYALQAILSWNLGIKHFPLFRDHGSTHNGHIYQSRSKLCNRKNS

SEQ ID NO: 200431 - protein, 64 aa, Glycine max
  Coding DNA Sequence Number=SeqID_83653
  Subcellular localization annotation: CTP_CleavageSite=23; ConfidenceScore=5.20e-01
MSSPSTTNYGDATPFAFTIDGAMCSKISTPTTTTAKSHDFYVVVGRARWFAVVGQVQILVKGGG

SEQ ID NO: 200432 - protein, 120 aa, Glycine max
  Coding DNA Sequence Number=SeqID_83654
MEPSQILSLRTTTTDPDHVKVIQWDDFQHDLARLASLSSALHEANEKKRNLQYKLEPLIQGKRVWSRGECELEWGMESRSVFDYENSWRKEIELGKGDESRDFKSRSLFSGVEVYYGWTG

SEQ ID NO: 200433 - protein, 98 aa, Glycine max
  Coding DNA Sequence Number=SeqID_83655
  Gene Ontology: Mol. function=serine-type endopeptidase activity; Cellular component=spindle pole body; Biological process=protein modification process
  Homolog annotation: Hit_ID=Q9FLP6; Match level="QueryCoverage=90%, HitCoverage=87%, E-value=1e-13, Identity=38%"; Hit description =Ubiquitin-like protein SMT3-like
  Pfam annotation: Domain name=ubiquitin; Domain location=23-91; Score =5.9; E_value=0.065; Accession=PF00240.13; Description=Ubiquitin family
MATNGPLKRKSPPDDESVNLKIKLQDGRNLFFKVNRDMKLINVFKEFCDRQKLDYETLKFIYDGFNIKGKHTAKMLNMEDDAEIVAIRPQIGGGAAAL

SEQ ID NO: 200434 - protein, 485 aa, Glycine max
  Coding DNA Sequence Number=SeqID_83656
  Gene Ontology: Mol. function=Rab GTPase activator activity; Cellular component=intracellular; Biological process=regulation of Rab GTPase activity
  Homolog annotation: Hit_ID=Q1SDX8; Match level="QueryCoverage=86%, HitCoverage=86%, E-value=1e-145, Identity=65%"; Hit description =RabGAP/TBC
  Pfam annotation: Domain name=TBC; Domain location=232-453; Score=2.9; E_value=7.9e-08; Accession=PF00566.9; Description=TBC domain
  Subcellular localization annotation: CTP_CleavageSite=44; ConfidenceScore=5.51e-01
MVKKKVPDWLNSSLWSSSSPSSPPSSAVASPFEQPPPPPPRPPSPAVVTPSEPPPRPPSPPAVHDPLPTQRIDDSPREDHGDGFRSAHDVSRQAQLLAEVPSLRLRLLLYNDIEVSLIIVKEGGGYERVAEPRVSRKNGARISALGMCIPNHLTKYASGLFPFHSNQTGCVFISLSKDMVWLLLLLLGYLPPDRGLWSAELAKKRSQYKQFKEEIFMNPSEITRKMFNSTNCDTGDANCARALLSRSEITHGEHPLSLGKTSVWNQFFQDTEIIDQIDRDVKRTHPDMHFFSGDSQFAKSNQLNPGVQYVQGMNEILAPLFYVLKNDPDEENAASAEADAFFCFVELLSGFRDNFVQQLDNSVVGIRSTITRLSQLLREHDEELWRHLEVTSKVNPQFYAFRWITLLLTQEFNFADSLHIWDTLLSDPDGPQETLLRVCCAMLVLVRKRLLAGDFTSNLKLLQNYPTTNISHLLYVANKFRVQSV

SEQ ID NO: 200435 - protein, 101 aa, Glycine max
  Coding DNA Sequence Number=SeqID_83657
  Gene Ontology: Mol. function=structural constituent of cytoskeleton; Cellular component=cytoskeleton; Biological process=actin filament polymerization
  Homolog annotation: Hit_ID=Q1W4C5; Match level="QueryCoverage=65%, HitCoverage=39%, E-value=6e-27, Identity=88%"; Hit description=Actin- related protein complex 4
  Pfam annotation: Domain name=ARPC4; Domain location=2-101; Score =29.4; E_value=1.2e-05; Accession=PF05856.3; Description=ARP23 complex 20 kDa subunit (ARPC4)
MMSYAKLQMSVIGVKQADELENILTKKFLRFLSMRAEAFQVLRRKPVQGYDISFLITNYHCEEMQKHKLIDFIVQFMEARILLTLLLGFAFYFAACSNYLN

SEQ ID NO: 200436 - protein, 68 aa, Glycine max
  Coding DNA Sequence Number=SeqID_83658
MKQAQMITEQSRIFKWLKNYFPNFTGDATQLTVYDEAQARSQDTQLRYTAYCLGWRVKNIFSFAKSHP

SEQ ID NO: 200437 - protein, 81 aa, Glycine max
  Coding DNA Sequence Number=SeqID_83659
  Gene Ontology: Mol. function=4 iron, 4 sulfur cluster binding; Cellular component=integral to membrane; Biological process=electron transport
  Homolog annotation: Hit_ID=Q9TNL4; Match level="QueryCoverage=66%, HitCoverage=18%, E-value=3e-21, Identity=83%"; Hit description =Photosystem I P700 apoprotein A2
  Subcellular localization annotation: CTP_CleavageSite=23; ConfidenceScore=5.01e-01
MSLSKYFCFSFQAISNNFSVDFRESVSSGWLHLQPKWKPSVSWFKNAESRLNHHLSGLFGVSSLAWTRHLIHVATSVSNSQ

SEQ ID NO: 200438 - protein, 202 aa, Glycine max
  Coding DNA Sequence Number=SeqID_83660
MEDEINRELDLLPSSRSESSLLRLRSAVSSSSTTDCGGGGGGGATPSLDLQLSISVRPPAAVLMCDGVDALKWQAAEQIRLAAMEKAYAERVRELTRREMEMAQSEFARARQMWERAREEVERAERIKERATRKVDSTCMEITCHSLVRLIVNNGMMINLVRQDPKLRTSMTIEQMNRNKKHSSTNHHKDEIYSCIHLYSTS

SEQ ID NO: 200439 - protein, 47 aa, Glycine max
  Coding DNA Sequence Number=SeqID_83661
MLVATPRVFLSWNTHPASHASPSRRMPEGPYHLLNCTHGALRPRMPK

SEQ ID NO: 200440 - protein, 150 aa, Glycine max
  Coding DNA Sequence Number=SeqID_83662
MRIGDTLVHNPEQVQSQSGKDFVFKPFGEDGMDAEYMSQQDLLGPPRFLFTIVEESKEDLESDDGKFKCDKSGKGSRGRSLGDLLVVETPYMTPTTSPPFFTPPFTTPISPYNQRGFNPLFETATDAEFNRLKSSPPPKFKFLQEAEREA

SEQ ID NO: 200441 - protein, 181 aa, Glycine max
  Coding DNA Sequence Number=SeqID_83663
  Gene Ontology: Mol. function=solute:hydrogen antiporter activity; Cellular component=integral to membrane; Biological process =regulation of pH
  Homolog annotation: Hit_ID=Q1SA42; Match level="QueryCoverage=93%, HitCoverage=19%, E-value=3e-40, Identity=52%"; Hit description =Na+/H+ antiporter-like protein, putative
MNLSANETLFLSVDKIKFFTYNVCTVAPPNIVSDGLWGGQLNGRTPFKSSLPLFELQVLVIFAITQICQFLLQSFDFPQFIPQMIVRSPRIFVTCSMQCWPDSRPCCSGRDAGQIQKEVVSISKSGHTCNNIINWLCTFHLYKWCANGFEHDNQDRTQGMGHCYYWIGCADTYLYSNHNQH

SEQ ID NO: 200442 - protein, 285 aa, Glycine max
  Coding DNA Sequence Number=SeqID_83664
  Gene Ontology: Mol. function=nucleoside-triphosphatase activity; Cellular component=chloroplast
  Homolog annotation: Hit_ID=Q2PMM5; Match level="QueryCoverage=100%, HitCoverage=12%, E-value=1e-156, Identity=95%"; Hit description =Protein ycf2
MSRENWIWLDNVWLVNKDRFFSKVRNVSSNIQYDSTRSSFIQVTGSSQLKGSSDQSKDYFDSIRNEDSKYHTLINQREIQQLKERSILCWDPSFLQTERTEIESERFPKILSGYSSMCRLFMEREKQMNNHLLPQEIEEFLGNPARATRSFFSDRWSELHLSSNPTERSTRDQKLLKKEQKKHLVLSRRSENKEIVNLFKIIMYLQNTVSIHPISSYPGCDMVPKGELDSSNKISFLNKNPFWGLFHLFHDRNSGRYTLHHDFESEEIFQEMADLFTLSITEPDL

SEQ ID NO: 200443 - protein, 54 aa, Glycine max
  Coding DNA Sequence Number=SeqID_83665
MKRLPEEQVFRKALGTPLPLPETFRKRVLSDDLSVVPEALSERPFFRNVSGRID

SEQ ID NO: 200444 - protein, 92 aa, Glycine max
  Coding DNA Sequence Number=SeqID_83666
MAKPSKKRKGALIDDWKFDFSVHDARQLVCTNQADMTGRLLVGSLAFESRILHYLIVRILLPRSSNLAQVSEEDLIVMWAFHKGLQIDWAHL

SEQ ID NO: 200445 - protein, 192 aa, Glycine max
  Coding DNA Sequence Number=SeqID_83667
  Gene Ontology: Mol. function=intracellular transporter activity; Cellular component=endoplasmic reticulum; Biological process =intracellular protein transport
  Homolog annotation: Hit_ID=Q1RXL2; Match level="QueryCoverage=89%, HitCoverage=55%, E-value=3e-69, Identity=77%"; Hit description =Tetratricopeptide-like helical
  Pfam annotation: Domain name=TPR_1; Domain location=3-36; Score=16.4; E_value=0.059; Accession=PF00515.18; Description=Tetratricopeptide repeat
MAARYLKEIAELYESEQNIEQAVVYYEKSADFYENEEVNTSANQCKQKVAQFSAQLEQYQRSIEIYEDIARQSLSNNLLKYGVKGHLLNAGICQLCKDDVIAITNALERYQVQYFSRIYILRPDLDPTFSGTREYRLLADIAAAIDEEDVGKFTEVIKEFDSMTPLDSWKTTLLLRVKEKLKAKELEEDDLT

SEQ ID NO: 200446 - protein, 37 aa, Glycine max
  Coding DNA Sequence Number=SeqID_83668
SLPKDADISRKGADDHIGLCVSVTVGCLCMPPDSWVT

SEQ ID NO: 200447 - protein, 52 aa, Glycine max
  Coding DNA Sequence Number=SeqID_83669
  Homolog annotation: Hit_ID=Q9SD67; Match level="QueryCoverage=83%, HitCoverage=5%, E-value=1e-10, Identity=72%"; Hit description=FtsH metalloprotease-like protein
MTRPCLKGIEEKTAKLKGSENALVARHEASHAVVGTAVPNLLAGQPHVEICG

SEQ ID NO: 200448 - protein, 68 aa, Glycine max
  Coding DNA Sequence Number=SeqID_83670
MWVQAIGLFAQATCAPELDYQDRSIRNYSCYTFGCENNTTMDTSEPYTGAMKGIMHKPQANLGVDQKF

SEQ ID NO: 200449 - protein, 93 aa, Glycine max
  Coding DNA Sequence Number=SeqID_83671
MVGYAPSSFADLVFAGKRIEAGLKRGKFDHPTLISEKARANEEGENEGETHDATRTTRPRHQRTTRPRHQRAACPHLQRTARPHLQRTAHPHL

SEQ ID NO: 200450 - protein, 140 aa, Glycine max
  Coding DNA Sequence Number=SeqID_83672
  Gene Ontology: Mol. function=cyclopropane-fatty-acyl-phospholipid synthase activity; Biological process=metabolic process
  Homolog annotation: Hit_ID=Q3BVQ4; Match level="QueryCoverage=94%, HitCoverage=41%, E-value=1e-47, Identity=70%"; Hit description =Putative cyclopropane-fatty-acyl-phospholipid synthase
MAAHPVVATLGFERVHQRAMGKDMHEQRTVWLQPLRDARQQALVVAHVFEHLDRHAAVEACRGQLKLVDIAGDHLDVAQPPGFTLRHDVLALARSAIHRVSEPQPHPSSRICWPSARPARWPYSSSIASSAWSSVSRPVG

SEQ ID NO: 200451 - protein, 271 aa, Glycine max
  Coding DNA Sequence Number=SeqID_83673
  Homolog annotation: Hit_ID=Q47522; Match level="QueryCoverage=21%, HitCoverage=77%, E-value=4e-19, Identity=74%"; Hit description=LacZ protein
GHQDLFILRSDLPSQWLLFLSAVPPVQLLTGWCVTAKAPPDISAGKCSGHAARRVPFAIQAAQLLGRAIGAGLFAITPAGERGMCCKAIKLGNARVFPEFDQGLTVTKATKNFLMVLGFISEDGSMKQVDLSDYVAATIADPLSRVEGVGDIQIIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 200452 - protein, 185 aa, Glycine max
  Coding DNA Sequence Number=SeqID_83674
  Gene Ontology: Mol. function=ribulose-bisphosphate carboxylase activity; Cellular component=chloroplast ribulose bisphosphate carboxylase complex; Biological process=carbon utilization by fixation of carbon dioxide
  Homolog annotation: Hit_ID=P27066; Match level="QueryCoverage=99%, HitCoverage=44%, E-value=1e-100, Identity=86%"; Hit description =Ribulose bisphosphate carboxylase large chain precursor
  Pfam annotation: Domain name=RuBisCO_large; Domain location=1-172; Score=223.1; E_value=6.3e-64; Accession=PF00016.10; Description =Ribulose bisphosphate carboxylase large chain, catalytic domain
MHDINGGITANTSLAHYCRDNGLLLHIHRAMHAVIDRQKNHGMHFRVLAKALRLSGGDHVHAGTVVDRSRGIYFTQDWVSLPGVLPVASGGIHVWHMPALTEIFGDDSVLQFGGGTLGHPWGNAPGAVANRVALEACVQARNEGRDLAREGNEIIREASKWSPELAAACEVWKEIKFEFEAMDTL

SEQ ID NO: 200453 - protein, 269 aa, Glycine max
  Coding DNA Sequence Number=SeqID_83675
VLFPNVEGLVDLAAIDAFLAYHHSKESPTITILANLYDTSACPLQGHRLCIEKGKANWDQLLASMEGASINWFPRWKEGRTGLGYPMRGAPSEESVTPFITRGFSDPNARLLQGVRKAWEAAQRKDKELRGSSNGVIDVYHKCLRVRTQGLDWLPKLKAAREEEAKALEESEEVQALKAELEKARAIKEKFKSTVIKVRKEYNELKDINMAAAKALERETKRARKEEHGRNNFRGALWGRNNELKLQRDEMDQSRVKGMIMKDELKACL

SEQ ID NO: 200454 - protein, 140 aa, Glycine max
  Coding DNA Sequence Number=SeqID_83676
MEKLDHLEERLGAIEGGEDYAFANLGELFLVPNIITPPKFKVLDFDKYKGTTCPKNHLKMYCRKMGAYVKDEELLIHSFQESLTGVAVTWMQLQNMCKKGAQIFQRIRPKVEGSGSPSGTPNDGNGDDNHDGRHIIGILL

SEQ ID NO: 200455 - protein, 75 aa, Glycine max
  Coding DNA Sequence Number=SeqID_83677
MAPRKLASKRSRKDKAAEGISSAPEYDRHRFRSIEHQQRFEAIKGWAFLRERRVQLRDDEYTDFQEEIVAGGGHH

SEQ ID NO: 200456 - protein, 130 aa, Glycine max
  Coding DNA Sequence Number=SeqID_83678
  Subcellular localization annotation: CTP_CleavageSite=25; ConfidenceScore=5.27e-01
MSSTNKRWWRLCTFSSFGRRTREPRLARLQKGRLRQQVLHNNNSLSLLSRMLLVQESHMFLLQYSSNNNSSHNKELVRQMTIQNIQFQQETRASIQSLTNQIGHMATQMNQAQSQNSDKLPSQTVQNPKN

SEQ ID NO: 200457 - protein, 106 aa, Glycine max
  Coding DNA Sequence Number=SeqID_83679
  Gene Ontology: Mol. function=ribonuclease H activity; Biological process=DNA integration
  Homolog annotation: Hit_ID=Q1SYR3; Match level="QueryCoverage=63%, HitCoverage=2%, E-value=9e-22, Identity=73%"; Hit description=RNase H, putative
MKSAFDKKVRLRRFHEGDLVLKKMSHAVKDHRGKWAPNYEGPFVVKRAFSGGALVLTNMDGEELPSPGQDHLGLPSGVETKHERQKPIKDERKRGWGHDRPIVAFL

SEQ ID NO: 200458 - protein, 140 aa, Glycine max
  Coding DNA Sequence Number=SeqID_83680
MPISPYGSISWSVSFRHRDRAYKTPSGPGEVQQGPGVSSSSYGPMDHARKTPCGPGEVQQGPGVSSSGYGPLSVLQGIAPARHPVDPKKSNRVLRFPAPITGLCQFYGVPVAPNKFIRPPINRAFIKKYCTPRQAQGETP

SEQ ID NO: 200459 - protein, 127 aa, Glycine max
  Coding DNA Sequence Number=SeqID_83681
  Gene Ontology: Mol. function=unspecific monooxygenase activity
  Homolog annotation: Hit_ID=O04892; Match level="QueryCoverage=60%, HitCoverage=24%, E-value=3e-14, Identity=51%"; Hit description =Cytochrome P450 like_TBP
ESGDVGGGPGKSYLFCLTACPPWKRLSRRTECLPRPVVLITASGLQGEQPLVDGTIPEPVGCRWTARAASAARAGRRVPVGGRIGNGPFGASSPGVEQSTQNCALNVKVKKFNQARVNGGSNYDSLK

SEQ ID NO: 200460 - protein, 115 aa, Glycine max
  Coding DNA Sequence Number=SeqID_83682
MRLLLHLPLVKVKKQKESSEEIYPQEEGQPLMVKEKCKEVSISSKRNNQHENTEKGTLYCITFLNFLNSDQGVPTDPKRIKAIPDWPTQPSIREIWGCHDLTNFYKRCQGKEPRV

SEQ ID NO: 200461 - protein, 76 aa, Glycine max
  Coding DNA Sequence Number=SeqID_83683
MKEFYANLYDPDDKSPKQTPVVLEEGENLCTYSRFALLRHDPPELATKLCLPGRGFELNADGQPLKILQKNMTTLA

SEQ ID NO: 200462 - protein, 124 aa, Glycine max
  Coding DNA Sequence Number=SeqID_83684
MRGVPSEESITPFIAWGFSDPNARVLQGVCKEWDDVRRKDKELRGSSNGIIDGYRKRLRFHTQGLDWLPKQRAARGEEAKAPEESEEVQALKAELEKAHAVKEKFKSTAIKVRREYDELKDVGS

SEQ ID NO: 200463 - protein, 200 aa, Glycine max
  Coding DNA Sequence Number=SeqID_83685
  Homolog annotation: Hit_ID=Q47522; Match level="QueryCoverage=25%, HitCoverage=64%, E-value=7e-24, Identity=100%"; Hit description=LacZ protein
MLILRLSAIFVARAPRRVVRRTLEKTSERQVKRQRECRSVRWVVLHRQRHRSVIRLQASRCRRGASPPQRRASTATSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 200464 - protein, 304 aa, Glycine max
  Coding DNA Sequence Number=SeqID_83686
  Gene Ontology: Mol. function=nucleoside-triphosphatase activity; Cellular component=chloroplast; Biological process=macromolecule biosynthetic process
  Homolog annotation: Hit_ID=Q2PMM5; Match level="QueryCoverage=100%, HitCoverage=17%, E-value=1e-116, Identity=85%"; Hit description =Protein ycf2
  Pfam annotation: Domain name=AAA; Domain location=94-302; Score=-6.8; E_value=0.00069; Accession=PF00004.19; Description=ATPase family associated with various cellular activities (AAA)
MLWGGGPTYGVKSIRSKKKYLNLIDLISIIPNPINRIAFSRNTRHLSHPKRRIFLANYQTITYSQTLRGANSFHFPSHGKPFSLRLALPPPSRGILVIGSIGTGRSYLVKYLATNSYVPFITVFLNKFLDNKPKGFLIDDSDDIDDSYDSDDIDRDLDMELELLTMMNTLTMDMMPEIDRFYITFQFELAKAMSPCIIWIPNIHDLDVNESNYLSLGLLVNYLSRDCERCSTRNILVIASTHIPQKVDPALIAPNKLNTCIKIRRLLISQQRKHFFTLSYTRGFHLEKKMSHTNGFGSTTMGSN

SEQ ID NO: 200465 - protein, 109 aa, Glycine max
  Coding DNA Sequence Number=SeqID_83687
MRKRRDNLTKNGMLQYELAATFTPTHLPFKCESLPHGSLPLELTSIAILTTCSTCTTATSAGYPAPPSYSSEPVTSIAILATYGTYTATARCAVPSYLFESVTKLNLHL

SEQ ID NO: 200466 - protein, 137 aa, Glycine max
  Coding DNA Sequence Number=SeqID_83688
  Pfam annotation: Domain name=Transposase_23; Domain location=37-107; Score=-3.8; E_value=0.0029; Accession=PF03017.5; Description =TNP1ENSPM transposase
MQSQGLALPPEPDVGPSAARVSTKESCVDPSGNDLDTGDSYKCGLYIEEYPSRLVALGRVYEGSTTIHNIPLLHDQVKVSVEEIRDVDAPIPVPTKEVKVVGQALNTFLAWPTHLVKRLSEQGAVRPAKPADRPDDE

SEQ ID NO: 200467 - protein, 76 aa, Glycine max
  Coding DNA Sequence Number=SeqID_83689
MGAKYLKAVKQWLHAIKQWSPDEIRAIGSWGSELDGGGCMNDNQFMGLRIRFDGGGCTNSARKSIRGAPESMVEDA

SEQ ID NO: 200468 - protein, 219 aa, Glycine max
  Coding DNA Sequence Number=SeqID_83690
  Gene Ontology: Mol. function=unfolded protein binding; Cellular component=cytoplasm; Biological process=protein folding
  Homolog annotation: Hit_ID=Q4UT11; Match level="QueryCoverage=100%, HitCoverage=33%, E-value=1e-111, Identity=93%"; Hit description =Chaperone protein dnaK
  Pfam annotation: Domain name=HSP70; Domain location=4-219; Score= -33.9; E_value=2.1e-14; Accession=PF00012.10; Description=Hsp70 protein
MGKIIGIDLGTTNSCVAIMDGGKARVIENSEGDRTTPSIVAYTKDGEVLVGASAKRQAVTNPKNTFYAVKRLIGRKFTDAEVQKDIAHVPYSILAHDNGDAWVATSDGKKMAPQEISAKVLEKMKKTAEDFLGEKVTEAVITVPAYFNDSQRQATKDAGRIAGLDVKRIINEPTAAALAYGLDKGDNKDRKIVVYDLGGGTFDVSVIEIANVDGEKQFE

SEQ ID NO: 200469 - protein, 75 aa, Glycine max
  Coding DNA Sequence Number=SeqID_83691
MAKPSTRALSELSARLALSSNSLTRAKWENGGLKTVNFREHRAEQGAKFSSFREISEFLRDCEIPRGGGVIPTPL

SEQ ID NO: 200470 - protein, 195 aa, Glycine max
  Coding DNA Sequence Number=SeqID_83692
MGKKETNTQDFLYWFGNNPCLHPVPKRPAVLEISFQPCKNPFTSKDPQGMYPPLFSLNNLVDVPSTRTDPQEMHPLLFSVKSKEKGDTKEFRRLVLCSFGKGRRETQKEFKRLVLGDSFWQREKGMKKMNSTSFQGLENQKTSESFWYKEEEDVQRDSRLVKDCMNKCSRCLKCKTKPCFYRLFMFGQDNHLEEL

SEQ ID NO: 200471 - protein, 64 aa, Glycine max
  Coding DNA Sequence Number=SeqID_83693
MEQVSIGNQNWDEFYRLFAAKFLPWLVFWFVLKVVFSIGCVEGKEKGCYWLSNDIVGLVGNLAV

SEQ ID NO: 200472 - protein, 269 aa, Glycine max
  Coding DNA Sequence Number=SeqID_83694
MRCKKHLPDLTSTIGVCASCLRERLQPLLAAQAQAQAQSERSTTNSNVDYNHRRRKPKPKPEENPPPLNFPRSVSPYVTHRKSDYDRLRDRPRRHGGRFWILSNLFRARSNKTESSHEPREDPTGPHPPQSWFSTILYARRHHDVRSPRADRGLSPSTAENFTQFSADSAQDRSDSGNSSETSPAKQNPTPVTGHRRSRMGPTGKGFTSMAFCLNPLVRAGPNRHWSHHNKGLAQEQGGGGAHHISNAASFCANRSRKLADFGRGAHNR

SEQ ID NO: 200473 - protein, 130 aa, Glycine max
  Coding DNA Sequence Number=SeqID_83695
  Gene Ontology: Mol. function=nucleoside-triphosphatase activity; Cellular component=membrane; Biological process=defense response
  Homolog annotation: Hit_ID=Q1SI25; Match level="QueryCoverage=93%, HitCoverage=13%, E-value=1e-46, Identity=77%"; Hit description=NB -ARC domain, putative
  Pfam annotation: Domain name=LRR_1; Domain location=16-37; Score =11.7; E_value=1.9; Accession=PF00560.23; Description=Leucine Rich Repeat
  Pfam annotation: Domain name=LRR_1; Domain location=39-61; Score=8.4; E_value=7.8; Accession=PF00560.23; Description=Leucine Rich Repeat
  Pfam annotation: Domain name=LRR_1; Domain location=63-85; Score=4.3; E_value=44; Accession=PF00560.23; Description=Leucine Rich Repeat
  Pfam annotation: Domain name=LRR_1; Domain location=87-109; Score =9.7; E_value=4.3; Accession=PF00560.23; Description=Leucine Rich Repeat
  Pfam module annotation: Pfam domain module=LRR_1::LRR_1::LRR_1::LRR _1; Domain location=16-37::39-61::63-85::87-109
MYILGWKTSKEKVMEKLKILNLSHSHYLTQTPDFSNLPNLEKLLLIDCPRLSEISYTIGHLNKVILINFQDCISLRKLPRSIYKLKSLKALILSGCLKIDKLEEDLEQMESLTTLIADKTAITRVPIFNS

SEQ ID NO: 200474 - protein, 54 aa, Glycine max
  Coding DNA Sequence Number=SeqID_83696
MLTTSKDWKVVSNDSSVASTYGIEVGQLTKMSSSPDTITKCPPSSGSTGVPKDS

SEQ ID NO: 200475 - protein, 56 aa, Glycine max
  Coding DNA Sequence Number=SeqID_83697
  Subcellular localization annotation: CTP_CleavageSite=35; ConfidenceScore=5.09e-01
MAGVGRYMAPTDIFQPTLRNFFYKRWPIMTARFLRASSTEGSFRPTVACCSSHLGG

SEQ ID NO: 200476 - protein, 80 aa, Glycine max
  Coding DNA Sequence Number=SeqID_83698
  Gene Ontology: Mol. function=microtubule motor activity; Cellular component=microtubule associated complex; Biological process =microtubule-based movement
  Homolog annotation: Hit_ID=Q1SGR1; Match level="QueryCoverage=91%, HitCoverage=7%, E-value=4e-23, Identity=87%"; Hit description =Kinesin, motor region; Prefoldin
MEMFFLFQVCIFAYGQIGSGKTYTMMGRPGHLEEKGLIPRSLEQIFQTKQSQQPQGWKYEIIADKVFLAKFTGVNVGNIQ

SEQ ID NO: 200477 - protein, 136 aa, Glycine max
  Coding DNA Sequence Number=SeqID_83699
MPLRGRIALETLCAYSRFRLLRPDPQELAAKLSIPGRGFELNDDGYLLKILWKNMTTLAQIWSVISFSNLIPTSHTSDVTLDRAKLIYGIIMKMDMNVGYLVSHQISLTTQHDTSRLGFPALITALCKARGVQSDS

SEQ ID NO: 200478 - protein, 465 aa, Glycine max
  Coding DNA Sequence Number=SeqID_83700
  Gene Ontology: Mol. function=sugar porter activity; Cellular component=integral to membrane; Biological process=carbohydrate transport
  Homolog annotation: Hit_ID=Q1Z3R8; Match level="QueryCoverage=98%, HitCoverage=95%, E-value=1e-172, Identity=65%"; Hit description =Putative sugar-proton symporter
  Pfam annotation: Domain name=MFS_1; Domain location=11-414; Score =118.5; E_value=1.9e-32; Accession=PF07690.6; Description=Major Facilitator Superfamily
  Pfam annotation: Domain name=Sugar_tr; Domain location=7-455; Score =370.2; E_value=3.2e-108; Accession=PF00083.14; Description=Sugar (and other) transporter
  Pfam module annotation: Pfam domain module=MFS_1::Sugar_tr; Domain location=11-414::7-455
MRYVWSICLVAACGGLLFGYDWVVIGGAKPFYEAWFNVTDPAASGWAMSSALVGCVFGALVSGWSADKLGRRLPLIVAALLFVVSAIGTALASSFTLFVWWRILGGVGIGIASALSPMYIAEIIPADKRGKFVAVNQLTIVIGVLAAQLINLMIADPVVGASTHAALRETWNGQVGWRWMFASAAVPSLAFLLLMMWVPESPRWLMLAGQPQRALAMLNKIGSPAYAQQTQREIARALEQDRQQTRARSGSLLAPRTLPIVITGIVLAIFQQWCGINVIFNYAQEIFASAGFDINGTLKSIVATGLINLLATVLALPLVDRLGRRKLMLIGAGGLTLCYALIAGAYTLGITGWPVLILVLAAIAVYALTLAPVTWVLLAEIFPNRIRGLAMSVATLALWIACFVLTYTFPILNAGLGAAGSFMLYGVICAAGFVFVLRRVPETKGISLEQLEQQLTAGEPAAVAR

SEQ ID NO: 200479 - protein, 73 aa, Glycine max
  Coding DNA Sequence Number=SeqID_83701
MESHELQFGLQQDISIDPMNLDLLHQIDMRGNHYIDWMEYHAEWINIWKNKHSDVLAGQWIEGIVTHTLAYME

SEQ ID NO: 200480 - protein, 89 aa, Glycine max
  Coding DNA Sequence Number=SeqID_83702
MHENATHAIACAFCLVHRCSIGGYSTSIIIQNRCSMLNDGSNLDVWQLQTMLNIRHSISVIRKADVELRTFYIDCPDNRCRMVRILRRV

SEQ ID NO: 200481 - protein, 135 aa, Glycine max
  Coding DNA Sequence Number=SeqID_83703
  Gene Ontology: Mol. function=protein serine/threonine kinase activity; Biological process=protein amino acid phosphorylation
  Homolog annotation: Hit_ID=Q7XZK4; Match level="QueryCoverage=58%, HitCoverage=14%, E-value=5e-17, Identity=58%"; Hit description =Calcium-dependent calmodulin-independent protein kinase isoform 2
MAPHGPHASHETASCVAAQGEKGKKQNHFAIDYGFNAIVAAANGSKLTILKSPTGREIEAHYELGRELDHSEFGITYLCTNKELGISYGLRPLRERTGSWNDEVCLGTCLKFQFFDDRDGIALAAIALCSCDLWK

SEQ ID NO: 200482 - protein, 145 aa, Glycine max
  Coding DNA Sequence Number=SeqID_83704
MSQQRLNGLALLSIEKKMPLKSLSRTYPASGGSDQCCYSCPNRKLMPSNRERQIALQLMGQGEMIDAIVEPIKENVDSDELGQNKIQTKNSELVEGSDPEKEGETSDKDDKVQIDLSSNESQCLEVKEKTIAARRSEVKTYIPFS

SEQ ID NO: 200483 - protein, 94 aa, Glycine max
  Coding DNA Sequence Number=SeqID_83705
MAKFNPEIVLEFYANAWPMEEGVRDMRSWVRGQWIPFNANALNQFLSCPLILEKDQRCEFSQKRDQASGFDKEAIAQLLCIPGQDFPWTAAGRR

SEQ ID NO: 200484 - protein, 227 aa, Glycine max
  Coding DNA Sequence Number=SeqID_83706
  Gene Ontology: Mol. function=sequence-specific DNA binding; Biological process=regulation of transcription, DNA-dependent
  Homolog annotation: Hit_ID=Q5PHQ6; Match level="QueryCoverage=85%, HitCoverage=98%, E-value=3e-60, Identity=61%"; Hit description =Conserved hypothetical DNA-binding protein
  Pfam annotation: Domain name=Cupin_2; Domain location=124-195; Score =34.8; E_value=2.9e-07; Accession=PF07883.2; Description=Cupin domain
  Pfam annotation: Domain name=HTH_3; Domain location=26-80; Score =43.0; E_value=1e-09; Accession=PF01381.12; Description=Helix-turn -helix
  Pfam module annotation: Pfam domain module=Cupin_2::HTH_3; Domain location=124-195::26-80
MTKKVNLVTFAGADVNTVNEAVSLRIKQFRKQRKISLDELSRKASVSKGMLVEIEGCKANPSIALLCRLAAAMGVSVADFVDVSARPDVHIIADTDIPELWTGDKGGSARLLAGSGGPDMLELWLWEMRPGEKFESPGHTSGTLELLHVKSGTLTLGVKESVFQVTAGSSVTAKTDVPHFYANQGENTLNFIMTADCVFAMSEERILATKSRGISHSGQVDIAHGLI

SEQ ID NO: 200485 - protein, 445 aa, Glycine max
  Coding DNA Sequence Number=SeqID_83707
  Gene Ontology: Mol. function=dihydrodipicolinate synthase activity; Biological process=metabolic process
  Homolog annotation: Hit_ID=Q0S0T5; Match level="QueryCoverage=62%, HitCoverage=93%, E-value=8e-81, Identity=55%"; Hit description =Dihydrodipicolinate synthase
  Pfam annotation: Domain name=DHDPS; Domain location=150-444; Score =15.0; E_value=7.5e-12; Accession=PF00701.12; Description =Dihydrodipicolinate synthetase family
MCFRNLVPNPNARPVLLRRYATRASRWHPARARSGGENIAAYQGAPRLTVATGTEPFDTMKEGVMAVEYPAPGEVVWCDDAGVTCRRWNWRQGIRTRLSVEAQHMWFILESLPQMPPDQLHEAGKMLTDGLEEMMPGRQCNVTLIGELCMFTGLSAFPLTPVTARGVDEQGFTKILARLTAARVDSLGVLGSTGSYAYLSREQRKRSATLACQVAGEIPVMVCVGAISTDAVLHLAEDAQSAGAAALLLPAMSYQPLRDEEVYALFETVTRHASVPVCVYDNPGTTHFRFTDELLGQLSSLKGIRSIKIPGVPDTPIAAAERVAALRQHLRPGVTLGISGDASAGLGLNAGCEVWYSVCGGIFPETAKQITQAAAINDAERVTALTHRLKPLWDLFRKHGGSLRVIAAAVGILGLTDADCLPRPLLPLSATEVAEVAAVMAALDL

SEQ ID NO: 200486 - protein, 288 aa, Glycine max
  Coding DNA Sequence Number=SeqID_83708
  Gene Ontology: Mol. function=oxidoreductase activity; Cellular component=membrane; Biological process=metabolic process
  Homolog annotation: Hit_ID=Q0B1M5; Match level="QueryCoverage=89%, HitCoverage=99%, E-value=7e-82, Identity=63%"; Hit description=Short- chain dehydrogenase/reductase SDR
  Pfam annotation: Domain name=ADH_zinc_N; Domain location=37-169; Score=-13.6; E_value=0.067; Accession=PF00107.16; Description=Zinc -binding dehydrogenase
  Pfam annotation: Domain name=Epimerase; Domain location=41-281; Score= -39.5; E_value=0.0014; Accession=PF01370.11; Description=NAD dependent epimerasedehydratase family
  Pfam annotation: Domain name=adh_short; Domain location=39-199; Score= 36.7; E_value=2.1e-08; Accession=PF00106.15; Description=short chain dehydrogenase
  Pfam module annotation: Pfam domain module=ADH_zinc_N::Epimerase::adh_ short; Domain location=37-169::41-281::39-199
MTTSRSARVAILPALLIMVLPHQQTGDSPMPCDLDFHGKRILVTAGTKGVGKAVVGLFKQLGATVLTTARHASAECRADAFVTADLTTVTGCNSVAEAVQTHLGGVDIIVHVAGGSTAPGGGFAALGEEEWQQELNLNLLPAVRLDRALLPAMLQQEGGVIIHVTSIQRELPLPESTTGYAAAKAALSAYSKSLSKEVASQGVRVVRVAPGWIETEASVAMAERLAQQAGTDYEGGKQIIMKALGGIPLGRPSQPIEVANLIVFLASSYAAAITGTEFVIDGGTIPTV

SEQ ID NO: 200487 - protein, 58 aa, Glycine max
  Coding DNA Sequence Number=SeqID_83709
MAQLIFDAIHYLHGSRPQDTQWTRMSPIGPWGFQLWLLASVSPTRCPSPLARSCHRDI

SEQ ID NO: 200488 - protein, 78 aa, Glycine max
  Coding DNA Sequence Number=SeqID_83710
MGEVVSRIFPLDLMMKSVQFQVKKRLSHEVLKVTVELSSAVGLSTHPSLSAVSAHLARQKNLAEHQYQGRALSARSVH

SEQ ID NO: 200489 - protein, 233 aa, Glycine max
  Coding DNA Sequence Number=SeqID_83711
  Gene Ontology: Mol. function=metal ion binding; Cellular component =intracellular; Biological process=protein kinase C activation
  Homolog annotation: Hit_ID=Q2R484; Match level="QueryCoverage=99%, HitCoverage=56%, E-value=6e-41, Identity=42%"; Hit description =Pentatricopeptide repeat-containing protein, putative
  Pfam annotation: Domain name=PPR; Domain location=141-175; Score=7.8; E_value=0.9; Accession=PF01535.11; Description=PPR repeat
  Pfam annotation: Domain name=PPR; Domain location=42-76; Score=13.6; E_value=0.18; Accession=PF01535.11; Description=PPR repeat
  Pfam annotation: Domain name=PPR; Domain location=7-41; Score=36.0; E_ value=1.3e-07; Accession=PF01535.11; Description=PPR repeat
  Pfam annotation: Domain name=PPR; Domain location=79-113; Score=12.8; E_value=0.23; Accession=PF01535.11; Description=PPR repeat
  Pfam module annotation: Pfam domain module=PPR::PPR::PPR::PPR; Domain location=141-175::42-76::7-41::79-113
MPEKSSSLWTTMVCGYAQNFCSNEALDLFEDMVGEGFEPSGSTLASVLSACARSGCLELGERIHEFMMVKGVGLGDGVILGTALVYLYAKNGAIAMARRLFDEMSERNVVTWNAMICGLGAYGYVDDVLDLREWVVVPNGVTFVGVLSACCHAGLIDVGCEIFRSMKSVYGIELKIQHYGCLVDLHGRGASTNSGNTEVAERVVKEILALEPQNNVVLSAFSNMQRLDTGRKF

SEQ ID NO: 200490 - protein, 338 aa, Glycine max
  Coding DNA Sequence Number=SeqID_83712
  Gene Ontology: Mol. function=metalloendopeptidase activity; Cellular component=membrane; Biological process=proteolysis
  Homolog annotation: Hit_ID=Q94DI2; Match level="QueryCoverage=85%, HitCoverage=84%, E-value=1e-107, Identity=69%"; Hit description =Peptidase M48-like
  Pfam annotation: Domain name=Peptidase_M48; Domain location=133-324; Score=26.9; E_value=1.3e-06; Accession=PF01435.8; Description =Peptidase family M48
  Subcellular localization annotation: CTP_CleavageSite=20; ConfidenceScore=5.28e-01
MASTPFSTFCHFHKPTLLFLASDGFRLGGAPAIAFGKVRKNRKMGIFPVCRAGSAVVFRDLDADDFRHPLDQQVGWAIKNEEKGRGVDPLNTLLLRAIPGLNELGKALLVFIEKFSQTGPYISAFNLPDLYHLMVEAAEILNVDAPDLYVRQSPVPNAYTLAISGKRPFVVIHTSLVELLTKAELQAVLAHELGHLKCDHGVWLTYANILTLGAYSVPGIGGMIAQTLEEQLFRWLRAAELTCDRAALLVAQDPKVVISVLMKLAGGCPSMADQLNVDAFLEQARSYEKAASSPIGWYIRNAQTRQLSHPLPVLRASEIDECACMEFVESAQQLKVLQ

SEQ ID NO: 200491 - protein, 179 aa, Glycine max
  Coding DNA Sequence Number=SeqID_83713
MVEGEILVEGGACINILPVTKLKHFKKKVEDLLPHTLCHRRLIIFMAISSQANFNMLLGHEWMQFRLQLFFWNKERHLTLSSYFAQMLTYIAEKMVVTNVAEKMENSRSTLTNLALNKVSYVAQFASSSRSIHPTLLKVHHRGVVGGESWLDAKKDLAIEMVAPAYTLMFKCKSRNYLA

SEQ ID NO: 200492 - protein, 230 aa, Glycine max
  Coding DNA Sequence Number=SeqID_83714
  Homolog annotation: Hit_ID=Q6YZF2; Match level="QueryCoverage=67%, HitCoverage=57%, E-value=7e-51, Identity=55%"; Hit description =Translation factor-like
  Pfam annotation: Domain name=Sua5_yciO_yrdC; Domain location=80-222; Score=27.3; E_value=4.7e-09; Accession=PF01300.8; Description=yrdC domain
  Subcellular localization annotation: CTP_CleavageSite=36; ConfidenceScore=5.51e-01
MQTFCVCGDKLWHYDAVSFFGSRVSFCPPRRRSRVVSMVAKRSPKRLKYTSASRFTKEDGLVHIEADPSASDSWKLEPIVNLLKQGAVGVIPTDTMYSIVCDLRSHSAIERLRRIKNIEASKPLSILCHSFRDIDKYTAGFPRGDGQGHANLFKAVKQYLPGPYASRKNVGVRMPDDAICQAILKEMDAPLICTSNRSALCTSNPMQMGHNGKYLRIKGGSGKICCFSLD

SEQ ID NO: 200493 - protein, 76 aa, Glycine max
  Coding DNA Sequence Number=SeqID_83715
METPRNQQGRLDRIPTGKSFDSDVRLRPIIYHGACHNLPFCGRAWRGSRVDKSGALAPMYPPSKRKSDLRSSFKRQ

SEQ ID NO: 200494 - protein, 40 aa, Glycine max
  Coding DNA Sequence Number=SeqID_83716
MPPKVLRQGKVFVQGPILHWMELEDDQKTDVDKDLIPAGI

SEQ ID NO: 200495 - protein, 396 aa, Glycine max
  Coding DNA Sequence Number=SeqID_83717
  Homolog annotation: Hit_ID=Q1T393; Match level="QueryCoverage=62%, HitCoverage=32%, E-value=2e-12, Identity=26%"; Hit description=IMP dehydrogenase/GMP reductase
MVDFWTSVPSYELKINGIPRTVVSTSKPEDLIIFLDFSIPTRNSTEQVLNALHVNSGILTPLHGRSNGTRGFSFKLKNISRTEIITIELQATSILGRTGTPVSPVAPITFLYDPMKPNVVLRTSSLTETRDFNINIIAEFTKPVFGFVTSIVDVSGGRLIRQGKGIIKSFLLVDCQSSDKGGVSYHSCREDSTPAISIALHSFISAGTIATSLVAAMVSLSSANLEALSILALEGASSPASNPSINLHGMIGHLQVFALTSWFSTNQFIKYSETTRGLRWLIPHHKLPWKKIDTWSSILEREKLAGRSNGLSAGEHSYNRDQQQNDLMNLSYIDHKLSFQTKNTTKFGRFHNQHDLSKTSTLYGLPLNSIEYFTYFLRGEPLSASNVIKGMESYKG

SEQ ID NO: 200496 - protein, 234 aa, Glycine max
  Coding DNA Sequence Number=SeqID_83718
  Homolog annotation: Hit_ID=Q1T393; Match level="QueryCoverage=87%, HitCoverage=27%, E-value=4e-19, Identity=28%"; Hit description=IMP dehydrogenase/GMP reductase
MGGTTGGIITGVLLLAIPVAFILSSLLFLVIAIYTGSFAQYKEFNKITNEEKWYTKLWFFFIGRPMNGKWFNKEGLPSSFLSRFGILFDNWKGPPVLILGDQNEQNNTITKWSESDKSGIRRTKTASSEDSNEETKISTFKRVFGCIRASYIILDLLRKVGLGIISAAYPSENSNKSLFALIITLMQFIFLFTTKPYISRGVHVVESVSLLCEADYQSMVCYGKFPIESLTISE

SEQ ID NO: 200497 - protein, 49 aa, Glycine max
  Coding DNA Sequence Number=SeqID_83719
  Gene Ontology: Mol. function=hydrolase activity, hydrolyzing O -glycosyl compounds; Biological process=carbohydrate metabolic process
  Homolog annotation: Hit_ID=Q9LTN0; Match level="QueryCoverage=98%, HitCoverage=8%, E-value=1e-09, Identity=57%"; Hit description =Arabidopsis thaliana genomic DNA, chromosome 3, P1 clone: MTC11
MVKGAEAVHAANPDVLVILSGLNFDTSLSFIQDRPVSLTFKGKLVFEVN

SEQ ID NO: 200498 - protein, 179 aa, Glycine max
  Coding DNA Sequence Number=SeqID_83720
  Gene Ontology: Mol. function=protein serine/threonine kinase activity; Biological process=protein amino acid phosphorylation
  Homolog annotation: Hit_ID=Q2R441; Match level="QueryCoverage=92%, HitCoverage=56%, E-value=7e-49, Identity=55%"; Hit description =Uncharacterized plant-specific domain TIGR01627 family protein, expressed
  Pfam annotation: Domain name=DUF579; Domain location=1-179; Score =185.2; E_value=1.6e-52; Accession=PF04669.4; Description=Protein of unknown function (DUF579)
MWDSFNPRGTTLFLEEDPKWTLSALQRFPILRAHIVRYSTRLAEAKELLSSYKDYCPGVSKNTTDHPLKGDRWCKLALGTLPNEVYNRDWDVIMIDGPRGYFAAAPGRMAVIYSAAMMARGRKGSGVTHVFLHDVDRGVEKQYAKEFLCMKYRVGGIGKLWHFVIPPVVNPSDIAHGFC

SEQ ID NO: 200499 - protein, 127 aa, Glycine max
  Coding DNA Sequence Number=SeqID_83721
MNFGREEVACDEAELGEEEFAEKMLNQQKLQEQQLEMLKYMRKFHLEDQSAILEKLHQQIENGTYESGTSMLSAEQIDEIVPRKASPQYTPSCCKVKVSCAMVGTCCFLPAGFPTSVISTERPIRKT

SEQ ID NO: 200500 - protein, 326 aa, Glycine max
  Coding DNA Sequence Number=SeqID_83722
  Gene Ontology: Mol. function=oxidoreductase activity; Cellular component=vacuole; Biological process=hydrogen peroxide catabolic process
  Homolog annotation: Hit_ID=Q96509; Match level="QueryCoverage=99%, HitCoverage=97%, E-value=1e-111, Identity=62%"; Hit description =Peroxidase 55 precursor
  Pfam annotation: Domain name=peroxidase; Domain location=42-289; Score=430.5; E_value=2.2e-126; Accession=PF00141.13; Description =Peroxidase
MEKSMRMVLMALLAFTMLLSKGEGQLVENFYSLSCPNVESIVKQAVTNKFTQTITTGQATLRLFFHDCFVEGCDASVIISSPNGDAEKDAEENISLPGDGFDTVIKAKQAVESSCPGVVSCADILALATRDVIGLLGGPSFNVELGRKDGLISKASSVEGNLPKANFNLDQLNALFSKHGLSQTDMIALSGAHTVGFSHCDQFANRLYSFSSSNTVDPTLDPSYAQDLMAGCPRNPDPTVAVALDPQSPAAFDNLYYQNLLSGKGLLTSDQVLFEDATSQPTVVRFANNVADFNDAFVAAIRKLARVGVKTGNDGEIRRDCTTFNS

SEQ ID NO: 200501 - protein, 117 aa, Glycine max
  Coding DNA Sequence Number=SeqID_83723
MAMEVEQNQNHQLGFPFWKPLRRRFGPESPFFAHGNLERELLAKQLALELTEEKQQLEKWMQEEEGRLIGLVCPFLLIPETWPLASLFVGNLLLLSNSSSIARQQSIEMARQAVVGL

SEQ ID NO: 200502 - protein, 41 aa, Glycine max
  Coding DNA Sequence Number=SeqID_83724
MELLCMVIWASPWAQGFIGKRPQKPNLGPFLPAPSNSSIML

SEQ ID NO: 200503 - protein, 108 aa, Glycine max
  Coding DNA Sequence Number=SeqID_83725
  Subcellular localization annotation: CTP_CleavageSite=85; ConfidenceScore=5.49e-01
MANRPIVSHLLGQTCHTSKAKHVVPPRPSVSHLRSEQQWSYTVVASRNPLAPRSLTLSHLPGQHCRTFTTNNNNPFILCTPPRTSSALISYFFPFHVHNLVSPSLFHC

SEQ ID NO: 200504 - protein, 148 aa, Glycine max
  Coding DNA Sequence Number=SeqID_83726
  Homolog annotation: Hit_ID=Q9FMT8; Match level="QueryCoverage=73%, HitCoverage=18%, E-value=6e-43, Identity=73%"; Hit description =Nodulin-like protein
  Pfam annotation: Domain name=Nodulin-like; Domain location=51-146; Score=-17.7; E_value=1.1e-09; Accession=PF06813.4; Description =Nodulin-like
MVHNLPKWIFENWVNQNDVPYVASQAIQKTNAPPCRLNPTMEKLSSFYKSRWLVFVAAMWLQSWAGIGYLFGSISPVIKSSLGYNQKQLAMLGVAKDLGDAVGFMTGLLCEILPIWGALLVGAALNVVGYGWVWLVVTSQVPVLPVWA

SEQ ID NO: 200505 - protein, 134 aa, Glycine max
  Coding DNA Sequence Number=SeqID_83727
  Homolog annotation: Hit_ID=Q9FMT8; Match level="QueryCoverage=62%, HitCoverage=17%, E-value=7e-29, Identity=76%"; Hit description =Nodulin-like protein
MVIKKQDNPKKGEERGTHSPNRQDGDLRSDNKPDPAISHDVQSSADEKRAPDGQNLAEQARHEADGVAKPRELFMTGEMLPNKYPMPAHDCSHIAATKTSQRLLDQSFTEEDERALLVFDRYEEEEDPDMVQEA

SEQ ID NO: 200506 - protein, 632 aa, Glycine max
  Coding DNA Sequence Number=SeqID_83728
  Gene Ontology: Mol. function=nucleic acid binding; Cellular component= intracellular; Biological process=DNA integration
  Homolog annotation: Hit_ID=Q1T010; Match level="QueryCoverage=77%, HitCoverage=40%, E-value=1e-150, Identity=49%"; Hit description =Peptidase S8 and S53, subtilisin, kexin, sedolisin; Integrase, catalytic region; Zinc ...
  Homolog annotation: Hit description=finger, CCHC-type; Peptidase aspartic, catalytic
  Pfam annotation: Domain name=rve; Domain location=159-333; Score =148.3; E_value=2e-41; Accession=PF00665.16; Description=Integrase core domain
  Pfam annotation: Domain name=zf-CCHC; Domain location=111-128; Score =20.2; E_value=0.00045; Accession=PF00098.13; Description=Zinc knuckle
  Pfam module annotation: Pfam domain module=RVT_2::rve::zf-CCHC; Domain location=497-632::159-333::111-128
MSLEELQSSLEAREHRLLERNKKKIAEQALLAQSSNKNPGDSNRGRSGFRGRGHGRNNKGRSGYVSSSGRGQNNVENKPDQSQRGRGRGYYRGGSNGRGRGGRKMFDKQNIQCYNCDRWGHFADECYAKKDSLGDPRKSCQRTFGANLEALCHKCLAAVVSEDDWVWHHRYGHLNFRDLHDLNTYNMCESLGESRYFVSFLDDFTRKMWVYILKRKSEVLGVFKKFKRMVERQTGCLIKTIVTDGGREYTSNEFDEFYELEGIVHDVTPPYTPQHNGAAERRNRTVMNMVRCMLNGKKLPKFLWAEAVSTAVYVLNRNPKKRLNKITPEEAWSGCKPVVSHFKIFGSICYKHVPDQLRRKLDSKSEIMILLGYHATGGYKLFNPVTKEVLVSRDVVVDESKDWNWDKEMVEEPTKVVIEASIDEPSDSSAAVIDDSDQGGVRKSQRARQPSSRLQDYELIHDSAIGEEGELVHLALFAESESVSLEEAMNDTKWTDAMKEELKAIEKNNTWQLVPLPAKKKPIAVKWVYKVKKNPKGEISKYKARLVAKGFLQKAGIDFKEVFAPVARMETVRIITAIASQKGWHMHHMDVKSAFLNGPLEEEVYVSQPPGFEIKGSEEKVYRLNKALYGLK

SEQ ID NO: 200507 - protein, 523 aa, Glycine max
  Coding DNA Sequence Number=SeqID_83729
  Gene Ontology: Mol. function=RNA binding
  Homolog annotation: Hit_ID=Q6Z7B3; Match level="QueryCoverage=50%, HitCoverage=34%, E-value=9e-43, Identity=37%"; Hit description=Heat shock factor protein hsf8-like
MTCGAHHCPLFANQLIYTYAYPSLLHHFHFGLQVHTATLKMVHFDSLLIFPCPSSLPQSSPASSSDPLYRHRDPRHAVILAALQNPLTVAPLLPPWHAPRGERVLLVLCLLPLPLPPHVPHSLHNRTKYMEFGLVNLALKVFNEMPENNSVSYNTGLEQHEQRRFEFHEEPNDLCQFSDLKSNDSRVELSAEAALQAKPKRYMKQTSKFVGEEGASHNIGGHTNNDDLGKIVDMPDFQESEDADWTRTQDLIKTGDREDVELVSCNTKGFIVSFGSLVGFLPYHNLASKWKFLAFESWLKQKGIDPSIYKQNSGTITSFDAEIKNLSSDSPPSLEIDGKVEDRISPDMKLEDLLRIYDQEKLKFLSSFVGMELVLLIECNKVLFRFDFCFSPQARLQIGDIVKCCAQKIAYFGIFVEGAGELFGAAIMSVQRAGTTASLILMLFLLTGGYYVQRKPRWGTFDAADDVEEAVKTLGDEGVDVDKELALGGEEHDVSGEQLGECDEKEAKEGEELGEQGGDGEAF

SEQ ID NO: 200508 - protein, 49 aa, Glycine max
  Coding DNA Sequence Number=SeqID_83730
MTLFCTRLPIESKIKRGVGYRQSRTTLNGNLKGRDTKNGFSFAGSPLPC

SEQ ID NO: 200509 - protein, 101 aa, Glycine max
  Coding DNA Sequence Number=SeqID_83731
MACTHIPVQAKIFQNCPMCGVACQCRDSYVILLKFQPARINWTLHLMLQGHTVLNGMPQGSSMICTCCVQAVSSENGGGGNLAEVMATIELSSRYESKFSI

SEQ ID NO: 200510 - protein, 67 aa, Glycine max
  Coding DNA Sequence Number=SeqID_83732
MVKPINILLTLKEHNVNSCTTIKFHIDKNVKAKCKSLISQKNAWDYVMDNWGTLVDCPSEHKFAESF

SEQ ID NO: 200511 - protein, 286 aa, Glycine max
  Coding DNA Sequence Number=SeqID_83733
  Homolog annotation: Hit_ID=Q10Q83; Match level="QueryCoverage=39%, HitCoverage=29%, E-value=2e-16, Identity=43%"; Hit description =Expressed protein
  Pfam annotation: Domain name=DUF566; Domain location=1-216; Score= -146.6; E_value=0.082; Accession=PF04484.3; Description=Family of unknown function (DUF566)
  Subcellular localization annotation: CTP_CleavageSite=52; ConfidenceScore=5.63e-01
METSSKLATSSLWSPSRGVSPSRAQNGVLSGLSSRFGGGSEPSILSFAVDVSRGKVAENRIFDAYLLRLFHNKLLQWRFVNARANAALSAQTLNAENLRESVRAKRVEFQLLKQQFKLISILKDQFYRFSSSLIAMSFCPSLCNCHFMASGFIEFYIGQSSHQTHSTFEASKTNMLRGTLFLLGSCLSYTAWFIVQGAVFNVKCMPCRTQTAIANGEFGHKSVGNRQSNWRVPIAEGAERRASPAMAVQQCVSQGQIAITIGDLPCPRIASTAGGLPLLKILVLPL

SEQ ID NO: 200512 - protein, 79 aa, Glycine max
  Coding DNA Sequence Number=SeqID_83734
AYIYLGIVIMRIREGTSLVDQFNPLAKRKPRAKRIFGHALSRESLALSTQPLHLKLIWSAKLSKAELSPFQFDLNLAKR

SEQ ID NO: 200513 - protein, 124 aa, Glycine max
  Coding DNA Sequence Number=SeqID_83735
  Subcellular localization annotation: CTP_CleavageSite=68; ConfidenceScore=5.24e-01
MASLVSVKDSPLRVAICPCKAQITSTNGDTQGKGTASQTGSCAFQWLGCRSFFRERGVATAIGELPASCNSHWRFRPEKIAIRIGNFVLINTKPLLSVVCSRFQLQIRNKYFSCVLTFSASNQK

SEQ ID NO: 200514 - protein, 49 aa, Glycine max
  Coding DNA Sequence Number=SeqID_83736
TNEVCISASLLGVREWADPYSIQIKLIRKTGTNQVDLYVDINHMDQLDP

SEQ ID NO: 200515 - protein, 68 aa, Glycine max
  Coding DNA Sequence Number=SeqID_83737
  Subcellular localization annotation: CTP_CleavageSite=57; ConfidenceScore=5.10e-01
MTPYKARSLLNDQLLRATKCRGGGRKARGRQNRGGGRGRGRGRGGGDGRGRNRGCQRSNRRRGCYCPW

SEQ ID NO: 200516 - protein, 87 aa, Glycine max
  Coding DNA Sequence Number=SeqID_83738
  Gene Ontology: Mol. function=DNA binding; Cellular component=nucleus; Biological process=regulation of transcription
  Homolog annotation: Hit_ID=Q0PJD2; Match level="QueryCoverage=51%, HitCoverage=27%, E-value=1e-14, Identity=82%"; Hit description=MYB transcription factor MYB67
  Subcellular localization annotation: CTP_CleavageSite=69; ConfidenceScore=5.04e-01
MGIDPKTHKPRTDLNDLMNLSQFLGMSNLSSAINTAWGNKPLGLQPNITRTTQKSFWFTDNNGPLTRVREAYLDTDSDSDSEIGREW

SEQ ID NO: 200517 - protein, 118 aa, Glycine max
  Coding DNA Sequence Number=SeqID_83739
MPYTDYMKPDTETYNWVIQAYTRVESYASLCVIGLTPSHIAFKDEGGITAVDFNVGKSDCSGIKVIGKRKKGKSAVKPRTSLVSPSRMRTPGPSLVPKEVRLTQQGSLAQRSWEGLLV

SEQ ID NO: 200518 - protein, 41 aa, Glycine max
  Coding DNA Sequence Number=SeqID_83740
MYMMSFDLRAAQDVGALLKVGEARRRRQQCVDAFDCAEEQR

SEQ ID NO: 200519 - protein, 127 aa, Glycine max
  Coding DNA Sequence Number=SeqID_83741
  Homolog annotation: Hit_ID=Q1SKD7; Match level="QueryCoverage=86%, HitCoverage=29%, E-value=2e-10, Identity=31%"; Hit description =Ankyrin
MAPRKLASKRSRKDKAVEGTSSTPEYDSHRFRSAEHQQRFEAIKGWSFFRERRVQLKDDEYTDFQEEIVRWRWASLVTPMAKFDPDIVLEFYANAWPTEEGVRDMRSWVRGGPGVRVWPEEEPGRWV

SEQ ID NO: 200520 - protein, 92 aa, Glycine max
  Coding DNA Sequence Number=SeqID_83742
VERNEDKGYVGVRELSEGGQLGMVGLCVICGCGELNCTIARPPPSTTCDGVVPGDMSRGSGDLGDVRQAPGSQPIKEQRPQSKEACVVAGQL

SEQ ID NO: 200521 - protein, 80 aa, Glycine max
  Coding DNA Sequence Number=SeqID_83743
MAASDHAILRDRTHVPTKRSLLELSSQDALLAQNKLLAKQLKTLTETLRSELYGQLAQTKSFYLLGGPHYYRFSTMPLFT

SEQ ID NO: 200522 - protein, 213 aa, Glycine max
  Coding DNA Sequence Number=SeqID_83744
  Gene Ontology: Mol. function=transferase activity, transferring phosphorus-containing groups; Cellular component=membrane; Biological process=two-component signal transduction system (phosphorelay)
  Homolog annotation: Hit_ID=Q1SE10; Match level="QueryCoverage=79%, HitCoverage=22%, E-value=2e-64, Identity=61%"; Hit description =CHASE; Lantibiotic regulatory protein
  Pfam annotation: Domain name=HisKA; Domain location=93-149; Score =15.3; E_value=0.004; Accession=PF00512.15; Description=His Kinase A (phosphoacceptor) domain
MCSINMLIGSRYVGGSFDVESLVENLLGQLAGHQAILVNVYDIIKSTDHLIMYGNQNEEGDMSLIHEMGYILYGAGNHIVKVDDDFHQMEELKVDAAIKLHVSVGMLGLLLKIELSSTQRDYAQTAQACGKALIALINEVLDRAKIEAGKLELEAVPFDIHSILDDVLSLFSVKSRNVGLEPLCICKGKAAYNIPPPYLRIAKSLRAMGYEVF

SEQ ID NO: 200523 - protein, 92 aa, Glycine max
  Coding DNA Sequence Number=SeqID_83745
MEVNEAERNRVHIHVSVARDGVEIVGFGESRGGVDMGSGENAESKWNENEKRARQKQQQPTPETASLSPFVLVIVKQLCNARGREQCSTGET

SEQ ID NO: 200524 - protein, 195 aa, Glycine max
  Coding DNA Sequence Number=SeqID_83746
  Gene Ontology: Mol. function=helicase activity; Biological process =viral genome replication
  Homolog annotation: Hit_ID=Q9FHV5; Match level="QueryCoverage=91%, HitCoverage=15%, E-value=1e-28, Identity=37%"; Hit description =Helicase
  Pfam annotation: Domain name=DUF889; Domain location=113-195; Score= -136.4; E_value=0.03; Accession=PF05970.5; Description=Eukaryotic protein of unknown function (DUF889)
MMAHGVATFLFSYANTDEQKHIFDTIINVVNRGTGGMFFLYGYEGTGKTFMWKTALHSKGIEQAELLKATKLIIRDEAHMTHRYYFEALDKTLNDIMCMSNSDNVPFGGKVVVFRGDFRKILPVIPRGSRLDISNLTLTNAQEIKSFSQWLIDVGDGKLGKGDDGCYEIEIPPDLLITSFTNPIEEIVNHTYLDI

SEQ ID NO: 200525 - protein, 157 aa, Glycine max
  Coding DNA Sequence Number=SeqID_83747
  Gene Ontology: Mol. function=oxidoreductase activity, acting on paired donors, with incorporation or reduction of molecular oxygen, 2-oxoglutarate as one donor, and incorporation of one atom each of oxygen into both ...
  Gene Ontology: Mol. function=donors; Cellular component=cytoplasm; Biological process=protein metabolic process
  Homolog annotation: Hit_ID=Q9FKX6; Match level="QueryCoverage=98%, HitCoverage=58%, E-value=3e-57, Identity=65%"; Hit description =Prolyl 4-hydroxylase, alpha subunit-like protein
  Pfam annotation: Domain name=2OG-FeII_Oxy; Domain location=52-145; Score=8.2; E_value=0.019; Accession=PF03171.10; Description=2OG -Fe(II) oxygenase superfamily
MLKSLVIDNESGEGIETSYRTSTEYVVERGKDKIVRNIEKRIADVTFIPIEHGEPLHVIRYAVGQYYEPHVDYFEEEFSLVNGGQRIATMLMYLSNVEGGGETVFPIANANFSSVPWWNELSECGQTGLSIKPKMGDALLFWSMKPDATLDPLTLHR

SEQ ID NO: 200526 - protein, 106 aa, Glycine max
  Coding DNA Sequence Number=SeqID_83748
MAKIMLKVTVASEDILNTVNAKGQTYREVNRSFVVRWKDVLDRYWHLLDKDEILHIVLYNQDLDNPTIVVGWTAPMDFYHLTGDHQMSLTHYGWSECILSDHIQEQ

SEQ ID NO: 200527 - protein, 396 aa, Glycine max
  Coding DNA Sequence Number=SeqID_83749
  Gene Ontology: Mol. function=helicase activity; Biological process =viral genome replication
  Homolog annotation: Hit_ID=Q1SRJ5; Match level="QueryCoverage=63%, HitCoverage=43%, E-value=3e-48, Identity=34%"; Hit description =Probable helicase [imported]-Arabidopsis thaliana-related
MTNEEHRMKNDVEVDYGCNSQKGRLGGLAACPSELMLHSEVITSIVGVANQPINRDIILEKQSGRSQRINELHPGYLGLQYPLLFPYGEDGYRNDINHRDMDDSYERKRNRLTIKEFLCFRLHSKKDEAQTLLRSRRLFQQFIVDGLPYAHILLFLDAGSKYPSPVDIDRIISVEIPDSIEQPQLYECVKKHMMHGPCDDYPIYKRRNDGKYIDRNGVALDNRYVYINKGYDRITAALVPVENEDGTTEQSVNEIKHYLDGRYISPCEACWRIFSFQIHKRSPVVERLYFYLPGENSVIFEDSDDIDALLSKPIVKKSMLKWVPPSTGGLYYLRIMLTMVKGPITYEQICTINGQLYSTFREACFAMGFLVDDKDYIEALREAFHWDFGQFLEDSL

SEQ ID NO: 200528 - protein, 274 aa, Glycine max
  Coding DNA Sequence Number=SeqID_83750
  Homolog annotation: Hit_ID=Q1SWQ8; Match level="QueryCoverage=41%, HitCoverage=41%, E-value=3e-10, Identity=34%"; Hit description =Nucleic acid-binding, OB-fold; TonB box, N-terminal
MVYDFTLFDDVLTGSANPDYLIDVIRELVDVLQWSLDGKPKKVVFTMKDKCGIIVNCTLWEDFAFLLKDYLDKHENVPVILLLHLEKIKETQGAYGVSIQNSMYGSRLFTNEDLKDIEDYKNGVLIKERASDIKQQMIDEEGEFDSKDIPEAIDRILGKKLAFRFKAIPNNTRYSMSQISEDEDLIMLLLKRLPTYELARIELEMSDSSVKHGDDIAYIQSLLAIGDFDHESSKSVTPAKRGFMISESQLESVPFEDLSLIQLSCSKLSKHIKS

SEQ ID NO: 200529 - protein, 264 aa, Glycine max
  Coding DNA Sequence Number=SeqID_83751
  Gene Ontology: Mol. function=nucleic acid binding; Cellular component= ribonucleoprotein complex
  Homolog annotation: Hit_ID=P93396; Match level="QueryCoverage=94%, HitCoverage=89%, E-value=3e-44, Identity=53%"; Hit description =Transformer-SR ribonucleoprotein
  Pfam annotation: Domain name=DUF1777; Domain location=10-111; Score= -76.1; E_value=0.0048; Accession=PF08648.2; Description=Protein of unknown function (DUF1777)
  Pfam annotation: Domain name=RRM_1; Domain location=73-144; Score =83.6; E_value=6e-22; Accession=PF00076.12; Description=RNA recognition motif. (a.k.a. RRM, R
  Pfam module annotation: Pfam domain module=DUF1777::RRM_1; Domain location=10-111::73-144
  Subcellular localization annotation: CTP_CleavageSite=39; ConfidenceScore=5.89e-01
MADSPLARNSRSPSPWKAQSRSRSRSRSRSRSRPRQRPRSRSRSHGRSRSPIHGRSRSPIHGRSEPSNPGDTLYVTGLSSRVTERDLEEHFSKEGKVSSCFLVVEPRTRISRGFAFVTMESAEDAERCIKYLNQSVLEGRYITIERVFWLYSECIASAMLAAIKDDQYIHSRRKRARTPTPGHYLGLKNTREYGFRGERGRYRDGPDRDNYSRRRSPRRSPYRGGQDYSPRRSPYGGRSRRDSSRSLPYSPHGSPDRKYARGSR

SEQ ID NO: 200530 - protein, 70 aa, Glycine max
  Coding DNA Sequence Number=SeqID_83752
MRKGESGRASASKSRTKHEISALSATGTMPRAQNHTIAIVPISGQEPWKQQRGIACALKPWFCHLREIIE

SEQ ID NO: 200531 - protein, 311 aa, Glycine max
  Coding DNA Sequence Number=SeqID_83753
  Gene Ontology: Mol. function=chitin binding; Cellular component =extracellular region; Biological process=chitin metabolic process
  Homolog annotation: Hit_ID=UPI000044A8F0; Match level="QueryCoverage =97%, HitCoverage=100%, E-value=3e-43, Identity=31%"; Hit description= PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
QHVLTIEGLHLLAIRGLHALAFIGLHILTIRRLHVLAFRGLHVLAKRGLHALTFRGLHVLTFRGLHVLTFRGLHALTNRGLHGPAFRGLHVLTFIGLDVLAYIGLHFLAIKGLHVLAIRRGKDVLAFKGVHALAFRGLHVLPFRGMHALAIRGLHALAFIGQHVLTFRGRHAFAFRGLHVFAIRVLNVLAIRGLHALAFRGLRVLTIRGLHLLAIRGLHALAFKGLQILTIRRLHVLAFRGLHVLAFRGLHVLANRGPHALTFIGLHVLAFIGLHVLAFRGLHVLAIRGLHVLAFRGLHVLTFIGLQVLEL

SEQ ID NO: 200532 - protein, 79 aa, Glycine max
  Coding DNA Sequence Number=SeqID_83754
MAIREKHYILKSTLVSGISKRLQEKQVARMLRISDKDEKAVNEFQGLYPQAKQDEFGRIFRSPSLFEDVVKSILLCKCT

SEQ ID NO: 200533 - protein, 175 aa, Glycine max
  Coding DNA Sequence Number=SeqID_83755
  Gene Ontology: Mol. function=metal ion binding; Cellular component =integral to membrane; Biological process=ubiquitin cycle
  Homolog annotation: Hit_ID=Q8GT75; Match level="QueryCoverage=80%, HitCoverage=60%, E-value=8e-47, Identity=67%"; Hit description=RING -H2 finger protein ATL4M
GTLLGAMTGALIGQETESGFIRGAAIGAISGAVFSIEVFESSLVLWKSDESGIGCVLYLIDVLGSLLSGRLVRERIGPAMLSAVQSQMGAVEISFDEVQNLFDIGGAKGLSRDSVEKIPKITITSDNNVDASGEKDSCSVCLQVQIQRGWAGTSVIITAMFKASVKSLVLTGKRN

SEQ ID NO: 200534 - protein, 142 aa, Glycine max
  Coding DNA Sequence Number=SeqID_83756
MGIIIGQSLGKGCSSSTCESCPLADKFSTLSLEDNGKSYCDVGDGVVVLVRDGMAVPVGDGVAATTDDGDRVGAITRDGVAATIEIGDGVATTTEDNDGVVATTEDGDSVCATTKDGDVDGATNGAWADDLSVSLCDNTLIT

SEQ ID NO: 200535 - protein, 432 aa, Glycine max
  Coding DNA Sequence Number=SeqID_83757
  Gene Ontology: Mol. function=protein serine/threonine kinase activity; Cellular component=membrane; Biological process=protein amino acid phosphorylation
  Homolog annotation: Hit_ID=Q9LK35; Match level="QueryCoverage=71%, HitCoverage=37%, E-value=8e-63, Identity=42%"; Hit description =Receptor-protein kinase-like protein
  Pfam annotation: Domain name=APH; Domain location=98-270; Score=-8.1; E_value=0.021; Accession=PF01636.13; Description=Phosphotransferase enzyme family
  Pfam annotation: Domain name=Pkinase; Domain location=95-359; Score =121.8; E_value=1.9e-33; Accession=PF00069.15; Description=Protein kinase domain
  Pfam annotation: Domain name=Pkinase_Tyr; Domain location=95-359; Score=92.5; E_value=1.3e-24; Accession=PF07714.7; Description =Protein tyrosine kinase
  Pfam module annotation: Pfam domain module=APH::Pkinase::Pkinase_Tyr; Domain location=98-270::95-359::95-359
MSWLICRPKASPPAIAQPPMKSRSGSAHKMLLEFIAGILTTMVGALLYCLFRRKVIPFLKQRKTLKGKEHKSFEYDKISLRYFDFKELERATKNFSQDCLLGSGAFGNVYKGTFDLEGTLAIKRAHSESFSSVEEFRNEVRLLSAVRHRNLIGLIGYCEEPGRHGAKILIYEYVPNGSLLEYIKGNETSLTWKQRLNIAIGAARGIAYLHEGVKPSIIHRDIKPSNILLGEGFEAKVSDFGLVRLGPTGDQSHVSSQIKGTPGYLDPAYCLSFHLTKFSDVYSFGIILLQLVSARPVVDSAARPSLEKGSVEEIIDANLLCQSEPCNMEVMLKMGQLGLRCVVEEPKHRPTMTQVCQELEQALHSADDSFNNKQSPKRFHTPIGSSQQSTKSETQRSVESYDCSQSFVSIDSVGLQKFHVDMDSFSFKSTDL

SEQ ID NO: 200536 - protein, 356 aa, Glycine max
  Coding DNA Sequence Number=SeqID_83758
  Gene Ontology: Mol. function=protein phosphatase type 2C activity; Cellular component=protein serine/threonine phosphatase complex; Biological process=protein amino acid dephosphorylation
  Homolog annotation: Hit_ID=Q9M3V0; Match level="QueryCoverage=98%, HitCoverage=81%, E-value=1e-154, Identity=79%"; Hit description =Protein phosphatase 2C
  Pfam annotation: Domain name=PP2C; Domain location=2-307; Score=83.3; E_value=7.3e-22; Accession=PF00481.12; Description=Protein phosphatase 2C
MAVVQANNLLEDQSQIESGPLSLLDTGPYGTFVGVYDGHGGPETSRYVCDHLFQHLKRAVLQTELEIHLDNLHNKGFASEQKSMSEEVIRKAYQATEEGFLSVVTKQWPMNPQIAAVGSCCLVGVICGGILYIANLGDSRAVLGRVVRATGEVLAIQLSSEHNVARESVRQEMHSLHPDDSKIVVLKHNVWRVKGLIQGPLTNPEFDQEISRSIGDVYLKKAEFNKEPLYAKFRVREGFKRPILSSDPSISVHEIQQHDQFLIFASDGLWEHLSNQDAVDIVQNNPHNGIARRLIKAALQEAAKKREMRYSDLKKIDRGVRRHFHDDITVVVVFLDSNLVSRASSVRGPPLSVRGG

SEQ ID NO: 200537 - protein, 78 aa, Glycine max
  Coding DNA Sequence Number=SeqID_83759
MEKKESTEETSCSKQKMENLSKGKTQRQVKLEETDHKIEEKKQTGEGGEMTKHSSEETTGEGWRRRHVEQPKLEAEIK

SEQ ID NO: 200538 - protein, 58 aa, Glycine max
  Coding DNA Sequence Number=SeqID_83760
MDGEELPSPVNSDGRMQVGLGSRPIDRCPSPALNKQRTSLQGSPVSFVFAVSFTICLF

SEQ ID NO: 200539 - protein, 78 aa, Glycine max
  Coding DNA Sequence Number=SeqID_83761
MGLRIRFVGGGCTNSARQSIRGAPDSMAINSWGSRLDGGGCMNDNQFMGLRIRFIGGGCTNSARQSIRGAPDSMVKDA

SEQ ID NO: 200540 - protein, 201 aa, Glycine max
  Coding DNA Sequence Number=SeqID_83762
MKAGMEAMKEQMATMMEAMMSMKKIMKANAVAIAATSAVAKVNPMPPSGLNQMNHSTSNMVCKDMGSTGGPHYAQIQNKHAFPPYGLPPNYTLPNVAYTPSENVNNSIPILIESRQPQTSHAHVSQTVGETHEIPHHNLADFKPCLGYATEGQVVSGILLQNTLEGPQFRHQPQPLHSTTCKIPPIMEGMGKVGSSRGKRL

SEQ ID NO: 200541 - protein, 55 aa, Glycine max
  Coding DNA Sequence Number=SeqID_83763
MWDLLAITYKGSSEVKRNKLSLLTLFQQGRFGRALETHNQQKVLEGEIVEIEDKS

SEQ ID NO: 200542 - protein, 116 aa, Glycine max
  Coding DNA Sequence Number=SeqID_83764
  Gene Ontology: Mol. function=hydrolase activity; Biological process =aromatic compound metabolic process
  Homolog annotation: Hit_ID=Q8VZV6; Match level="QueryCoverage=53%, HitCoverage=19%, E-value=4e-12, Identity=53%"; Hit description =Putative phospholipase
MIFLKIIVNTNHFHSAEGSREYRGKAIKNLQCLAEISVMALKQTPLSDGQVHRCATSSDTSTSLYLPCSSRQICSSSCAMAVQGCSTVLHRLASASLHFHSTLNNNLGIEPHMGTT

SEQ ID NO: 200543 - protein, 95 aa, Glycine max
  Coding DNA Sequence Number=SeqID_83765
  Subcellular localization annotation: CTP_CleavageSite=31; ConfidenceScore=5.31e-01
MEEPSKKRKGSSSRSQRHSKAQDTPIPSSISSSSLFSLEEQRTRYTNLFSSRSIIDPKFIDMDFFSDESFKCIQAFHNSNLIPFMSLKLPVYSEL

SEQ ID NO: 200544 - protein, 59 aa, Glycine max
  Coding DNA Sequence Number=SeqID_83766
MACSPLQARMCSPLMARTYSPLKIDCPFEKGDNSCNLILSFANLSGNSLRVYILFDLVT

SEQ ID NO: 200545 - protein, 163 aa, Glycine max
  Coding DNA Sequence Number=SeqID_83767
MTTLTWMTLLFSNILPSDHNANLPLQMDQLGSCPQRHAVDREKSNRALGFPTLVTGLCSPTGCPFPPADGSGSRPQDTQWTRRSPTGSWSCQALIAGLCQFYGVPVTSSKGIRPPTNRAFIKKYCVPRQAQGKTPQQPGDGRQRATDAPPSPLEVTSAHPQKG

SEQ ID NO: 200546 - protein, 235 aa, Glycine max
  Coding DNA Sequence Number=SeqID_83768
MGCCFSTPNSKPPQNGDKHQQPHLGSHEQNCRIRISQPLEEESVKEVLSETPISKPQQVPILMPQTKTQLPEIQHPKVPIKKALELEEGSLVSETCSNGESLSTTATTTTENREDEATSKRSNGTRNRKRSYAVDGNRIGGRDRRPKSPGRKPEIPARSRSVRRRETDHARRHSGEGTTHRSRSPSRGGRSKLRLPGGVSRRVPPAKGVVEEKDTVSVKESLENPHVSLECFIFL

SEQ ID NO: 200547 - protein, 299 aa, Glycine max
  Coding DNA Sequence Number=SeqID_83769
  Gene Ontology: Mol. function=4 iron, 4 sulfur cluster binding; Cellular component=integral to membrane; Biological process=protein -chromophore linkage
  Homolog annotation: Hit_ID=P56766; Match level="QueryCoverage=99%, HitCoverage=47%, E-value=1e-148, Identity=74%"; Hit description =Photosystem I P700 chlorophyll a apoprotein A1
  Pfam annotation: Domain name=PsaA_PsaB; Domain location=1-299; Score =124.3; E_value=3.5e-34; Accession=PF00223.9; Description=Photosystem I psaApsaB protein
GMYFHGARFSNYEAWLSDPTHIRPSAQIWRASGITSELQLYCTAIGALVFAALMLFAGWFHYHKAAPKLAWFQDVESMLNHHLTGLLGLGSLSWAGHQIHVSLPINQFLNAAVDPKEIPLPHEFILNRDLLAQLYPRLDPVTGGLWLTDIIHHHLAIAILFLIAGHMYRTNWGIGHSIKDILEAHKGPFTGQGHKGLYEILTTSWHAQLSINLAMLGSLTIVVAHHMYSMPPYPYLATDYGTQLSLFTHHMWIGGFLIVGAAAHAAIFMVRDYDPTIRYNDLLDRVLRHRDAIISHLNW

SEQ ID NO: 200548 - protein, 52 aa, Glycine max
  Coding DNA Sequence Number=SeqID_83770
GDPSSSSQHALSALISCLARGLDIDALPNSSVALSMLSPTDELSSTVTFSTS

SEQ ID NO: 200549 - protein, 553 aa, Glycine max
  Coding DNA Sequence Number=SeqID_83771
  Gene Ontology: Cellular component=microtubule; Biological process =microtubule cytoskeleton organization and biogenesis
  Homolog annotation: Hit_ID=Q7XIP0; Match level="QueryCoverage=97%, HitCoverage=87%, E-value=5e-89, Identity=39%"; Hit description =Putative ABI3-interacting protein 2; CnAIP2
  Pfam annotation: Domain name=Frigida; Domain location=153-459; Score =372.1; E_value=8.9e-109; Accession=PF07899.2; Description=Frigida -like protein
MGVEEQGEEINVQSMIEQLSQAFLELEAQKGETENKIQWVEIKQHFHDLETELNKKLEELEAKEREYEAKQVEVDTLLAERKTVIASKEQDLLDRLQELKDAAVASIVEAHANHRNATLESVYDGENKDNKVSNSLGDTNSSEDDFPHKSDEKSKGVAVEGRPRPELTQFCEQMDAKGLLNYIVENKKKKSVNREEISVALQSATDPACLVLDLLEGFYPTNETSQLKDKSGASLQGMRKSCIIILEAMATLLARADPGADHLLNPQTKQHAKAIADEWRPNLARADTDAANGNSLEAKAFFQLISTFKIASEFDEEELCKLVLAVAQLRQAPELCCSIGLIHKMPAVVESLINTGKQIAAVHFIHAFQLQESFPPVPLLKAYLKNRRRNSQVKTGNVRDITSAKNDANAQELAALRAVIKCIEEYKLESDYPPDTLRKRVLQLEKSKGDRKRSGEFIKRPQSKRPRPNERRFSLHSSGGSVASTVVLGRQVPPVRAPYAANPDRYPHDGTITYDYQVPGQSIYTAASNAPPSNYGRYMGTSTSLQSSHQPYL

SEQ ID NO: 200550 - protein, 525 aa, Glycine max
  Coding DNA Sequence Number=SeqID_83772
  Gene Ontology: Mol. function=pepsin A activity; Cellular component =cellulose and pectin-containing cell wall; Biological process =proteolysis
  Homolog annotation: Hit_ID=Q1SED9; Match level="QueryCoverage=89%, HitCoverage=74%, E-value=0.0, Identity=87%"; Hit description =Peptidase aspartic, active site
  Pfam annotation: Domain name=Asp; Domain location=133-474; Score= -7.0; E_value=3.3e-13; Accession=PF00026.14; Description=Eukaryotic aspartyl protease
  Subcellular localization annotation: CTP_CleavageSite=42; ConfidenceScore=5.62e-01
MSSTFLHRDADLTSLLSPPSFPFLSFFRSVTAGTTITRIPTRSSSPSHQLMARELTHHLSLILFLIATVAGDTALLRNRHHGSRPSMLLPLYLSAPNSSTSALDPRRQLTGSESKRHPNARMRLHDDLLLNGYYTTRLWIGTPPQMFALIVDTGSTVTYVPCSTCEQCGRHQDPKFQPESSSTYQPVKCTIDCNCDGDRMQCVYERQYAEMSTSSGVLGEDVISFGNQSELAPQRAVFGCENVETGDLYSQHADGIMGLGRGDLSIMDQLVDKKVISDSFSLCYGGMDVGGGAMVLGGISPPSDMTFAYSDPDRSPYYNIDLKEMHVAGKRLPLNANVFDGKHGTVLDSGTTYAYLPEAAFLAFKDAIVKELQSLKQISGPDPNYNDICFSGAGNDVSQLSKSFPVVDMVFGNGHKYSLSPENYMFRHSKVRGAYCLGIFQNGNDQTTLLGGIIVRNTLVMYDREQTKIGFWKTNCAELWERLQTSIAPPPLPPNSGVRNSSEALEPSVAPSVSQHNASPGIMSC

SEQ ID NO: 200551 - protein, 199 aa, Glycine max
  Coding DNA Sequence Number=SeqID_83773
MVECMPSSFADLVFAGERIEVGLRRGKFDYTASISYCNRRPGVGEAKKKEGDVHAVTTTPTWPRSSHTLHNPMYQCPPHQYNYLANIGSPPCSMPFRPRITNQPQRPPQHHPQNPFPTQPRPSANPNPNANTNPRRNFLARKVAEFTPILMSYVGLLPSLLRNQMVVVSSRKIYQPPFPRWYNPNAIGAYHGGVPGHFI

SEQ ID NO: 200552 - protein, 112 aa, Glycine max
  Coding DNA Sequence Number=SeqID_83774
  Homolog annotation: Hit_ID=Q1SED9; Match level="QueryCoverage=57%, HitCoverage=9%, E-value=3e-08, Identity=41%"; Hit description =Peptidase aspartic, active site
MTKLELEAPTRVAPPKSYQAKITHAFPCTPIYIFTLLKSPILVRKSQNILNSTQKNWWQQHFFLVVSLAILITLLLGLSILGTFLIWKKRQQSSHSYKPVDAAVPEQELQPL

SEQ ID NO: 200553 - protein, 111 aa, Glycine max
  Coding DNA Sequence Number=SeqID_83775
MTTDRPPLPMAHTDPGIRPNISTCVQKCKCHVCIEQSKNHLTLLAKQTNNSQADATRFESCLRIGKVLAPHVCRQRIKLNVLMMPKDHMLLKALFKTKKLKIFKMDDQDSL

SEQ ID NO: 200554 - protein, 256 aa, Glycine max
  Coding DNA Sequence Number=SeqID_83776
  Gene Ontology: Mol. function=RNA-directed DNA polymerase activity; Biological process=RNA-dependent DNA replication
KEHALRRPYRTRARARVMGEAEEVQEKMKADMEAMKEQMATMVEAMMSMKKIMEANAVTVAATSTVAKVNLMPPSDLNQMNHPTSDMVGKDLGSTDGPMMCKFKTSTPSRHMACLPTIHHPMWRTLPTHEIPHHNLVDFEPCLGYATEGQAVGEMGELDQLEERLRDIKRGEDYAFANLEELFLYKGITCPKNHLKMYCRKMGAYAKDEELLIHSFQESLTGVVVTWYTNLEPSRVHSWEDLMVAFVRQCRYNGFG

SEQ ID NO: 200555 - protein, 114 aa, Glycine max
  Coding DNA Sequence Number=SeqID_83777
  Subcellular localization annotation: CTP_CleavageSite=82; ConfidenceScore=5.04e-01
MASYGGEPVLDSSSPCSGISNHLSSFSILLPLIFKKQRTPLMKKIQGLQAPHGAKSLVSAMPSKIILMMPKNQELSKSQRIRSQKASRIKFQRIKFKNNQVSRFNEVSRIKIQE

SEQ ID NO: 200556 - protein, 75 aa, Glycine max
  Coding DNA Sequence Number=SeqID_83778
MFPLFSKGVRKRKIDADQTCLVMVRTCSEAEEGAGPSGRVHKSKVGSDARHCCSAIKVVGFKFGQRWWRVVLVRW

SEQ ID NO: 200557 - protein, 69 aa, Glycine max
  Coding DNA Sequence Number=SeqID_83779
MTLVAPKHRTEPNSLLSKLPSPVVADTVASLCSSSCEDQMALRGVWQLNKLIVSYCNWGGSSRGLIFVL

SEQ ID NO: 200558 - protein, 240 aa, Glycine max
  Coding DNA Sequence Number=SeqID_83780
  Gene Ontology: Mol. function=binding; Biological process=DNA integration
  Pfam annotation: Domain name=HEAT; Domain location=81-116; Score =23.2; E_value=0.00092; Accession=PF02985.12; Description=HEAT repeat
MRIIPESQIALFTEQDQNTQASVVLCLASTIDRASDLDLTRLSKLLSRFKKLLKRDDFKVKPVLLTLVESIVAAGGASDPAQLKSLIPCLVEALSSEDWATRKAAAEMLMVVADVERDFLSEFKGEVSSGRYESDVGSVEAVFDQRIWDVETNMLLFGLSFGNLPMPYASAVGSLMYAMVCTRLDLAKAASVVNLDARRSVIGYAFTIGNSLVSWKATPQPIVALLTAKAEYMALVEATK

SEQ ID NO: 200559 - protein, 155 aa, Glycine max
  Coding DNA Sequence Number=SeqID_83781
  Homolog annotation: Hit_ID=Q1S0U5; Match level="QueryCoverage=51%, HitCoverage=16%, E-value=1e-07, Identity=33%"; Hit description =Transposase, IS4
LPFAHKLIDLFKDVVANGDFQWAPLSGILPTSVKVNMNDGYRPSLKGIGLDLEEGSSVGATYAFEGIHLNNSQGIVSQGIGSQKSREKRKRINHTEKLSKMKATTSSRITDAISVIVEAWTIDGTHVPCVVTPSEQARFIGTKGMPTQNITVACD

SEQ ID NO: 200560 - protein, 120 aa, Glycine max
  Coding DNA Sequence Number=SeqID_83782
  Homolog annotation: Hit_ID=Q9C9V9; Match level="QueryCoverage=88%, HitCoverage=12%, E-value=6e-22, Identity=51%"; Hit description =Putative golgi transport complex protein; 67058-70172
MFQNLHRITAKKICHFPNPIELLIDNVDADEVILVVEAEDLEVELGGHGEIDFFGVDGNHEVVKLLGEAKGVDGVLEELGGAMEVGELGDFGGDRAVRVGELRAEAANRRLERGKCRSKG

SEQ ID NO: 200561 - protein, 648 aa, Glycine max
  Coding DNA Sequence Number=SeqID_83783
VAGGDTQVVIRTLSFAIYPTQSPRLMSSSAPLSSRDGESDDMRRYPSGYPYKRFLLILTREAEIPKWLSAHTHLQFVRVRVQGNEPVDTQRLTSSSAPMSSRDSESDDMRRYPKTNVVICTFCQHEASEPADTQSLTSSSAPFSSRDGESDDMRRYPSESNVVSCTICQLGANEPVDTQRLRSSSAPSSSRDGEFDHMRRYPSDLESDSMQSLASSSSPFVNQWQASPQVASGDTGVGICTKTISVNPTPRRGDTHVVICIHLFAVHQTQSPASEPIDTQRLTSSSAPLSSRDGRYTQVVIRTPSYAICHTESLASEPVGTQRLTSSSAPLSSRDGESDDMRQYPSGKRPLDTQSLTSSSAPLSSRYGEFDYMWRYSSDTNIVIFTFCKPEASEPVDTHSLTSSSAPLSSRVDESDDMQRYPSETNVIICTFCQPEASGPIDTQRLTSCSAPLSSRDGKSDDMRRHPSAVKSGSRRRYPKEIGPVDTQCLTSSSVPLSSIDGESDDMRRYPSETNVVICTICQLEASEPVDTQRLTSSSAPLSSRDGESDDMRRYPSGYPRRYPSGYLHTLICYLSGIESGSMQRLTSSFAPLVNQRQARPLKQSNEVICIFCQPEASEPFETQSLTSSSAPLSSRDDESDDMQRYPR

SEQ ID NO: 200562 - protein, 621 aa, Glycine max
  Coding DNA Sequence Number=SeqID_83784
  Gene Ontology: Mol. function=binding
  Homolog annotation: Hit_ID=Q6L4Y6; Match level="QueryCoverage=88%, HitCoverage=92%, E-value=1e-141, Identity=47%"; Hit description =Putative tetratricopeptide repeat (TPR)-containing protein
  Pfam annotation: Domain name=CwfJ_C_1; Domain location=8-117; Score= -48.2; E_value=0.06; Accession=PF04677.5; Description=Protein similar to CwfJ C-terminus 1
MKSRIPEISTSKTTHNLNCSCFFCILSETVPSVRRAKISNYLKQMPLRDDQEHVLILSGLWKIAMTKPNDPEFPSLGIFACMAKLISKGVTNRSWLLRHQNIYIPYYAAHIIGSYTIKKAKFAKKAVKSLVVQPLLELLKGKISWVEQRVALRALAHIASQEATFEALKAHEVEIIEAAMNIASTCLNKVYDDFVGLKKSERLKYHRNLLTRGLGGFELENRKAEEWASQLQCRSLYLLHCFACRERSLRLICKKKFLKDLCGMWGGLKNPSSPCGIGLLKTLCHTQMGRESIAGLQEVLESLCNVSRSSDERQHMAIESLMQLLMDPVTRYKVIDKVAPVLADLVELRDIKGKHKIGKTIMKVLLHDYHKIKLCKVSLYSERTRSRLEELWDLKVERINREKLMSVQEMREKEALSCVLKKEGSKSFFAGEIEKAVVKYSEALNFCPLKQRKERIVLHSNRAQCYLLLQHSEGAISDATRALCLSGAARPHGKSLWRRSQAYDMEGFAKESLMDCLAFIDTKGLKIPYYVARFFNKQINSSWLFASAQSKWYSKHEEMNGFVSLSQKAMRKMKGMSYIVEEPFTGRRARERRKCVRMSQGRKLVSANVRRSWHCIEKDEA

SEQ ID NO: 200563 - protein, 403 aa, Glycine max
  Coding DNA Sequence Number=SeqID_83785
  Gene Ontology: Mol. function=binding; Cellular component=thylakoid; Biological process=photosynthesis
  Homolog annotation: Hit_ID=Q1SBZ0; Match level="QueryCoverage=98%, HitCoverage=36%, E-value=1e-173, Identity=76%"; Hit description =Tetratricopeptide-like helical
  Pfam annotation: Domain name=TPR_1; Domain location=122-155; Score =24.2; E_value=0.00047; Accession=PF00515.18; Description =Tetratricopeptide repeat
  Pfam annotation: Domain name=TPR_1; Domain location=156-189; Score =30.8; E_value=4.8e-06; Accession=PF00515.18; Description =Tetratricopeptide repeat
  Pfam annotation: Domain name=TPR_1; Domain location=2-35; Score=11.5; E_value=0.22; Accession=PF00515.18; Description=Tetratricopeptide repeat
  Pfam annotation: Domain name=TPR_1; Domain location=54-87; Score =20.3; E_value=0.007; Accession=PF00515.18; Description =Tetratricopeptide repeat
  Pfam annotation: Domain name=TPR_1; Domain location=88-121; Score =8.4; E_value=0.53; Accession=PF00515.18; Description=Tetratricopeptid e repeat
  Pfam annotation: Domain name=TPR_2; Domain location=122-155; Score =16.2; E_value=0.12; Accession=PF07719.7; Description=Tetratricopeptid e repeat
  Pfam annotation: Domain name=TPR_2; Domain location=156-189; Score =28.0; E_value=3.3e-05; Accession=PF07719.7; Description =Tetratricopeptide repeat
  Pfam annotation: Domain name=TPR_2; Domain location=2-35; Score=8.7; E_value=3.2; Accession=PF07719.7; Description=Tetratricopeptide repeat
  Pfam annotation: Domain name=TPR_2; Domain location=54-87; Score =16.9; E_value=0.075; Accession=PF07719.7; Description=Tetratricopepti de repeat
  Pfam annotation: Domain name=TPR_2; Domain location=88-121; Score =6.4; E_value=5.9; Accession=PF07719.7; Description=Tetratricopeptide repeat
  Pfam module annotation: Pfam domain module=TPR_1::TPR_1::TPR_1::TPR _1::TPR_1::TPR_2::TPR_2::TPR_2::TPR_2::TPR_2; Domain location=122 -155::156-189::2-35::54-87::88-121::122-155::156-189::2-35::54-87::88- 121
MSCINFNAGIVNFKFKEFDAAVEDLSACVKLDKDNTSAYTYLISYMEGLFSISPNKLTVQGLALSSIGEYKKAEEAHLKSLQLDKNFLEAWAHLTQFYQDLAKPTKAQECINKMLQIDGRFARANHLRGLLFHAMGEHRKAIKDLTMGLSIDGSNIECLYLRASCYHAVGQYKEAVKDYDAALDLELDSMDKFVLQCLAFYQKEIALYTASKFNGDFCWFDIDGDIDALFKEYWCKKLHPKNVCEKVFRQPPLRESLRKGKLKKQEFTITKQKASLLQASDSIGMKIQYDCPGFLPNRRQHRMAGLAAIEIAQKVSKAWRSLHAEWKYSNKGNSKNGRRARRRERINMPSQNRGGAGCSTSSTSVTSSNGTVDDRLSSRTLSWHNVYSLAVRWRQISEPCDPV

SEQ ID NO: 200564 - protein, 65 aa, Glycine max
  Coding DNA Sequence Number=SeqID_83786
MYIARGRWQRLTSKSKGHRCCPAMARVPETAPKHLEQLRFATRGMMLKSWLLFLLLQTCSPYPFA

SEQ ID NO: 200565 - protein, 420 aa, Glycine max
  Coding DNA Sequence Number=SeqID_83787
  Gene Ontology: Mol. function=binding
  Homolog annotation: Hit_ID=Q1SBZ0; Match level="QueryCoverage=92%, HitCoverage=36%, E-value=1e-133, Identity=65%"; Hit description =Tetratricopeptide-like helical
  Pfam annotation: Domain name=TPR_1; Domain location=293-326; Score =12.5; E_value=0.17; Accession=PF00515.18; Description=Tetratricopepti de repeat
  Pfam annotation: Domain name=TPR_1; Domain location=327-360; Score =29.3; E_value=1.4e-05; Accession=PF00515.18; Description =Tetratricopeptide repeat
  Pfam annotation: Domain name=TPR_1; Domain location=361-394; Score =36.1; E_value=1.2e-07; Accession=PF00515.18; Description =Tetratricopeptide repeat
  Pfam annotation: Domain name=TPR_1; Domain location=45-78; Score =26.0; E_value=0.00014; Accession=PF00515.18; Description =Tetratricopeptide repeat
  Pfam annotation: Domain name=TPR_1; Domain location=79-112; Score =2.7; E_value=2.6; Accession=PF00515.18; Description=Tetratricopeptide repeat
  Pfam annotation: Domain name=TPR_2; Domain location=293-326; Score =15.4; E_value=0.2; Accession=PF07719.7; Description=Tetratricopeptide repeat
  Pfam annotation: Domain name=TPR_2; Domain location=327-360; Score =27.1; E_value=6.2e-05; Accession=PF07719.7; Description =Tetratricopeptide repeat
  Pfam annotation: Domain name=TPR_2; Domain location=361-394; Score =31.2; E_value=3.7e-06; Accession=PF07719.7; Description =Tetratricopeptide repeat
  Pfam annotation: Domain name=TPR_2; Domain location=45-78; Score =14.1; E_value=0.51; Accession=PF07719.7; Description=Tetratricopeptid e repeat
  Pfam annotation: Domain name=TPR_2; Domain location=79-112; Score =4.6; E_value=9.5; Accession=PF07719.7; Description=Tetratricopeptide repeat
  Pfam module annotation: Pfam domain module=TPR_1::TPR_1::TPR_1::TPR _1::TPR_1::TPR_2::TPR_2::TPR_2::TPR_2::TPR_2; Domain location=293 -326::327-360::361-394::45-78::79-112::293-326::327-360::361-394::45 -78::79-112
MAPPPPPPAAAATSERVDLARLCASKDWSKAIRVLDSLISHSNAIQDLCNRAFCYSKLELHKHVIRDCDRALQLDPTRLQAYILKGSALSVLGRQENALLVWEQGYEHALHQSADLKQLLELEELIETAKQGKNTLCESENHRPPPQTKSDSLSNGSSSETLKIQDTLGTPAELCGDATGDKSETCLNSADNSDLKHESHDEDRDSNKSDGQVNGSPDVLDILSYNSESCNDSSDASESSEKVSTNSGDSSNIPEIFRNPISKFIFSDERKGEARKNKKFCIAQISNTNSISVDFRLSRGIAEVNEGKYAHAISIFDQILKKDPAYPEALIGRGTAYAFQRELDAAIADFTKAIQFNPLAGEAWKRRGQARAALGEFVEAIEDLTKALEFEPDTADILHERGSLPLTNLLFVQLIFAGLE

SEQ ID NO: 200566 - protein, 163 aa, Glycine max
  Coding DNA Sequence Number=SeqID_83788
  Subcellular localization annotation: CTP_CleavageSite=56; ConfidenceScore=5.57e-01
MDRNPDDLTITFPGTRKTKARGPSNASTFALITAPPTSTPTPPPVPAPAPYTSAPSDTSAQSSNILVAWPGVQPSPAGGGEAPTTLEPTPDATPEEMPQDTPAATPTEATEEGDSTTDTNYVADMAAAQSTWDPWPTPAQDTSLPAQDAPSSPQDDPTLAQED

SEQ ID NO: 200567 - protein, 89 aa, Glycine max
  Coding DNA Sequence Number=SeqID_83789
MGVQIASRPTWALWNIPPEGGCFWRKQPCSPGQAKLAWASWAATTSLFSPINRGKRAEQKCSALLVLRILSKLVKKIVFVKKIQVEVLP

SEQ ID NO: 200568 - protein, 90 aa, Glycine max
  Coding DNA Sequence Number=SeqID_83790
  Homolog annotation: Hit_ID=O23661; Match level="QueryCoverage=56%, HitCoverage=8%, E-value=9e-14, Identity=72%"; Hit description=Auxin response factor 3
MSWLWKPKIVVDGEEEDTGAMVKSTTPRMFCKTLRASDTITHGGFSVPHRAAEDCFPSLIVRHTKTVLGITVVVCLMSTGLFKMGIRRTV

SEQ ID NO: 200569 - protein, 163 aa, Glycine max
  Coding DNA Sequence Number=SeqID_83791
  Gene Ontology: Mol. function=cation transporter activity; Cellular component=integral to membrane; Biological process=calcium ion transport
  Homolog annotation: Hit_ID=Q8L783; Match level="QueryCoverage=77%, HitCoverage=28%, E-value=6e-48, Identity=77%"; Hit description =H+/Ca2+ antiporter, putative
  Pfam annotation: Domain name=Na_Ca_ex; Domain location=1-125; Score =28.1; E_value=3e-05; Accession=PF01699.14; Description=Sodiumcalcium exchanger protein
MTPARKKIVKFNATELIISIYALKSGMTCVVQLSLLGSILSNMLLVLGCAFLCGGIVNHEKEQVFNKAATSVNSRLLLMAVMGILFPAVLHYTHSEVHVGKSELSLSRFSSCIMLVAYVAYLFFQLKSQRNLYVSVNEVGSLISSFLFVSSVILLFVDMWYAM

SEQ ID NO: 200570 - protein, 619 aa, Glycine max
  Coding DNA Sequence Number=SeqID_83792
  Gene Ontology: Mol. function=nucleic acid binding; Cellular component= intracellular; Biological process=DNA integration
  Homolog annotation: Hit_ID=Q1RXN8; Match level="QueryCoverage=87%, HitCoverage=90%, E-value=1e-55, Identity=54%"; Hit description =Peptidase S8 and S53, subtilisin, kexin, sedolisin; Integrase, catalytic region; Zinc finger, CCHC-type
MRGRSGRVYERDRVKLGILDVVISIVKGPSKILFVHRDLCNSCTIVDHSHPSRGRRFRTIMASSVGNKKKRRSTTGSTKFDIEKFSRSNDFGLWRIKMQAILVHQGLDDGLKGESSLLATMSDKEKKDLIEKAKSTIILCLGDKALREVAREPIATTIWLKLESLYTTKLVANRLFLKQQLYFFKMTEERMLSDQIDDINKILDDIENLDVKMEDEDKALMLLHGLPSSYEHFKDAILFGRDQTITLEEDCPERRGKDSKKSQEPRDVDIAQAGYETVNVLVVSNSKIEKDWVMDSSCTFHLCPRCDYSESMILNEGGVVMLGNNKPCLQTPIELWSGKPANYSNLRVFGAFAFAHIKQDKLGARAIKYAFIGYPLGIKGYKLWRMEPVNDYNLAKDKVRRNIVPPRRYEQANLIYLALTIAEEIQATEPRNFKEALNNKERVDFKEIFSPVVKYCSIRIMLAIVTQFDLELEQLDVKTAFLHGDLEEAAYMQQPKDFAKENGKQGYMKKFVEKFRMHESKPISTPLGQHDKLSTKDAPNSDEERERIALIPYSNEVGSIMCSMVCNNPNLAYVVNMVSRKMESEEPIKGYIDSDVIGNIDTRKSLSIYVFTFFGTAVS

SEQ ID NO: 200571 - protein, 128 aa, Glycine max
  Coding DNA Sequence Number=SeqID_83793
MRFHSFNHNKRKIGVYERDRVKLGILDVVISIAKGPSKILFVLKDLCNSCTIVDLFVEAMPSKVILMMPKNQELSKVFKQRFKNQVSSFKIQDSRIKFQESRIKNQESRSRFKTQDSRIKRRLNQDKY

SEQ ID NO: 200572 - protein, 117 aa, Glycine max
  Coding DNA Sequence Number=SeqID_83794
  Gene Ontology: Mol. function=RNA-directed DNA polymerase activity; Cellular component=chromatin; Biological process=chromatin assembly or disassembly
  Homolog annotation: Hit_ID=Q947Y6; Match level="QueryCoverage=98%, HitCoverage=10%, E-value=5e-14, Identity=42%"; Hit description =Putative retroelement
MDNMQLWGSAENPNVVKEDNNMFTEQRSENIVHGGLEHGKYVTKTKRHDLVLISVESHLMHILRLKVNLAKSGIIYTILQESYFFLRRGTGEEKRLVLGGIQPLASNLATYDSISSF

SEQ ID NO: 200573 - protein, 424 aa, Glycine max
  Coding DNA Sequence Number=SeqID_83795
  Homolog annotation: Hit_ID=Q5GA22; Match level="QueryCoverage=35%, HitCoverage=44%, E-value=4e-31, Identity=44%"; Hit description =Hypothetical protein adh1B
MKKTYMFYSGGVPKRNMTIRVMNEYDLTLKELGGTNPRQVLIMSKRIYLIMIVIIKKGENVNLLRFIAALREMRKPKSPPSPSSNSTTPATAGSQTRFGFRIMVGVDGEILPETLQRMLSICDHMFVDIQALVCRFDNINGRVSHVVLRGSGFFYLLPRVTFLKASTDEPVFIDVEVRKWCCMVVMHVKDGCEVDPTGAEDCFLGGFLAGIAKGLAMPDAALLGNFFGSIVVAQLGPPKHDFNLIQYESLEFYCGMVLHCSNLFISALETHLILEKAGDGIVVKGKAYGICSIRVDGNDALAVYSAVHTAREIAIREKTGKKGAKQIWREKKRRGDAGGEARDVRWKSECSCRHGLLLRSSGTEKATKFKRLALCNHTVQLLQMFGLNTRKSAYTKIVGRNIFRQRLEAGDHEADIEQCRKLTI

SEQ ID NO: 200574 - protein, 43 aa, Glycine max
  Coding DNA Sequence Number=SeqID_83796
MDATSTLPTPASPTLLCSPPGSSQKKICLFVCYASSFQFPSHP

SEQ ID NO: 200575 - protein, 67 aa, Glycine max
  Coding DNA Sequence Number=SeqID_83797
  Gene Ontology: Mol. function=protein serine/threonine kinase activity; Cellular component=membrane; Biological process=protein amino acid phosphorylation
  Homolog annotation: Hit_ID=Q9AWA6; Match level="QueryCoverage=98%, HitCoverage=16%, E-value=5e-18, Identity=68%"; Hit description =Serine/threonine/tyrosine kinase
MGEPFAQGAFGKLYRGTYNGEDVAIKILERPENDPAKAQLMEQQFQQLLSISEFLSNINHDLYFSSC

SEQ ID NO: 200576 - protein, 165 aa, Glycine max
  Coding DNA Sequence Number=SeqID_83798
  Homolog annotation: Hit_ID=Q9SE03; Match level="QueryCoverage=16%, HitCoverage=20%, E-value=5e-07, Identity=88%"; Hit description =Copper chaperone homolog CCH
MGPTYSDMGCKLALEDKTRVAFRRRQRHEHVDASRHAKPCNCSSLASQQQKACVCCFIKLPCRICHQALRCARKWACYGSKNNRVGFVNSLAFAKSGEFLVAGVGHVKIFSNCVLLTVVLKVGMSCQGCAGAVNRILGKMEGIFIPASYLYYQIQNENDLVIVAT

SEQ ID NO: 200577 - protein, 138 aa, Glycine max
  Coding DNA Sequence Number=SeqID_83799
  Gene Ontology: Mol. function=catalytic activity; Biological process =trehalose biosynthetic process
  Homolog annotation: Hit_ID=Q45RR4; Match level="QueryCoverage=50%, HitCoverage=51%, E-value=7e-25, Identity=79%"; Hit description =Trehalose-6-phosphate phosphatase
  Pfam annotation: Domain name=Trehalose_PPase; Domain location=1-138; Score=-60.8; E_value=0.0066; Accession=PF02358.7; Description =Trehalose-phosphatase
MDATSTLPTPASPTLLCTPPGSSQKKEYTPDISGLCAMSRCFPFPPLGYTNKGYEKEGYNRGCGITDKALAEKVRLVLNEYPQLRLTQGRKVLEICLTIKWDNGKALEFLLESLGYKNSNDVFPIYIGDDRTDEDAFR

SEQ ID NO: 200578 - protein, 155 aa, Glycine max
  Coding DNA Sequence Number=SeqID_83800
  Subcellular localization annotation: CTP_CleavageSite=37; ConfidenceScore=5.26e-01
MFAHSIKGCRPLGRACGVLIPSPSRLFRFFRRFPQINVGGDSARIPFVEHASRESRVALPPKGRLRHYGSKNNRVGFVNSLAFAKSGEFLVAGVGHVKIFSNCVLLTVVLKVGMSCQGCAGAVNRILEKMEGIFIPASYIYYQIQNENDLVIVAM

SEQ ID NO: 200579 - protein, 76 aa, Glycine max
  Coding DNA Sequence Number=SeqID_83801
MVVEEAKSTMGTNAEEEKMVIVRFGDLQTMRRVRIGKRLLMKKKQMVAAAEAEKSLPVSPAGGPQPLYPCYEYTLF

SEQ ID NO: 200580 - protein, 208 aa, Glycine max
  Coding DNA Sequence Number=SeqID_83802
  Gene Ontology: Mol. function=hydrolase activity; Biological process =aromatic compound metabolic process
  Homolog annotation: Hit_ID=Q1SED4; Match level="QueryCoverage=93%, HitCoverage=80%, E-value=1e-65, Identity=73%"; Hit description =Alpha/beta hydrolase fold
MGTQEDKKKIMGIVEEAHNMTIVGKGNEIVILTHGFGTDQSVWKHLVPHLVDDYRVVLYDNIGAGTTNPDYFDNIGAGTYSPSCKSFRCNLASSLVTLSPLWWASSLPSLTLISSPNSSSSLLLKARRSDPTLRRNPIELQNMVFGVRSAGDRRDMDSVAVQEFSRTLFNMRPDIALSLAQTIFQLDMRPILSHLTVPCHIIQNTKCV

SEQ ID NO: 200581 - protein, 76 aa, Glycine max
  Coding DNA Sequence Number=SeqID_83803
MLTTHYGCTSIVDFTSSITIAIINKTSSERFEDAVIASQQASKLDPSSFEVNVVVRRARAVASARMSGILLFNVGA

SEQ ID NO: 200582 - protein, 131 aa, Glycine max
  Coding DNA Sequence Number=SeqID_83804
  Subcellular localization annotation: CTP_CleavageSite=81; ConfidenceScore=5.03e-01
MPISPYGSISWDRAHKTPSGSGGVQQGHGVSSFGYGPLLVLQGARPPQQGHAIGSRLQDTQWTRRSPNRVLGFPALITSLCQFYGVPVIPSGVANCRNLPFSGRATRELRRSDFLFDGGYVGAKAPLLSTS

SEQ ID NO: 200583 - protein, 168 aa, Glycine max
  Coding DNA Sequence Number=SeqID_83805
  Homolog annotation: Hit_ID=Q47522; Match level="QueryCoverage=30%, HitCoverage=64%, E-value=5e-24, Identity=100%"; Hit description=LacZ protein
GTKAGTGPPLEVDGIDKLDFSLTLELGLYSIPTFMHCPLAFQCMVTRGVGLGALHVSDLRDSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASAD

SEQ ID NO: 200584 - protein, 89 aa, Glycine max
  Coding DNA Sequence Number=SeqID_83806
MRGQDIYSSQEETTSFPSFSGSEDEVRGEEFSEEVYPPGRRKIIYNGLTNEITLTHLGTKFVLHPQIPSQVAKDQLSMKDKRDEEEKEG

SEQ ID NO: 200585 - protein, 136 aa, Glycine max
  Coding DNA Sequence Number=SeqID_83807
  Gene Ontology: Mol. function=RNA-directed DNA polymerase activity; Biological process=RNA-dependent DNA replication
MTLFEEEVEDKDRDKWIVWFDGVSNALGHKVGTVLVTPDDQCIPFTTRLGFHCTNDMVEYEAYIRKLIGYFDDISFHHIPREENQMVNVLATLASMFQLTPHGDFPYIEFRCHGKPTHCCLIEDEQDGKPWYFDIK

SEQ ID NO: 200586 - protein, 150 aa, Glycine max
  Coding DNA Sequence Number=SeqID_83808
  Gene Ontology: Mol. function=tetracycline:hydrogen antiporter activity; Cellular component=integral to membrane; Biological process=tetracycline transport
  Homolog annotation: Hit_ID=Q8ZRM5; Match level="QueryCoverage=99%, HitCoverage=38%, E-value=2e-66, Identity=86%"; Hit description =Putative drug efflux protein
  Pfam annotation: Domain name=DUF1393; Domain location=4-123; Score= -134.7; E_value=0.019; Accession=PF07155.2; Description=Protein of unknown function (DUF1393)
MPLALWALTISAFAIGTTEFVIVGLIPTIAEQLSITLPSAGMLVSIYALGVAVGAPVLTALTGKLPRKQLLMGLMALFTVGNLVAWLAPNYETLVMARLLTGLAHGVFFSVGSTIATSLVSKEKAASAIAIMFGGLTVALVTGVPLGTLI

SEQ ID NO: 200587 - protein, 261 aa, Glycine max
  Coding DNA Sequence Number=SeqID_83809
  Gene Ontology: Mol. function=transcription factor activity; Biological process=regulation of transcription, DNA-dependent
  Homolog annotation: Hit_ID=Q5PFE2; Match level="QueryCoverage=98%, HitCoverage=84%, E-value=7e-88, Identity=64%"; Hit description =Hypothetical transcriptional regulator
  Pfam annotation: Domain name=HTH_1; Domain location=5-64; Score=74.9; E_value=2.6e-19; Accession=PF00126.17; Description=Bacterial regulatory helix-turn-helix protein, lysR family
  Pfam annotation: Domain name=LysR_substrate; Domain location=88-261; Score=93.5; E_value=6.6e-25; Accession=PF03466.10; Description=LysR substrate binding domain
  Pfam module annotation: Pfam domain module=HTH_1::LysR_substrate; Domain location=5-64::88-261
MKASSEELKVFIAVVESGSFSRAAEQLQMANSAVSRTVKKLENKLGVSLLTRTTRQLALTYEGELYFRRVQKLILEIATAENELIERQQAPQGVLRIDAATPVILNLLMPMIKPFRERYPAVTLSLISSESFINLIDRKVDVAIRAGDLTDSTLRARLLFTSYRKMVATPAYLAKYGTPASVEALAQHHCLGFVETPRLNRWPVSANGSDLYEIDAAMSSNSGETIKQLCLNDQGIACLSDFMVNAEIAAGTFVEVLAHQS

SEQ ID NO: 200588 - protein, 134 aa, Glycine max
  Coding DNA Sequence Number=SeqID_83810
MASCKRKAATLVSQAGYDRSRFVSQEAWDHYSDNMLARNILPERNVKMYINEFDDFRRELIRRNWHKQLTNLTEGSIDVAIVKEFYANLYVPKDKSPKQVRVRRHLIKFDVDSLNTFLETPVVMEQGESLPSYS

SEQ ID NO: 200589 - protein, 135 aa, Glycine max
  Coding DNA Sequence Number=SeqID_83811
NYVGLSSSLEDTQEQEPCFCRPPHKLCHTDPERQNLVILHPLSSRGSGPDDTRRQNLVIPHPFAIQTQSCPMASRDKIWSFCTLVSSRGGGPDDTRRYLTVIRTLLSSRGGGPDDKQRQNLVILHPCVIQRRLAR

SEQ ID NO: 200590 - protein, 329 aa, Glycine max
  Coding DNA Sequence Number=SeqID_83812
  Gene Ontology: Mol. function=oxidoreductase activity; Biological process=electron transport
  Homolog annotation: Hit_ID=Q8UJH8; Match level="QueryCoverage=99%, HitCoverage=100%, E-value=1e-140, Identity=77%"; Hit description =Oxidoreductase
  Pfam annotation: Domain name=CO_deh_flav_C; Domain location=225-325; Score=14.1; E_value=5.6e-05; Accession=PF03450.7; Description=CO dehydrogenase flavoprotein C-terminal domain
  Pfam annotation: Domain name=FAD_binding_5; Domain location=2-219; Score=334.7; E_value=1.5e-97; Accession=PF00941.11; Description=FAD binding domain in molybdopterin dehydrogenase
  Pfam module annotation: Pfam domain module=CO_deh_flav_C::FAD_binding_ 5; Domain location=225-325::2-219
MNIFSYHQASDAGSAIALKQAGPAAKYLGGGTNLVDLMRETVERPETLIDVTRLSSSIEQRTDGSLLIGAGVKNTALAAHGAVRTQFPVLSRAILAGASAQIRNVATVGGNILQRTRCRYFYDNAAHCNKREPSSGCDALEGFNRYHAILGASQSCIATHPSDMCVALVALDAMVHLEGPSGTRSLPLRDLHRLPGDTPQIETALHPDELITAVEIPALPFAKRSAYRKVRDRASYAFALVSVAAALDVDSAGNVNDVRLALGGVAHKPWRALTAESHLKGQPANAKTFRAAAEAELADAVGLRDNAFKIELAKRTIVAVLEELKGENA

SEQ ID NO: 200591 - protein, 77 aa, Glycine max
  Coding DNA Sequence Number=SeqID_83813
  Subcellular localization annotation: CTP_CleavageSite=56; ConfidenceScore=5.03e-01
MASYGGELPLDSSSPRSGFSSLSSFSILLPIHLSRSKGIPLMKKILGLQAPMELTSCGIKSIFILVMFFCFLYLFVR

SEQ ID NO: 200592 - protein, 117 aa, Glycine max
  Coding DNA Sequence Number=SeqID_83814
MEVASLSFNEVFQWRRGERRRHPLENKPWKKKFHHQESALDTKLREEASMEEENERERERKREKVAWKIEGRKGEKLNLEVCLISFSFITVAISVTHTAIYSLGSFLEKQVLHPSHS

SEQ ID NO: 200593 - protein, 413 aa, Glycine max
  Coding DNA Sequence Number=SeqID_83815
  Gene Ontology: Mol. function=DNA binding; Biological process=DNA modification
  Homolog annotation: Hit_ID=Q1QC71; Match level="QueryCoverage=54%, HitCoverage=94%, E-value=7e-47, Identity=40%"; Hit description =Restriction modification system DNA specificity domain
  Pfam annotation: Domain name=Methylase_S; Domain location=57-195; Score=42.5; E_value=1.4e-09; Accession=PF01420.9; Description=Type I restriction modification DNA specificity domain
AVPPLPEQEAIAEALSDADTLIESLSFLLAKKRKIKQGAMQELLTGKTRLPGFQAPWARTQLGKLLSVRHGRNQRLVQYDDGPYPILATGGQIGWANRFLHDKPSVLIGRKGTIDEPQFMDTPFWTVDTLFYTDIHPPNVAKFLFYRLCLVHWMRHNEASGVPSLSAKVIESIEIEHPDADEQQAIADVLSTMDAEIESAEARLQKARRLKQGMMQALLTGRIRLAQPAFDAVPLLTDLAVHSPSIHSRPQLDNQQGAATWGAENTDSCESFVAGDKIDQAQRYFEECMIVVHPEWLLKPSRELFTDRRVAAAIAECKTFLGGIGQPERATQDRVIALFRDELGWRYAGDWSDRDANANIEESILTSWLARRGCTPAQISAVLLRLRSEASNNHRTLYANNKAVYGLLRYGVQ

SEQ ID NO: 200594 - protein, 69 aa, Glycine max
  Coding DNA Sequence Number=SeqID_83816
MPRIHDTILYYNGKWNMPPQNKFVGCAFTGKNPKKFQIPSTCTIYELKNLIKQVAPKRIPPLGIHESQT

SEQ ID NO: 200595 - protein, 44 aa, Glycine max
  Coding DNA Sequence Number=SeqID_83817
MTHVSGGRRKYPSGYPYKDNICYHDLQKYPNGYPYKDNICYHDL

SEQ ID NO: 200596 - protein, 112 aa, Glycine max
  Coding DNA Sequence Number=SeqID_83818
  Gene Ontology: Mol. function=protein binding
  Homolog annotation: Hit_ID=UPI00005F9B23; Match level="QueryCoverage =78%, HitCoverage=100%, E-value=2e-39, Identity=86%"; Hit description= COG3084: Uncharacterized protein conserved in bacteria
  Pfam annotation: Domain name=DUF1040; Domain location=24-111; Score =202.0; E_value=1.4e-57; Accession=PF06288.3; Description=Protein of unknown function (DUF1040)
MATEATCGRNRANTLFMLLDDIEMKTHRVNELIELLHPAWQEDPDLNLMQFLQKLAQEAGFQGELSELSDDILIYHLKMRGSAGTDQIPGLKKDYEEDFKTALLRARGVIKD

SEQ ID NO: 200597 - protein, 312 aa, Glycine max
  Coding DNA Sequence Number=SeqID_83819
  Gene Ontology: Mol. function=kinase activity
  Homolog annotation: Hit_ID=Q9RB11; Match level="QueryCoverage=99%, HitCoverage=95%, E-value=1e-136, Identity=72%"; Hit description=YihE
  Pfam annotation: Domain name=APH; Domain location=14-250; Score =154.6; E_value=2.6e-43; Accession=PF01636.13; Description =Phosphotransferase enzyme family
MDALEGVGLRVDSGLTALNSYENRVYQFMDEDRRRYVVKFYRPERWSAAQIGEEHQFALDLASAEIPAVAPLALQGATLHTHGGFFFTLFPSVGGRQYEIDNLDQLEWVGRFLGRIHQVGGERLFAERPTMGVEEYLTAPRQVLADCGLLPAAQRDAFLLATDNLIAAIKAHWHLDWQPRRLHGDCHPGNILWRDGPLFVDLDDARNGPAVQDLWMLLHGERRDQLMQLDVLLEAYGEFAEFDQRELALIEPLRAMRMVYYLAWVARRWQDPAFPKSFPWMAESDFWLSQTAAFTEQVKLLQEPPLQLTPMY

SEQ ID NO: 200598 - protein, 78 aa, Glycine max
  Coding DNA Sequence Number=SeqID_83820
MSTEEHKKKVAEEANLKVLTLSTKEVQRKAVEEATIFVFDGLEQRKVMQATTEPIRPLTLLENIDQCLKRKDQQQATE

SEQ ID NO: 200599 - protein, 244 aa, Glycine max
  Coding DNA Sequence Number=SeqID_83821
  Homolog annotation: Hit_ID=Q97T90; Match level="QueryCoverage=36%, HitCoverage=14%, E-value=2e-21, Identity=56%"; Hit description =Glycosyl hydrolase, family 35
DLPSQWLLFLSAVPPVQLLTGWCVTAKAPPDISAGKCSGRVPFAIQAAQLLGRAIGAGLFAITPAGERGMCCKAIKLGNARVFPEFDMMATYYPEYPQMDPLVKSSLSERTLELTKKTSLFGNLNEIAQVTESLYPQTMEEIDHPLGYLLYETEVEMDAEEERLRIIDARDRVQVYAIKLIDTVDLEGGPVGKPVVPAALMNRPTRGERRFAYWALAECILAYYVGTDEGVSEVLHVAGEKRLH

SEQ ID NO: 200600 - protein, 181 aa, Glycine max
  Coding DNA Sequence Number=SeqID_83822
  Gene Ontology: Biological process=transposition, DNA-mediated
  Homolog annotation: Hit_ID=Q8ZMS9; Match level="QueryCoverage=92%, HitCoverage=48%, E-value=3e-85, Identity=88%"; Hit description=Fels -2 prophage protein
  Pfam annotation: Domain name=Phage_portal; Domain location=23-181; Score=-83.1; E_value=0.036; Accession=PF04860.3; Description=Phage portal protein
MAGGATAEAFTFGDPVPVLDRRELLDYVECVVTDRWYEPPVSFDGLARTFRAAVHHSSPLNVKRNILTSTFIPHPLLSGQAFSRFIQDYLVFGNAYLEKRTNRLGGVLSLEPSLAKFTRRGTDLDTYWFAQYGLNTQPYQFAPGSVFHLMEPDLNQEIYGLPEYLSAIPSTLLNESATLFR

SEQ ID NO: 200601 - protein, 113 aa, Glycine max
  Coding DNA Sequence Number=SeqID_83823
MGSLKAPKPDGYRAIFFQKVIRDDFQSPQKIEDVNQTFISFIPKKGVDIYDGGSRSLETIWLSRHGPLFPHLAFMDVLILFVEASVEFQSENQFGEVKDVLLNPCSDQYEAQA

SEQ ID NO: 200602 - protein, 219 aa, Glycine max
  Coding DNA Sequence Number=SeqID_83824
  Homolog annotation: Hit_ID=Q1SFC5; Match level="QueryCoverage=99%, HitCoverage=23%, E-value=2e-20, Identity=31%"; Hit description =Asp/Glu racemase
MTPTLLDVAALTGLRPSGETYDPTTSSDNIKLVYKENTFSKYIAEHKGPVEEEVSDEEHVAFLTLSELWIWTPLVAVLYESLGEACDDLKKSKDGSSFLVSGPMWLLQLWLNATFEQEMGLIIPQDYAEEVANRSIEGQRALRLTPKPLIQNSQKLFLKYMRIFLSFDKFLPQHAPFISREVGPAWFTDYFPAVDPDNEEEVNEIWSFYLNPQILSCRT

SEQ ID NO: 200603 - protein, 50 aa, Glycine max; identical to SEQ ID NO: 125980
  Coding DNA Sequence Number=SeqID_83825

SEQ ID NO: 200604 - protein, 344 aa, Glycine max
  Coding DNA Sequence Number=SeqID_83826
  Gene Ontology: Mol. function=catalytic activity; Biological process =metabolic process
  Homolog annotation: Hit_ID=Q10BT3; Match level="QueryCoverage=91%, HitCoverage=58%, E-value=4e-34, Identity=40%"; Hit description=Acyl -activating enzyme 18, putative, expressed
  Subcellular localization annotation: CTP_CleavageSite=32; ConfidenceScore=5.13e-01
MGVNFVANCSAIVIYFFLSHSSLSFLYSRVVDAQSPMAVVIPTKGSEFSMKLRNGDLSWHDFLEKINSLKTSPGAAVKLCLGDLLVMDSNPETVKSLWAMGGKEFIATEQPIGTFTNILFSSGTTGNSMDQYYSLKAAADAWCHMDVRKGDVVCWPTNLGRMMGPWLVYASLLNGASMALYIGSPLGSGFAKFVQPQNVPGIGELALGPLMLGASNTLLNADHYGVYFKGMPLLNGKVSSIEIERICNGVDSNILETAAIGVPPSGGGPELLTIAVVFKDSNSTKQDLHQLRMSFNSALQKKLNPLFRVSQVVTLPSLPRTASNKVMRRVLRQQLSETNQNSKI

SEQ ID NO: 200605 - protein, 201 aa, Glycine max
  Coding DNA Sequence Number=SeqID_83827
  Gene Ontology: Mol. function=catalytic activity; Biological process =metabolic process
  Homolog annotation: Hit_ID=Q0WQ54; Match level="QueryCoverage=91%, HitCoverage=73%, E-value=3e-40, Identity=43%"; Hit description =Acetyl-CoA synthetase-like protein
MAYYKPLSSITMSDIEFHGIGREDVATLHQRLAQIIEIHGDGTLPHGSTESAALTNVWQLLERKGEEFLGSAYKDPITSFDDFQKFSVSNPEIYWKCVLDEMSISFSKPPECILHDRPPGEGPLSHPSGKWLPRAFINPAHNCLNVNSERCLNDIVIIWHEEQHDDLPLKRMILEELRENVWYAANSLLLLALTLMFFYLL

SEQ ID NO: 200606 - protein, 720 aa, Glycine max
  Coding DNA Sequence Number=SeqID_83828
  Gene Ontology: Mol. function=DNA binding; Cellular component=beta -galactosidase complex; Biological process=DNA integration
  Homolog annotation: Hit_ID=Q1SLU3; Match level="QueryCoverage=99%, HitCoverage=87%, E-value=1e-124, Identity=44%"; Hit description =Integrase, catalytic region
  Pfam annotation: Domain name=zf-CCHC; Domain location=156-173; Score =15.7; E_value=0.0025; Accession=PF00098.13; Description=Zinc knuckle
  Pfam annotation: Domain name=zf-CCHC; Domain location=196-211; Score =0.9; E_value=0.72; Accession=PF00098.13; Description=Zinc knuckle
  Pfam module annotation: Pfam domain module=RVT_2::zf-CCHC::zf-CCHC; Domain location=375-630::156-173::196-211
MSERDSQTPGVDSFLFLHPSENPTVSLVSPVLDSLNYHSWSRSMMIALSAKNKLEFIDGGAPEPLKADRTYGAWRRCNNMSDLLRISDLQQEASSIRQGLNEQYGNVRSHVLLMDPLPEISRIFSYVAQQERQIGSNLIAANNIDMKGSLINAMKLACNYCGKTGHTENVCYKKHGVPSNNSERNKSSSHRNGKVCTCYGKMGHTIDVCYKKHGFPPGYRFSNPRSSANSLVAGDDAVTNDQTQLLESKEIHFSPEQYKALLALIQQPTDGNSANMSSNLKQVASCSVDTTPAHDRRPLTYLHDYHAFLTSTANTNSASVSHPLDYSALVCHPLDSVLSYSRLSSSHRHFVLSISTSTEPKTYAKASQHGCWLKAMKAELQALQTNNTWTLTDLPANKKAIGCRWVYKIKYHADGSVERYKARLVAKGYTQMEGLDFLDTFSPVAKLTTVGLLLALAAIHGWHLRQLDVNNAFLRGELNEEVYMQLPPRMQVSHPNQVCQLQRSLYGLKQASRQWFHRLSSFLLTHGFTQASADHSLFLCFNENSFTALLVYVDDIVLTGNDIMAINRITIFLDQTFKIKDLGTLKFFLGIQVARSHQGIHLCQRKYVLDILSDSRMLACRPVSTPMDCTSHHQAGIGDPLSAEDSSSYHRLVGRLIYLTNTRPDISYVVQQLSQFMANPTTDHSKAASRVLRNLKSSPGCGIFFPTTGSTRLQAFSDSD

SEQ ID NO: 200607 - protein, 143 aa, Glycine max
  Coding DNA Sequence Number=SeqID_83829
  Homolog annotation: Hit_ID=Q1S717; Match level="QueryCoverage=100%, HitCoverage=19%, E-value=4e-12, Identity=24%"; Hit description =Ovarian tumour, otubain
MTKSFVGHPYAGRMTKDEKIVVADMTKSMVKTKIIILTLKEHNANSYTTIKQIYNVRHAYCSFIRGSNTEMQQLMMLLDRDQYIHWHRMKDVNVVCDLFWSNPDAGMTFFAAFAYLEGERLNNVVWALRRFRGLFMKVDALPK

SEQ ID NO: 200608 - protein, 229 aa, Glycine max
  Coding DNA Sequence Number=SeqID_83830
  Gene Ontology: Mol. function=DNA-directed RNA polymerase activity; Biological process=transcription
  Homolog annotation: Hit_ID=Q9MQV1; Match level="QueryCoverage=22%, HitCoverage=5%, E-value=5e-17, Identity=80%"; Hit description=Single- subunit RNA polymerase G
  Subcellular localization annotation: CTP_CleavageSite=63; ConfidenceScore=5.51e-01
MDRRRNKSLIYARQWSGGSNSTGSSSPTMLPAHPQSRLGTIFVIGLSTVKRTQNVTAKAAALRLAHVMASQNTTANDGEDAAVSVQYQLEDQRFQFACLQIKRRLKERNAISDDTELFGASCYAAKVTLTALEDMFQGARGIMSWLGDCAKDQKLDWCKMFALGIEPQYVRNPNLWPKNPEKFRFGEVLKVIIVTDAAKGAAYIEFMRKEAADNALYLDNTSFMSTILK

SEQ ID NO: 200609 - protein, 50 aa, Glycine max
  Coding DNA Sequence Number=SeqID_83831
MRLVGDSKSQRGSGESGVRNEGNFKEEWKDFHCESRKKGIGESTKQLSFL

SEQ ID NO: 200610 - protein, 324 aa, Glycine max
  Coding DNA Sequence Number=SeqID_83832
  Homolog annotation: Hit_ID=Q9DH49; Match level="QueryCoverage=81%, HitCoverage=79%, E-value=1e-11, Identity=30%"; Hit description =AMVITR08
MSQNFTDCLTMGVKYLEAVKRGSHAIKQWSPDEIGNVIRPVNIPTSGTSAIALDHPWMTKEIDCAEKLLVYLRTPPDFRVKKLLVYLRTKPDLRVSVTEIDCAEKFLVCLYTPPDFRVSLTEIDCAEKLLVYLRTSPDFRVSLTEIDCAEKLLVYLCASSDFRVSLTEIGCAEKLLVYLCTPPDFRFSVTEIDCAEKLLVYLRTSPDFRVSVTEIDCAEKLLVYLRTSPDFRVSVTEIDCAEKLLVYLRTSSDFRVSLTEIDCAEKLLVYLRTSADFRVSLTEIDCAEKLLVYLRTSPDFMDSVIEIDCAEKLFGYLRTSPDFT

SEQ ID NO: 200611 - protein, 53 aa, Glycine max
  Coding DNA Sequence Number=SeqID_83833
MESQAYVKLHNMLQYWSTRCRIGLAGVVKCEGPNDKGFADIGVRKGEEKWRVF

SEQ ID NO: 200612 - protein, 242 aa, Glycine max
  Coding DNA Sequence Number=SeqID_83834
  Gene Ontology: Mol. function=hydrolase activity
  Homolog annotation: Hit_ID=Q5FAL6; Match level="QueryCoverage=94%, HitCoverage=75%, E-value=1e-66, Identity=56%"; Hit description =Putative Expressed protein
  Pfam annotation: Domain name=DUF1637; Domain location=18-242; Score =306.1; E_value=6.4e-89; Accession=PF07847.3; Description=Protein of unknown function (DUF1637)
  Subcellular localization annotation: CTP_CleavageSite=41; ConfidenceScore=5.04e-01
MVFSSLRGYFSMRQQSSKVQALYDHCKTILSPSGSGTAPPSSQALMKLSSILDTIQPADVGLKEETADDDRGLGFFGANALSRVTRWAQPITYVDIHECDSFTTASALHCTAAGFHVYVSMCIFCFPTSSVIPLHDHPGMTVFSKLLYGSLHVKGYDWVEPPCIIESKGPGYGQVRLAKLAVDKVLNALCDTSVLYPKHGNLHCFAAVTPCAMLDILTPPYREEEGRSCTYYHDYPYSAFCK

SEQ ID NO: 200613 - protein, 67 aa, Glycine max
  Coding DNA Sequence Number=SeqID_83835
MEYRISDEYENGVIKFNPTDIGDKYDIWLYEAGNKMVFASSNTDFKVVQAQRVLETHYFQKGHRMLP

SEQ ID NO: 200614 - protein, 180 aa, Glycine max
  Coding DNA Sequence Number=SeqID_83836
  Gene Ontology: Mol. function=transferase activity, transferring nitrogenous groups; Cellular component=membrane; Biological process =biosynthetic process
  Homolog annotation: Hit_ID=Q3JXY0; Match level="QueryCoverage=97%, HitCoverage=45%, E-value=8e-66, Identity=68%"; Hit description =Aromatic aminotransferase
  Subcellular localization annotation: CTP_CleavageSite=55; ConfidenceScore=5.08e-01
MMTLNSSVKLSSKQPDVGTTIFSVIGQLSAQHQAVNLSQGAPNFPCDPQLVELVSQAMRDGHNQYAAMTGLPALREALAEKVHRLYGQQYDAASEVLITGSASQGIYMAISALVHPGDEVIFFEPAFDSYAPVVRLQGATPIGLKLQVPDFAIDWDELRAAITPRTRMIIINTPHNPSGQ

SEQ ID NO: 200615 - protein, 100 aa, Glycine max
  Coding DNA Sequence Number=SeqID_83837
MNSARQSTHGSPNKRGEWRIALGNHFAWLHTHWWRMHERQSIHGAPNKSGEWIIALGNHYVWLQTHWWRMHEQQSIHRAPNKSREWRIALVNHYAWLQTH

SEQ ID NO: 200616 - protein, 144 aa, Glycine max
  Coding DNA Sequence Number=SeqID_83838
  Gene Ontology: Mol. function=ribonuclease H activity; Cellular component=mitochondrion; Biological process=DNA integration
  Homolog annotation: Hit_ID=Q1S8I9; Match level="QueryCoverage=99%, HitCoverage=28%, E-value=1e-49, Identity=68%"; Hit description =Probable integrase-common tobacco
MNGVVEAANKNIKKIIQKMTVSYKDWHEMLPFALHGYRTSVQTSTGATPYSLIYGMEAVLPFEVEIPSQRILAELGLEESEWAQTHYNQLNLIEGKRLTAMSHGCLYQQRMKNAFDKKVCLRKFHEGDLVLKKMSHAVKDNRGK

SEQ ID NO: 200617 - protein, 94 aa, Glycine max
  Coding DNA Sequence Number=SeqID_83839
MESTRSSLTYDVFFHKVAHLDSIAESGLQKPSNGIADTYLYLFLSAGVLPADTLIREMELGICFETSSLRATNCHYSEAYGDPVPRKALFPGQD

SEQ ID NO: 200618 - protein, 125 aa, Glycine max
  Coding DNA Sequence Number=SeqID_83840
  Gene Ontology: Mol. function=nucleoside-triphosphatase activity; Cellular component=integral to membrane; Biological process =translation
  Homolog annotation: Hit_ID=Q1S1V3; Match level="QueryCoverage=55%, HitCoverage=11%, E-value=2e-15, Identity=65%"; Hit description=AAA ATPase
HDEEEGSRDGEEREAVVVLEGGEFAEGGGDKRSGVEEESVVGGEGAGGEDVEEGGFSGAAGAHRDQDLKGEGEERSKLGFGGGFGGSSMEGWSESEELWTEVRRTEGLGLLVFPKKRNGRRKAKN

SEQ ID NO: 200619 - protein, 154 aa, Glycine max
  Coding DNA Sequence Number=SeqID_83841
  Gene Ontology: Mol. function=RNA-directed DNA polymerase activity; Cellular component=integral to membrane; Biological process=RNA -dependent DNA replication
  Pfam annotation: Domain name=ABC_tran; Domain location=4-150; Score= -50.9; E_value=0.0055; Accession=PF00005.17; Description=ABC transporter
  Pfam annotation: Domain name=AT_hook; Domain location=66-78; Score =14.9; E_value=0.061; Accession=PF02178.9; Description=AT hook motif
  Pfam module annotation: Pfam domain module=ABC_tran::AT_hook; Domain location=4-150::66-78
MRMLRWMCGKTRQDKIRNGAIRERVGVAPIVEKMVENRLRWFGHVERRPVDSVVRRVDQMERRQTIRGRGRPKKTIREVIKKDLELNDLDRMANPSIIFMDEPTSGLDARVAAVVMRAIGKIVDTGRTVVCTIHQPSIDIFESFDEVNMQSKKL

SEQ ID NO: 200620 - protein, 213 aa, Glycine max
  Coding DNA Sequence Number=SeqID_83842
  Gene Ontology: Mol. function=fructose-bisphosphate aldolase activity; Cellular component=integral to membrane; Biological process=metabolic process
  Homolog annotation: Hit_ID=Q6DAB6; Match level="QueryCoverage=99%, HitCoverage=74%, E-value=3e-70, Identity=65%"; Hit description =Probable sugar-bisphosphate aldolase
  Pfam annotation: Domain name=F_bP_aldolase; Domain location=1-213; Score=57.3; E_value=1.5e-14; Accession=PF01116.10; Description =Fructose-bisphosphate aldolase class-II
DAFQHKYAVLAINCFNLETARAAIQAAEQQRAPLILNVYQGHSAHFPPAVAAPLVQALAAQAAVPVALALDHGKAFPLIGQAFRAGFTGLMIDASAEPLADNIRQTAAVVKMAHTAGVCVEGELGHIADAPTYELADAAVKMTRVEDVLPFIEQTGIDLLAISVGTAHGLYAPGVKPKIDFERLQQLDAVTTRPLALHGGSGTPAEDIRRVSA

SEQ ID NO: 200621 - protein, 184 aa, Glycine max
  Coding DNA Sequence Number=SeqID_83843
MGAGTVDPLRCRCPYPVLGPPADLGERNGAYEAPYGPRKVQQGIRIYSTDHGPLPILRSASRPQQGWCRVRHHSSLGMNSSRAQMPHRHLRSLPLITCGDWSGIYDMWLTSRQPTTRIRCGCMRLSTSTRTADLARIPAHTCGLLWSILRLQYHGWGIGPRIRQDLPVLLEVRTRLRTIRTWQT

SEQ ID NO: 200622 - protein, 231 aa, Glycine max
  Coding DNA Sequence Number=SeqID_83844
  Gene Ontology: Mol. function=nucleoside-triphosphatase activity; Cellular component=chloroplast
  Homolog annotation: Hit_ID=Q2PMM5; Match level="QueryCoverage=99%, HitCoverage=11%, E-value=1e-114, Identity=81%"; Hit description =Protein ycf2
MNGSDILWRMRQIPLCLPQWNLISEIWNLISEIPGNCLHNLLLSEEIIHRNNELLLISTHLRSLNVQEFFYSILFLLLVAGYLVRTHLLFVSRVYSELQTEFEKNLFLVALEQLGDSLEEIRSFAFGGNMLWGGGPTYGVKSIRSKKKYLNLIDLISIIPNPINRIAFSRNTRHLSHPSKTIYSLIRKIKNVNGDWIDDKIESWVLNSNSIDDNGKRILGSVFYLNDRKKD

SEQ ID NO: 200623 - protein, 64 aa, Glycine max
  Coding DNA Sequence Number=SeqID_83845
REKLDLIKERLRAVEGFGDYPFADMVDLCLVPDVVIPPKFMVSYPNFVRGPLLDDMRPFFGACE

SEQ ID NO: 200624 - protein, 101 aa, Glycine max
  Coding DNA Sequence Number=SeqID_83846
MSLRRLGGSSPESYSLHSATIILFPRTRFVIITASAKDPGRSVHSAPHDHTQHPTYERGQKLVPKTLKGQCTVPPTNIHNMHMLMHFQHQSTNRISMSFTT

SEQ ID NO: 200625 - protein, 35 aa, Glycine max
  Coding DNA Sequence Number=SeqID_83847
MFAYSPLAKRKPRAKRIFAHALSGESLALNPCISG

SEQ ID NO: 200626 - protein, 51 aa, Glycine max
  Coding DNA Sequence Number=SeqID_83848
MAGVVREGPKPTLHFETMGHATLPPFSCYPCLKCAQQVFCEMPQWHLRMIL

SEQ ID NO: 200627 - protein, 69 aa, Glycine max
  Coding DNA Sequence Number=SeqID_83849
MSFAKAGIETQSPEKSGEKHILVATALEFEQPYPCVSPVCNLSSKGINMVLTNHVNNYLFSKNANPIQP

SEQ ID NO: 200628 - protein, 581 aa, Glycine max
  Coding DNA Sequence Number=SeqID_83850
  Gene Ontology: Mol. function=signal transducer activity; Cellular component=membrane; Biological process=response to light stimulus
  Homolog annotation: Hit_ID=Q6AST7; Match level="QueryCoverage=71%, HitCoverage=66%, E-value=3e-38, Identity=29%"; Hit description=NPH3 family protein
  Pfam annotation: Domain name=NPH3; Domain location=192-418; Score =169.8; E_value=6.8e-48; Accession=PF03000.5; Description=NPH3 family
MPKHSDLQIHINDEEVFLLDKKFISKYCGRIKKILSHEKRMCIEINDFPGGPQGFELVSRFCYNNGKIPINVSNVLILHCCGLYLGMTEEVFTNNLLQQIETFLEGIHYWTWNEILVSLKNCELFYAHADSYGLLEKIIGALLAKMDQNPEANLFTSSSSSSPSSPESNSAKRFSYSTQATPKTVKSTLPKKAWWFEDLATLPPKIIEKILQSIGAYKTDNKNSTLTIFLLHYLKIVTPTREVNCNNSVEYAGLAETAVYGVIFVGNKSFSCRGLFWVLRIVSRFGMSRDYRIEIEKLIGGVLEQATLDDLLVSGHHMGLYYDVTFVIRLIKQFVDINGSDGVSVQKLKKVGRLVDKYLIEISPDQNLKVTKFLAVAECLPDCARDRFDGVYRAIDIYLQVCPIQASTIQENLLTLAEKEITSKTLLKSLIEFYIARFCYISILPSFYFHNRIKFSHFRTNYELQSHPMLAFEERSRLCRCLNYNKLSFEVCKDLAKNPRIPPMIAMQALISQQTKIPSSDLIIEESEIINPSQIILHYDKTDSFLEEKEDMRQNLERMEWRVKELEILCKEMKVQMSRFH

SEQ ID NO: 200629 - protein, 114 aa, Glycine max
  Coding DNA Sequence Number=SeqID_83851
MVVVGWNSDNDNDHDDEGDKMVMAITVAATLTMIITIIVVVAAMTMVAKTRCDGGDGDNGCVNGMIDNGGSDGDDKGETIELGEEGNVDGVGDDTGQGTHETLHLPNWCEEDEN

SEQ ID NO: 200630 - protein, 91 aa, Glycine max
  Coding DNA Sequence Number=SeqID_83852
MARARCKTSPEASTNETQISVYVEREKEIEGNLIEEMCADTVEVVVAAVVAVPLQNQVGICYVTTDSDLLSLGSRERDEFELQPTRKQRKA

SEQ ID NO: 200631 - protein, 117 aa, Glycine max
  Coding DNA Sequence Number=SeqID_83853
  Subcellular localization annotation: CTP_CleavageSite=73; ConfidenceScore=5.37e-01
MAAGSNTGFHCDDMSSALNWHWVSFQSGAVSSLPEMVPMGNYFGLNSNTSGMMMYSGNSSIINNVYEPVTSLPSNAFGSSLLLDSVPGLRHEERLAAEWSVDEQCKLEEGLAKSSLI

SEQ ID NO: 200632 - protein, 57 aa, Glycine max
  Coding DNA Sequence Number=SeqID_83854
MTKNGIHHYWESDDQHGPSTGTLSFNQRREKMVVALNVPHRRLLTAGTKRGKREGSF

SEQ ID NO: 200633 - protein, 81 aa, Glycine max
  Coding DNA Sequence Number=SeqID_83855
MVVPKSEEMQRQAETKKKQHRTMGSSRCGVSTENNGILWWLMVAVGDGDSAWDVRNGFGRKKGEEMAFFLSYTKAKAETLK

SEQ ID NO: 200634 - protein, 164 aa, Glycine max
  Coding DNA Sequence Number=SeqID_83856
GLHVLTFKGLHVLTFSGLHALAFKGSFLLSVSGPPPDIGGRPTVQAQPEREAITQLLYIPGHDFTRAATKKRVRIMRTNMTTITQICMTLLLSNILPNDRNVDLPLRKYQGPAHKTPSGPREVQQGPGVSSSGYGPLSVLQGARSPQQGIVPARHPVDPEKSNR

SEQ ID NO: 200635 - protein, 174 aa, Glycine max
  Coding DNA Sequence Number=SeqID_83857
  Homolog annotation: Hit_ID=Q6CQF3; Match level="QueryCoverage=31%, HitCoverage=58%, E-value=4e-08, Identity=71%"; Hit description =Kluyveromyces lactis strain NRRL Y-1140 chromosome D of strain NRRL Y- 1140 of Kluyveromyces lactis
MGGPSPGLFDMLVETSSSRLWMAARALGVPRHLRAPGRRACGLPIRPVLKTRTKESDMCASQRASKPVRRKEADWWDPPVAGRSQRKLWWRPAAILTIAGARGRVLSGRCGCSVEPRHGIESSKWAIFGKQNWRCGMNRKLGYGAQLRANLDPTKGVGRLRQQDGGHGSRNPLR

SEQ ID NO: 200636 - protein, 97 aa, Glycine max
  Coding DNA Sequence Number=SeqID_83858
  Homolog annotation: Hit_ID=Q8RZF8; Match level="QueryCoverage=33%, HitCoverage=8%, E-value=2e-09, Identity=72%"; Hit description =Lustrin A-like
MGILIVLLILLIIHIHGNGHHKEARGNINPKRGCDLFQECPFILKEFDCQKNGRPDKLYVKYRWQPKDCNLPSCILDLETETAKLGRGAVPVEIHAC

SEQ ID NO: 200637 - protein, 237 aa, Glycine max
  Coding DNA Sequence Number=SeqID_83859
  Gene Ontology: Mol. function=protein disulfide oxidoreductase activity; Biological process=intracellular signaling cascade
  Homolog annotation: Hit_ID=Q67UI1; Match level="QueryCoverage=37%, HitCoverage=12%, E-value=3e-14, Identity=39%"; Hit description =Glutaredoxin-related-like protein
  Pfam annotation: Domain name=Glutaredoxin; Domain location=146-205; Score=56.2; E_value=1.1e-13; Accession=PF00462.14; Description =Glutaredoxin
MGSEEVVEEPTPKTPNQTTTPETTSSSSPRKIKTNTPTENGHVSVTPTTLSIVQPHSLLPKPVPPRTTYTQNDVVVSSTTFGKFLRKRSNDLSSAISKGISTLKHSINDQNDNNGVTEFNLSGLKVFVTVKNKNDASSNSLARMKISFFSRSNCRECCAVRRFFRERALRFVEINVDVFAEREKELRERTGSATVPKIFFGERLIGGLVELNALRKDGGEELERRLKEAGGQGPAAP

SEQ ID NO: 200638 - protein, 199 aa, Glycine max
  Coding DNA Sequence Number=SeqID_83860
  Gene Ontology: Mol. function=oxidoreductase activity; Cellular component=cytosol; Biological process=flavonoid biosynthetic process
  Homolog annotation: Hit_ID=Q9XF81; Match level="QueryCoverage=90%, HitCoverage=56%, E-value=9e-64, Identity=65%"; Hit description =Aldose reductase ALDRXV4
  Pfam annotation: Domain name=Aldo_ket_red; Domain location=18-199; Score=74.9; E_value=2.5e-19; Accession=PF00248.11; Description =Aldoketo reductase family
MAQVVVKRHEPKTQSFTLLSGHTIPAVGLGTWKAGSQAVNSVFTAIVEAGYRHIDTASQYGVQEGVGQALQAAMQARVERKDLFVTSKLWCTDLIPERVRPAINNTLQELQLDYLDLYLIHWPFRLKDGASRPPKEGEVLEFDMEGVWREMEKLVKENLVRDIGICNFTLTKLEKLMSIAQIMPSVCQVKFIYLKIFLA

SEQ ID NO: 200639 - protein, 193 aa, Glycine max
  Coding DNA Sequence Number=SeqID_83861
  Gene Ontology: Mol. function=protein disulfide oxidoreductase activity; Cellular component=intracellular; Biological process =intracellular signaling cascade
  Homolog annotation: Hit_ID=Q67UI1; Match level="QueryCoverage=98%, HitCoverage=29%, E-value=2e-37, Identity=42%"; Hit description =Glutaredoxin-related-like protein
  Pfam annotation: Domain name=DUF547; Domain location=1-121; Score =140.8; E_value=3.7e-39; Accession=PF04784.5; Description=Protein of unknown function, DUF547
MTQDLQRVNLLELSENETLAFFINLYNAMIVHAIIRVGCQEGHPYSLGAIKNGILRSNRRSPYSLIKPFGTGDRRLEHALVKMNPLVHFGLCNGTKSSPKVRFFSPYRVAEELRSAAREFFENDGIEVDLEKRTIHLTPIFKWYSADFGQERNILKWIINFLDANKAGLLTHLLGDGGHVNISYMSYDWSINS

SEQ ID NO: 200640 - protein, 434 aa, Glycine max
  Coding DNA Sequence Number=SeqID_83862
  Gene Ontology: Mol. function=protein phosphatase type 2C activity; Cellular component=nucleus; Biological process=protein amino acid dephosphorylation
  Homolog annotation: Hit_ID=Q1S458; Match level="QueryCoverage=86%, HitCoverage=84%, E-value=1e-105, Identity=48%"; Hit description =Protein phosphatase 2C-like
  Pfam annotation: Domain name=PP2C; Domain location=48-341; Score =127.6; E_value=3.5e-35; Accession=PF00481.12; Description=Protein phosphatase 2C
MGGCCSHDVSVRGKVESEMDDREYEYDYENDVSYQQGGALVRLRGSSRFASMYSQQGQKGVNQDAMTVWEDYTGEKDVIFCGVFDGHGPLGHKVSQFIRDNLPSKLSAAIEISQQKTIKYYDANDAETGSFDDAYDDNNHNMSLASWEGCLLKSFDEMDEYLAQEINTDSYCSGCTAVTLIKQGDQLIVGNLGDSRAVLCTRDRDQLIPVQLTVDLKPDIPSETSRIVNCEGRVFAAEEEPDVYRIWMPDDDCPGLAMSRAFGDFCLKDYGLISVPDVFYRKITPQDEFVVLATDGVWDVLTNSEVINIVASAPRRSIAAKLLVKRAVRAWRYKYPGSKVDDCAVICLFLDAQSALSHSQSYSNRKSRQRSKHLNRTKSTRNEDNETVYGKVGVELDEEWKALGGFARANSLSKLPRLARGMSKRQSSKYYIPS

SEQ ID NO: 200641 - protein, 148 aa, Glycine max
  Coding DNA Sequence Number=SeqID_83863
MMIRMTITMSEDVKPCHTDLIPNGVLGNMIAAWCCEQRISFKAERVIGKHNKRVTNKAALEGMRMTISFLVNKLKGNGKKNNDKVNVPLSVEDTNDVLYKLRVLAKGRPEVDGRGCRGGGGNVGGGGDDFGRSGEEGWVGGGAGGGLG

SEQ ID NO: 200642 - protein, 467 aa, Glycine max
  Coding DNA Sequence Number=SeqID_83864
  Gene Ontology: Mol. function=transferase activity, transferring hexosyl groups; Cellular component=integral to membrane; Biological process=metabolic process
  Homolog annotation: Hit_ID=Q1S2D1; Match level="QueryCoverage=98%, HitCoverage=93%, E-value=0.0, Identity=71%"; Hit description=UDP -glucose glucosyltransferase
  Pfam annotation: Domain name=UDPGT; Domain location=11-465; Score= -97.3; E_value=1e-05; Accession=PF00201.9; Description=UDP -glucoronosyl and UDP-glucosyl transferase
MKTDLHANQLNLIFLPYLSPGHLNPMVDTARLFARHGASVTIITTPANALTFQKAIDSDFNCGYHIRTQVVPFPSAQLGLPDGAENLKDGTSLEILGKIMYGISMLQGQIEPLFQDLQPDCLVTDVLYPWTVESAAKLGIPRLYFYSASYFASCATYFIRKHKPHERLVSDTQKFSIPGLPHNIEMTTLQLEEWERTKNEFSDLMNAVYESESRSYGTLCNSFHEFEGEYELLYQSTKGVKSWSVGPVCASANTSGEEKVYRGQKEEHAQESEWLKWLNSKQNESVLYVNFGSLTRLSLAQIVEIAHGLENSGHSFIWVVRIKDENENGDNFLQEFEQKIKESKKGYIIWNWAPQLLILDHPAIGGIVTHCGWNSILESVSAGLPMITWPMFAEQFYNEKLLVDVLKIGVPVGSKENKFWTTLGEVPVVGREEIAKAVVQLMGKEESTEMRRRARKLGDASKKTIEE

SEQ ID NO: 200643 - protein, 338 aa, Glycine max
  Coding DNA Sequence Number=SeqID_83865
  Gene Ontology: Mol. function=transferase activity, transferring hexosyl groups; Cellular component=integral to membrane; Biological process=metabolic process
  Homolog annotation: Hit_ID=Q1S2D1; Match level="QueryCoverage=99%, HitCoverage=76%, E-value=1e-137, Identity=64%"; Hit description=UDP -glucose glucosyltransferase
MLDKISLVLSILKDQIELLFQDMQPECIITAMLYPWTVEFAAKLGIPRLYFYSSSYFNSCAGHFMRKHKPHERMDSNNQRFSIPGLPHNIEITTLQVEEWVRTKNYFTDHLNAIYESERRSYGTLYNSFHELEGDYEQLYQSTKGVKCWSVGPVRIRLPHAQLVEIAHGLENSGHDFIWVIRKRYGDGDEDGESFLQDFGQRMKESKKGYIIWNWAPQLLILDHPASGGIVTHCGWNSVLESLSVGLPMVTWPVFADQFYNEKFVVNVLKIGVPVGSKENKFWTHIGVDPAVRREEIAKAVILLMGKEEGGEMSRARKLGDAAKKTIGEGGSSYNNLM

SEQ ID NO: 200644 - protein, 541 aa, Glycine max
  Coding DNA Sequence Number=SeqID_83866
  Gene Ontology: Mol. function=sequence-specific DNA binding; Cellular component=nucleus; Biological process=regulation of transcription
  Homolog annotation: Hit_ID=Q40090; Match level="QueryCoverage=95%, HitCoverage=90%, E-value=1e-111, Identity=44%"; Hit description=SPF1 protein
  Pfam annotation: Domain name=WRKY; Domain location=201-259; Score =135.8; E_value=1.2e-37; Accession=PF03106.6; Description=WRKY DNA -binding domain
  Pfam annotation: Domain name=WRKY; Domain location=370-429; Score =145.1; E_value=1.8e-40; Accession=PF03106.6; Description=WRKY DNA -binding domain
  Pfam module annotation: Pfam domain module=WRKY::WRKY; Domain location=201-259::370-429
  Subcellular localization annotation: CTP_CleavageSite=81; ConfidenceScore=5.18e-01
MGDHNNWETSELSLNNQYQNHNQVGLDVPKFKSVQPPSLLFSPSSISPSSYFNFSSAFSPSEFLNSPLFFPSPNIFASPTTEALVGQSFNWRNGSGEEQQRGKEDEKNYSDFSFQTQIQSSSNMFQVEPLKKQDMWKFNEPTKQTDFSPERTATKSEFPSIQSFSSEMAEGKPEIQSSSVPGSGYFDYTSASQSVREQKRTEDGFNWIKYGQKQVKGSENPRSYYKCTHPNCSVKKKVEKSLDGHITEIVYKGQHSHPKPQSTRRTNSQSIHQPSSSCTNSGITDHSVVTLGNPQMDHFSIQEDSSASVGEEEFEQTPQTSYSGGDGDNLGPDAKRWKGDNENDGYSVSASRSVREPRVVVETTSEIDILDDGFRWRKYGQKVVKGNSNARSYYKCTAPGCSVRKHVERAAHDIKAVITTYEGKHNHDVPAARGSGKYNSNRNSQNSNISAPIRPSAVNCYSNSSSFTNSLYNNTRLPATGNQESFSLDKFKNPGSFGYSDLNRPMGSHTNHAQYTDAAYSRAKDERKDDSFLQSFLSKDF

SEQ ID NO: 200645 - protein, 540 aa, Glycine max
  Coding DNA Sequence Number=SeqID_83867
  Gene Ontology: Mol. function=kinase activity; Cellular component =integral to membrane; Biological process=protein amino acid phosphorylation
  Homolog annotation: Hit_ID=Q6EQG8; Match level="QueryCoverage=93%, HitCoverage=71%, E-value=1e-168, Identity=58%"; Hit description =Leucine-rich repeat family protein /protein kinase family protein- like
  Pfam annotation: Domain name=LRR_1; Domain location=106-128; Score =16.7; E_value=0.083; Accession=PF00560.23; Description=Leucine Rich Repeat
  Pfam annotation: Domain name=LRR_1; Domain location=130-151; Score =8.1; E_value=8.6; Accession=PF00560.23; Description=Leucine Rich Repeat
  Pfam annotation: Domain name=LRR_1; Domain location=154-176; Score =8.5; E_value=7.2; Accession=PF00560.23; Description=Leucine Rich Repeat
  Pfam annotation: Domain name=LRR_1; Domain location=203-225; Score =4.5; E_value=42; Accession=PF00560.23; Description=Leucine Rich Repeat
  Pfam annotation: Domain name=LRR_1; Domain location=227-249; Score =19.8; E_value=0.0098; Accession=PF00560.23; Description=Leucine Rich Repeat
  Pfam annotation: Domain name=LRR_1; Domain location=251-274; Score =8.1; E_value=8.9; Accession=PF00560.23; Description=Leucine Rich Repeat
  Pfam annotation: Domain name=LRR_1; Domain location=35-57; Score =16.0; E_value=0.14; Accession=PF00560.23; Description=Leucine Rich Repeat
  Pfam annotation: Domain name=LRR_1; Domain location=58-80; Score =10.3; E_value=3.4; Accession=PF00560.23; Description=Leucine Rich Repeat
  Pfam annotation: Domain name=LRR_1; Domain location=82-104; Score =14.5; E_value=0.39; Accession=PF00560.23; Description=Leucine Rich Repeat
  Pfam module annotation: Pfam domain module=LRR_1::LRR_1::LRR_1::LRR _1::LRR_1::LRR_1::LRR_1::LRR_1::LRR_1; Domain location=106-128::130 -151::154-176::203-225::227-249::251-274::35-57::58-80::82-104
MVTTEGVLITSLTDRYWKAQNLSGSLSPEFSKLHYLQKLDLSRNIITGSIPPQWGTMRLVELSLMGNKLSGPFPKVLTNITTLRNLSIEGNQFSGHIPTEIGKLTNLEKLVLSSNGFTGALPPVLSKLTKLIDLRISDNNFLGKIPDFISNWTLIEKLHMHGCSLEGPIPSSISALTRLSDLRITDLKGSKSSAFPPLNNLKSMKTLVLRKCMIKGEIPEYIGRMEKLKILDLSYNGLSGEIPESFAQLDKVDFMYLTGNKLSGIIPRWVLANNENIDISDNNFSWDSSSPTECQRGSVNLVESYSSSVNTQTKINSCLKKNFLCTASPSQYRYSLNINCGGNEANVSGNIYEADREQKGAAMLYYTSQDWALSSTGNFMDNDIDSDPYIVANTSRLNVSALNSKLYTTARVSPLALTYYGLCLINGNYTVKLHFAEIIFINDRSLNSLGRRVFDVYIQGNLVLKDFDIRREAGGTGKSIEKTFNASVTQHTLKIHFYWAGKGTTGIPTRGVYGPLVSAISVNPIKGKDYHLCLPLQDLH

SEQ ID NO: 200646 - protein, 118 aa, Glycine max
  Coding DNA Sequence Number=SeqID_83868
  Homolog annotation: Hit_ID=Q6CQF3; Match level="QueryCoverage=47%, HitCoverage=59%, E-value=2e-07, Identity=72%"; Hit description =Kluyveromyces lactis strain NRRL Y-1140 chromosome D of strain NRRL Y- 1140 of Kluyveromyces lactis
RCGCSVEPRHGIESSKWAIFGKQNWRCGMNRKLGYGAQLRANLDPTKGVGRLRQQDGGHGSRNPLRRRGGRCKTQGASPGGAVVGADLGGTGEARLIALCARTPKGNRVKIPEPGRGG

SEQ ID NO: 200647 - protein, 237 aa, Glycine max
  Coding DNA Sequence Number=SeqID_83869
MVAATFDGFSIRDYTSKMRSIDVFKCWPFASTSSRDVSDEEVQSWLPPMNPCPRSDDSTDHRAQNLEIPPSAAETDEDDGDVDCSEEESAESMESEKSAPPSDSSPANNNNNNEDEKLEMVCPVCREFNAATLTAVNAHIDGCLAQTMREERRHMRIMNLKSSSSKSKPSKPLKKRSIAEIFMVEEQPHLPQPQPQPQLPPQIESVLKFWPFREGQGGRCIYYRYEVRVAFSATGRR

SEQ ID NO: 200648 - protein, 122 aa, Glycine max
  Coding DNA Sequence Number=SeqID_83870
  Homolog annotation: Hit_ID=Q9FKM4; Match level="QueryCoverage=63%, HitCoverage=12%, E-value=1e-13, Identity=45%"; Hit description =Arabidopsis thaliana genomic DNA, chromosome 5, P1 clone:MUA2
MEKCYENGAWHLEHLGNALVVHGCEHGDKAGVVNALEDDVEGHVDLSILTTKLFWCDIDVAIGHHDDADDLVALKDIDKVVVVYDNDVDNVLFLGTEKTWNGSIVKRVKGTSCVRGVVCGDA

SEQ ID NO: 200649 - protein, 492 aa, Glycine max
  Coding DNA Sequence Number=SeqID_83871
  Gene Ontology: Mol. function=protein kinase activity; Cellular component=cytoplasm; Biological process=protein amino acid phosphorylation
  Homolog annotation: Hit_ID=Q1ENV7; Match level="QueryCoverage=92%, HitCoverage=95%, E-value=1e-167, Identity=65%"; Hit description =Protein kinase family protein
  Pfam annotation: Domain name=Ank; Domain location=33-65; Score=10.7; E_value=0.89; Accession=PF00023.20; Description=Ankyrin repeat
  Pfam annotation: Domain name=Ank; Domain location=66-98; Score=41.2; E_value=3.6e-09; Accession=PF00023.20; Description=Ankyrin repeat
  Pfam annotation: Domain name=Ank; Domain location=99-131; Score=11.5; E_value=0.69; Accession=PF00023.20; Description=Ankyrin repeat
  Pfam annotation: Domain name=Pkinase; Domain location=151-447; Score =171.7; E_value=1.9e-48; Accession=PF00069.15; Description=Protein kinase domain
  Pfam annotation: Domain name=Pkinase_Tyr; Domain location=151-447; Score=112.9; E_value=9.5e-31; Accession=PF07714.7; Description =Protein tyrosine kinase
  Pfam module annotation: Pfam domain module=Ank::Ank::Ank::Pkinase::Pki nase_Tyr; Domain location=33-65::66-98::99-131::151-447::151-447
METKKLHPRFSLGRQSSLAPERAGAGDSSEALDPAVRLMYLANEGDSDGIKELLDAGSNVNFTDIDGRTSLHVAACQGRTDVVDLLLRRGAHVDPQDRWGSTPLVDAMYYKNHQVVKLLEKHGARPPMAPMHVQNAREVPEYEIDPSELDFTNSVCITKGTFRIALWRGIQVAVKTLGEELFTDDDKVWVGLLMQSVVSFMSITQLDIQFSIFILIVDFVSWCMFIRKAFHYELTLLEKIRHPNVVQFLGAVTQSTPMMIVTEYLPQGDLGAYLKRKGALKPVTAVKFALDIARGMNYLHEHKPEAIIHRDLEPSNILRDDSGHLKVADFGVSKLLKVAKMVKEDKPVASLDTSWRYVAPEVYRNEEYDTNVDVFSFALILQEMIEGCPPFFAKPENEVPKAYVENERPPFRASPKLYAYGLKQLIEECWDEKPYRRPTFRQIIGRLEDIYYHLAQKRGWKVRTPGCFQNLEAIFRGNRTNPSSRSSRSTAR

SEQ ID NO: 200650 - protein, 323 aa, Glycine max
  Coding DNA Sequence Number=SeqID_83872
  Homolog annotation: Hit_ID=Q1ENV3; Match level="QueryCoverage=38%, HitCoverage=21%, E-value=3e-46, Identity=70%"; Hit description =Protein kinase family protein
  Pfam annotation: Domain name=Pkinase_Tyr; Domain location=231-322; Score=-163.6; E_value=0.02; Accession=PF07714.7; Description=Protein tyrosine kinase
MRVAEEEKAVLEQVFGSSSSEECDSDGYSESESEWEPISEVNGLWLCPHFLSPRRQSHILSSIQADNWFPSPSINQAMRFGLQHLPSWATPLAHSIRRSVQAQAQAQTHPPPFPLHLLHREPLFDQMIANVYQPGEGICAHVDLLRFDDGIAILSLESSCVMHFTPLSGSLSVPVLLTPAGVLVVVLLVLVLMRRMGWLGGKDPVYKELRGVDLQTGLFTLRQIKAATKNFDAVNKIGEGGFGCVYKGLQSDGTMIAVKQLSSKSKQGNREFVNEMGLISGHEHPNLAKLYGCCVEGNQLILIYEYLENNCLSRILFGKLHDE

SEQ ID NO: 200651 - protein, 67 aa, Glycine max
  Coding DNA Sequence Number=SeqID_83873
MSKAGVRLLKQNLQSKHPPRELKVPKSLLIETSTTESEDQTTATQYIQQEGNKKFQLDLHHEYGIFY

SEQ ID NO: 200652 - protein, 430 aa, Glycine max
  Coding DNA Sequence Number=SeqID_83874
  Gene Ontology: Mol. function=transferase activity, transferring acyl groups, acyl groups converted into alkyl on transfer; Cellular component=glyoxysome; Biological process=tricarboxylic acid cycle
  Homolog annotation: Hit_ID=P49299; Match level="QueryCoverage=96%, HitCoverage=81%, E-value=0.0, Identity=81%"; Hit description=Citrate synthase, glyoxysomal precursor
  Pfam annotation: Domain name=Citrate_synt; Domain location=98-430; Score=373.8; E_value=2.7e-109; Accession=PF00285.11; Description =Citrate synthase
MSSNSDAAAATVHARGRLAMLAAHLLPFELTDHDALRPIPLSAQLPPTNLAGSLTVVDDRTGKKYQLQVSKEGTVKASDLKKISTGKNDKGLKLYDPGYLNTAPVRSAISYIDGDEGILRYRGYPIEELAEKSTFTEVSYLIMYGSLPSESQLAEWEFAISQHSAVPQGILDIIQSMPHDAHPMGVLVNAMSALSVFHPDANPALRGLDIYDSKQIRDKQITRVIGKITTIAAAVYLRMAGRPPVLPSNHLSYTENFLYMLDSLYVCGNRSYKPNPRLTRVLDIIFILHAEHEMNCSTSAVRHLASSGVDVYTAIAGAVGALYGPLHGGANEAVLKMLSEIGTVQNIPEFIEGVKARKRKLSGFGHRVYKNYDPRAKVLRKLAEEVFSIVGRDPLIEVAVALEKVALSDEYFIKRKLYPNVDFYSGLIYR

SEQ ID NO: 200653 - protein, 282 aa, Glycine max
  Coding DNA Sequence Number=SeqID_83875
HKLSGRNRRPDEKVDPVIASPYLRRRRSASRSIAEILTVAPPIEAGKRKAIQVEEEDEEKSDYGYSGGDSTRAATPAPSAAVATPVASVIKNKKSTMKNRNKKKLMKVKKKKSKVEKHGDSGVWFVNNEKKTVASKKKKKKKKNVFNNRPTGNKRNTRQVKVGKGELQERKTKTSAFVRGRDSEGSEACKNVAPAVVCAVCIISTSTLARRGHSWVTSFSDVERFYTQLTAGCILASGRSVSGDNFECLLEPNLGGLYRTNGNRKTMSVCGYAGRNLKVEVN

SEQ ID NO: 200654 - protein, 66 aa, Glycine max
  Coding DNA Sequence Number=SeqID_83876
  Gene Ontology: Mol. function=structural constituent of ribosome; Cellular component=large ribosomal subunit; Biological process =translation
  Homolog annotation: Hit_ID=Q1SZV5; Match level="QueryCoverage=98%, HitCoverage=60%, E-value=3e-22, Identity=59%"; Hit description =Ribosomal protein L14b/L23e
  Pfam annotation: Domain name=Ribosomal_L14; Domain location=1-66; Score=-5.0; E_value=0.00013; Accession=PF00238.10; Description =Ribosomal protein L14pL23e
MCIPALKGKKGARGRCDGSEVKFDENAVVLVDKQRQPIGTRVFGTVPHEFRQKKHVKILTLAGHIA

SEQ ID NO: 200655 - protein, 942 aa, Glycine max
  Coding DNA Sequence Number=SeqID_83877
MVQSAVNSSRKLKGTIDNKMLPLHEVDPSIDRKISGINCLSVEKKQQVKNCDSVGKQEKAVSPNHGILKNRFKHVSEKTSSGSSIGDGTQESYYSDQEETSDRHVKFSGKDDIPGPKKTNSFDETLFKISSDAVASSAVKEKSSGSDEETASLEPNRNYDHIDRGKREVCPIVESKQFSNTLDQDTIQSFLKPCINQEKSKLLEEKSELLTKVAVCDNNDSQFFYGGNRTTLHCSPYADISRPLSAVQVEKMSGINTKVCESGSFSYSGKLDHLDDPQVDAVNSNENTKTFLEPSSSYSASYNANEKPESPLQTYGDKDNSGEALGNRQFSRMFSADMIDNSFPNTGWEKGSGKNSCLDPDFFGLPLNSHGELINFSSSGNLGMNQSDTSSTLRGSFSGLPINNILHQSSQENLSINENHVVQKTFPKDGLDPFPHHPTRLPVTELQSREREDIHRPNSSDMCSSHYVPPLNSELNCKKNSFVEQNQCDRVWNHNGNGVVSLKEGSHHISPSSSQPTMRLMGKDVPIGRSSQEMQQFAGDVWPDEESRRRNYSEYAALDHSLLERSSKQDWVSGSPLQISADNVLQAAKIQNNQAAQGTILMSSTDSGFSQQFIDRQSNHGVNRNASSYFNPITQKSTSYAAFNGASNDFSEQFIPGAKPLGLSSQLVVLPTPGNFSHSTHVTNGELNDRNKNPHVTKSAFGFPFLQPTVNEQAKTSWYSPYRSSPSWLSISTDEMLPGTFSRQFSASSSQNFPQNLWGNNFTTPFVNHSAEVRFPSNHLTSSLGPMQTTPLSRVSIGHPLHVPVTPSTINSDNININKVADRLKFDDHQLCTNTRKRPAAAANLDDSRKPTKLLNMRVQENFSRMTRLPGEKSSVELQRNTRTLELDPHMGSARSRCCQHEAQNLNPGSYPAVNSFKLDGMVTSGPVRLGPKRAKHILNSS

SEQ ID NO: 200656 - protein, 1386 aa, Glycine max
  Coding DNA Sequence Number=SeqID_83878
  Gene Ontology: Mol. function=actin binding; Cellular component =cytoskeleton
  Homolog annotation: Hit_ID=Q5XPJ9; Match level="QueryCoverage=96%, HitCoverage=98%, E-value=2e-95, Identity=36%"; Hit description =Protein SCAR2
MPLCRHHIRSAHALADPELRRTADSDDSEVLLEAVAMSGLVGFLRQLGDLAQFAAEMFHDLHEEVLATTARGHSLMSRVQQLEAEVPALEKVFLSQTHHSSFFTNGGIEWHPNLRSEQNLVTRGDLPRFIMDSYEECRGPPRLFLLDKFDVAGAGACLKRYTDPSFFIVESASSGKATVEVQREKKIRKVKQKKGTRLRNGETPEVVSSHAKLHQLLLQERIENACGDPARLVKLKRKQLNGSAVEAKTGKSYMEKILEIPSPDYKMVCETSIIPQPGKLVSDDTSESGIKILEISSITPMNRSLGNENTWSSPNEQELEVNSYSERDRDTDGYIVEVSEQISGGVTEEMSSDYLKVLNEAGSVFDEQNKRECNLDSYHSDDVISEVDDYMDALATIDSELDTDNERGSMKDSLNIENLTDSNGKGEPQLRARFSDSQSFGDSLTSEEIISLEQDRNGEHNEVQGQMSDSLSTGTSWASDDNSPFRRDISEDHSQLQAQFSDFQSIRNSTSRIKDMSSNQLLPTFESQRTYCHEFVVHDDAHVQGEVISDSRPVSSGSCLMDSGHSMFSSDLGAASAMSLSAGSQSHETPSGPVELHLRIEDDEEKMCLVESIVARSDALYPIRDDALPVVSFDNNYLNLDVCDPHVHSNDLLQTSNELNLAHEGESGDHSGIKVLQAESLNECSSEILVSGDVSLQGEDPIFPSMEVDLNPDTKLLLDVQDLKSEDDIIATQLNSEDLFPVAETTTKSSITEELCFDFINVNKPDLAEVEVLPPDQQMNFEEVPSILPGNEISGSTCSLDLVEDDGHIIKHPSSNIISSPMSNHTKLEETLSIFADPCEKEMIVNEAGSRESLTELAAQKVEDQPEITSTDVQLNMNRSGPCDPSDFGMWNNTQHSSLKEKIQYSSSINDLKTVPVCSELDSQILSGQGINPTKHVMDPLKPLIPEFLPKASKNNLEEMPPMPPLPPMQWRTGKVQHASLFTQREDIEVNLASLQPIQPNKLDDISQFGLPTSEKETLPYQNLFLPVMAVESNMHQYSSGFSVGMSEQPVAIPFQLPVMVNEANGQYNFLVPEHSQIQNPFLSLQDRPPLGYAVALEGEKVLNPSPCPPSLPAECVVSRADPILQQEKSTQSPSELTEVTGLEVTKDRPEELHLVLPAECPVSGDDPISPKEKPTQSPSQLIEETSLEVKPLEQSSINLEREQEDPSTSPMSPPNLEIEETNHSLLPSDGEMVFPLVTSSQTRERDNTEMPNGKPKNKRRLPQDPVIDPVAALDKSRLRKVTERVMPPRAPKEDERESLLEMIRSKSFNLRPAAVQRPPSIQGPKTNLRVAAILEKANAIRQVYPSLSVYCNKLVLLNPFPLPAPAKYQPTKLFFIIELGIRWKR

SEQ ID NO: 200657 - protein, 94 aa, Glycine max
  Coding DNA Sequence Number=SeqID_83879
  Homolog annotation: Hit_ID=O80906; Match level="QueryCoverage=92%, HitCoverage=74%, E-value=8e-26, Identity=65%"; Hit description =Expressed protein
MESSSGIESTGGRAPLSGVVADCVKRWFKDTLKEAKAGDVNMQVLVGQMYYHGYGVPRDAQKADVIGWGMKGRIWLTKASRVRSSVWRVGGKRP

SEQ ID NO: 200658 - protein, 274 aa, Glycine max
  Coding DNA Sequence Number=SeqID_83880
  Gene Ontology: Mol. function=oxidoreductase activity; Cellular component=membrane; Biological process=metabolic process
  Homolog annotation: Hit_ID=Q9SCU0; Match level="QueryCoverage=99%, HitCoverage=89%, E-value=1e-106, Identity=69%"; Hit description =Short-chain alcohol dehydrogenase-like protein
  Pfam annotation: Domain name=Epimerase; Domain location=6-262; Score=- 67.5; E_value=0.1; Accession=PF01370.11; Description=NAD dependent epimerasedehydratase family
  Pfam annotation: Domain name=KR; Domain location=5-163; Score=-57.6; E_value=0.00052; Accession=PF08659.1; Description=KR domain
  Pfam annotation: Domain name=adh_short; Domain location=4-172; Score =101.3; E_value=2.9e-27; Accession=PF00106.15; Description=short chain dehydrogenase
  Pfam module annotation: Pfam domain module=Epimerase::KR::adh_short; Domain location=6-262::5-163::4-172
LEGKVAIVTGGARGIGEATVRVFVKHGAKVVIADVEDAAGGMLAETLSPSATYVHCDVSIEKEVENLISSTISRYGHLDIMFNNAGVLGNQSKNKSIVNFDPDEFDKVMCVNVKGVALGIKHAARVMIPRGVGCIVSTSSVAGVMGGLGPHAYTASKHAIVGITKNTACELGRYGIRVNCISPFGVATSMLVNAWKPCGDGDDEGINFGVPFPEEVEKIEEFVRGLANLRGPTLRALDIAQAALYLASDESKYVSGHNLVVDGGVTSSRNCIGL

SEQ ID NO: 200659 - protein, 132 aa, Glycine max
  Coding DNA Sequence Number=SeqID_83881
MQSQGLVLPLEPVVGPSAAHVNTKESCVDPIGNNPNTSDSEKCRLYVKENPPRLVSLGRLYEWSTIVHNITLRNDQVKVGVEEVRDAGAPILVPTQEGVVGPIKPVDRPDHDVDDPLYLMTWTIPQLFLKLL

SEQ ID NO: 200660 - protein, 244 aa, Glycine max
  Coding DNA Sequence Number=SeqID_83882
  Gene Ontology: Mol. function=oxidoreductase activity; Cellular component=cytoplasm; Biological process=aromatic compound catabolic process
  Homolog annotation: Hit_ID=Q3K842; Match level="QueryCoverage=97%, HitCoverage=99%, E-value=9e-93, Identity=72%"; Hit description=Short- chain dehydrogenase/reductase SDR
  Pfam annotation: Domain name=Epimerase; Domain location=9-239; Score=- 34.1; E_value=0.0006; Accession=PF01370.11; Description=NAD dependent epimerasedehydratase family
  Pfam annotation: Domain name=KR; Domain location=9-185; Score=-24.6; E_value=6.4e-06; Accession=PF08659.1; Description=KR domain
  Pfam annotation: Domain name=adh_short; Domain location=7-168; Score =115.5; E_value=1.6e-31; Accession=PF00106.15; Description=short chain dehydrogenase
  Pfam module annotation: Pfam domain module=Epimerase::KR::adh_short; Domain location=9-239::9-185::7-168
MTQNVKPLIVITGASSGIGLATAKLLSARGHALLLLARRIDRMTALNLPNALCRAVDVTDRHAFSAAVQDAEQQFGPADALINNAGVMLLGAIEQQDAGEWDKMFDVNVKGLLNGVQAVTAGMIDRKRGTIINISSVAGRKTFPNHAVYVGTKFAVHGMSENLREELSPHNVRVIVIAPGAVETELLSHTTSEAIKDGYHAWKAEMGGKVLSADDVASAIDYAYSQPQSVCVREIVLAATRQGA

SEQ ID NO: 200661 - protein, 78 aa, Glycine max
  Coding DNA Sequence Number=SeqID_83883
  Gene Ontology: Mol. function=transcription factor activity; Cellular component=membrane; Biological process=regulation of transcription, DNA-dependent
  Homolog annotation: Hit_ID=Q3K843; Match level="QueryCoverage=100%, HitCoverage=28%, E-value=2e-22, Identity=66%"; Hit description =Transcriptional Regulator, LysR family
  Pfam annotation: Domain name=HTH_1; Domain location=3-62; Score=70.2; E_value=6.8e-18; Accession=PF00126.17; Description=Bacterial regulatory helix-turn-helix protein, lysR family
MDKRQLKAFICVFEERNITRAAQLLNLTQPALSATIKLLEEELATTLFIRRPRGVEVTEDARVLYPQARKMLSDMQAL

SEQ ID NO: 200662 - protein, 40 aa, Glycine max
  Coding DNA Sequence Number=SeqID_83884
MTFSAEGVLRKQQGGYAIGNRAALTALAEEMEPGAALPGH

SEQ ID NO: 200663 - protein, 80 aa, Glycine max
  Coding DNA Sequence Number=SeqID_83885
MWAIIDKCKEKLNLAATHEQRLEDEYAKISAEREARERESRTSPIASQGQSSGGHLLRPRGDPRTSQLLSAYDRLNGPYD

SEQ ID NO: 200664 - protein, 68 aa, Glycine max
  Coding DNA Sequence Number=SeqID_83886
MSGFTRNSPQISASPHQLDLAPYASEPYHAQWNAPGLLHDKHTLRLSRILGEMEVVFVIGSAVDRLCG

SEQ ID NO: 200665 - protein, 184 aa, Glycine max
  Coding DNA Sequence Number=SeqID_83887
  Gene Ontology: Mol. function=RNA-directed DNA polymerase activity; Biological process=RNA-dependent DNA replication
MGEVEEVQEQMKSNTEALKEKMAMMSIKEIMEANAIAVATASVVAKVNLMPPSGLKQMNHPTSDMDVNNSAPIVIEIRQPHHVHVSQPMGETHEIPHHNLADFEPCLEYATEGNGKLDHLKERLRAIEGGEDYAFANLEELFLVPNIITPPKFKVSDFDKYKGTTSPKNHLKMCCRKMGAYAKA

SEQ ID NO: 200666 - protein, 214 aa, Glycine max
  Coding DNA Sequence Number=SeqID_83888
  Gene Ontology: Mol. function=alkaline phosphatase activity; Cellular component=periplasmic space; Biological process=transport
  Homolog annotation: Hit_ID=P35482; Match level="QueryCoverage=74%, HitCoverage=41%, E-value=4e-34, Identity=45%"; Hit description =Alkaline phosphatase L precursor
MGLRQARPAPHRRWRRREGDRRITVMQRTYAEGAGIAAGALVRFLQLPKQSQLQRTADARAGAGVVHGPGVGGGRKAGADRITPGLGQRDELVRADGGVVRALLHAVDHRAAVVAGQEAADVGAHGAVLVALAEHEVGVARDRVARVRVAEHRHPVGRVLSGGIGRRSDGFQGRLHAHFVRRETLDLGDLGGVGQARDHVRADVADAAIGSVHG

SEQ ID NO: 200667 - protein, 93 aa, Glycine max
  Coding DNA Sequence Number=SeqID_83889
  Subcellular localization annotation: CTP_CleavageSite=55; ConfidenceScore=5.29e-01
MSHPHSPTARFPAALWRSHPMAWAVAVALGSVVAPATQAQQAFSPGWFAERGAAQGAAAQSGRMPNGVPIQFQLPAQQQDAARQKLQQSIDNL

SEQ ID NO: 200668 - protein, 81 aa, Glycine max
  Coding DNA Sequence Number=SeqID_83890
  Homolog annotation: Hit_ID=Q2HRM7; Match level="QueryCoverage=46%, HitCoverage=5%, E-value=2e-11, Identity=81%"; Hit description =Polynucleotidyl transferase, Ribonuclease H fold
MGPKSTLRLRVFSCISGPIFLESSIQYPWGGGDAGFLSNFWKNLWTKLGTKLLFSTTFHPQTDGQTKVVNRSLSILLRALS

SEQ ID NO: 200669 - protein, 83 aa, Glycine max
  Coding DNA Sequence Number=SeqID_83891
MDKSSNFDENSDVGAKEDVLSKEGLKLCEYSTDDKLDGCVDSALREANADVVFEDLIWWYSVEDWEDDDDLEESKSSSFSARS

SEQ ID NO: 200670 - protein, 107 aa, Glycine max
  Coding DNA Sequence Number=SeqID_83892
MVKRMNCYSITIPELESITTRFKFNSLVKGNGDANGMRVSTNPDINSHGVSIVGPLPKKKNEEEGVAENAKLNLFLKGEEPVGRGWQGASGLKYEITKKCGSWLVSV

SEQ ID NO: 200671 - protein, 95 aa, Glycine max
  Coding DNA Sequence Number=SeqID_83893
  Subcellular localization annotation: CTP_CleavageSite=42; ConfidenceScore=5.15e-01
MRLHYDQASRRPSMTTDQPPLLMAHIDPGIGPNISMCVRGVVPSGVANCRNLPFSGRAMRDSMVHLPTKENARSFHQRLFEENARKTKKTKVYRF

SEQ ID NO: 200672 - protein, 90 aa, Glycine max
  Coding DNA Sequence Number=SeqID_83894
MMVPRASHVNLRIAFVVHSISMPESFISMRCGRSIGDQNCYSLDYRVESSTFFKGKIHQVKVKYGSNQLAKLGQKVDRVTSPFCLLPTHD

SEQ ID NO: 200673 - protein, 78 aa, Glycine max
  Coding DNA Sequence Number=SeqID_83895
  Subcellular localization annotation: CTP_CleavageSite=33; ConfidenceScore=5.12e-01
MLILASQIELLNASCRAIRKAPGSPRLASGSPRLASGSPGPPKLLHGEVTSSPGRARLLQKEVTARLGELHPKCLVLL

SEQ ID NO: 200674 - protein, 106 aa, Glycine max
  Coding DNA Sequence Number=SeqID_83896
  Gene Ontology: Mol. function=oxidoreductase activity; Biological process=ethylene biosynthetic process
  Homolog annotation: Hit_ID=Q8W3Y3; Match level="QueryCoverage=87%, HitCoverage=37%, E-value=8e-39, Identity=71%"; Hit description=1 -aminocyclopropane-1-carboxylic acid oxidase
  Pfam annotation: Domain name=2OG-FeII_Oxy; Domain location=22-98; Score=27.4; E_value=5.1e-05; Accession=PF03171.10; Description=2OG -Fe(II) oxygenase superfamily
MRINLGLKKGYLKKAFYGSRGPTFGTKVANYPPCPNPELLLKDGQWVDVPPMCHSIVVNITIGDQLEVIANGKYKSVEHHVIAQTDGTIMSIASFYNLLGLLNKWP

SEQ ID NO: 200675 - protein, 100 aa, Glycine max
  Coding DNA Sequence Number=SeqID_83897
MGNLQQAYSHSGHLQGPMFSADLLIKSRGLIIFHSLLFSTGFKHSYSTTQLMSRKFGAQSIQIAETLETIWHAEIRQDDDDNTVLHIAAETTKMICENLD

SEQ ID NO: 200676 - protein, 96 aa, Glycine max
  Coding DNA Sequence Number=SeqID_83898
MKISKEWTGERAGREERAKSGIREIQGKNVEDAGFDDVIIEDQTDKTRGAELNELDVEEEDATEEEGFRSSSPLRNDEVAMKKMCKGEVESINECI

SEQ ID NO: 200677 - protein, 360 aa, Glycine max
  Coding DNA Sequence Number=SeqID_83899
  Gene Ontology: Mol. function=oxidoreductase activity, acting on single donors with incorporation of molecular oxygen, incorporation of two atoms of oxygen; Biological process=L-phenylalanine catabolic process
  Homolog annotation: Hit_ID=Q7WNZ3; Match level="QueryCoverage=100%, HitCoverage=83%, E-value=0.0, Identity=88%"; Hit description =Homogentisate 1,2-dioxygenase
MAAHAVVQAGAAGGEAVGLGVVHALDQAHEFAGDVAVEPGRTEGVFHCQDARREDGEVHVGRARGIGRGGQHREDRRVRMVVADRADGVEVAQVVLVRRVRAVPGDHVQRRMADRGAPEAAGELGDQFEVAFHVFVPGHRRLEVAGIGQAVRADRAQFGQAQRGAEVLQHVAARAVVQQLHAEAHAARDHGDLQRLQVDQAQFGGQAQAALLRHQQQLAVGVVEIAALHRAVGGIQVDADAALFIGAAVAAPGLHAFDEVGGRGGNGQGAPAQLVGRDRAVAERAFPALDAGKRLERLVLRARADAVEPGAAVLAARRGEGGAGQLLGVQAIGALLGRIAAQGQRAGQGFGGTVVAETGL

SEQ ID NO: 200678 - protein, 35 aa, Glycine max
  Coding DNA Sequence Number=SeqID_83900
MENNVAAVVATSTAVEADPTHLSSINQTSQPVPNM

SEQ ID NO: 200679 - protein, 366 aa, Glycine max
  Coding DNA Sequence Number=SeqID_83901
  Gene Ontology: Mol. function=3-deoxy-7-phosphoheptulonate synthase activity; Cellular component=cytosol; Biological process=aromatic amino acid family biosynthetic process
  Homolog annotation: Hit_ID=Q9I2Y7; Match level="QueryCoverage=87%, HitCoverage=89%, E-value=1e-155, Identity=86%"; Hit description =Phospho-2-dehydro-3-deoxyheptonate aldolase
MHASSDGDAVLKLVEIFRNRLAAPAQVAFHHQADDRVVAFDDLVADVVHHQRLQGRVLVGVGVAAVDHDVQRDFRLVQVLLAERDADRIVVRLAVAAAQHHVTIAVALGGDDGYAALLVDAEEAMRAGDRLQGIDRHGQAAIGAVLEADRGRQAGGHLAVGLRFGGTGADRRPADQVLQVLRGNRVERFGGGGQAFLGEVAEQLATDVQAILDLERVVQVRIVDQAFPAHRGTRLLEVHAHDDFQFAGQRVTQRLQALGVLDGGLRVVDRARADHHCQAVVAAMQDLVQGRARGADGVGGFIVTGQHRQQLGRRCQRFDGADTQVVGVRGHCGRSPERWGSPAWRHEKSRQVRWRLSGMRLKLSSG

SEQ ID NO: 200680 - protein, 95 aa, Glycine max
  Coding DNA Sequence Number=SeqID_83902
MPETARSTPTFPHIHFNTIGNRWLEPTEPPIEEKLKKTLHCCWNCVGRRKPYTALGTVVGAQSSKLSTLPVNKLDESYTPSKVSIRAGDGFHNLK

SEQ ID NO: 200681 - protein, 77 aa, Glycine max
  Coding DNA Sequence Number=SeqID_83903
MGKMLSGDNLTKGFFVLPESHVPPKVDLVDLMSEGKGDKLREDTSFEEDLSTDEEDPVKVPKPMEEDSLQDSSEESY

SEQ ID NO: 200682 - protein, 64 aa, Glycine max
  Coding DNA Sequence Number=SeqID_83904
MLPIFKEARMKKGDDLGRFRQLDEILFVDGYPGYMQLMSIVENCMQVVSEIIGDPILVLILFTT

SEQ ID NO: 200683 - protein, 290 aa, Glycine max
  Coding DNA Sequence Number=SeqID_83905
  Gene Ontology: Mol. function=sequence-specific DNA binding; Cellular component=intracellular; Biological process=transposition, DNA -mediated
  Homolog annotation: Hit_ID=Q13HP7; Match level="QueryCoverage=99%, HitCoverage=84%, E-value=1e-130, Identity=79%"; Hit description =Putative transposase IS116/IS110/IS902
  Pfam annotation: Domain name=Transposase_20; Domain location=161-248; Score=104.2; E_value=3.9e-28; Accession=PF02371.7; Description =Transposase IS116IS110IS902 family
  Pfam annotation: Domain name=Transposase_9; Domain location=14-109; Score=23.4; E_value=0.00049; Accession=PF01548.8; Description =Transposase
  Pfam module annotation: Pfam domain module=Transposase_20::Transposase _9; Domain location=161-248::14-109
MEACSGAHYWARVFQQHGHTAKLMAPRLVAPYRMSGKRGKNDAADAAAICEAVTRPSMRFVPLKDEHQQATLCLHRTRQGFVEEGTAAYNRMRGLLAEFGVVLPRSPERLRREITPHLDILPGWARRCISDLLEHAGNIEDRLEEYDRAISGIARDDERSKRLMRLRGIGPTTASALLASLGGGHDFRNGRQVAAWLGLTPGQHSSGGKARLGSITKAGDAYLRSLLVLGARAVIANLGEKQDRLSRWVRGLVERRGYWRAAVAIAAKNARMAWAVLKYGEDFKPDPVAA

SEQ ID NO: 200684 - protein, 74 aa, Glycine max
  Coding DNA Sequence Number=SeqID_83906
  Gene Ontology: Mol. function=sequence-specific DNA binding; Cellular component=intracellular; Biological process=transposition, DNA -mediated
  Homolog annotation: Hit_ID=Q1QG70; Match level="QueryCoverage=55%, HitCoverage=12%, E-value=3e-11, Identity=76%"; Hit description =Transposase IS116/IS110/IS902
  Pfam annotation: Domain name=Transposase_20; Domain location=1-52; Score=-3.0; E_value=0.018; Accession=PF02371.7; Description =Transposase IS116IS110IS902 family
ALCAAIGNGKQFRSGRDWAAWIGLVPRQHTTGGKPTLLGISKAAPGDSDTEASVENDSTTRASPLSASSSVVFG

SEQ ID NO: 200685 - protein, 43 aa, Glycine max
  Coding DNA Sequence Number=SeqID_83907
MSAEKYQSGATSRPMSTIEFSIQSLNEICMMSTSTVNFFNQYR

SEQ ID NO: 200686 - protein, 242 aa, Glycine max
  Coding DNA Sequence Number=SeqID_83908
  Homolog annotation: Hit_ID=Q1R115; Match level="QueryCoverage=47%, HitCoverage=30%, E-value=3e-20, Identity=51%"; Hit description =CRISPR-associated protein, CT1975
MLNSNTAALCRILNPDAQKALLDWFATLSERYERKDDKRINGRAWRAELKRMEPPYGVMMCEGYDALRQALLKHMRLQPLDEMALALFVSVAAVKIRGTDGVNVLSLADGIILWMEEWQRRENHQPESQRLRVSSQSLKRAWRVSETFEGAMDGFMGKRTRRIGVDYVYRPMIAAGVIGKTAKSAAEKIAAQFGKLKNDKNASDEKNLEIEQIVHVSNHEISLIKHLVDTLIADKREPNDEE

SEQ ID NO: 200687 - protein, 86 aa, Glycine max
  Coding DNA Sequence Number=SeqID_83909
MRERRLVNPSGGHHRHLVCDQRWQQVPTRHENRGELQKLLCWSVPPRIGTHARVGTVGEARLRVAERLSFLGQVPSDAILPRKGIG

SEQ ID NO: 200688 - protein, 35 aa, Glycine max
  Coding DNA Sequence Number=SeqID_83910
MDEYFRVSNCKSAKDMWDTLQEHEMEFDRGRTRIK

SEQ ID NO: 200689 - protein, 86 aa, Glycine max
  Coding DNA Sequence Number=SeqID_83911
MATHCQNILLKGFPLRGHLNILSPFLGLVIDYTPLAIDYQRPISRYHSRFIVGQSQHKPPCFVVFVLLLVDCQELACLGTSQVLTD

SEQ ID NO: 200690 - protein, 712 aa, Glycine max
  Coding DNA Sequence Number=SeqID_83912
  Gene Ontology: Mol. function=binding; Cellular component=kinesin complex; Biological process=protein amino acid phosphorylation
  Homolog annotation: Hit_ID=Q8S3S1; Match level="QueryCoverage=96%, HitCoverage=90%, E-value=0.0, Identity=56%"; Hit description =Putative kinesin light chain gene
  Pfam annotation: Domain name=TPR_1; Domain location=335-368; Score =12.5; E_value=0.17; Accession=PF00515.18; Description=Tetratricopepti de repeat
  Pfam annotation: Domain name=TPR_1; Domain location=377-410; Score =1.8; E_value=3.3; Accession=PF00515.18; Description=Tetratricopeptide repeat
  Pfam annotation: Domain name=TPR_1; Domain location=459-492; Score =21.4; E_value=0.0033; Accession=PF00515.18; Description =Tetratricopeptide repeat
  Pfam annotation: Domain name=TPR_1; Domain location=501-534; Score =14.9; E_value=0.09; Accession=PF00515.18; Description=Tetratricopepti de repeat
  Pfam annotation: Domain name=TPR_1; Domain location=544-577; Score =17.6; E_value=0.042; Accession=PF00515.18; Description =Tetratricopeptide repeat
  Pfam annotation: Domain name=TPR_1; Domain location=585-618; Score =6.0; E_value=1; Accession=PF00515.18; Description=Tetratricopeptide repeat
  Pfam annotation: Domain name=TPR_1; Domain location=627-660; Score =3.3; E_value=2.1; Accession=PF00515.18; Description=Tetratricopeptide repeat
  Pfam annotation: Domain name=TPR_2; Domain location=248-282; Score =4.9; E_value=8.9; Accession=PF07719.7; Description=Tetratricopeptide repeat
  Pfam annotation: Domain name=TPR_2; Domain location=335-368; Score =8.6; E_value=3.3; Accession=PF07719.7; Description=Tetratricopeptide repeat
  Pfam annotation: Domain name=TPR_2; Domain location=377-410; Score =8.6; E_value=3.3; Accession=PF07719.7; Description=Tetratricopeptide repeat
  Pfam annotation: Domain name=TPR_2; Domain location=419-452; Score =0.8; E_value=27; Accession=PF07719.7; Description=Tetratricopeptide repeat
  Pfam annotation: Domain name=TPR_2; Domain location=459-492; Score =13.6; E_value=0.73; Accession=PF07719.7; Description=Tetratricopeptid e repeat
  Pfam annotation: Domain name=TPR_2; Domain location=501-534; Score =12.6; E_value=1.1; Accession=PF07719.7; Description=Tetratricopeptide repeat
  Pfam annotation: Domain name=TPR_2; Domain location=544-577; Score =20.0; E_value=0.0086; Accession=PF07719.7; Description =Tetratricopeptide repeat
  Pfam annotation: Domain name=TPR_2; Domain location=585-618; Score =6.7; E_value=5.5; Accession=PF07719.7; Description=Tetratricopeptide repeat
  Pfam annotation: Domain name=TPR_2; Domain location=627-660; Score =5.9; E_value=6.7; Accession=PF07719.7; Description=Tetratricopeptide repeat
  Pfam module annotation: Pfam domain module=TPR_1::TPR_1::TPR_1::TPR _1::TPR_1::TPR_1::TPR_1::TPR_2::TPR_2::TPR_2::TPR_2::TPR_2::TPR _2::TPR_2::TPR_2::TPR_2; Domain location=335-368::377-410::459 -492::501-534::544-577::...
  Pfam module annotation: Domain location=585-618::627-660::248 -282::335-368::377-410::419-452::459-492::501-534::544-577::585 -618::627-660
MPGIVRNGVHHDEGGSNDLNGDHDSTSKEPLNLVKSPRGGSVSPQRGQGDDGANFGGDEVVEPSIEQLYENVCDMQSSDQSPSRQSFGSDGDESRIDSELRHLVGGRMREVEIMEEEVGEEKGLPEGSSSSEISSALGGLSNDKKLNQVDEIQEVQPAATSSGSSEKSIKASISMVGPDNTSPKSTSKGKIPLSKAPIPRNNGKPLRKQISGATTGVKTTKNSPMGKSVSRNRAESTAESALEKPERAPVLLKQARDLISSGDNPHKALDLALQAMKLFEKFGNEKPSLELVMCLHVTAAIYCSLGQYGEAIPILERSIEVPVIGESQQHALAKFAGHMQLGDTYAMLGQLENSTMCYTTGLEVQKQILGETDPRVGETCRYVAEANVQALQFDEAERLCQMALDIHIANNSAPSLEEAADRRLMGLICETKGNHETALEHLVLASMAMVSNDQEAEVASVDCSIGDTYLSLSRYDEAVFAYQKALTVFKTSKGENHPAVGLVFVRLADLYNRTGKIRESKSYCESALKIYENPMPGIPPEEIASGLTNISTIYESMNELEHALKLLQKALEIYNDTPGQQSTIAGIEAQMGVMYYMLGNYSKSYNTLKNAISKLRAIGEKKSSFFGIALNQMGLACVQCYALSEATELFEEAKSILEQEYGPYHPETLGVSSNLAATYDAIGSIFFNLLWYYEKQANNSNNSLPNPVMSPV

SEQ ID NO: 200691 - protein, 80 aa, Glycine max
  Coding DNA Sequence Number=SeqID_83913
MIPTSSMTMKFCGELEISIIKLGKKDSFQNILSMSEEFRIRLSNQVVVKLDISNIKLRKGFHSQTYIPNSEEFGFQTKWF

SEQ ID NO: 200692 - protein, 103 aa, Glycine max
  Coding DNA Sequence Number=SeqID_83914
MDAGETCIGTTCGIHFAIGICGMGLNFASQPGDTQGQQARPQVAGSRRNFQVASAGMYRQPSQRNRLHVGVVIPTSETPCARVLKILVSSLPRFASCCLFRQS

SEQ ID NO: 200693 - protein, 135 aa, Glycine max
  Coding DNA Sequence Number=SeqID_83915
  Gene Ontology: Mol. function=RNA-directed DNA polymerase activity; Cellular component=signal recognition particle, endoplasmic reticulum targeting; Biological process=RNA-dependent DNA replication
QQREKEGCLRTRRLGLGAHEKRKVFGTKEIKASTKGRWTISSERINDNAYKVELPDEESDLRKNPSQEGENDEDMTRSMGKDPLEGLGGPMTRARVRKAKEALQQVLSILFEYKPKFQGEKSKVVSCIMAQMEED

SEQ ID NO: 200694 - protein, 90 aa, Glycine max
  Coding DNA Sequence Number=SeqID_83916
  Subcellular localization annotation: CTP_CleavageSite=52; ConfidenceScore=5.11e-01
MKHLTKRKLKDKSSSAKPAKKQKQIWKNSRKKAHSTITEHQSTASLQTANIRSETQACIIDIHIQIKMSKGECLQIYLIQLPATTIHFMI

SEQ ID NO: 200695 - protein, 130 aa, Glycine max
  Coding DNA Sequence Number=SeqID_83917
  Gene Ontology: Mol. function=ribonuclease H activity; Biological process=DNA integration
VVLPFEVEVPSLRIMAESGLKELEWAQARFDQLNLIEGKWLTAMSHGRFYQRWVKNAFDKKMRPRRFNEGDLVLKKASQALKDNRGKWAPNYEGPFVVKKAFSGGALVLANMDNTGLLSPVDVPSFSSIF

SEQ ID NO: 200696 - protein, 79 aa, Glycine max
  Coding DNA Sequence Number=SeqID_83918
MAMNKAPEDAHVDLEQPRHVVEVCQVIAERLERLFNLRIMIEGTEVYIVTEECLRIARGVTMQRNVYVRSRRRRRMEDT

SEQ ID NO: 200697 - protein, 282 aa, Glycine max
  Coding DNA Sequence Number=SeqID_83919
  Homolog annotation: Hit_ID=Q1T1Y0; Match level="QueryCoverage=28%, HitCoverage=20%, E-value=3e-08, Identity=43%"; Hit description =Ankyrin
  Pfam annotation: Domain name=DUF1723; Domain location=87-136; Score =46.6; E_value=8.4e-11; Accession=PF08330.1; Description=Protein of unknown function (DUF1723)
MVKTRDLGRTLGKVIGRALGREDVHDMDHIDDEVHEQLEEAVGDDVATDAEGFPSEPHDTSVLPAPEIEGLVAATGLSPLITCSLDTGDRGLMSTFMERWHKKISSFHPSVGEVTITLDDVASLLHFPITDAFHTFEPLHVDDVILLLVKFLEVSAEKVRAETVQCHGAYVRTIPWGICLTILATRHYDERKPRAYHWKSGKTLPISTYRGRLDRLTSDIVCWIPYGNHRAFREFETIPPHHAAPSLCIEDIDDRWIQFSGYIAPVGQICVTPNQCSPNYMD

SEQ ID NO: 200698 - protein, 271 aa, Glycine max
  Coding DNA Sequence Number=SeqID_83920
  Gene Ontology: Cellular component=peroxisome
  Homolog annotation: Hit_ID=Q9FXT6; Match level="QueryCoverage=88%, HitCoverage=39%, E-value=2e-26, Identity=59%"; Hit description=PEX14 protein
  Pfam annotation: Domain name=Pex14_N; Domain location=45-134; Score =24.2; E_value=3.9e-07; Accession=PF04695.4; Description=Peroxisomal membrane anchor protein (Pex14p) conserved region
MVLSSALLFKGGEIEQTENVDQHNRGEELGKQSSDTSVFVNSEPLREEQIQNAVKFLSHPKVRGSPVIHRRSFLEKKGLTKEEIDEAFRRVPDSPPSVQTAGINQGELSNVEVADWSSVFFIFTFGLSLNCYYIDSWLTVILTDGQLKPSSNIQQQGQPQALQLTVPASTGVTTTLGTLSRRSFHWSHALIAVGLLAASGAGTVIVIKNSILPRLKSWIRNVVLEEDHDQSKRTGSKPTLAEEAAQAAKAAAVAAADIAKASQELLSSKIE

SEQ ID NO: 200699 - protein, 58 aa, Glycine max
  Coding DNA Sequence Number=SeqID_83921
MFEEEVAAIGEEAPQDPPSFVRPCHPNFQLGNWHVTSQSKVYTADSIIYIGEEIHGLD

SEQ ID NO: 200700 - protein, 300 aa, Glycine max
  Coding DNA Sequence Number=SeqID_83922
  Homolog annotation: Hit_ID=Q9FM16; Match level="QueryCoverage=85%, HitCoverage=88%, E-value=1e-10, Identity=27%"; Hit description =Arabidopsis thaliana genomic DNA, chromosome 5, P1 clone:MQB2
  Pfam annotation: Domain name=DUF1645; Domain location=114-285; Score =41.9; E_value=2.2e-09; Accession=PF07816.2; Description=Protein of unknown function (DUF1645)
MMQLQQHHQEVEEAEEEASNSSSHHHNKASPSPSFSSYSSETLAEIAARVIEELRRDPSSLSVDDDDDALFPPWENQNDSFVPQNDKPAEQNDDDDDDFEFAFVSRDFTSPVSADDIFHNGRIKAMYPIFGVVVPSNDAVSSVVPNNNNNNIANSTPRRRLPLRKLMFEEGETASCSSSTEESVDLEGVVAAEGAYCVWTPNSVGRERKKSNSTGSASKRWKLRVRDLLLRSHSDGKDNNNNKQQQQQQRELKEVVFQIPKNKVAAKPQNGTEHAEQNKRKSFLPYRPELVGLFANVNGL

SEQ ID NO: 200701 - protein, 114 aa, Glycine max
  Coding DNA Sequence Number=SeqID_83923
MGSFLKYFHEGTLLDVKRMHVAPKPPVELVSLVSVKKSPVLMAIYVPVGTASQTGEFQVHDEFDYNSVVFQWKGSKKVIQIKRGISFSALKKKIGDKENILPCKFVMTKTLKRC

SEQ ID NO: 200702 - protein, 80 aa, Glycine max
  Coding DNA Sequence Number=SeqID_83924
MAIDLVTILLSVASSYLRNYNHNEPTDVVSKMIWRWPGLERIKCFFGKVGKKFWSLTTSGGPGAWQRPTNALYVQMIGSP

SEQ ID NO: 200703 - protein, 74 aa, Glycine max
  Coding DNA Sequence Number=SeqID_83925
  Homolog annotation: Hit_ID=Q8L5Y9; Match level="QueryCoverage=89%, HitCoverage=7%, E-value=5e-25, Identity=86%"; Hit description =Pantothenate kinase 2
MEKFLQKGTEITAPVPMTPLAGTTGLGGFEVPLSKGSTLRSDASALNVGVLHLVPTLEVFPLLADPKFLYHQRW

SEQ ID NO: 200704 - protein, 307 aa, Glycine max
  Coding DNA Sequence Number=SeqID_83926
  Gene Ontology: Mol. function=pantothenate kinase activity; Biological process=coenzyme A biosynthetic process
  Homolog annotation: Hit_ID=Q8L5Y9; Match level="QueryCoverage=99%, HitCoverage=35%, E-value=1e-144, Identity=84%"; Hit description =Pantothenate kinase 2
  Pfam annotation: Domain name=DUF89; Domain location=1-294; Score= -133.5; E_value=0.066; Accession=PF01937.10; Description=Protein of unknown function DUF89
MEEPSAYGKLGLANLLEMREECLREFQFVDAYRSIKQRENEASLAVLPDLLVELDSMDEESRLLTLIEGVLAANIFDWGSRACVDLYHKGTIIEIYRMSRNKMCRPWRVDDFDDFKERMLGTGDKKMPHHKRALLFVDNSGADIVLGMLPLARELLRRGTEVVLVANSLPALNDVTAMELPDIVAEAAKHCDILRRAAEAGGLLVDAMINTSDSSKENPSSVPLMVVENGCGSPCIDLRQVSSELAAAAKDADLIILEGMGRALHTNLNARFKRDALKLAMVKNQRLAEKLVKGNIYDCICKYEPAS

SEQ ID NO: 200705 - protein, 88 aa, Glycine max
  Coding DNA Sequence Number=SeqID_83927
  Subcellular localization annotation: CTP_CleavageSite=32; ConfidenceScore=5.06e-01
MLNSRYSCKVKIDQMYIPHSSKSSCSKSIICRNSNVFPSKQWRPFRIAWSSAWTIEQGGEAENEASILIPKHSSTLNEEDRSPSHFLA

SEQ ID NO: 200706 - protein, 190 aa, Glycine max
  Coding DNA Sequence Number=SeqID_83928
  Gene Ontology: Mol. function=pantothenate kinase activity; Cellular component=cytosol; Biological process=coenzyme A biosynthetic process
  Homolog annotation: Hit_ID=Q8L5Y9; Match level="QueryCoverage=99%, HitCoverage=24%, E-value=1e-95, Identity=83%"; Hit description =Pantothenate kinase 2
  Pfam annotation: Domain name=Fumble; Domain location=1-151; Score =129.3; E_value=1.1e-35; Accession=PF03630.5; Description=Fumble
VDGDGKFERVSGTNVGGGTYWGLGRLLTKCKSFDELLELSQKGDNRTMDMLVGDIYGGLDYSKIGLSASTIASSFGKTISEKKELEEYRPEDISLSLLRMISYNIGQVRGHAYTMDTISFAVHFWSNGEAQAMFLRHEGFLGALGAFMSYEKHGLDDLMVHQLVERFPMGAPYTGGKIHGPPLGDLNEKA

SEQ ID NO: 200707 - protein, 225 aa, Glycine max
  Coding DNA Sequence Number=SeqID_83929
  Gene Ontology: Mol. function=pantothenate kinase activity; Cellular component=cytosol; Biological process=coenzyme A biosynthetic process
  Homolog annotation: Hit_ID=Q8L5Y9; Match level="QueryCoverage=80%, HitCoverage=21%, E-value=3e-71, Identity=75%"; Hit description =Pantothenate kinase 2
  Pfam annotation: Domain name=Fumble; Domain location=90-225; Score= -104.5; E_value=6.7e-08; Accession=PF03630.5; Description=Fumble
MAGSLQNQRQQLLGIIEEEEQEKLQKQKEETEGNNNNNNNNKSDMAPTAGNSIHRSGSRPQLDVSKAEIQGNVEEKYPTILLPNQSDDLSHLALDIGGSLIKLVYFSRHEDQSWDDKRKRSMKEPLGLSNGNRRSFPILGGRLHFVKFETRKINECLDFIHSKQLHCGGLESHYSDGVTDQNGIIKATGGGAYKYADLFKERLGVSLDKEDEMDCLVAGANFLLK

SEQ ID NO: 200708 - protein, 89 aa, Glycine max
  Coding DNA Sequence Number=SeqID_83930
MYLRKRRERECGDAIAKCKRGRLCEGKGKSCGLAMPEEEGNGEREGEVKVRGPKGGEGSWVPEGRGKVTGAEREGGEGRSYEGEMEGEK

SEQ ID NO: 200709 - protein, 64 aa, Glycine max
  Coding DNA Sequence Number=SeqID_83931
  Subcellular localization annotation: CTP_CleavageSite=40; ConfidenceScore=5.61e-01
MHKKRKKEASAPPPWATSTPLPPPPPPPSSSPWRPRVAVPCTSGAGEARHPPWWLLLLRRHFES

SEQ ID NO: 200710 - protein, 151 aa, Glycine max
  Coding DNA Sequence Number=SeqID_83932
  Gene Ontology: Mol. function=metal ion binding; Cellular component =mitochondrion; Biological process=iron-sulfur cluster assembly
  Homolog annotation: Hit_ID=O49627; Match level="QueryCoverage=82%, HitCoverage=74%, E-value=7e-46, Identity=72%"; Hit description=NifU -like protein
  Pfam annotation: Domain name=NifU_N; Domain location=30-146; Score =178.3; E_value=1.8e-50; Accession=PF01592.7; Description=NifU-like N terminal domain
MLRIAASAKRIVQTASLEAPPLGIRVLPRLYHERVVDHYDNPRNVGSFDKNDPTVGTGLVGAPACGDVMKLQIKVDDKTGKIVDARFKTFGCGSAIASSSVATEWVKGKQMEEVLTIKNTRTENSLCPLLSPAFVLGSFHTLTWVDLGFDS

SEQ ID NO: 200711 - protein, 71 aa, Glycine max
  Coding DNA Sequence Number=SeqID_83933
  Subcellular localization annotation: CTP_CleavageSite=28; ConfidenceScore=5.40e-01
MKRSLSFSQWSWTLENISSKISPPPPPMSATKENENRLRRMTSSGTPTIFTVLQISMYVARWAYGSSLGSP

SEQ ID NO: 200712 - protein, 168 aa, Glycine max
  Coding DNA Sequence Number=SeqID_83934
  Subcellular localization annotation: CTP_CleavageSite=76; ConfidenceScore=5.24e-01
MHHTQVFRKLRRPIPEALLPELAFLTSGRPSSGSGTTATNKTSNTEHGTTKSSNTSLHGTTNRLLKGPPPKQQQTEEETKQTEEETKQTEEERKKAHSLKKKERKRSKTQPEEGNPKAAGIGQRRICVFRKNKRTISGGTSSGMFPEEASSGRHWNSSGRSFFRKHSG

SEQ ID NO: 200713 - protein, 140 aa, Glycine max
  Coding DNA Sequence Number=SeqID_83935
MAKLPFSNSSYGRRFFRKLFRKNLLPEEEFVSSGSTHRQLPEERHPECFRKKLLPEDFHCLPEEASSGSTEGGRSGMTTSGRRSSGNYEGQFRKKFFRKLLPEDLLPELVIPDLPPSVPKNSSGYTFYCFSSLYTNRKTK

SEQ ID NO: 200714 - protein, 86 aa, Glycine max
  Coding DNA Sequence Number=SeqID_83936
MTKGADNHTVPPHVIGLAVSGLQKMTKGADNRKVSPHATGLSGRWIAKGVYGLPSGVSACHQTLGSLDSKGCLRVTVGCLRIPSDS

SEQ ID NO: 200715 - protein, 301 aa, Glycine max
  Coding DNA Sequence Number=SeqID_83937
MRGYHMVIRSFCHPEATSPLTCGDGKSDDMRGYRMVICTFGHLETASPMICRDGKSDDMRGDRMVICTFGHLKTTSPMTFMGIVWSSAPLVIERWQGYRMVIDNFGHLETASPMTCGDGKSDDMQRYRMVIRTFGHLETASPMTCGDGKSDDMWGYRMVIHTFGHLETASPMTCGDRKSDDMQGYRMVIRTFCHPETASPMTCGDGKSDDMRGYRMVICTFCHPETASPMTCGDGKSDDMRGYRMVIRTIRQPGANGPVDTQRLTSSSVPFVILTHEVRGKRARLRAEANIVFCTFCHPDP

SEQ ID NO: 200716 - protein, 133 aa, Glycine max
  Coding DNA Sequence Number=SeqID_83938
  Gene Ontology: Mol. function=RNA-directed DNA polymerase activity; Cellular component=intracellular; Biological process=RNA-dependent DNA replication
MSLKIKEEVKKQFDVGFLAIARYPEWVANIVLVPKKDRKVRMYVDYRDLNRASPKDNFPLPHIDVLVDNTTNFALFSFMDGFSGYNQIKMAPEDMEKTTFVTLWGTFYYKVMSFGSRTSGQPINGLWWLCSTT

SEQ ID NO: 200717 - protein, 50 aa, Glycine max
  Coding DNA Sequence Number=SeqID_83939
MLTGDNDKEWKDRVFFHLSVADLDYVLYQQFETSDKAIKLIDTVDLEGGP

SEQ ID NO: 200718 - protein, 318 aa, Glycine max
  Coding DNA Sequence Number=SeqID_83940
  Gene Ontology: Mol. function=oxidoreductase activity; Biological process=electron transport
  Homolog annotation: Hit_ID=Q1MZD3; Match level="QueryCoverage=100%, HitCoverage=75%, E-value=1e-104, Identity=56%"; Hit description =Amine oxidase, flavin-containing
MSFSVRNEATGLEYNGTSLNSLFAQRRNLLSPAFYRMVRDILRFNKESLSLLAPGNEIALGDYLQQHGYSQQFIRDYIVPMGAAIWSTDAEQMLQFPARFFVRFFHHHGMLTIDDRPQWRTIVGGSSAYLQKVTAGYREHIQLNKPVGSIQRQHAAVTVTTLNGNSEQFDYVFFACHSDEALKILGDQATSEEKQVLGAIPYQDNTVYLHTDARLMPKRKLAWAAWNYHVTEKPSGKVQVTYNMNILQGIKSATPLLVTLNYTDAIDPAKVIKKLHYRHPLYTLEGAEAQTRHAEISGHHRTGYAGAYWRNGFHEDGV

SEQ ID NO: 200719 - protein, 307 aa, Glycine max
  Coding DNA Sequence Number=SeqID_83941
MEFYANLYDPEDKSPKQVRVRGHLVKFDEDTLNTFLKTPVILEDGENLCTYSRFALLRPDPQELAAKFCIPGKGFELNVDGQPLKILRKNMTTLAQTWSVLSFSNMIPTSHTSDVTLDSAKSIYGIIMKMDMNLEYLICHQISLIAQHDTSRLGFSALIIALCKARGVQSDSRSLENLSHTINLAYIKKNYWNLDDPTVTFRGPRKARGKRSEVPTTSAAPETPTPTSSTAPVPLIQTPVIPPTFTQLPLPAPLYAGPSDFSFTPQMLHSMAQSLHRGQSIIMQSLQGLGLPSIMSMDEFNMQVAWP

SEQ ID NO: 200720 - protein, 38 aa, Glycine max
  Coding DNA Sequence Number=SeqID_83942
MALIGCRSFAGIGLFTTKETKNVRVKGDQEWKKSGGDG

SEQ ID NO: 200721 - protein, 107 aa, Glycine max
  Coding DNA Sequence Number=SeqID_83943
MTLVSIAHLLGLSYSSSKPLCFAGAQNRNNEHENKEKGMFYSITFLNFLNSDQGLPMDRKRIKVIPEWPTTPCVEEKSPEFQEPRHLRSNPFQGGGNDAILTRKGIG

SEQ ID NO: 200722 - protein, 89 aa, Glycine max
  Coding DNA Sequence Number=SeqID_83944
MLHLAIKSGTPRIDCLALFVYPPPSNLIRSVMNILPMAVHASSTIESGATPIDCLALFVYPPTSNLIRSLMNLLPSAVYSSSTIEFGAP

SEQ ID NO: 200723 - protein, 87 aa, Glycine max
  Coding DNA Sequence Number=SeqID_83945
MADLRSELRVGWQTFCKLSELMLRLMDNLRCLYVYDDEYQAGGHSKNEDLYFVQIVMSNDNDLSLRYDPYPEHLPTMGKIVSKARDR

SEQ ID NO: 200724 - protein, 139 aa, Glycine max
  Coding DNA Sequence Number=SeqID_83946
MHCLCDTRVFMVVCKIIRGSWAKHISTAKHSFSELSTKENLAEHQHQSRVLSARSVRYAQQVPSARLSVRLTLSSIPLTRAKREGGAKRSVAISEPIQSLSCTELGYTFYNTFYENFYTLVQNGQGTEFQSSHRPIWGK

SEQ ID NO: 200725 - protein, 58 aa, Glycine max
  Coding DNA Sequence Number=SeqID_83947
MVISLGHKGVPKPSDTPPSRSSPPHKELQCDMRHETWAPSSARTMDELKILRHPLGHA

SEQ ID NO: 200726 - protein, 362 aa, Glycine max
  Coding DNA Sequence Number=SeqID_83948
  Gene Ontology: Mol. function=transferase activity; Cellular component= integral to membrane
  Homolog annotation: Hit_ID=Q6EVP5; Match level="QueryCoverage=71%, HitCoverage=17%, E-value=1e-56, Identity=48%"; Hit description =Putative membrane-bound sugar-binding protein
  Pfam annotation: Domain name=RHS; Domain location=70-110; Score=53.4; E_value=7.3e-13; Accession=PF03527.4; Description=RHS protein
HYDALGRRSRKAVRYKGKTEQTTRFLWQGYRLLQEQRDDGSRRSWSYDPASPWSPLAALEQAGDSRSADIYWYHTDLNSAPLEVTDAAGNLCWSGQYDTFGKLQGQTVAGAAKRQGAQYQQPLRYAGQYQDDESGLHYNLFRYYEPEVGRFTTQDPIGLRGGLNLYQYAPNPLMWVDPLGLSVEGVPHGFNSFGQFKQFGEALQAGMSKLGYPGTVSYMQGSSVSGLYQKAEQLGIGKGGRTGPIDMGSEMAKKLGIDDTLQKLSKMSGGRPVNAMVFESAAEVKAKGKGTRIPDKLTITDNYIPHSNEWLEEDNKEFSTIIKVSFTNGKNPEKLSRYKFLKNAFNQLDGLSIISDECIEEE

SEQ ID NO: 200727 - protein, 241 aa, Glycine max
  Coding DNA Sequence Number=SeqID_83949
  Homolog annotation: Hit_ID=Q338Y6; Match level="QueryCoverage=65%, HitCoverage=76%, E-value=2e-07, Identity=40%"; Hit description =Expressed protein
  Pfam annotation: Domain name=DUF641; Domain location=29-125; Score =34.9; E_value=2.2e-07; Accession=PF04859.3; Description=Plant protein of unknown function (DUF641)
MVEIISDANLKDEGNTGKSKTILNWSDSFNEDDDEDLQETEANEALLAKNLSELKQCYLKKQFDPSPKTAILEAESKELQGVIKTYEMKGKKLESQVSLKDSNIIFHEEKLEEANRQNKAIKNRLNQSGQLSILDNLHITGLSPSHKRVWLLHCLAFSYEPQASIFQVGKGCRFSDVYMESSNDEIFLYLEVESDPQVAVIVVPGFRIEMKKRPSLPRTQTVTMAVRSKTMAQRLEAFLVP

SEQ ID NO: 200728 - protein, 71 aa, Glycine max
  Coding DNA Sequence Number=SeqID_83950
MQSSKRDVYLGAYLNGPTNYLKGIINSALKGLDDTPQPESKAGARWIVVKTIRTREIEGASHPVGTILSQS

SEQ ID NO: 200729 - protein, 192 aa, Glycine max
  Coding DNA Sequence Number=SeqID_83951
  Gene Ontology: Mol. function=transcription factor activity; Biological process=regulation of transcription, DNA-dependent
  Homolog annotation: Hit_ID=Q8ZR43; Match level="QueryCoverage=98%, HitCoverage=98%, E-value=7e-48, Identity=52%"; Hit description =Putative regulatory protein
  Pfam annotation: Domain name=TetR_N; Domain location=12-57; Score =58.2; E_value=2.7e-14; Accession=PF00440.13; Description=Bacterial regulatory proteins, tetR family
ARPKSEDKKQALLEAATAAFAQSGIAASTSAIARSAGVAEGTLFRYFATKDELLNELYLAIKMRLVQTMIAGLNPDEKRPKENARNIWNSYIDWGMRNPMEYRAIRRMALSERITDETRSQVKESFPELNEMCQLSVKAVFLSDAYRAFGDALFLSLAETTIEFASHDPQRARDIIALGFEAMWNALHESES

SEQ ID NO: 200730 - protein, 117 aa, Glycine max
  Coding DNA Sequence Number=SeqID_83952
  Pfam annotation: Domain name=Tryp_alpha_amyl; Domain location=32-110; Score=3.9; E_value=0.035; Accession=PF00234.12; Description=Protease inhibitorseed storageLTP f
MGQKTFLALVMFVMAYGLAATTFTVSQIPPSCNGDESLLTFCGPYMGNIHPNPTSDCCKAATSVFDKAMATGQGIRDLCNCLRVAGPVLRFQKEKMLSLPDVCRIKLSFSMELCIEG

SEQ ID NO: 200731 - protein, 68 aa, Glycine max
  Coding DNA Sequence Number=SeqID_83953
  Gene Ontology: Mol. function=microtubule motor activity; Cellular component=microtubule associated complex; Biological process =microtubule-based process
  Homolog annotation: Hit_ID=Q8RV44; Match level="QueryCoverage=91%, HitCoverage=30%, E-value=5e-12, Identity=50%"; Hit description =Dynein light chain-like protein
MVEARKSVSHIETLSSVIAYLQVKVLVSDMPSFMQVHAFRCARRTYDSLEKFSAKHIAHNIKKGHRDG

SEQ ID NO: 200732 - protein, 75 aa, Glycine max
  Coding DNA Sequence Number=SeqID_83954
  Gene Ontology: Mol. function=hydrolase activity, hydrolyzing O -glycosyl compounds; Cellular component=cellulose and pectin -containing cell wall; Biological process=polysaccharide catabolic process
  Homolog annotation: Hit_ID=Q9SRX3; Match level="QueryCoverage=97%, HitCoverage=14%, E-value=2e-19, Identity=59%"; Hit description =Endoglucanase 1 precursor
MQSAKKTLTCGNEVADPARLINLAKSQADYILGKNPLGMSYMVGYGAEYPEKIHPRGSTLASVDMHPQHIQCHDS

SEQ ID NO: 200733 - protein, 136 aa, Glycine max
  Coding DNA Sequence Number=SeqID_83955
  Homolog annotation: Hit_ID=Q1RUU3; Match level="QueryCoverage=40%, HitCoverage=11%, E-value=2e-15, Identity=69%"; Hit description =Putative beta-d-xylosidase
  Subcellular localization annotation: CTP_CleavageSite=54; ConfidenceScore=5.27e-01
MGEKKVLALVMFVMAYGLAATTFTSYVLGTTRKSRFNIVILTSVLTKTNVKGLVCETCGHCNVRLGCSLCNPFRQLTGSHNKAQQQVNVNIHVCKVLCMVDKSRTRRVPMGLHSVDIGDVKHYVSLQAETPGIIKS

SEQ ID NO: 200734 - protein, 77 aa, Glycine max
  Coding DNA Sequence Number=SeqID_83956
MDVMLHHHQEHSVEVHSSLENITSRLENIEIRLTLSNLLNHDEDSPNALKWKLKFGIIKDKKREIIRDMGNNMKIKL

SEQ ID NO: 200735 - protein, 311 aa, Glycine max
  Coding DNA Sequence Number=SeqID_83957
MAFLKISIQELYANLFDPEDKSLRQCRVRGKLIKFDVATLNEFLETPVVLEPGERYSAYSRFCQNHPDPQEFASRLCIPGRGFVLNAEGVPWKLLRKDLTTLAQTWSILSYSNLVPTSHTSDLNMGRARFPTLITALCIARGVVPDSLTFESLSLAINLAYIRKNCWNPDDPTITFLGSHKARARGPSDASTSTPTPTLAPTPTPTPVLPPALAPTPSDPFTSSTYMIVPMLQSLHHGLCLPSSSRGGEAPIAREPQPEAEAEETPDDTPAATAKEVTNKGDGAAETGVDTNYVADIIAAQSTWDPWPTPA

SEQ ID NO: 200736 - protein, 304 aa, Glycine max
  Coding DNA Sequence Number=SeqID_83958
  Homolog annotation: Hit_ID=Q47522; Match level="QueryCoverage=15%, HitCoverage=59%, E-value=2e-21, Identity=97%"; Hit description=LacZ protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPVTTLNSIATSNKHVLAENITKDRQDNLDALHAHRSNSAMNHFSDPHTVLASNVSLQKHPSSLSIPSTSRGGPVPAFVPFSEVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 200737 - protein, 176 aa, Glycine max
  Coding DNA Sequence Number=SeqID_83959
MPMILAEGETLPAYSRYCRLPTDYKEIKAALCIPGRGFVLNFEGHPGKILRKDLTTLAQVWSILSYSNLAPTSHTSDLTVDRAWLIFGLVSQMDMNVGALISGQITSIAQSNSSRLGFPALIITLCKARGARRARTRSVEPPSTSTTPIPARTFAAPSVPASADVQCLEAMLQSIH

SEQ ID NO: 200738 - protein, 235 aa, Glycine max
  Coding DNA Sequence Number=SeqID_83960
  Gene Ontology: Mol. function=hydrolase activity, acting on ester bonds; Cellular component=nucleus; Biological process=biosynthetic process
  Homolog annotation: Hit_ID=Q8VUE5; Match level="QueryCoverage=99%, HitCoverage=61%, E-value=2e-88, Identity=52%"; Hit description =Synthetase CbsF
PGRAAGRAADGGRHSAGGYRRGGVAALRAPQPGADGDCADRRRLAAAGHRLPGRAAGLHGGGRQAAADYHRERVGCPLCRAGADAAVRCAGRQRARTACAPAGGERRLSRLRAVYLRLYRAAERRGGEPPGDRQPPVLDAARVCARCAGRGIAENPVQLRRFRLGILLAADGRRAPGDGAAGGASRSAGADDVDRRLWRDHAAFRSVHVGYLGGGAERAGATARRRQPETRVLQR

SEQ ID NO: 200739 - protein, 392 aa, Glycine max
  Coding DNA Sequence Number=SeqID_83961
  Gene Ontology: Mol. function=strictosidine synthase activity; Cellular component=vacuole; Biological process=biosynthetic process
  Homolog annotation: Hit_ID=Q1RSG3; Match level="QueryCoverage=83%, HitCoverage=99%, E-value=1e-79, Identity=48%"; Hit description =Strictosidine synthase
  Pfam annotation: Domain name=NHL; Domain location=262-290; Score =16.8; E_value=0.078; Accession=PF01436.11; Description=NHL repeat
  Pfam annotation: Domain name=SGL; Domain location=172-383; Score= -111.4; E_value=0.031; Accession=PF08450.2; Description=SMP -30GluconolaconaseLRE-like region
  Pfam annotation: Domain name=Str_synth; Domain location=206-295; Score=98.0; E_value=2.8e-26; Accession=PF03088.7; Description =Strictosidine synthase
  Pfam module annotation: Pfam domain module=NHL::SGL::Str_synth; Domain location=262-290::172-383::206-295
MTSRVEDIAEKGTKTTSVSSIHNIYLLLHHIILSVLLHLYIQNITNLVQHILLAIMLSTNPIAILVILISLFYSASKVTSTRILDRLFLPSLLTGPQSLAFDSIGGGPYTGVSDGRILKYEETYSGFVEFAYTWQDRNKTICDGISDFSTLQETCGRPLGLSFYYQTGELFIADAYLGLVKVPYYGGAATQLVAHAQGSNPFGFLSGVDVEPDTGTVYFTEASSGFKLRDIRELLKNTDDYSGNLYKYDPSTNQTSLLLSNLAVAAGVAVSGNGSFVLVSECNAHRIRRFWLAGPKANTSEVFLQLPGRPENIKRNSKNEFWVAMNYPFGTPPPPRPPVLPLGLRVNEDGEVLEAVPLVDEFGTESVSEIQEFNGTLYASSLHVSYANIFKV

SEQ ID NO: 200740 - protein, 110 aa, Glycine max
  Coding DNA Sequence Number=SeqID_83962
  Homolog annotation: Hit_ID=Q1SXR1; Match level="QueryCoverage=48%, HitCoverage=3%, E-value=2e-07, Identity=46%"; Hit description =Integrase, catalytic region; Zinc finger, CCHC-type
MRVPLRSLPRQWRPQETALRASKNLDNLSIEELIGILKVQKIELQQDNEGNKGKSLALIVHKTKKPSSSKSLPKASSKVVSVDNSSDDEYEYEEANEDDLSLICRKIRKM

SEQ ID NO: 200741 - protein, 87 aa, Glycine max
  Coding DNA Sequence Number=SeqID_83963
MTALTCMDAGLCFISHMLADLKDFKKVNEIYAKFNDISFTKNKDQIGLNHFRPIKPLGSGDTGKFFPHSLFNFPTFETCMNRRWHRA

SEQ ID NO: 200742 - protein, 196 aa, Glycine max
  Coding DNA Sequence Number=SeqID_83964
MEREMITMIMDILSVFYYEKMVGYMPSSFADLVFAGKRIEVGLKRGKFDYAASTSAGNRRIITGGAKKKEGDAYAVTTTPTWPKSQQIPHKPTYQYPLHQYNYSANVESPPSPTTIQQRMPTQPQGPLSQNPFHAQSRPTGYPNPNTNTNPRRNFPERKLVKFTLISMPYADLLPSLLSNQMDVVIPGKVYQYPFP

SEQ ID NO: 200743 - protein, 96 aa, Glycine max
  Coding DNA Sequence Number=SeqID_83965
MVPQWHIRGKARSQPERGLEGNRSRVVGVLIRHMYNIGWCIVGRQAVWWERILALHNMGTALAALVVATAAVWTSIIFFMLKMASIMAAIWSFMAS

SEQ ID NO: 200744 - protein, 145 aa, Glycine max
  Coding DNA Sequence Number=SeqID_83966
MGFVEHQLRRYKRCSTWNSATLMRHYESFSMKEELFVDDMFGRLQVLINGLEALGHLHQSSNKPQDFRQLSQDFDALMSKETISRKEENKSYSKALKVHIVESEKPYNNSKEFMNDEVALMSRQFKEMLKKKGHKLQEEIQGGKQ

SEQ ID NO: 200745 - protein, 106 aa, Glycine max
  Coding DNA Sequence Number=SeqID_83967
MHCCVLYLKRNVQKSCRNLPFGGKVRRNVEEQKEAIKALDLERSQVTSMEEMRAFGTMVAHPGELMLSPEETGSPRRVGSFNPKKFGAQASQRLAWASQGPENCLK

SEQ ID NO: 200746 - protein, 103 aa, Glycine max
  Coding DNA Sequence Number=SeqID_83968
MDLCPYCSQYSCVVCCDVNIEQQQTSLFAHHHYQQEQQQAIREALPILKLELGFKSLVNVEFFKLKCMARTMDWIALLLLLQFHKGKMQILMGNARKAKTFLS

SEQ ID NO: 200747 - protein, 217 aa, Glycine max
  Coding DNA Sequence Number=SeqID_83969
MRAGTTWPMHLARQGNYDEAIAAYDRALALHPGMADAVANRAVVDAARKRKQSGGKGQDQQKPPQNGQQKPPQNGQGQQNPQGQQPQQGQQNPGQGQPQLGQQGQPRPGDDKNPSSPQPGERGRDGQQAPPQVEDAKAQAQADEQQRQRMQQAMQQAREGKGEQDGKPVPGSDGTTPRQREEQQAVEAWMRRVPDDPGALLRAKFQLENERRKREGR

SEQ ID NO: 200748 - protein, 205 aa, Glycine max
  Coding DNA Sequence Number=SeqID_83970
  Homolog annotation: Hit_ID=UPI00005FA0EC; Match level="QueryCoverage =100%, HitCoverage=55%, E-value=3e-77, Identity=68%"; Hit description= COG0451: Nucleoside-diphosphate-sugar epimerases
  Pfam annotation: Domain name=NAD_binding_4; Domain location=1-118; Score=-61.6; E_value=0.00012; Accession=PF07993.2; Description=Male sterility protein
MAQVPRLKRFLHVGTVMSCSPEPGSLVAESGEFEEDAEHLVEYTRSKSTIEQLMRQRCPQLPLTIARPSIVVGHTRLGCQPSSSIFWVFGMALMLRKFMCSLQDNIDVIPADYCADAQVMLMNSETLENDVYHISAGEESSVSFAEIDRAMAAALEKAPVGDEYAQVTYDALVKMRRQLKDIFGPCNERLMLKAMRLYGSFAMLN

SEQ ID NO: 200749 - protein, 162 aa, Glycine max
  Coding DNA Sequence Number=SeqID_83971
  Gene Ontology: Mol. function=hydrolase activity
  Homolog annotation: Hit_ID=Q6W237; Match level="QueryCoverage=74%, HitCoverage=39%, E-value=2e-32, Identity=58%"; Hit description=Metal dependent hydrolase
MVTVHEQSFRPKLLPSLPLSYELESGAVRLQESEAEISKEINMEAETSTRPRTQLDELVPSRYAVKVGDIEVIVISDGVLAPPAESMATNADTKSLNAWLDDRLLAHDTFGWALNAVVVKTPKQTILIDSGLGEEYPDFPRAGHMIQRMEAAGVELGSVTDV

SEQ ID NO: 200750 - protein, 138 aa, Glycine max
  Coding DNA Sequence Number=SeqID_83972
  Gene Ontology: Mol. function=hydrolase activity
  Homolog annotation: Hit_ID=Q1MGY1; Match level="QueryCoverage=81%, HitCoverage=36%, E-value=1e-32, Identity=60%"; Hit description =Putative beta-lactamase/hydrolase
MSQPSNHPSPVRQLQVPPESAFHTGKKGAEELVPSRYAVKIGDIDVMVVSDGVLPLPTVMMGHNADPTVRANWMVDQFLPPDAFDWPLNAVVVRSGSQTVLLDAGLGLDPDLNLPRAGQLLQRLQHADIDLRPLRTSF

SEQ ID NO: 200751 - protein, 97 aa, Glycine max
  Coding DNA Sequence Number=SeqID_83973
  Subcellular localization annotation: CTP_CleavageSite=50; ConfidenceScore=5.50e-01
MATTFASSSPQIAASSFTLPPFQSKKFILFHNPVLQKNNILRPILLPPPPAAAAAQDAVDAAEQLYKTTDQGVATVVSALFFIAFVGLSAITIGVKL

SEQ ID NO: 200752 - protein, 115 aa, Glycine max
  Coding DNA Sequence Number=SeqID_83974
VTGGDTQVVIRIKTLSLSVRLRVRRGYRMVIRTFCQPGANEPVDTQSLMSSSAPFVIQGQRVRWQAEIPYGRPHLSSTKANEFDGIKMIHSSPTMHEILLCWARTIKFDSVWKRR

SEQ ID NO: 200753 - protein, 100 aa, Glycine max
  Coding DNA Sequence Number=SeqID_83975
MAEEPRRVTLEDYSSSNVPQFFTSIDKLWLHDVPSVGELMNLDVVFLLKNTPLMKSITREISPKTILMQEDFQDSNMASNIINNRDNGGTTLEISSIEIK

SEQ ID NO: 200754 - protein, 257 aa, Glycine max
  Coding DNA Sequence Number=SeqID_83976
  Gene Ontology: Mol. function=chitin binding; Cellular component =extracellular region; Biological process=chitin metabolic process
  Homolog annotation: Hit_ID=UPI000044A8F0; Match level="QueryCoverage =99%, HitCoverage=99%, E-value=1e-42, Identity=30%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
RGLHIVTIRVLHALTFRGLHVLAFRGLHVLPFRGLHVLAIGGLHVLTFKGLHVLALRGLHAIAFRGLHVLPFRGLHVFAIRGLHIVTIRGLHTLTFRGLHVLAFRGLHALAFRGLHALAFRGLHALAFRGLHVLAFRGLHILAFRGLHALAFRGPHVLTFRGLRALTFRGVHVVALRGLHAIAFSRLHVLPFRGLHVFAIRGLHIVTIRGLHALTFRGLHVLAFRGLHVLPFRGLHVLAIGGLHVLTFRELHALAFR

SEQ ID NO: 200755 - protein, 62 aa, Glycine max
  Coding DNA Sequence Number=SeqID_83977
MLKLLSKIKVKKNHTFPVVYECEFYDVKGLVLVEALNQQPENDRERALEGLKAKLVEQSDVF

SEQ ID NO: 200756 - protein, 120 aa, Glycine max
  Coding DNA Sequence Number=SeqID_83978
MDKVDIFVPHPLTNACLLIQLSPECGCKPLVCLLKQPALLSVDFQDRSIRDYSSCTLVGRSELSRIGCWTNGLRKRGVELRCKDYSPIELSISLFGLTMHIGTTVPLCSRILYYKRPMVS

SEQ ID NO: 200757 - protein, 83 aa, Glycine max
  Coding DNA Sequence Number=SeqID_83979
MKARRQRHYQDYQLLLKAQTNLKAQTYQGNPCGVYPDLSSFTRSGVYLDLSSFTGSGVYPDLSSFTGSGVIQIFVACIKRSAS

SEQ ID NO: 200758 - protein, 144 aa, Glycine max
  Coding DNA Sequence Number=SeqID_83980
MERSMIDAASGGALGDMTPAEARNLIEKMASNSQQFSARNDAIVIRGVHEVATNSAASSETKNLEGKLDALVNLQLGAIEQPEAYAANIYNRPPQPQQQNQPQPQQQQQQPAPSFQNAAGPRAVSNKKMEEAEKEILETFRKVE

SEQ ID NO: 200759 - protein, 228 aa, Glycine max
  Coding DNA Sequence Number=SeqID_83981
  Gene Ontology: Mol. function=chitin binding; Cellular component =extracellular region; Biological process=chitin metabolic process
  Homolog annotation: Hit_ID=UPI000044A8F0; Match level="QueryCoverage =78%, HitCoverage=99%, E-value=1e-24, Identity=28%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
LDALAFRGLHVLANRGLHTLTLRGLHVLAIRALHVLAIRGLHALAFRGLHVLSFRGLHALTFRGPHALTIRGLHILAIRGLHTLTFRGLHVLAFRGLDALAYRGIHVLTIRGLHALTFKGIHVISFRGLHALAFRGLDVLAFRGLDVLAFRGLDALIFRGLHVLAFKGLHALTFVGLHALVFIGLYICAFRELKDYARKIPSGPGEVQQGPALSSSNYWTFIKKYCAP

SEQ ID NO: 200760 - protein, 81 aa, Glycine max
  Coding DNA Sequence Number=SeqID_83982
MPISPYGSFSWDCTHKTPSGPGGAEQGPGVSSSGYGPLSVLQGIAPARYPVDTEKSNRILGFPALITGLCQFYRVPVAPNK

SEQ ID NO: 200761 - protein, 93 aa, Glycine max
  Coding DNA Sequence Number=SeqID_83983
  Gene Ontology: Mol. function=hydrolase activity
  Homolog annotation: Hit_ID=Q69QI6; Match level="QueryCoverage=98%, HitCoverage=17%, E-value=2e-34, Identity=72%"; Hit description =Nucleotidase-like protein
MACLLADIVQYFVDAKLEFDASYIYEDVICAIDHVHRSGLVHRGILSDSHRYLVKNGKILRYLKMLREQGKKLFLLTNSPYYFVDGGMCFMLE

SEQ ID NO: 200762 - protein, 291 aa, Glycine max
  Coding DNA Sequence Number=SeqID_83984
  Gene Ontology: Mol. function=transcription factor activity; Biological process=regulation of transcription, DNA-dependent
  Homolog annotation: Hit_ID=Q6J668; Match level="QueryCoverage=58%, HitCoverage=50%, E-value=8e-32, Identity=46%"; Hit description =Transcriptional regulator
  Subcellular localization annotation: CTP_CleavageSite=63; ConfidenceScore=5.43e-01
PVPRARPGRAPRTAGSARAPASGSRSATGPAAAAAPPGGNRSAGRYRVVHIAGLQAAAELLPRAPVAPPTRQVGRGQGIGGRQAQLVARRHGGDARARLDQLVDQFDGRDAEALARLGELGRESGTVDQPRARPVLQALDAAAERRLRQIAGLGRAREIAQLRQGDEVLQPPGIHTTPCAIRMGHARHAWRRMRTSHWTSAPRPRTLCPPVPHWNLPALKPAFCRSVNMDQTLRAAAREYLIRYGGDTFPNLFKSAKGTVVRDDTGREILDFTSGQMCATIGHNHPAIVDA

SEQ ID NO: 200763 - protein, 238 aa, Glycine max
  Coding DNA Sequence Number=SeqID_83985
  Gene Ontology: Mol. function=chitin binding; Cellular component =extracellular region; Biological process=chitin metabolic process
  Homolog annotation: Hit_ID=UPI000044A8F0; Match level="QueryCoverage =94%, HitCoverage=99%, E-value=1e-34, Identity=28%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
GLHALAFRGLQVLACRGLHVLAIRGIHALTFRGLHVLTIKGLHALTFRGLHILTFRGLHALTFEGLHALTFRGLHVIAFRGLHTLAFKGLHVLPVRGLHVLAFRGLHILAFRELHVLAIRGLHALTFRVLHILTINGLHALTFRGLHVLTIRGLHALTFRRLDVLAIRGLHALTFKVLHVLTFRGLHALTFKGLHVLAFRGSHAFSFRGLHALAFRGLRVLTFSGLHIRTLRSFALNA

SEQ ID NO: 200764 - protein, 92 aa, Glycine max
  Coding DNA Sequence Number=SeqID_83986
MSGYHLVGSCNGLHCGVSEIPEGYHVCFWNKATRVISRESSALSFSPGIGRRTMFGFGNDPSSDKYKVVAIALTMLSLDVSEKTEMKVLWRG

SEQ ID NO: 200765 - protein, 111 aa, Glycine max
  Coding DNA Sequence Number=SeqID_83987
MEGSQQNTHYPKEKLPKIITHKWKFGNLLEAPNTLPMKGLFVTKLESNEVLLSPIALKVVGPFLLDSNSSRVDTNPPYNSLYGNPQTRKQRDKSNNQRPNKNEMKAKPMDF

SEQ ID NO: 200766 - protein, 121 aa, Glycine max
  Coding DNA Sequence Number=SeqID_83988
MQSYPLRVLDRRLQEDWARAAKEGPGVLMNLRVDFFSPWAKVGSSLLCKYSNRGELSYYRGCVAKLYLLISRSFSRNLLKEVSQESFLRKLLKKLLKEVFLKEASQGSFLKKASLLLKEAT

SEQ ID NO: 200767 - protein, 169 aa, Glycine max
  Coding DNA Sequence Number=SeqID_83989
MRTSMTTLTQTWMTLLLSNVLPSDHNSDLPLPKCQLVYAILTRMSVHVAQVIADAIYLFEALITGLCQSFGVPVTPTKVIRPPITQAFIEKYCTPRQVQGDAPQVADAPPPPHQADPAGSLGMERYLQHLVRQQAANHRGQVQIHECLYWFSLSQQGQGFTPFACPTPE

SEQ ID NO: 200768 - protein, 264 aa, Glycine max
  Coding DNA Sequence Number=SeqID_83990
  Gene Ontology: Mol. function=zinc ion binding
  Homolog annotation: Hit_ID=Q5XM22; Match level="QueryCoverage=36%, HitCoverage=54%, E-value=2e-34, Identity=76%"; Hit description =Resistance-like protein HAAS-2
  Pfam annotation: Domain name=DUF1723; Domain location=11-60; Score =47.4; E_value=4.9e-11; Accession=PF08330.1; Description=Protein of unknown function (DUF1723)
LSPLIDCSVITGDPGLISAFVERWHSETSTFHLLVGELMITLDDVSSILHFPITDALHNFHALSTEEARFLPTKLLEVSAEEARAETALTRGAYVRLGWVQDIYETRCQARRWIVAARAYLLHLVDCTLFANKSATYVHVVYLDTFRDLAHSGGYAWGVAALVHIYDQLDEACRTTTRQLAGYLTLLQAHMKGITGAPYSARCDGLTVIDVSWLPYTEHRGVRAFQEISSFQGQLRWGPMICHSSTGEGGTPVRLHPEHPSVAC

SEQ ID NO: 200769 - protein, 83 aa, Glycine max
  Coding DNA Sequence Number=SeqID_83991
MVIFIALVLGFEVSIVVFFHNLVARKNEGGASPHQLDLAPYALGPYNAQWNAPRLLHDKHTLHSSRVLGEMEVDEPWLGLWLP

SEQ ID NO: 200770 - protein, 110 aa, Glycine max
  Coding DNA Sequence Number=SeqID_83992
  Pfam annotation: Domain name=G-patch; Domain location=4-47; Score =24.6; E_value=0.0002; Accession=PF01585.13; Description=G-patch domain
MSNVVMMVARVMLGHGYEPEMGLGKNNNGVANLVEFKENRRSSIGACRPRIFFINGFLCFLEDEWQQNGEGRERRRHFKEKMSLEEAHHHRRPWIRPWRKKEMNEGRGRE

SEQ ID NO: 200771 - protein, 58 aa, Glycine max
  Coding DNA Sequence Number=SeqID_83993
MTHVCKGNARGPAVLAYLYREMCNATDYKTKSIGGGYEVEISILVMMILEFFVANWIS

SEQ ID NO: 200772 - protein, 178 aa, Glycine max
  Coding DNA Sequence Number=SeqID_83994
  Homolog annotation: Hit_ID=Q84VH5; Match level="QueryCoverage=100%, HitCoverage=27%, E-value=7e-61, Identity=68%"; Hit description =Envelope-like protein
MATSTKETSAPGSPSAPSNQERPEFNIQPIQMIPGQAPVPEKLVPKRQQGVKISENPSIATSPREVDPEMDKKIRSIVSSILKDASVPDAGEDVPTSSTPNVSVPDVDKDVPTSSAPNAEALPSPSEEESTEEEDQASEETPAPRAPEPAPGDLIDLEEVESDEEPIANRLAPGIAEK

SEQ ID NO: 200773 - protein, 38 aa, Glycine max
  Coding DNA Sequence Number=SeqID_83995
MSEMRRFGGLGMEERRGGSLLVIDYMNTVIDYRPSVLV

SEQ ID NO: 200774 - protein, 63 aa, Glycine max
  Coding DNA Sequence Number=SeqID_83996
MEGNGVVFWRCIVSKLVAYTNASIYAFSYWDIANKASHAIGGSKKLHGLIPPDPGQVAGVWGT

SEQ ID NO: 200775 - protein, 72 aa, Glycine max
  Coding DNA Sequence Number=SeqID_83997
MPCSHQGNIWKSFARGQNLGSSFLPARELINGHPLRVVEAKLSKFILMMPKTQVKNQESSKYQESKSRSIKN

SEQ ID NO: 200776 - protein, 128 aa, Glycine max
  Coding DNA Sequence Number=SeqID_83998
MEEFDAQVAWPRDQPSSSGGGEASTAQEPVIEEPPATATEDEDELTPPTHDALLYYNGKWNMPHQNNFVGYAFIGKNPKKFDIPSGCTIDELKDLIKQVAPQGIPPHGIHESQTVMEMEDDVATSLQD

SEQ ID NO: 200777 - protein, 128 aa, Glycine max
  Coding DNA Sequence Number=SeqID_83999
  Homolog annotation: Hit_ID=Q8UWJ5; Match level="QueryCoverage=28%, HitCoverage=8%, E-value=7e-07, Identity=72%"; Hit description=CDH1-D
MGGGAWPFLVGGAICLGTMPLRPRKFEAITGIPSKRESSARVDYVPALCTHRPSLLPIEWSGEVFGLRRREPAEGSLSMPHNQIDPRTCLFIYRREGGDDHGAPCARPPRPRDKHKPRRFVRQGTQIC

SEQ ID NO: 200778 - protein, 312 aa, Glycine max
  Coding DNA Sequence Number=SeqID_84000
  Gene Ontology: Mol. function=chitin binding; Cellular component =extracellular region; Biological process=chitin metabolic process
  Homolog annotation: Hit_ID=UPI00006A17C9; Match level="QueryCoverage =97%, HitCoverage=100%, E-value=2e-42, Identity=36%"; Hit description= UPI00006A17C9 related cluster
  Subcellular localization annotation: CTP_CleavageSite=35; ConfidenceScore=5.05e-01
HASLPRTTCPYFQRTTCPHLQRATRPRLHRTTRPPLQREKHPHLQRTTPPHLQRTTPPHLHRATRPHLLRTTLLAIRGLHVLAFRGLHVLAFRGLHALTFRGLHVLAFRGLHVLAIRGLHVLAIRGLHALTFRGLHVLAFRGSCTITFRGLHVLTFRGLQALTFRGLHVLAFRGLHVLAIRGLHALIFRGLHVLAFRGSCTFTFRGLHVLAFKGLHALTFRGLPVLAFTGLHALTFKGLYALIFKGLHALTFRGLHVLAFKGLHVLAIRGLHALTFRGLHVLTFRGSCTFTFKGLHVLAFKGLHALTFSGLP

SEQ ID NO: 200779 - protein, 64 aa, Glycine max
  Coding DNA Sequence Number=SeqID_84001
TQEAAATPEKSPEATPEPPAPVADTTSPQQAADPSMPEDQTTPVLSPNTSPIATHVLHLLEEEE

SEQ ID NO: 200780 - protein, 203 aa, Glycine max
  Coding DNA Sequence Number=SeqID_84002
MMSMKKVMEVNGAIVVATSVVAEVDLTPPSSLNQINHAILNIVGQRGKELGSTGGPYFVQVQNKHSFPLYDLAPNYAPSNMVHTLNKNVNNSTPILIKNQQPQFDHAFVPQLMGETHEIHHHNLANFEPRLEYATEGKAVGGVPLPNTLEGPQFLPQPQPLYFVAGRIPLAMVGKGKLDHIEERLTAVEGGGGYAFANTTDCA

SEQ ID NO: 200781 - protein, 35 aa, Glycine max
  Coding DNA Sequence Number=SeqID_84003
MPQPPRPDKFTAAVAKRTYPSRNQTYDFCIANTTL

SEQ ID NO: 200782 - protein, 283 aa, Glycine max
  Coding DNA Sequence Number=SeqID_84004
  Gene Ontology: Mol. function=intramolecular transferase activity, phosphotransferases; Cellular component=cytosol; Biological process =metabolic process
  Homolog annotation: Hit_ID=Q6Z8J0; Match level="QueryCoverage=82%, HitCoverage=80%, E-value=2e-76, Identity=58%"; Hit description =Putative phosphoglycerate mutase
  Pfam annotation: Domain name=PGAM; Domain location=72-222; Score =62.9; E_value=1e-15; Accession=PF00300.12; Description =Phosphoglycerate mutase family
  Subcellular localization annotation: CTP_CleavageSite=77; ConfidenceScore=5.07e-01
MGDSRQAHNARAYSIAATGSDVGGLVGETAFVKFGLQRTASQTSVVDPVLSPSRSNIGDTHKKSIGFTKFEVVATFRQFKLSGCVDVPLSKKGIDEAIEAGQRISSIPVDVIFTSALIRAQMTAMLAMTQHRRGKGLNKQETADRYGKEQVHEWRRSYDIPPPNGESLEMCAERAVAYFRDQSSYNADKGLMLLTSILQIEPQLLSGKNVMISAHGNSLRSIIMYLDKLTSQEVISLELSTGIPMLYIFKEGRFIRRGSPIGPSEAGVYAYTRTAMALLVLYQ

SEQ ID NO: 200783 - protein, 64 aa, Glycine max
  Coding DNA Sequence Number=SeqID_84005
MYNNLLPSRSMRYLRLQYWNVKKAAQMLKQSLKWRKEYKPEEIRWEEVAEEAETGMMYKPNYHD

SEQ ID NO: 200784 - protein, 259 aa, Glycine max
  Coding DNA Sequence Number=SeqID_84006
  Gene Ontology: Mol. function=transporter activity; Cellular component= intracellular; Biological process=transport
  Homolog annotation: Hit_ID=O22270; Match level="QueryCoverage=94%, HitCoverage=81%, E-value=3e-83, Identity=57%"; Hit description =Putative phosphoglyceride transfer protein
  Pfam annotation: Domain name=CRAL_TRIO; Domain location=84-256; Score= 24.1; E_value=1.1e-07; Accession=PF00650.10; Description=CRALTRIO domain
  Pfam annotation: Domain name=CRAL_TRIO_N; Domain location=4-67; Score= 31.7; E_value=2.6e-06; Accession=PF03765.5; Description=CRALTRIO, N -terminus
  Pfam module annotation: Pfam domain module=CRAL_TRIO::CRAL_TRIO_N; Domain location=84-256::4-67
MAISAEQQAKIIEVRGLIGPLSDKESVYCSDASISRYLRARNWNVKKAAQMLKQSLKWRKEYKPQEIRWEEVAAVAEKGMLYRPNYSDKYGRPVIVMRPCNKKSTPAQDMIKYFVYCMENAIINLPPHEEQLAWLIDFQGVKMSDVSFKTSRETVHILQEYYPKHLGLAMLYKAPRIFQPFFSMLRPFLETELYNKVKFGYSDDHNTKKMLEDLFDMDKLESAFGGNDDTGFDMNKYAERMKEDENKILSFWTQAKSVS

SEQ ID NO: 200785 - protein, 96 aa, Glycine max
  Coding DNA Sequence Number=SeqID_84007
MKLGDSLDRNKCARVLCLCNFEIYFKVRKLIKWDEARAWASIIILLKHVLTSKMIKKAKRILSKIAYERRRNTWFILVHSNRDTSTSPLRNSKRFH

SEQ ID NO: 200786 - protein, 50 aa, Glycine max
  Coding DNA Sequence Number=SeqID_84008
MTQAVLAPAQLPYTQQLCVIFYLSFPKTDMDWAIHKSHTNWSIRMRLMNP

SEQ ID NO: 200787 - protein, 105 aa, Glycine max
  Coding DNA Sequence Number=SeqID_84009
MAGSTHIANNSTALEAMMLGWFECVGKLEKMHKENKSKARDKCSSALERTVEEGGLATKTCHVVMMLALSVIACDSASEHKLFGSRNMKVYLLTPRHAPKILPSL

SEQ ID NO: 200788 - protein, 59 aa, Glycine max
  Coding DNA Sequence Number=SeqID_84010
MDLKFWRSHVSKVIMAVDSGNMFRGWSGSTIIFVENNDFREAIMWKRLTLDEKMVGVQV

SEQ ID NO: 200789 - protein, 44 aa, Glycine max
  Coding DNA Sequence Number=SeqID_84011
MPRRLPSSDSSNMLRPTIDEAPCRDIINAVVGAFVSRFISQTVL

SEQ ID NO: 200790 - protein, 324 aa, Glycine max
  Coding DNA Sequence Number=SeqID_84012
  Gene Ontology: Mol. function=GTPase activity; Cellular component =intracellular; Biological process=small GTPase mediated signal transduction
  Homolog annotation: Hit_ID=Q6Z9X4; Match level="QueryCoverage=96%, HitCoverage=56%, E-value=1e-126, Identity=70%"; Hit description =Putative tRNA modification GTPase trmE
  Pfam annotation: Domain name=Dynamin_N; Domain location=79-200; Score= -33.8; E_value=0.0093; Accession=PF00350.13; Description=Dynamin family
  Pfam annotation: Domain name=MMR_HSR1; Domain location=77-201; Score =153.5; E_value=5.7e-43; Accession=PF01926.13; Description=GTPase of unknown function
  Pfam annotation: Domain name=Miro; Domain location=78-201; Score =16.2; E_value=0.00014; Accession=PF08477.3; Description=Miro-like protein
  Pfam annotation: Domain name=Ras; Domain location=78-245; Score= -97.7; E_value=0.059; Accession=PF00071.12; Description=Ras family
  Pfam module annotation: Pfam domain module=Dynamin_N::MMR _HSR1::Miro::Ras; Domain location=79-200::77-201::78-201::78-245
MTEDNYILGQGGFSSLVRSLRSQCIELLTEIEARLDFDDEMPPLDLNLTMDKIHNMSREVENALETANYDKLLQSGLQIAIVGRPNVGKSSLLNAWSKSERAIVTEIAGTTRDVIEASISVSGIPITLLDTAGIRDTDDIVEKIGVERSEAVARGADLIIMTVSAVEGWTSEDTKLLERIQSTKGSTGSSTPVILVVNKIDCKPCAETKWDKGCQSHIFSKRVFTCAVTGQGLHDLERAVLQIVGLEGIPAGGRRWTVNQRQCEQLVRTKEALARLQSSIKEELPLDFWTIDLRDAALSLGQISGEDISEEVLSNIFGKFCIGK

SEQ ID NO: 200791 - protein, 1760 aa, Glycine max
  Coding DNA Sequence Number=SeqID_84013
  Gene Ontology: Mol. function=acetyl-CoA carboxylase activity; Cellular component=endoplasmic reticulum membrane; Biological process=metabolic process
  Homolog annotation: Hit_ID=Q42793; Match level="QueryCoverage=98%, HitCoverage=77%, E-value=0.0, Identity=96%"; Hit description=Acetyl CoA carboxylase
  Pfam annotation: Domain name=ACC_central; Domain location=231-975; Score=1325.0; E_value=0; Accession=PF08326.2; Description=Acetyl-CoA carboxylase, central regio
  Pfam annotation: Domain name=Biotin_lipoyl; Domain location=164-230; Score=32.6; E_value=1.9e-07; Accession=PF00364.12; Description =Biotin-requiring enzyme
  Pfam annotation: Domain name=Carboxyl_trans; Domain location=1072 -1629; Score=917.5; E_value=5.8e-273; Accession=PF01039.12; Description=Carboxyl transferase domain
  Pfam module annotation: Pfam domain module=ACC_central::Biotin _lipoyl::Carboxyl_trans; Domain location=231-975::164-230::1072-1629
MVLGLKEIQIRGEIRTNVDYTIDLLNASDYRENKIHTGWLDSRIAMRVRAERPAWYLSVVGGALYKASASSAALVSDYVGYLEKGQIPPKHISLVHSQVSLNIEGSKYTIDMIRGGSGSYRLRMNQSEIEAEIHTLRDGEEEAAGTRLLIDGRTCLLQNDHDPSKLVAETPCKLLRYLVADDSHVDADTPYAEVEVMKMCMPLLSPASGIIHFKMSEGQAMQAGELIARLDLDDPSAVRKAEPFTGSFPVLGPPTAISGKVHQKCAASLNAARMILSGYEHNIDEVVQSLLNCLDSPELPFLQWQECLAVLATRLPKELKNELESKYKEFEGISSSQIVDFPAKLLKGIIEAHLSSCPDKEKGAQERLVEPLLSLVKSYEGGRESHAHIIVQSLFDEYLSVEELFSDNIQADVIERLRLQYKKDLLKIVDIVLSHQGIKSKNKLILQLMDKLVYPNPVAYRDQLIRFSLLNHTNYSELALKASQLLEQTKLSELRSNIARSLSELEMFTEDGENIDTPKRKSAINDRMEDLVSAPFAVEDALVGLFDHSDHTLQRRVVESYIRRLYQPYLVKGSARMQWHRSGLIATWEFYDEYIERKNGVEDQSLSKTVEEKHSEKKWGVMVIIKSLQFLPAIITAALREATNNPHEALTSGSVEPVNYGNMMHIGLVGINNQMSLLQDSGDEDQAQERINKLAKILKEQEVGSTIRAAGVGVISCIIQRDEGRAPMRHSFHWSEEKLYYAEEPLLRHLEPPLSIYLELDKLKAYENIRYTPSRDRQWHLYTVVDHKPQPIQRMFLRTLVRQPTTNEGFSSYQRLDAETSRTQLAMSFTSRSIFRSLMAAMEELELNAHNVNIKSEHAHMYLYIIREQQIDDLVPYPKRINIEAGKEEITVEAVLEELAREIHSSVGVRMHRLGVVVWEIKLWMAACGQANGAWRVIVNNVTGHTCTVHLYREKEDTITHKVVYSSVSVKGPLHGVAVNENYQPLGVIDRKRLSARKNSTTYCYDFPLAFETALEQSWAIQQPGFQRAKDKNLLKVTELKFADKEGSWGTPLVPVENYPGLNDVGMVAWFMEMCTPEFPSGRTILVVANDVTFKAGSFGPREDAFFRAVTDLACTKKLPLIYLAANSGARLGVAEEVKSCFRVGWSEESNPENGFQYVYLTPEDNARIGSSVIAHELKLESGETRWVIDTIVGKEDGLGVENLSGSGAIAGAYSRAYKETFTLTYVTGRTVGIGAYLARLGMRCIQRLDQPIILTGFSALNKLLGREVYSSHMQLGGPKIMATNGVVHLTVSDDLEGVSSILKWLSYIPSHVGGALPIVKPLDPPERPVEYFPENSCDPRAAISGTLDGNGRWLGGIFDKDSFVETLEGWARTVVTGRAKLGGIPVGVVAVETQTVMQIIPADPGQLDSHERVVPQAGQVWFPDSATKTAQAILDFNREELPLFILANWRGFSGGQRDLFEGILQAGSTIVENLRTYKQPIFVYIPMMGELRGGAWVVVDSRINSDHIEMYADRTAKGNVLEPEGMIEIKFRTRELLESMGRLDQQLITLKAKLQEAKSSRNIVAFESLQQQIKSRERQLLPVYTQIATKFAELHDTSLRMAAKGVIREVLDWRNSRSVFYQRLHRRIGEQSLINSVRDAAGDQLSHASAMNLLKEWYLNSDIAKGREDAWLDDEAFFRWKDIPSNYENKLKELRVQKVLLQLTNIGDSALDLQALPQGLAALLSKLEPLGRVKLTDELRKLGDHNQHHHVPSIYLLVD

SEQ ID NO: 200792 - protein, 35 aa, Glycine max
  Coding DNA Sequence Number=SeqID_84014
MDTRLRVIGDPMNGVQRSCSVSHSYDEVYYKLWRY

SEQ ID NO: 200793 - protein, 69 aa, Glycine max
  Coding DNA Sequence Number=SeqID_84015
FALSATMDRSALISGFWLSAYFSRSTDGLKWCASLDEPSLSEHGKLILLPDFSSRSTKGVLRSADGSLS

SEQ ID NO: 200794 - protein, 66 aa, Glycine max
  Coding DNA Sequence Number=SeqID_84016
MLAQPGGSSGALSKLILAERILDNSSASKIFYTLSHELLRLVDGSLSQRIGLASFSKSALPPNLPN

SEQ ID NO: 200795 - protein, 733 aa, Glycine max
  Coding DNA Sequence Number=SeqID_84017
  Gene Ontology: Mol. function=binding; Cellular component =intracellular; Biological process=metabolic process
  Homolog annotation: Hit_ID=Q654C7; Match level="QueryCoverage=87%, HitCoverage=89%, E-value=1e-122, Identity=30%"; Hit description =Putative pentatricopeptide (PPR) repeat-containing protein
  Pfam annotation: Domain name=PPR; Domain location=191-225; Score =24.0; E_value=0.00053; Accession=PF01535.11; Description=PPR repeat
  Pfam annotation: Domain name=PPR; Domain location=292-326; Score =37.9; E_value=3.4e-08; Accession=PF01535.11; Description=PPR repeat
  Pfam annotation: Domain name=PPR; Domain location=393-427; Score =31.4; E_value=3.2e-06; Accession=PF01535.11; Description=PPR repeat
  Pfam annotation: Domain name=PPR; Domain location=494-528; Score =40.6; E_value=5.4e-09; Accession=PF01535.11; Description=PPR repeat
  Pfam annotation: Domain name=PPR; Domain location=565-599; Score=9.7; E_value=0.53; Accession=PF01535.11; Description=PPR repeat
  Pfam annotation: Domain name=PPR; Domain location=631-665; Score =11.6; E_value=0.32; Accession=PF01535.11; Description=PPR repeat
  Pfam annotation: Domain name=PPR; Domain location=89-123; Score=14.0; E_value=0.16; Accession=PF01535.11; Description=PPR repeat
  Pfam module annotation: Pfam domain module=PPR::PPR::PPR::PPR::PPR::PP R::PPR; Domain location=191-225::292-326::393-427::494-528::565 -599::631-665::89-123
MSQLPQMIKLLYKETRVALHYISNRYILTGTATECRELIQQPIQEQPAENAYSVHNMLELNSELKQLVKQGQLCKARYMFDKMTHRDEISWTTLIAGYVNASDSYEALILFSNMWVHPGPQRDQFMISVALKACALGVNICFGELLHGFSVKSGLIHSVFVSSALIDMYMKVGKIEQGCRVFEKMMTRNVVSWTAIIAGLVHAGYNMEGLLYFSEMWRSKVGYDSHTFAIALKASADSSLLHHGKAIHTQTIKQGFDESSFVINTLATMYNKCGKPDYVMRLFEKMRMPDVVSWTTLISTYVQMGEEEHAVEAFKRMRKSYVSPNKYTFAAVISSCANLAAAKWGEQIHGHVLRLGLVNALSVANSIITLYSKCGLLKSASLVFHGITRKDIISWSTIISVYSQGGYAKEAFDYLSWMRREGPKPNEFALSSVLSVCGSMALLEQGKQVHAHLLCIGIDHEAMVHSAIISMYSKCGSVQEASKIFNGMKINDIISWTAMINGYAEHGYSQEAINLFEKISSVGLKPDYVMFIGVLTACNHAGMVDLGFYYFMLMTNVYRISPSKEHYGCLIDLLCRAGRLSEAEHIIRSMPFHTDDVVWSTLLRACRVHGDVDRGRWTAEQLLQLDPNSAGTHITLANIYAAKGRWKEAAHIRKLMKSKGVIKERGWSWVNVNDQLNAFVAGDQAHPQSEHITTVLKLLSANIGDAQQEIRSLHEDVEDLAYSCILSHGNARK

SEQ ID NO: 200796 - protein, 82 aa, Glycine max
  Coding DNA Sequence Number=SeqID_84018
MVQLWFGNRVKHLPVKKKREGVETRVVIPERAGRTKSVSYLCFPLISDETYLAPFVAQYVKSRDVPKIKRKQAYVIRENSVM

SEQ ID NO: 200797 - protein, 145 aa, Glycine max
  Coding DNA Sequence Number=SeqID_84019
MGGPPYRNSEPCVCTLLLRPPRAYSSINYVVGHTRRCSGAFQSRPATIAQHLQGSSNTDKLKVDLEKTESSLDSALQANITLAEDNSNLKWCILYLEGKMKVLEKRALDAKALDKLNKEEVARLEVVLATTEKERNAEEERLQIE

SEQ ID NO: 200798 - protein, 145 aa, Glycine max
  Coding DNA Sequence Number=SeqID_84020
  Gene Ontology: Mol. function=DNA binding; Biological process=DNA integration
MKSKWYIRYDINDTVDELVKLETLPRLGQLKTFKLRTLSFSYVSTKECMQVETQELESWKTTIVEYLLKGILLEEREKAKKWRTQAAKYKIANEMYQRGFFSPLLKCLDNEQVDYVVRELYYKGICGMHSRGRSMAARVLRVGYY

SEQ ID NO: 200799 - protein, 123 aa, Glycine max
  Coding DNA Sequence Number=SeqID_84021
  Subcellular localization annotation: CTP_CleavageSite=17; ConfidenceScore=5.28e-01
MAESSKKQKGSSSTTTTAGHRRHGTFGDPPAPIPPSLSSPWPSTLFSSDDQRQRYYSQFCNRIILDPKYLDLEFFDGETFDCFQVFQNSELVEFMSLKLPYFPELVRVFYNNLKIQDGVLYSE

SEQ ID NO: 200800 - protein, 118 aa, Glycine max
  Coding DNA Sequence Number=SeqID_84022
MGTIRDIRQGQCTPHEHTQHASSQCISNIINILFQYHSQHKHHLVSMTLSTTTTSFHINIITYQFKVINSNINRLRDFLHRIFKEDSEDSAPIKVFLLVWGSNSKQRWLTMATGGLGW

SEQ ID NO: 200801 - protein, 64 aa, Glycine max
  Coding DNA Sequence Number=SeqID_84023
MASYGGELVIGSSSPRSGVSNHLSSFSILLPLIFKKKRIPLMKKIQVLQALLGATSCGSIIFQS

SEQ ID NO: 200802 - protein, 98 aa, Glycine max
  Coding DNA Sequence Number=SeqID_84024
GDEGINCPENLITPITPHSASKSHILDQALATEILAMPKRANTPPKANFSKLYRYHPNRGHSTKECSILKDKIEDLIKVGTPKGFYPQASFISAQQQL

SEQ ID NO: 200803 - protein, 352 aa, Glycine max
  Coding DNA Sequence Number=SeqID_84025
  Gene Ontology: Mol. function=DNA binding; Cellular component=nucleus; Biological process=regulation of transcription, DNA-dependent
  Homolog annotation: Hit_ID=Q4VPE5; Match level="QueryCoverage=99%, HitCoverage=98%, E-value=1e-151, Identity=78%"; Hit description =Phantastica transcription factor b
  Pfam annotation: Domain name=Myb_DNA-binding; Domain location=4-53; Score=43.7; E_value=6.3e-10; Accession=PF00249.21; Description=Myb -like DNA-binding domain
  Pfam annotation: Domain name=Myb_DNA-binding; Domain location=59-104; Score=39.9; E_value=8.8e-09; Accession=PF00249.21; Description=Myb -like DNA-binding domain
  Pfam module annotation: Pfam domain module=Myb_DNA-binding::Myb_DNA -binding; Domain location=4-53::59-104
MKERQRWRAEEDALLCSYVKQYGPREWNLVSQRMNTPLNRDAKSCLERWKNYLKPDIKKGSLTEEEQRLVIRLQAKYGNKWKKIAAEVPGRTAKRLGKWWEVFKEKQQREKKDVNRISDPINNSKYEHILESFAEKLVKERPSPSFLMAASNGAFLHTDTPAPASSLLPSWLSNSSSPAADGPSSLSVTLSLSSSMVIAPPFSWLPPKRGPDNAPFVLGNAAALQGVIPTLSDNMLMSQMVEHRKELEEGHRALGTHKKEAAWRLSRVELQLESEKTNRRREKIEEFEAKIKALQEEELAALGRIEAEYREQLDALRRDAENKEQKLAEQWAAKHLRLTRLLEQLGCRAGLP

SEQ ID NO: 200804 - protein, 102 aa, Glycine max
  Coding DNA Sequence Number=SeqID_84026
MGSKIYPKVHENPKAFFINSIPILLEPLAHGSEAKDSIDEEDPRPTSSTWSYITISPFEQMMMAKMDELEKVHKEDYGEFKACFETILERLGVMRASYVDDL

SEQ ID NO: 200805 - protein, 194 aa, Glycine max
  Coding DNA Sequence Number=SeqID_84027
MEDFEFTLALRIARISFSYINLKKSQKKRSIEENAKTEAYPGGKNRRRRSGNTHRVAARSTQKHLLENETAPSRGKREREKRRSSGDDMSMTMNDDRIERECGGGEKTEHCNGAEREKVRIDKTGKRERKWGQGYTSVSALNMRERCTRMIREEGTEHQQQPDATQRVEEVEFVDLAHFPKLPMLEILHGLHVS

SEQ ID NO: 200806 - protein, 112 aa, Glycine max
  Coding DNA Sequence Number=SeqID_84028
MIDGEDECAQKNKGGPRRVHRSHSNLKNKTNRWLHEEHRTRNDVGIGHSRDPTAKGHFMDVAGELKLSVEAMSSPRQRRRGEGRHHPLRNKPRKKELHHQELPWIRSLKRML

SEQ ID NO: 200807 - protein, 147 aa, Glycine max
  Coding DNA Sequence Number=SeqID_84029
MLRSIHQGQIILLQSLQLVAPPDSIPTVEQFNEWVAWPGTQPPLHREDEDPAAQVPHQSKDESSKSSTPEPLIRKRRVVVTQEAAATSEKSLEATLELPTPVADTTSPQQATDPSTPEDQTTSVLSSNISPVATLVLHLSEEEEGQT

SEQ ID NO: 200808 - protein, 190 aa, Glycine max
  Coding DNA Sequence Number=SeqID_84030
MEIYHTELDEFKAKLERRNFHKRLTNLADNSIDLALVKEFYANLYSPEGPSPKQVRIQGHLIRIDADNLNVFLETPMVLAEGESLPAYSRYYRMPTDIREIEAALCIPGQGFILNVEGHPGKILRKDLTTLAQVWSVLSYSNLASTSHTLDLTVDRARLIFGLVTQLDMNVRALISRQITSMAQSNSSRL

SEQ ID NO: 200809 - protein, 195 aa, Glycine max
  Coding DNA Sequence Number=SeqID_84031
  Gene Ontology: Mol. function=chitin binding; Cellular component =extracellular region; Biological process=chitin metabolic process
  Homolog annotation: Hit_ID=UPI000044A8F0; Match level="QueryCoverage =75%, HitCoverage=99%, E-value=2e-17, Identity=28%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
MIGTSKPYTSEMKGTMHKPQVNIGAEQKKLDALTFRGLPVLTFRGLNVLLLGGLHALAFRGLYVLLFRGLHVLPFRGLHILTIKGPHVLAFRGIHVLTFIGLHVLPFRGLHALAFRGLHVLTIRGIHSLTFRRIHILLFRGLHVHAFRGLHALAFIGLHVIAFRGLHALAFVGLHPLAFIGLHICAFRELEVLRP

SEQ ID NO: 200810 - protein, 214 aa, Glycine max
  Coding DNA Sequence Number=SeqID_84032
  Gene Ontology: Mol. function=hydrogen ion transporting ATP synthase activity, rotational mechanism; Cellular component=proton -transporting two-sector ATPase complex; Biological process=ATP synthesis coupled proton transport
  Homolog annotation: Hit_ID=Q8RZF8; Match level="QueryCoverage=97%, HitCoverage=52%, E-value=7e-71, Identity=58%"; Hit description =Lustrin A-like
  Pfam annotation: Domain name=DUF231; Domain location=54-211; Score =265.9; E_value=8.3e-77; Accession=PF03005.6; Description=Arabidopsis proteins of unknown function
MEQTYDVKVMFSRNALLVDIVGESIGRVLKLDSIQAGQMWKGIDVMIFDSWHWWIHTGRKQPWDLIQVGNRTYRDMDRLVAYEIALNTWAKWVDYNIDPTRTRVFFQGVSPDHQNPAQWGEPRANLCEGQTRPILGFRYPGGPLPAELVLEKVLRAMQKPVYLLDITTLSQLRIDGHPSVYGFGGHLDPDCSHWCLAGVPDTWNELLYASLVKN

SEQ ID NO: 200811 - protein, 169 aa, Glycine max
  Coding DNA Sequence Number=SeqID_84033
MTTLTQIWMTLLLSNILPSDDNGSRPQDTQWTWRSPTEPWGFQLWLWASVSPTRCPSPPARSHHRDIGIALARYPVDPEKSNRVLGFAALITDLCQFYGVSIAPNKVIRPPINRTFIKKYCAPQASTGRDTTTAWGWPTTGNRRTTATSKAPQLIFKGWSVSYDPWLGY

SEQ ID NO: 200812 - protein, 47 aa, Glycine max
  Coding DNA Sequence Number=SeqID_84034
METSPFLAKLYGACGTADVILIENQLVESNFTTDNSYLIEEVCRLIQ

SEQ ID NO: 200813 - protein, 50 aa, Glycine max
  Coding DNA Sequence Number=SeqID_84035
MKLKQSGFKSDPFLHNHESYIKNSMQNSKTGCVPRSLPEWGTLANGRHFA

SEQ ID NO: 200814 - protein, 95 aa, Glycine max
  Coding DNA Sequence Number=SeqID_84036
  Gene Ontology: Mol. function=nucleoside-triphosphatase activity; Cellular component=membrane
MYSHSSTKRQSENNRADNNKDNSLYQKILTYLDSLPSVEDSDYPNPSDIFLHLDHNHTVHDTFLGARLSWTNASGDALVLRLKKKDKRRVFRQYF

SEQ ID NO: 200815 - protein, 172 aa, Glycine max
  Coding DNA Sequence Number=SeqID_84037
  Pfam annotation: Domain name=DUF538; Domain location=85-172; Score= -6.5; E_value=6.9e-05; Accession=PF04398.3; Description=Protein of unknown function, DUF538
MIPPLLRLYHIYCIMLLAIALIPLLDNQYSHKQNYPHSQRIMRTQQRSHCRKTNSNPNAKLVVAPKASAVSVVPEREVVMSSIRFLWILMVSLTESCTLSQPQKLSMYDVLMEYGFPVGLLPKGAIGYSLNKVSGEFAVYFQGVCSFDIESYMFKYKSTITGVVSKGKLYNL

SEQ ID NO: 200816 - protein, 95 aa, Glycine max
  Coding DNA Sequence Number=SeqID_84038
  Gene Ontology: Mol. function=protein serine/threonine kinase activity; Cellular component=calcium- and calmodulin-dependent protein kinase complex; Biological process=protein amino acid phosphorylation
  Homolog annotation: Hit_ID=Q2QDF4; Match level="QueryCoverage=84%, HitCoverage=15%, E-value=2e-32, Identity=73%"; Hit description=CDPK -related protein kinase
MTTTIAIEDVRREVKILRALNGHNNLIQFYDAFEDQDNVYIIMEGGKYLEDDAKAVMVQILNVAAFCHLQGVVHRDLKPEDPTARLQHAKFLVTV

SEQ ID NO: 200817 - protein, 245 aa, Glycine max
  Coding DNA Sequence Number=SeqID_84039
  Homolog annotation: Hit_ID=Q1SM20; Match level="QueryCoverage=34%, HitCoverage=22%, E-value=4e-11, Identity=38%"; Hit description =Nucleic acid-binding, OB-fold
MLCIAPLLGLTVRRKVWLCSIVRFGCEKSKLYFCTHVWIVNFGFRWLRWLCDYKVMARVPDKIKLIDGSREALKLSVRITDLWFIGIPEKFEQAEMVVVDSDGDEIHVVCKQDQLKSWKADLKENLTYVMHNFKVMKNDVIGVVDEVVFRYVSSKNTKVLSCTLWENYCLQFLSYLNEVEDERPIIILLTHARIKEAQGSYLPSVSNSFKASKLMINELVLEIQELRERLLDLGMEVRSVLTPIG

SEQ ID NO: 200818 - protein, 100 aa, Glycine max
  Coding DNA Sequence Number=SeqID_84040
MQPCCKIESSILESTDPTELEYQSVSVTADDDRSMLDSTEPTELESQSVSITADHDPLLRIPLTPTKRVSSDELDDEPKNFEISLAQVSSNNLAKHCQAE

SEQ ID NO: 200819 - protein, 132 aa, Glycine max
  Coding DNA Sequence Number=SeqID_84041
MVLHGKTIGFNLEDYDSTLNTCHTPFSTNMPTINGEDEVDDTYGYTIKLPSSRAAPSMFMSKRTRKAAWFTSLSAKPVGLERPLVHVDPNIKTIASPYRKKLRTYLGVIGQDKVDVTYINWIHVPTSQKDLI

SEQ ID NO: 200820 - protein, 78 aa, Glycine max
  Coding DNA Sequence Number=SeqID_84042
MLLKGSLSEPDWLSKAHPLSEGACSLSEYETLENVESESSTLSVQLARPARMVSLFTLSASKLALRPTTNSRTVRHAH

SEQ ID NO: 200821 - protein, 105 aa, Glycine max
  Coding DNA Sequence Number=SeqID_84043
MLPLIFKKQKTPLMKKIQGLQAPHGATSKVLGFNLKTNPTILHYTFVILSFNVEHILVDIISLPSSNILFRHIRKSGHFQKDCPKYKSWFEKKGELSAYVCLNQT

SEQ ID NO: 200822 - protein, 168 aa, Glycine max
  Coding DNA Sequence Number=SeqID_84044
  Gene Ontology: Mol. function=protein dimerization activity
  Homolog annotation: Hit_ID=Q9ZWT4; Match level="QueryCoverage=89%, HitCoverage=33%, E-value=7e-17, Identity=52%"; Hit description =Transposase
MALGLKFVDKNEYVKDIFLDMIQVQDTTSSTLNIQNIYGQGYDGASNMRGEWNDLQALILQECPYAYFLDEDLAAKGSTSAQRGDATCALKALISFDFVFTLHVMKETMGFTDKLCQVLQQKSQDILNAICLASSIKSLIQELRDSSWGTLLEKSHLFTIKKQFKFLK

SEQ ID NO: 200823 - protein, 78 aa, Glycine max
  Coding DNA Sequence Number=SeqID_84045
VDQHADISKEAAKDHQLEVEAVFDNEDASRRRIPYKLNLRIMHGYYSISKSIDIAEVLSNSKNKRIRKLIKWLEMRST

SEQ ID NO: 200824 - protein, 71 aa, Glycine max
  Coding DNA Sequence Number=SeqID_84046
MRENENESQNRLIKLKARASAKLRCERQPVDLRENEFRNLGRFKSSLEQVQICEKPMNKFESVRMRKIESE

SEQ ID NO: 200825 - protein, 299 aa, Glycine max
  Coding DNA Sequence Number=SeqID_84047
  Gene Ontology: Mol. function=DNA binding; Cellular component =intracellular; Biological process=DNA integration
  Homolog annotation: Hit_ID=Q8FC53; Match level="QueryCoverage=89%, HitCoverage=100%, E-value=1e-152, Identity=95%"; Hit description =Transposase insF for insertion sequence IS3A/B/C/D/E/fA
  Pfam annotation: Domain name=rve; Domain location=130-290; Score =193.2; E_value=6.3e-55; Accession=PF00665.16; Description=Integrase core domain
RGVLRKAVRLRYAFIRDNICCWPVRLLCRVLDVHPSGFYAWFKQPYSQRHQVDLRLTGQIKQFWLESGCVYGYRKIHLDLRDSGQQCGVNRVWRLMNRAGIKAQVGYRSPRARKGEASIVSPNRLQRQFNPDAPDKRWVTDITYIRTHEGWLYLAVVVDLFSRKIIGWSMQSRMTKDIVLNALLMAVWRRNPQKQVLVHSDQGSQYTSHEWQSFLKSHGLEGSMSRRGNCHDNAVAESFFQLLKRERIKKKIYGTREEARSDIFDYIEMFYNSKRRHGSSNHMSPTEYENQYYQRLGSV

SEQ ID NO: 200826 - protein, 301 aa, Glycine max
  Coding DNA Sequence Number=SeqID_84048
  Gene Ontology: Mol. function=transporter activity; Cellular component= 1-2nm peptidoglycan-based cell wall; Biological process=transport
  Homolog annotation: Hit_ID=Q1R659; Match level="QueryCoverage=83%, HitCoverage=76%, E-value=4e-98, Identity=65%"; Hit description =Hypothetical amino-acid ABC transporter permease protein yhdX
  Subcellular localization annotation: CTP_CleavageSite=28; ConfidenceScore=5.14e-01
SARVSPIQLAWKINQFSAGGITLQIIHRLSNVSSVFSQLENRHNGSVLLTLNQRNFAVIEVHQQRNEQTDNQINRHGDGNGFNCLAGLIQYGAGKQRHHIRIADRGRQRGVFYDVKVLAGERRDNHAHRLRNDHLTQRNRCQRQRCQFRNHGKATAEVETAQLGHIPVRGGTKQRAAQLTGFQLMLAVKAEQRGAGGDGNRQRDQEWPGAGCILRPRYIQTAVADKSQIERVQRLTRARKIAQHGKVPEEDLQQRRDITERLDINGRQLAQQPVIRQARQTDGEAEDRGEDNTERGDQQGV

SEQ ID NO: 200827 - protein, 204 aa, Glycine max
  Coding DNA Sequence Number=SeqID_84049
  Gene Ontology: Mol. function=oxidoreductase activity; Biological process=metabolic process
  Homolog annotation: Hit_ID=O52532; Match level="QueryCoverage=52%, HitCoverage=42%, E-value=4e-45, Identity=67%"; Hit description=tRNA -dihydrouridine synthase B
EYDSIRTVKQSVAIPIIANGDITDPHKARAVLDYTGADALMVGRAAQGRPWIFREIQHYLDTGELLAPKPLAEESAPDDQFRRTFNAIEDASEQLEALEAYFENLAISRAASVGHGDAVYPWQPDPRCPDDGHQPRLWAGVFVAAVCALTPRETIIVKMVTIVAIAGVIAHLSQGRCPALFLRRKNPPDRPSARFVCDPEPLQR

SEQ ID NO: 200828 - protein, 150 aa, Glycine max
  Coding DNA Sequence Number=SeqID_84050
  Gene Ontology: Mol. function=transporter activity; Cellular component= outer membrane-bounded periplasmic space; Biological process=transport
  Homolog annotation: Hit_ID=UPI00005F73BB; Match level="QueryCoverage =99%, HitCoverage=43%, E-value=2e-69, Identity=85%"; Hit description =COG0834: ABC-type amino acid transport/signal transduction systems, periplasmic component/domain
MMLSTLIAAASLFAVTQQAHAGTTLDAIKKKGFIQCGISDGLPGFSYADASGKFTGIDVDVCRAAAAAVFGDASKVKYTPLTAKERFTALQSGEVDILSRNTTWTSSRDGGMGFLFAGVNYYDGIGFLTHKKAGLKSAKELDGATVCIQA

SEQ ID NO: 200829 - protein, 139 aa, Glycine max
  Coding DNA Sequence Number=SeqID_84051
  Subcellular localization annotation: CTP_CleavageSite=52; ConfidenceScore=5.03e-01
MGLAMNSLSEPASLSEFIHFDEFLGFRMNSLSVPCSAKQRALRAKPLAAISMASKKRCASSSRPHELYDTSRFVSETAWDRAGATLVAQELDKRKMIKFDATTLNAFLETPVVLEPGDRYLAYSCFCHTHPDPQEIAAY

SEQ ID NO: 200830 - protein, 145 aa, Glycine max
  Coding DNA Sequence Number=SeqID_84052
  Gene Ontology: Mol. function=transition metal ion binding; Biological process=cytoskeleton organization and biogenesis
MQNSECHDDNPRVASIPYFGFIEEIWELNYVKFIVCVFKSKWVDSNTSVRTGDVGFVLVNLKKLAYQNDPFIMVEQAKQVFYVQDPCDERCSVVLHGKTVCVNVEDDDSYIDTYVSPLSTQMSPNVVGQEETNGVLVNRNDHDEG

SEQ ID NO: 200831 - protein, 276 aa, Glycine max
  Coding DNA Sequence Number=SeqID_84053
  Gene Ontology: Mol. function=L-malate dehydrogenase activity; Cellular component=membrane fraction; Biological process =tricarboxylic acid cycle intermediate metabolic process
  Homolog annotation: Hit_ID=Q8GQU4; Match level="QueryCoverage=78%, HitCoverage=85%, E-value=1e-104, Identity=92%"; Hit description =Malate dehydrogenase
  Pfam annotation: Domain name=Ldh_1_C; Domain location=187-274; Score =11.0; E_value=1.5e-07; Accession=PF02866.8; Description =lactatemalate dehydrogenase, alphabe
  Pfam annotation: Domain name=Ldh_1_N; Domain location=40-184; Score =229.4; E_value=7.7e-66; Accession=PF00056.13; Description =lactatemalate dehydrogenase, NAD bind
  Pfam module annotation: Pfam domain module=Ldh_1_C::Ldh_1_N; Domain location=187-274::40-184
MIIAVHSLLAATGSFRRLLKWRCLGSRLRRNVIARQEFRMKVAVLGAAGGIGQALALLLKTQLPAGSALSLYDIAPVTPGVTVDLSHIPTAVKVEGFSGEDATPALHGADVVLISAGVARKPGMDRADLFNVNAGIVRNLIEQVATTAPKALIGVITNPVNTTVAIAAEVLKKAGVYDKNRLFGVSTLDVIRANTFVAALKGKQPTEIEVPVVGGHSGVTILPLLSQVKGVSFSEQEIADLTKRIQNAGTEVVEAKAGGGSATLSMGQRRRALVCR

SEQ ID NO: 200832 - protein, 490 aa, Glycine max
  Coding DNA Sequence Number=SeqID_84054
  Gene Ontology: Mol. function=aminoacyl-tRNA ligase activity; Cellular component=membrane; Biological process=translation
  Homolog annotation: Hit_ID=Q8ZKB2; Match level="QueryCoverage=99%, HitCoverage=47%, E-value=1e-173, Identity=64%"; Hit description =Putative periplasmic binding protein
MVVARVLMRVMLPVKSRMVTVSPIRIGFSNRMIRPEIKLAKISCIPKPSPRPSAATSHCSFDHSTPIIEKPIRPPTSISAYLVRVAEVLQQRQLQQRRHIAHQLGGNDKDQDGDQHGTQRNGLYALDALHRGAGIPQRDVVEEAERGVDLRPQHNHRHQRNQRQNRADQPQRLRADRIQIDNRLFDFHGIGADGRLLLFFLFAARAVGQHIGTTLARAVKGDAAALNQHPAANDVVNHQQEEPDADRGFQTRQQRLRGGQIANAGGQRCHQRDGDHQADGDNAQRPADQNKAQAPQRSGELRIVEVGESNQQHNQRYDQADRQRVITHGARDPRLRPAEVHDKQAVRTGKSRADHECPQQRQGGSDAIANRYGKRVRPGVLQAKPERGPQHRQRHRDQNRPEDGAQCQAEAVLRHFPHAAGRARHKGVVVTTRADAKAHQQNGANNRQHRFAVSEHHRQRFAQLAQRVQRQQARQIGGHVQRIFQANRAD

SEQ ID NO: 200833 - protein, 50 aa, Glycine max
  Coding DNA Sequence Number=SeqID_84055
  Homolog annotation: Hit_ID=Q6X0N7; Match level="QueryCoverage=57%, HitCoverage=3%, E-value=4e-08, Identity=93%"; Hit description =Putative beta-galactosidase
MATRHMVDFMCLSMNLITTGSDGAEIRGEIKITGFENGDIDLSKSLWTYQ

SEQ ID NO: 200834 - protein, 130 aa, Glycine max
  Coding DNA Sequence Number=SeqID_84056
MFDQQAAVSPAKPPESPDHEVDDPLYLMILTIPRLFVFGVFNQNFSLYIKHENLSEIAHSGQCLSISVIQLWILHLTETSMQAGSYDVYGFLEPQSIQRSGQSQFESKSYIKSWMQSSKHGVYFGTYLNG

SEQ ID NO: 200835 - protein, 92 aa, Glycine max
  Coding DNA Sequence Number=SeqID_84057
MAERTGMDINLGYVTTSWAMPPEKGREGTIKVINGGWLMAKIPPYKHAIAAYGTAIAGRPSQIACGRAITKHHVIVLWQHCNCYLTTMGATS

SEQ ID NO: 200836 - protein, 351 aa, Glycine max
  Coding DNA Sequence Number=SeqID_84058
  Gene Ontology: Mol. function=cytochrome-c oxidase activity; Cellular component=integral to membrane; Biological process=electron transport
  Homolog annotation: Hit_ID=Q75HA3; Match level="QueryCoverage=74%, HitCoverage=84%, E-value=6e-76, Identity=53%"; Hit description =Expressed protein
  Pfam annotation: Domain name=DUF887; Domain location=32-329; Score =252.5; E_value=8.5e-73; Accession=PF05967.2; Description=Eukaryotic protein of unknown function (DUF887)
MFASEEIMSFKSYQNRANLFVKEYLLADSLIPYISVISGMLACKMVYELTQLIGSNYFKIYSSFSKFQRIEWNNRAISTVHAIFITTVSLYMVFCSNLFSDYQSTELITERSSSLSTFALGRGGCYKKGGREGNHERRVAILGTHWRGRGSGLKIAWKVSVGYFIADLGTILWFFPSLGGYEYVIHHLFSLVAVAYSMLSGEGQLYTFMVLISETTTPGINLRWYLDVAGMKKSKAYLINGVVIFISWLVARILLFIYMFYHVYLHFDKVADFDIQFLAFNDSNDVYTLFSWMINGLDHGSMYFFLSAKIVIYAFQFGSRKVVCGARIDILLWLYCVYRHMYKHTTITMPT

SEQ ID NO: 200837 - protein, 203 aa, Glycine max
  Coding DNA Sequence Number=SeqID_84059
  Homolog annotation: Hit_ID=Q47522; Match level="QueryCoverage=25%, HitCoverage=70%, E-value=2e-14, Identity=70%"; Hit description=LacZ protein
VPPVQLLTGWCVTAKAPPDISAGKCSGHAARRVPFAIQAAQLLGRAIGAGLFAITPAGERGMCCKAIKLGIRYSKSSRDAEDAGFNDAIAEDRTDQFVNTLQPELEALENKKDDFIGDFSKMGGARYQLLFPLVRVNFELGVIMVIAVSFGKPVVPAALMNRPTRGERRFAYWALAECILAYYVGTDEGVSEVLHVAGEKRLH

SEQ ID NO: 200838 - protein, 739 aa, Glycine max
  Coding DNA Sequence Number=SeqID_84060
  Homolog annotation: Hit_ID=Q1SS44; Match level="QueryCoverage=20%, HitCoverage=62%, E-value=4e-31, Identity=49%"; Hit description =Cyclin-like F-box
MASYGGELLLDSSSPGSGVSSLSSFSIPLPFIFQEAKESIDEEDPRPTSSNGAYITTSNIHYFEIPATPMAKSSVLYKVLKVDFEDSAPIKVFFPISLRELISLTETPILVLSATFCVEQITSSGIALSALVFLSEFSSQVGIVLGMFVSLSKFPSRVGIVLSALVSLCEFLSRVGIALSALVSLSNFPSWVGIALSVLVSLSKLSKDVIWKIAMVIFKILVDRLATVALKIISTQQKGSIKERSISDCISVACEVFNMINYRSFRVLWLDFYHPKFSSSFFLFQWLSVRIPCKMGVRNYPTLTHVLYVDDILVFYRKTKRNLSSLMDLFQSYGNVSDQIINPNKCLLFSSSMTPYIMLEIESLLGFKANFLKNTNHLSFYKKSSLWPSLNRHFEELGFHNKPTDFHSAFIQISVSITLAGMLSKGFLSYSMLEFSFLKSFDVDIHPPKPHLIKRVDCCPPLAGTIKCNEDGLAKGALGHARSGGIFSVLMVASWVASPLIPSKSSLSLGDLVFVVSISMRNSNIVSIARPCGMLCVDTVEVFLFSMSCDGTVLREGVEEVRMAWNMVLRGWKGVFTMMERMGKMGFRLDGEGWFSQELPALGCCFGAMESAVVVDLKVGMCEGEGENLNGVRVNEVSVGILSVVDWRYASVEDRLSLILFFQWCIGKRSIYVALQDPSITILRKLLKKNDWNVAKRGWDAQVLGEAPYKFTNALEAITKLRAEPKANNQYLPPFDRTS

SEQ ID NO: 200839 - protein, 101 aa, Glycine max
  Coding DNA Sequence Number=SeqID_84061
  Gene Ontology: Mol. function=nucleic acid binding; Biological process= RNA-dependent DNA replication
MARRNDRVIADAFQALSQAMGNQNSDVEYEGLDRFQQNNPPSFNGEEQKVAFGTYTLLEEAEYWWENTHQYLEAEGQAMTWETFKSVFLEKYLGHVTEFDP

SEQ ID NO: 200840 - protein, 115 aa, Glycine max
  Coding DNA Sequence Number=SeqID_84062
  Pfam annotation: Domain name=PPR; Domain location=61-95; Score=22.1; E_value=0.002; Accession=PF01535.11; Description=PPR repeat
MDKPLIQTALVLDDSTDPAIKQVEKNLKQLEKLWKEMKTRRVAPNKLFNEYRMNEGLIDRAMVGIMVSVFSKVGLVDELVKLLQDMKAEGTRLDQRLYQSASNAFKDVGLQIQAR

SEQ ID NO: 200841 - protein, 134 aa, Glycine max
  Coding DNA Sequence Number=SeqID_84063
MAMTHEQQLNNVLQNGRLGVVTKSDFGRTARLVMVNLDDAFEDLWELKIPAKALIFAWRLIRDRLPTKANLRRRQVPLCSILPHVQLEAIVWGIGTSIGEVPPDCISRVEKKEKSSTVPSCAATNGLFDYGSHN

SEQ ID NO: 200842 - protein, 269 aa, Glycine max
  Coding DNA Sequence Number=SeqID_84064
  Gene Ontology: Mol. function=protein dimerization activity; Cellular component=nucleus; Biological process=regulation of transcription, DNA-dependent
  Homolog annotation: Hit_ID=Q2HUH2; Match level="QueryCoverage=92%, HitCoverage=75%, E-value=1e-12, Identity=29%"; Hit description=CAMP response element binding (CREB) protein
MTSSHLMRLGNIGKPLHSMNLDDELQKNVISTDQSGQLVQDLLSDHNSFILPSLKNNNIGTLSNKTNNNINRPWKEIVHQEHVNRSMDTPLKQPSLGETLESFLVRAGVIDVGDHQDDNNDNVVVGGNTHHQALMGMDPVVMLSQKEHWLQLKIPIAIDMHQHQEQHHQQRDVGEHQDLIVPKSLFYENQEMEIGYSENPGGISVSPTYSDSKSAIFGKNKYSDEVLEKTIERKQKRMAKNRESVVRSRTKKQVSTRMTPQLSSKHACG

SEQ ID NO: 200843 - protein, 135 aa, Glycine max
  Coding DNA Sequence Number=SeqID_84065
  Gene Ontology: Mol. function=structural constituent of ribosome; Cellular component=ribonucleoprotein complex; Biological process =translation
  Homolog annotation: Hit_ID=P51412; Match level="QueryCoverage=52%, HitCoverage=32%, E-value=4e-13, Identity=56%"; Hit description=50S ribosomal protein L21, chloroplast precursor
  Pfam annotation: Domain name=HMG-CoA_red; Domain location=2-135; Score=-335.8; E_value=0.067; Accession=PF00368.9; Description =Hydroxymethylglutaryl-coenzyme A reductase
  Pfam annotation: Domain name=Ribosomal_L21p; Domain location=13-86; Score=38.5; E_value=2.6e-10; Accession=PF00829.11; Description =Ribosomal prokaryotic L21 protein
  Pfam module annotation: Pfam domain module=HMG-CoA_red::Ribosomal _L21p; Domain location=2-135::13-86
MTLPVILRFPTQNLILAVRERQIALHKVLLVATNTFCYIGKPIVTNVVVYAIVEEQGLDPKVIVFKYKKKKHYPRNIGYRQGARKVLKINAFALMELNMLKNLVGFFVTSVVGGFNAHASNIVSTIFIATGKDPA

SEQ ID NO: 200844 - protein, 75 aa, Glycine max
  Coding DNA Sequence Number=SeqID_84066
MWNQIVSRVHILQKRLDKCSGLGGHMNIHRNNKKRGNQGLQIGPNHIDDKIHHVRRGNQKESDLDLEVRLGHDPH

SEQ ID NO: 200845 - protein, 52 aa, Glycine max
  Coding DNA Sequence Number=SeqID_84067
MLPFDFRHFAELHGLPNDGQRQRQPRDDEFPHFLGGSGAIQPGSPYLQFILH

SEQ ID NO: 200846 - protein, 346 aa, Glycine max
  Coding DNA Sequence Number=SeqID_84068
MRDVEQLLSLLVVIEGERGDGCCGQFDQICNARLPRALDPRSVPSEELSTSLGYMVQLLNLIVHNLAAPALHNSGFAGSCSRIWQRDSYWDARPSSRRSNDFSLTYFLVFSNEYPLFIPRQNYCSTGGENSWSERSSSNFGVASMESERRHRLDSSGSSSFNYSLASSHSVQTHKDLQKGISLLKKSVACITAYCYNSLCLDVPSEASTFEAFAKLLATLSSSKEVRSVFSLKMPRSRTCKQVQQLNKSVWNMNSAISSTTLLESAHSVPTTDCMYQCSLDRAFRIENYLPSATASFLYATDSDGKNECLVEGWDIVEHPTFPPPPSQSEDVEHWTRAMFIDAKRK

SEQ ID NO: 200847 - protein, 154 aa, Glycine max
  Coding DNA Sequence Number=SeqID_84069
MMQAGFPNDLMVWNAFPKQRVFGSKPAEREKINDATDFMIYPGNPTTISPTSYPQCDWDYMSPYKSYDQMILQTFAKREAFSATIHAPYCYYRHHPCTLLPLPPPSMHPTAITATTTPQPTPSPTTIMGKWRESGWAVSVVARESPRSLEYPGN

SEQ ID NO: 200848 - protein, 301 aa, Glycine max
  Coding DNA Sequence Number=SeqID_84070
MNFLRDSSSACRKLAKVVRSTGYVLCTEVFDGGVEAVYGSRWESTIPDQFRPLEGHWKDTTKDCIVIGVLRQCVGRELVILGMPNMRLQSIMWDHGLCTSALRVTFIKRTGGGTCKINDSNAQFGSKQENLETSVVLGDLFQKEHKSDSMKSKIQVDTVGQDSSSVNVENIGDFEHKKDDGNRSKESTQKNQKTENTSEDNTLKLEMGGSKVHSTKIGCNTSIHILDTNPKAPCVVEKTISLRNFVREKSIIAVSIMLRHLSEKRYKGVVGNSSNVGKDASYSSKDNEMKEVYEKTMEKTT

SEQ ID NO: 200849 - protein, 100 aa, Glycine max
  Coding DNA Sequence Number=SeqID_84071
MAEATIIKQCKTSNSRNISSNSSESFNQTPCRKKWAMLDMERTLRSTKLKGIKFDIKPKKIVPYASSSEIVTHGGGRWCMAVRNRLMVAATKNRGVLLWT

SEQ ID NO: 200850 - protein, 64 aa, Glycine max
  Coding DNA Sequence Number=SeqID_84072
  Subcellular localization annotation: CTP_CleavageSite=40; ConfidenceScore=5.00e-01
MEFRTLEKIDGSLASAPPPWASSAPLSPLPSPWRPCITAPCTNGAGETCHPPWWLLLLQRRLGS

SEQ ID NO: 200851 - protein, 69 aa, Glycine max
  Coding DNA Sequence Number=SeqID_84073
MGLRKKWRMENWRTALGNEFMGLRKCGEWRIGEQFMGLLKMWRMENWRTVLGDKFAGLQTRWWRTHEQR

SEQ ID NO: 200852 - protein, 55 aa, Glycine max
  Coding DNA Sequence Number=SeqID_84074
MILFHLREGEIGLRKWMMDKDTLGYSRWRSSKNLGELGTHKPHFATPDGLRDYDF

SEQ ID NO: 200853 - protein, 293 aa, Glycine max
  Coding DNA Sequence Number=SeqID_84075
  Gene Ontology: Mol. function=RNA-directed DNA polymerase activity; Biological process=RNA-dependent DNA replication
MPLYTKFLKDLLTKKGKYINNESIVVEGNCNAVIQIILPQKFKDPGSVTIPCFVGVLLVGKALIGLGASINLMPLSMCRRIGNLRIAPTRMTLQLADHSITNPYGVVEDVLVKVRQFIFPVDFFIMDIEEDSDIPLILGLPFMLTAKCVVGMGNGNLEMSVDDKKVTINLFEAIKHPNDHKACFKVETIEQEANMVVQNMTSHSPLEKVLINSIDCLTKEEEKDLMACLEDLDKLKVIPSGECVFEELKKNPTIEKPKVDLKVLPAHLKYAFLEENEANLVVINNTLSSNEEF

SEQ ID NO: 200854 - protein, 96 aa, Glycine max
  Coding DNA Sequence Number=SeqID_84076
MKKKQEEEELIRKKKKQKQKRGERERFSADLGKNEVEVLKHVSNYLDPVDSELLLDLLATSELKARTMWFPGIAEQHEKLRLWLCCMLFSGRVPRS

SEQ ID NO: 200855 - protein, 93 aa, Glycine max
  Coding DNA Sequence Number=SeqID_84077
  Homolog annotation: Hit_ID=Q9SCM1; Match level="QueryCoverage=59%, HitCoverage=7%, E-value=2e-07, Identity=68%"; Hit description =Imbibition protein homolog
MTIIVVRVSEGKLVVKERTILTEMSKDVVETLMMEEISSCGRCLRKWEIEEGTFHWRLNFSWWKPKMCPEPEPNHVHSLSTSHGRLIQSVPPG

SEQ ID NO: 200856 - protein, 60 aa, Glycine max
  Coding DNA Sequence Number=SeqID_84078
MTGERVHLLLVEKVQKQMVMKDQMWIRRLMSSLLRELSQSRGVEGVQETLQAQPAFQRYL

SEQ ID NO: 200857 - protein, 799 aa, Glycine max
  Coding DNA Sequence Number=SeqID_84079
  Gene Ontology: Mol. function=glycerol-3-phosphate O-acyltransferase activity; Cellular component=integral to membrane; Biological process=phospholipid biosynthetic process
  Homolog annotation: Hit_ID=Q9FZ22; Match level="QueryCoverage=59%, HitCoverage=90%, E-value=1e-132, Identity=52%"; Hit description =Probable glycerol-3-phosphate acyltransferase 2
  Pfam annotation: Domain name=Acyltransferase; Domain location=296 -407; Score=21.7; E_value=4.5e-05; Accession=PF01553.11; Description =Acyltransferase
  Subcellular localization annotation: CTP_CleavageSite=12; ConfidenceScore=5.13e-01
MNPNYSKMRTISLVQKKAKPGNNETLVFNFEGTLLRSTSLFPYFMLVAFEAGGVLRSLILFLSYPLVWLVGEDQLGLKIMVFLSFFGLRKDTFRTGSAVLPKFFLEDVGWEGFEAAMCCEKKVASSKLPRVMVENFLKDYLGVDAVIARDLKSFKGFLLGVFENKPIKIPSCKVNGGTKGSNINNSIDIIDNHVEYIDQEELFQLFKEVYIADERRNWHVLPRERYPKPLIFHDGRLALRPTLASSVALFIWLPFGLVLSLLRFTIGIALPLNVSAPILALTGTRTTVSRPQSASLSLVHYEQNQKGMLYVCNHRTLLDPLYVAIVLGKPLSAVTYSLSRLSEIVSPIRTIRLTRDRVKDREIMDKMLTQGNLVVCPEGTTCREPYLLRFSPLFSELTDNIVPVAVDVKVSMFYGTTASGYKCLDPFFHFMNPNPSYFIKFLGMLPQSQTCQGGGMPKIEVANFVQNEICNALGFACTNLTRRDKYLVLAGNEGVSPSNDCNHNNDDDINISGDHGGSGDGGDIGGGSDDVVVVVVLVVTTNGDDVGGGSGDEGDISGGGGDGSVGGGGSNRGGICNLSNCRLLGDSHTITIHTVTFHSTPHWLEPSVDQNPPSVGVLCPYSHVFRETFQKVIRPIIAPSQAHLTVEFLSDELPKSICIVIHWNVTVLVVVVAMVMLAMSVVMVGTMMMVVCGGGCSNVGDDCGDDDGGDIVSNGGSVDNDIDGGDGSNVGGYDDVSGDDDDRDNSVCVVVVVVAMTLVMVMVVTMMMMVTVTTRKVVVAVAVGMMVVVVKSVIIKYGK

SEQ ID NO: 200858 - protein, 205 aa, Glycine max
  Coding DNA Sequence Number=SeqID_84080
  Gene Ontology: Mol. function=arsenate reductase (glutaredoxin) activity; Biological process=transposition, DNA-mediated
  Homolog annotation: Hit_ID=P74984; Match level="QueryCoverage=63%, HitCoverage=92%, E-value=2e-60, Identity=87%"; Hit description =Arsenate reductase
  Pfam annotation: Domain name=ArsC; Domain location=7-117; Score =163.8; E_value=4.4e-46; Accession=PF03960.6; Description=ArsC family
MSNITIYHNPACGTSRNTLEMIRNSGNEPTVIHYLETPPTHDELVKLIAEMGIVVRTLLRENVEPYAQLGLAEDKFTDEQLIEFMLAHPILINRPIVVTERGTRLCRPSEVVLDILPDPQQGAFSKEDGEKRRTRIIGAAATEVTSAAADSLSLSEAVIDGHKVATAIFGVAVIVAVQIFVTNVKHAGAQFHVFTDLPRGADIEH

SEQ ID NO: 200859 - protein, 521 aa, Glycine max
  Coding DNA Sequence Number=SeqID_84081
  Gene Ontology: Mol. function=protein binding; Cellular component =cytoskeleton; Biological process=red or far red light signaling pathway
  Homolog annotation: Hit_ID=Q69S84; Match level="QueryCoverage=89%, HitCoverage=98%, E-value=1e-145, Identity=52%"; Hit description =Kelch repeat-containing F-box-like protein
  Pfam annotation: Domain name=F-box; Domain location=87-134; Score =40.2; E_value=7.1e-09; Accession=PF00646.23; Description=F-box domain
  Pfam annotation: Domain name=Kelch_1; Domain location=216-261; Score =53.5; E_value=7e-13; Accession=PF01344.15; Description=Kelch motif
  Pfam annotation: Domain name=Kelch_1; Domain location=263-310; Score =54.3; E_value=4e-13; Accession=PF01344.15; Description=Kelch motif
  Pfam annotation: Domain name=Kelch_2; Domain location=216-261; Score =29.5; E_value=1.2e-05; Accession=PF07646.5; Description=Kelch motif
  Pfam annotation: Domain name=Kelch_2; Domain location=263-310; Score =21.9; E_value=0.0023; Accession=PF07646.5; Description=Kelch motif
  Pfam annotation: Domain name=Kelch_2; Domain location=381-426; Score =4.9; E_value=8.7; Accession=PF07646.5; Description=Kelch motif
  Pfam module annotation: Pfam domain module=F-box::Kelch_1::Kelch _1::Kelch_2::Kelch_2::Kelch_2; Domain location=87-134::216-261::263 -310::216-261::263-310::381-426
MVKSVVHVKEGGAGVYLTPISHRACLLSYTCWMLPMPLVLQQLGAEVNFSNIMANTKANQSESSEISPNETSKRQRMSPASVEECPRLIPNLPDELSLQIIARLPRICYYHVRLVSRKWKATITSSELYKVRKELGTTEEWLYLLVRIGQNKLLWHALDPRSRIWQRLPIMPSVVDEEDSQKGSSGLWMWNMVKGIRIAEIIRGLLGQKDALDDMPFCGCAFGAVDGCLYVLGGFSKSSTMKCVWRFDPIQNAWKKVNSMSTGRAYCKTGILNNKLYVVGGVSQAGLIPLQSAEVYDPFSDTWSDVPSMPFSRAGVLPTAFLADMLKPIATGLTSYKGRLYVPQSLYSWPFFVDVGGEIYDPETNSWMEMPNGMGEGWPVKQAGTKLSVVVNGELYAFDPSNSVDSGRIKVYDQGEDEWKVVIGKVPVYDFTESESPYLLAGFHGKLHFITKDANHDISVLKADHCSNVDSSPSTSAPQSPKYMEDELLRESAETHEAVWKLVASKGFEQAELINCQVIDI

SEQ ID NO: 200860 - protein, 162 aa, Glycine max
  Coding DNA Sequence Number=SeqID_84082
  Gene Ontology: Mol. function=structural constituent of ribosome; Cellular component=intracellular; Biological process=translation
MVLQNTNNITDNHKSFRYNDARNKIKAKSKTKTKMFPPYIPLLARTQNLASHMPWVLKRYYTNEGRLILKEEKMKHHEYFRAHRANGRLTLHLVNVPFDGHNEYFEEATPSNTPHDEEVHYHTNIVTIGGGRVKCLNCSSVRTGPTCNIFGLPVLPIRTVHS

SEQ ID NO: 200861 - protein, 40 aa, Glycine max
  Coding DNA Sequence Number=SeqID_84083
NPNRAFRGEALESTRNVTIANGERLNNYIEVRDELLALGD

SEQ ID NO: 200862 - protein, 246 aa, Glycine max
  Coding DNA Sequence Number=SeqID_84084
  Gene Ontology: Mol. function=nucleic acid binding; Biological process= DNA integration
  Homolog annotation: Hit_ID=Q1T010; Match level="QueryCoverage=97%, HitCoverage=26%, E-value=6e-27, Identity=36%"; Hit description =Peptidase S8 and S53, subtilisin, kexin, sedolisin; Integrase, catalytic region; Zinc ...
  Homolog annotation: Hit description=finger, CCHC-type; Peptidase aspartic, catalytic
MASASGYLPTSLLVLTNKNYDRWCAHIRVIFQFQEVTKIVRDGLQEVEKNSFDAQIATHHDAEKRNGKDLFIIHQCVDTNDFKKIVSSNTVKEAWDTLEKAHGGADKLKKVTLYILRRQYELLQMNKGESVAKYVTKLLTITNQMKTNVEQLATLMIVEKGHFVDECRSKQVKDKENKAQLAHDDDSDSEHVLLMLTTKSKGDSSDHWYLNTGCTNHMLGRNVWFIDLNEKVKSKVKFGDNFVDIE

SEQ ID NO: 200863 - protein, 112 aa, Glycine max
  Coding DNA Sequence Number=SeqID_84085
  Gene Ontology: Mol. function=DNA binding; Biological process=DNA integration
  Homolog annotation: Hit_ID=Q1T010; Match level="QueryCoverage=77%, HitCoverage=6%, E-value=2e-18, Identity=47%"; Hit description =Peptidase S8 and S53, subtilisin, kexin, sedolisin; Integrase, catalytic region; Zinc ...
  Homolog annotation: Hit description=finger, CCHC-type; Peptidase aspartic, catalytic
MLPNNLVTEERNLVHLALFIEAEPVTIEETIKDEKWLNAMKKELNSIERNHIGQLVSLPQHKRPIAVKWVYKIKRMPDRIIAKYKTSLCNSRSNNFASSFYQIFQDIVKELE

SEQ ID NO: 200864 - protein, 451 aa, Glycine max
  Coding DNA Sequence Number=SeqID_84086
  Gene Ontology: Mol. function=aspartic-type endopeptidase activity; Cellular component=membrane; Biological process=proteolysis
  Homolog annotation: Hit_ID=Q9LX20; Match level="QueryCoverage=89%, HitCoverage=77%, E-value=1e-110, Identity=49%"; Hit description =Aspartic proteinase-like protein 1 precursor
  Pfam annotation: Domain name=Asp; Domain location=26-375; Score= -80.1; E_value=7.1e-09; Accession=PF00026.14; Description=Eukaryotic aspartyl protease
MGLKEIGDRRELEWMLKKGGNGVLHYTWIDIGTPNVSFLVALDAGSDMLWVPCDCIECASLSADAPFYMGASLMQDRDLNQYRPSLSNTSRHLPCGHKLCDVHSFCKGSKDPCPYEVQYASANTSSSGYVFEDKLHLTSDGKHAEQNSVQASIILGCGRKQTGDYLHGAGPDGVLGLGPGNISVPSLLAKAGLIQNSFSICLDENESGRIIFGDQGHVTQHSTPFLPIIAYMVGVESFCVGSLCLKETRFQALIDSGSSFTFLPNEVYQKVVTEFDKQVNASRIVLQSSWEYCYNASSQELVNIPPLKLAFSRNQTFLIQNPIFYDPASQEQEYTIFCLPVSPSADDYAAIGQNFLMGYRLVFDRENLRFGWSRWNCQDRASFTSPSNGGSPNPLPANQQQTVPNARGVPPAIAGHTSPKPSAATPGLVTTSRHSLASLLLICHLWLWLSC

SEQ ID NO: 200865 - protein, 247 aa, Glycine max
  Coding DNA Sequence Number=SeqID_84087
  Gene Ontology: Mol. function=nucleic acid binding; Cellular component= intracellular; Biological process=chromatin modification
  Homolog annotation: Hit_ID=Q9FMJ5; Match level="QueryCoverage=92%, HitCoverage=80%, E-value=6e-75, Identity=56%"; Hit description =Arabidopsis thaliana genomic DNA, chromosome 5, P1 clone:MDC12
MKKATRIVSIFVISMLCFQELIHVSSSPFLYAHQVYEESSGGRNLKQEQEQEQKHAQEVHCSRERSRAARKVIEEYLTPFMERENYQLSSKCKLHPENDIFTDQEEHKIYIDRHEWRCGYCKKSFREEKFLDQHFDSRHYNFLNLSHGKCLGDLCGALHCDAVMNFKSSRSKCNPAAAARNRHLCENLADNCFPISEGPSAGRLHELFLHQFCDAHTCSGKHKPFSRGGKSYLSKLEVILYLSVGKA

SEQ ID NO: 200866 - protein, 126 aa, Glycine max
  Coding DNA Sequence Number=SeqID_84088
  Subcellular localization annotation: CTP_CleavageSite=19; ConfidenceScore=5.08e-01
MTRATIFTRTGTRPAHQCLASPKSDTYTSYGTSTLILLTLPYSEVSFLSWTTTSWGINPVNQDDPVVVSITIANFMVYMVLTDQGSFTDISYWKTFQRVEVSPDIVHPYTDLNLGFVSSSGNAYIQ

SEQ ID NO: 200867 - protein, 74 aa, Glycine max
  Coding DNA Sequence Number=SeqID_84089
MVSKGWSFDGASMVRKKKGIAILQAVSLVPVPRVSLHPSGPVFEGRQYIYQNAQNETPSVVQRLVLLNFKLHAK

SEQ ID NO: 200868 - protein, 65 aa, Glycine max
  Coding DNA Sequence Number=SeqID_84090
MDGEELPSPVNSDVVKRSRIVLGDGQIPGQIQRQRPIRVNGNVATVCCAMSFPVFRYLGTDTSRG

SEQ ID NO: 200869 - protein, 175 aa, Glycine max
  Coding DNA Sequence Number=SeqID_84091
  Gene Ontology: Mol. function=sequence-specific DNA binding; Cellular component=nucleus; Biological process=regulation of transcription, DNA-dependent
  Homolog annotation: Hit_ID=Q76K81; Match level="QueryCoverage=81%, HitCoverage=50%, E-value=8e-25, Identity=43%"; Hit description=MADS -box protein
MADLENSEKYLVDVLTRVIQRKEYLLSNHLSSYDPSGIQGIPTSFENVGWLQDGNQNHTQIFDASAPLDPLRDLSSTVYGSFSQGTSSNANPRIMGECHVSNPSDGNLQAWPLGYTLYPHHHIQHGMVGPDMTDMMPNGQVNIPITPSHVEQPKNESVEYDQSKQPPPHHQLNAQ

SEQ ID NO: 200870 - protein, 95 aa, Glycine max
  Coding DNA Sequence Number=SeqID_84092
  Gene Ontology: Mol. function=transferase activity, transferring hexosyl groups; Biological process=metabolic process
  Homolog annotation: Hit_ID=Q1RXI0; Match level="QueryCoverage=98%, HitCoverage=20%, E-value=2e-22, Identity=52%"; Hit description=UDP -glucuronosyl/UDP-glucosyltransferase
MHHIRLLKQILTIKNANYLTNGNLDSAIDWIPGLKNITLRDLAGIYRTTDPNDILLDFVVEQIEETSKASTIIQPIFDALEHDVLNALSTMFPKL

SEQ ID NO: 200871 - protein, 73 aa, Glycine max
  Coding DNA Sequence Number=SeqID_84093
  Subcellular localization annotation: CTP_CleavageSite=64; ConfidenceScore=5.67e-01
MNCFSTLVPSGGVYVGFSSSHSSKSSVGFSSIGGSVGSNERFSAVLKTMWDNVGVKRAVSGRFQAGGEREDRV

SEQ ID NO: 200872 - protein, 404 aa, Glycine max
  Coding DNA Sequence Number=SeqID_84094
  Gene Ontology: Mol. function=helicase activity; Biological process =protein amino acid phosphorylation
  Homolog annotation: Hit_ID=Q9LTU4; Match level="QueryCoverage=99%, HitCoverage=30%, E-value=2e-81, Identity=42%"; Hit description =Helicase-like protein
  Pfam annotation: Domain name=DUF889; Domain location=224-404; Score =163.6; E_value=5e-46; Accession=PF05970.5; Description=Eukaryotic protein of unknown function (DUF889)
MLLSNSIERPNHVWSETYLQLEIEELQNLALLEIEDILQSNKKSLKDYPAMPFPRHVVLSHIVEKMMAHVVATFLFFYANTHEQRHIFDSIINAVNRGAGGMFFLYGYGGTGKTFMWKTLASTLRSKGDIMLTIASSWITSLLLPYDKTAHSKFSIPVPTLQNSMSNIHQGTEQAELLKATKLIIWDEAPMAHRYCFEALDKTLSDIMCMSNSDNVPFGGKVVVFGGDFRQILPDIPRGSRSDIVHATINASYLWDYCTVLKLTKNMCLQSNLTLTNSQEIKSFSQWLIDVGDGKLGKSDDGCYEIKIPPDLLITSFTDPIEAIVNHTYPDIQKKYKDEEFLKSRSILATTNEVVDQINDYVLNIIRGEEKGYFSYDSIDMKNAATTKAFEAITLEFLHSLKTS

SEQ ID NO: 200873 - protein, 242 aa, Glycine max
  Coding DNA Sequence Number=SeqID_84095
  Gene Ontology: Mol. function=transporter activity; Cellular component= membrane; Biological process=sodium ion transport
  Homolog annotation: Hit_ID=Q8L7Z9; Match level="QueryCoverage=90%, HitCoverage=40%, E-value=7e-89, Identity=72%"; Hit description =Glutamate/malate translocator
  Pfam annotation: Domain name=Na_sulph_symp; Domain location=3-242; Score=-118.1; E_value=1.1e-08; Accession=PF00939.9; Description =Sodium:sulfate symporter transmembrane region
MDLNSLEWTICKSHARQKLKIYCLKLAEELGVIVPNPWVTCFKAASLPAIVCLLMPLILYKLYPPEIKDTPEAPALAAKKLESMGLVIKNEWIMVGTMLLAVSLWIFGIASAVAAMIGLSILLLLGVLDWNNCWNEKSAWDTLAWFAILVGMASQLTNLGYVSWMSDCVANNLRSFSLSWPASVAVLQAAYFFIHYLFASQTGHVGALYSAVLAMHKAGGVPGILAALALGYNTNLFGAITL

SEQ ID NO: 200874 - protein, 60 aa, Glycine max
  Coding DNA Sequence Number=SeqID_84096
MGHKRDKEVARSMMVTRQSRDSGMAKGRRSKKMWWCHYREEREMQKVIRDMLKLYCPYFY

SEQ ID NO: 200875 - protein, 134 aa, Glycine max
  Coding DNA Sequence Number=SeqID_84097
  Subcellular localization annotation: CTP_CleavageSite=46; ConfidenceScore=5.35e-01
MDVLCLVGTSVKPTKHRGRARKASIAARSIKPSTYFCGRPAMPFRVCFMRSKPLAESLTTVAILLKEGRHPEERYGFLPPRGHPRISSNSSMVGTNWKSPNVKASQGLVVVLGGSINRPNSLMPVVSGLLTLTW

SEQ ID NO: 200876 - protein, 132 aa, Glycine max
  Coding DNA Sequence Number=SeqID_84098
  Gene Ontology: Mol. function=helicase activity
  Homolog annotation: Hit_ID=Q1SRJ5; Match level="QueryCoverage=99%, HitCoverage=16%, E-value=4e-31, Identity=48%"; Hit description =Probable helicase [imported]-Arabidopsis thaliana-related
MVESERLSYIRNNQKKLRVDKYSSLQTSLDTRMAKGLTKGKRVILPSTFVGSSRYMDQLYFDGMAICSHVGFPNLLITLTCNPNWPEIRRLLSPLNLKPTDRPYIVSRIFRLKYEHMLSDLTNGQLIGKVVA

SEQ ID NO: 200877 - protein, 93 aa, Glycine max
  Coding DNA Sequence Number=SeqID_84099
  Subcellular localization annotation: CTP_CleavageSite=42; ConfidenceScore=5.06e-01
MHFMKRCDSSQLNLNFNVQIHWCRNLPFGGRVTRDSRMRLPRKENAQSRHQFEENVEKTGKRCGLRTLSERFGSCIYARGRVFPLLLRIPQLW

SEQ ID NO: 200878 - protein, 126 aa, Glycine max
  Coding DNA Sequence Number=SeqID_84100
MVFGASAASVKFPKTLGKHIPLNIGEREEKKDENQIRKQFRKASVTFPKIKSKYFRNASVSDYVEILHRSSSFFTVLHPFFVRSSVFNGIKTNLTFVHKELRRSDFLIAIKEYVGARETPSSTTKR

SEQ ID NO: 200879 - protein, 70 aa, Glycine max
  Coding DNA Sequence Number=SeqID_84101
KSQLAAFLASAKSKESLAQNLKEVLQLLQQEVEEEPSKKETESSETNDDQEDDPFYQNEDDCFGISLDDD

SEQ ID NO: 200880 - protein, 239 aa, Glycine max
  Coding DNA Sequence Number=SeqID_84102
  Gene Ontology: Mol. function=nucleic acid binding; Biological process= DNA integration
MVLGDFEVSRDRIFISTNQFITSLKEDAQVYMILSNLEVESKVSMSDLPVVREFPEVFTEDLSGLPPGRDRVFYRSSTWCRRFVRPSVSLWEALVLLVKKKDGTMRLCVDYHQLNKLAKQVLQVINTSSSERNTIFYPFSPETLNLPPHSPITTNGHHEPPPLVAGPLHRVEPFDWSETFKTQLMDSVENGALNPPFTVFSRYQGHTETAYKPRFLKTKKSKRRQSRTGSVRGEGRYEK

SEQ ID NO: 200881 - protein, 91 aa, Glycine max
  Coding DNA Sequence Number=SeqID_84103
MVLHEDLHINLRQHSTLQLSKLQGERWLVVWLVNMWRIWYWHKQCVFVGSVSFDSKDMHDVLATSPFIHGQVTHLALFVHMLQALAHGLNF

SEQ ID NO: 200882 - protein, 190 aa, Glycine max
  Coding DNA Sequence Number=SeqID_84104
  Subcellular localization annotation: CTP_CleavageSite=57; ConfidenceScore=5.18e-01
MASERSMLPPLQYDCINNSHEARNSRWASPNLILNTGNQSSTPMVSSAGSSNVIIPMQNLRQNLQIGRELSREEPNETARNFILIEGQVERLWDNQRFEIGEGSSSKRQRTNAPARRGPNTGLALQLPNNAPENQGVQNQNNNNPENHVEIRSNSLYDPVFETLGLAPDPHIRLFEAQNGQAERGYYMFK

SEQ ID NO: 200883 - protein, 277 aa, Glycine max
  Coding DNA Sequence Number=SeqID_84105
  Homolog annotation: Hit_ID=Q47522; Match level="QueryCoverage=17%, HitCoverage=59%, E-value=2e-21, Identity=97%"; Hit description=LacZ protein
LAQGFRLSTGTPDLFILRSDLPSQWLLFLSAVPPVQLLTGWCVTAKAPPDISAGKCSGRVPFAIQAAQLLGRAIGAGLFAITPAGERGMCCKAIKLGNARVFPVTTLNSMFSTERNWTGGREMRMAGGLQSVRVFIPVIVHILETTDMFLASSLSIPSTSRGGPVPAFVPFSEVGKPVVPAALMNRPTRGERRFAYWALAECILAYYVVIDEGVSEVLHVAGEKRLHRCVSRICDTGYIPLPRSLTRYARSFDCGERKWLTNGAEISWKMPGRYLTG

SEQ ID NO: 200884 - protein, 118 aa, Glycine max
  Coding DNA Sequence Number=SeqID_84106
  Gene Ontology: Mol. function=sulfate porter activity; Cellular component=integral to membrane; Biological process=sulfate transport
  Homolog annotation: Hit_ID=P53393; Match level="QueryCoverage=77%, HitCoverage=14%, E-value=3e-33, Identity=77%"; Hit description=Low affinity sulfate transporter 3
  Pfam annotation: Domain name=STAS; Domain location=3-89; Score=46.5; E_value=8.9e-11; Accession=PF01740.11; Description=STAS domain
ILKWVSQDEDDLKETPKGRIQAVILDMTNLMNVDTSGILALEELHKRLLSRGLELAMVNPRWLVIHKLKLALFVDKIGKEWVFLTVGEAVDASEHLYGKGHHAILEGQEYTMHREGGS

SEQ ID NO: 200885 - protein, 491 aa, Glycine max
  Coding DNA Sequence Number=SeqID_84107
  Gene Ontology: Mol. function=sulfate porter activity; Cellular component=integral to membrane; Biological process=sulfate transport
  Homolog annotation: Hit_ID=P53393; Match level="QueryCoverage=96%, HitCoverage=72%, E-value=0.0, Identity=73%"; Hit description=Low affinity sulfate transporter 3
  Pfam annotation: Domain name=Sulfate_transp; Domain location=183-490; Score=491.6; E_value=9.3e-145; Accession=PF00916.10; Description =Sulfate transporter family
MREQGAFHLEEHGQTERSQWVLDSPNPPPLWKKLFSSVKETILPHGNKFCFSSKRKTSHGHALSCLKNLFPIISWLTDYKASMFKDDLLAGLTLASLCIPQSIGYATLAKVAPEYGLYTSVVPPLIYAMMGSSREIAIGPVAVVSILLASLVPKVEDPVANPNAYRNLVFTVTFFTGIFQTAFGVFRLGFLVDFLSHAALVGFMAGAAIIIGLQQLKGLLGLSHFTSKTDVVSVLASVYKSLHNQIASGEKWNPLNFVLGCSFLIFILITRFIGRRNRKLFWLPAISPLLSVILSTLIVYLSRADKHGVNIIKHVKGGLNPSSLHQLQFYGPHVGQAAKIGLICSVIALTEAIAVGRSFASIKGYHLDGNKEMLSMGFMNIAGSLSSCYVATGSFSRTAVNFSAGCQTAVSNIVMAVTVFVSLELFTRLLYYTPVAILASIILSALPGLIDLSEACYIWKVDKLDFLACIGAFLGVLFASVEIGLLVARQN

SEQ ID NO: 200886 - protein, 90 aa, Glycine max
  Coding DNA Sequence Number=SeqID_84108
MLDQFVPFIQGFIHNVVDVKVDSNCGYRSIVALLGMGEDSWPLVSVDKWMDITEMRYVIASRYNVYLKDHCPLLSLALLWSSNCYPQTKQ

SEQ ID NO: 200887 - protein, 112 aa, Glycine max
  Coding DNA Sequence Number=SeqID_84109
MDNHSWCYPACVQCHRRTNIQTGPFTCGCGKDNDQPVLRYRVEIMVTQNNESSKFLLWDRECVELIGETADDVNRVKIELVDLSCFWQDGDLDLNASPQALDKLLGHVLAFK

SEQ ID NO: 200888 - protein, 291 aa, Glycine max
  Coding DNA Sequence Number=SeqID_84110
  Gene Ontology: Mol. function=sequence-specific DNA binding; Cellular component=intracellular; Biological process=regulation of transcription, DNA-dependent
  Homolog annotation: Hit_ID=Q1MEC8; Match level="QueryCoverage=89%, HitCoverage=86%, E-value=5e-75, Identity=54%"; Hit description =Putative AraC family transcriptional regulator
  Pfam annotation: Domain name=AraC_N; Domain location=13-167; Score =113.0; E_value=8.8e-31; Accession=PF06719.3; Description=AraC-type transcriptional regulator N
  Pfam annotation: Domain name=HTH_AraC; Domain location=182-228; Score= 55.7; E_value=1.5e-13; Accession=PF00165.13; Description=Bacterial regulatory helix-turn-helix proteins, araC family
  Pfam annotation: Domain name=HTH_AraC; Domain location=234-278; Score= 16.1; E_value=0.036; Accession=PF00165.13; Description=Bacterial regulatory helix-turn-helix proteins, araC family
  Pfam module annotation: Pfam domain module=AraC_N::HTH_AraC::HTH _AraC; Domain location=13-167::182-228::234-278
MPVTHSRMGAPPARLMFLYLGRSSHPSSLEHIASWTGFALMAQGQKALRMGDDVTHYGPGDLLLVTMDMPVQSCVVLATPEKPCLGVGITINEARLLRYLEHFPPQQIGSAATERSITVHKVAPPLVDAVIRLVALLDQPQDIAALAPLIEQEIFYRLLTGPEGPRILNMALTERPGNKVARAARWLRENFHQPLKVDQLASSVGMSISSLHHHFKAVTAMTPMQYQKQLRLNEARRLMMIEKLDAGTAGYRVGYQSASQFSREYSRFYGQSPARDVRKMAVGPEGLSPPQ

SEQ ID NO: 200889 - protein, 91 aa, Glycine max
  Coding DNA Sequence Number=SeqID_84111
  Gene Ontology: Mol. function=serine-type endopeptidase activity; Cellular component=chloroplast; Biological process=proteolysis
  Homolog annotation: Hit_ID=P56772; Match level="QueryCoverage=79%, HitCoverage=37%, E-value=5e-26, Identity=95%"; Hit description=ATP -dependent Clp protease proteolytic subunit
  Pfam annotation: Domain name=CLP_protease; Domain location=3-79; Score=-89.8; E_value=0.04; Accession=PF00574.13; Description=Clp protease
MNCRDGKAVCINTQKMLVRVMIHQPASSFYEAQTGEFILEAEELLKMRETITRVYVQRTGKPYGYMRRHGKGCFYVSSRSPSSRNCRSCSR

SEQ ID NO: 200890 - protein, 100 aa, Glycine max
  Coding DNA Sequence Number=SeqID_84112
MPLINFWGIRWSWKRGNIASLVRGKARPRDFEEAIGQLLCVLGQDFAQSVTGRRVQIMRTSMTTLTQIWMTLLLNNILHSDHNSDLPLPKCQLVYAILTQ

SEQ ID NO: 200891 - protein, 248 aa, Glycine max
  Coding DNA Sequence Number=SeqID_84113
MAESTKKRKGSSSTTAAAGHRRHRPSEAPTAPVPPSVIILDPKYLDLEFFDGETFDCYQDGILYSEVQNIPIVINQSLFFSLTKLPSQGVPFDSTIVDDWKFDYSSHDARCMVCNDQADMTDRLLAGSLTFDYRIMHYIIVRILQPRSSNLAQASEEDLILMWVFLTSHQIDRAHLDVDSQWICKQDLPPPILDERTPSPPPQRVDSSSLLTEVLTKLRGLRAFVGERFDVMDTRLDAMDARFDGMDT

SEQ ID NO: 200892 - protein, 62 aa, Glycine max
  Coding DNA Sequence Number=SeqID_84114
  Subcellular localization annotation: CTP_CleavageSite=37; ConfidenceScore=5.06e-01
MTFSCNTVRKILVPSMSDGNSSTAALNHKNNMHIMMLAALVFNRKVKQIKDTSTLVLSLTEQ

SEQ ID NO: 200893 - protein, 264 aa, Glycine max
  Coding DNA Sequence Number=SeqID_84115
  Homolog annotation: Hit_ID=Q47522; Match level="QueryCoverage=23%, HitCoverage=83%, E-value=9e-22, Identity=75%"; Hit description=LacZ protein
  Subcellular localization annotation: CTP_CleavageSite=42; ConfidenceScore=5.15e-01
GTSYVPINVSFSPKVGPGLPAVPPVQLLTGWCVTAKAPPDISAGKCSGHAARRVPFAIQAAQLLGRAIGAGLFAITPAGERGMCCKAIKLGNARVFPVTTLNSIFCLQNKMQDIMRMDAALDAMRPLGFRTQLILRTVNELLDVVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 200894 - protein, 182 aa, Glycine max
  Coding DNA Sequence Number=SeqID_84116
MEEPSSVDTRGRNFCVGFNGKTFFRSSSTVCLAEEVLPWDSPEEGFSAVDITTAKKDSFVKSCRRTSSESVTGRTLFLKNKNAQRHFWDFENLLDAPSKSLGVHAFDPPGPHDPVSPAPSPAPESESPAPSPSVPSPESQSPTPSPSVPRPKPKNSSASLAAQSHSLLLLVLLTGILLVYFY

SEQ ID NO: 200895 - protein, 236 aa, Glycine max
  Coding DNA Sequence Number=SeqID_84117
MAPKELEQLTQQIRDQLEESITEKIQPQGLALPPEPEVGPSVARVSIKGSCVDPSSTNPDTGDSDKCGLYIEENLSRLIALGRVYEGSTTVHNIPLLHGQVKVGVEEVKDVEALVPVPTDETAVSPAKPPDRPDHEVMWDATMFGVFNEDFPLYIKHKNLSEIAHGGQSLSISVIQLWILHLTETSMQAGNFDMYGFLERQSIQRSGQSQFESESYMKSWMQSSKCDVYLGAYLNG

SEQ ID NO: 200896 - protein, 39 aa, Glycine max
  Coding DNA Sequence Number=SeqID_84118
MTTVRPQSNLAPLSGSSGPKCSVSHFSRVLYLALPCFSC

SEQ ID NO: 200897 - protein, 100 aa, Glycine max
  Coding DNA Sequence Number=SeqID_84119
MESGGRRRYLRVIHTFRLPGANEPVGAQRLTSPSAPFAIQGQLVRWQAEIPCGHPHLSSTEVNEFDGIKMMFLLSSSEDIQARRHTRFFSDGRGRSSSMA

SEQ ID NO: 200898 - protein, 191 aa, Glycine max
  Coding DNA Sequence Number=SeqID_84120
  Homolog annotation: Hit_ID=Q337Z8; Match level="QueryCoverage=47%, HitCoverage=91%, E-value=7e-13, Identity=41%"; Hit description =Expressed protein
  Pfam annotation: Domain name=DUF1677; Domain location=60-177; Score =178.4; E_value=1.8e-50; Accession=PF07911.4; Description=Protein of unknown function (DUF1677)
  Subcellular localization annotation: CTP_CleavageSite=10; ConfidenceScore=5.07e-01
MAPHGESLASSFSRKSNMPTSSKPPKLSSENLKRTVSDISFELAKEEIDDHLKLPAISEVENANCECCGMCEECTPEYIDRVREKFNGKWVCGLCAEAVKEELEKNGGKKEEAVSAHMSACVKFNKYGRAFPVLFQAQAMKEMLKKNTLDGRRAKSISPRDKGGAKKGGISRSSSCIPAITREINDIKIAN

SEQ ID NO: 200899 - protein, 109 aa, Glycine max
  Coding DNA Sequence Number=SeqID_84121
  Gene Ontology: Mol. function=transporter activity; Cellular component= 1-2nm peptidoglycan-based cell wall; Biological process=transport
  Homolog annotation: Hit_ID=Q7CK71; Match level="QueryCoverage=83%, HitCoverage=42%, E-value=3e-19, Identity=56%"; Hit description =Putative permease of ABC transporter
RQRQRRRRPGRDVDAEQANAEEGKKQLHQQRRALKQLGITANQAGEPATLQQTQKQQRQCHQRAAEKGHQRQQNRPARRQQQVAQDVPVSKRCHAGCAPNHLRPSASSS

SEQ ID NO: 200900 - protein, 500 aa, Glycine max
  Coding DNA Sequence Number=SeqID_84122
  Gene Ontology: Mol. function=transporter activity; Cellular component= outer membrane-bounded periplasmic space; Biological process=transport
  Homolog annotation: Hit_ID=Q6D1F3; Match level="QueryCoverage=49%, HitCoverage=91%, E-value=1e-111, Identity=82%"; Hit description =Putative amino acid ABC transporter, substrate binding protein
  Pfam annotation: Domain name=HTH_6; Domain location=3-125; Score =27.3; E_value=4e-06; Accession=PF01418.8; Description=Helix-turn -helix domain, rpiR family
  Pfam annotation: Domain name=LacI; Domain location=40-62; Score=15.0; E_value=0.086; Accession=PF00356.11; Description=Bacterial regulatory proteins, lacI f
  Pfam annotation: Domain name=SBP_bac_3; Domain location=274-492; Score=175.2; E_value=1.6e-49; Accession=PF00497.10; Description =Bacterial extracellular solute-binding proteins, family 3
  Pfam module annotation: Pfam domain module=HTH_6::LacI::SBP_bac_3; Domain location=3-125::40-62::274-492
MMKQLDERLRSHYPQLSPQEQRIADFVFDHFDDLISYNSAELARLSGVSKATVSRLFKRLGYEKYKDMRDELRTLRQSGMPLTDNRDAVQGNTLLSRHYKQEMANLTQWVNSIDARQFSEVIAALGAARRVFIIGACPGAGIATARPDAGRRAGGHDAGRCGGGDGVSPPATHHSSTDAAAAAERHPGAGAVRTAGAGYSHPGALAALRLGNEPDQPAGQRAAARNAVAGASAHPSDCRSLPAARRAGTPLKGTVLAGSAMADQLQDIQKRGVIRVAVPQDFPPFGSVGTDLQPQGYDIDMAKYLAKQMKLKLQLVPVTSANRVPYLQTDKVDLVISSMGKNAEREKVIDFSRAYAPFFLGVFGPKGETLKDAAALSGKSIGVTRGAVEDMVLSDVAPKDAQVKRYEDNNTTLSAYLSGQVQYVATGNLVVAAIARQNAEKAPVPQFMLKDSPCFIGLKKNEPALKEKVNALIEQGIKDGTLNKLSEEWLKAPLPANLGA

SEQ ID NO: 200901 - protein, 77 aa, Glycine max
  Coding DNA Sequence Number=SeqID_84123
AWPGDQPSSSGGGGASTAQEPVTEEPPSPAPSPAAAEEETTPAQTLQPSPPFAPAPEETQPLPLDLNENQPQEEQDV

SEQ ID NO: 200902 - protein, 329 aa, Glycine max
  Coding DNA Sequence Number=SeqID_84124
  Gene Ontology: Mol. function=protein binding; Cellular component =outer membrane-bounded periplasmic space; Biological process=cell wall organization and biogenesis
  Homolog annotation: Hit_ID=Q9PH64; Match level="QueryCoverage=63%, HitCoverage=86%, E-value=1e-57, Identity=51%"; Hit description =Chaperone protein
  Pfam annotation: Domain name=Pili_assembly_C; Domain location=156 -237; Score=59.3; E_value=1.3e-14; Accession=PF02753.7; Description =Gram-negative pili assembly chaperone
  Pfam annotation: Domain name=Pili_assembly_N; Domain location=27-152; Score=220.4; E_value=3.9e-63; Accession=PF00345.11; Description=Gram -negative pili assembly chaperone
  Pfam module annotation: Pfam domain module=Pili_assembly_C::Pili _assembly_N; Domain location=156-237::27-152
TSDESTLSPGAAAGSVHAALCQNALAGVVVNGTRVIYPAQAREVTVQVDNVGDSPALVQAWIDSGDANQTADTSDAPFVLTPPIARVEPGRSQALRLIFSGAQLPTDRESVFWLNVLDVPPSPDNADSGEQNYLQVAFRSRLKLFYRPQGLKGVANDAPAALRWTRTGDRLRVENPSPFHVTLAEVHAVTGSSEKAVEDKGAMVAPKQSLEFAAPAGTDQVRFITINDYGGRALCLLVAGVACPGWALAAPANLGEQALMAQSGAANARAPESAQFNSSFLSGQAKQVDLAAFSNGNPMVAGNYRVDVYVNGAWQGRRDLQFKADAQGR

SEQ ID NO: 200903 - protein, 465 aa, Glycine max
  Coding DNA Sequence Number=SeqID_84125
  Gene Ontology: Mol. function=transferase activity; Cellular component= cytoplasm; Biological process=translation
  Homolog annotation: Hit_ID=UPI00005F9A0B; Match level="QueryCoverage =90%, HitCoverage=90%, E-value=1e-152, Identity=64%"; Hit description= COG0154: Asp-tRNAAsn/Glu-tRNAGln amidotransferase A subunit and related amidases
  Pfam annotation: Domain name=Amidase; Domain location=24-444; Score =395.4; E_value=8.7e-116; Accession=PF01425.11; Description=Amidase
MTLAALSISQLQQALAQGDLSARDIAQQTLAAIEQHNPAINAWTAVTAQRMLREADRLDQQRQRGEPLPALAGIPYAVKNLFDVAGHSTLAGASLFSERPVAQQDAWAVSKLQQSGALLSGMLNMDAYAYGFTTENTHYGATRNPRDLSRVAGGSSGGSAAAVAAGLVHFSLGTDTNGSIRVPASLCGIFGLKPTFGRLSRSGSHPFVASLDHIGPFARSVEDLSLVYDALQGGDASDAFQAARPAEPVSDRLSAGSEKLRSAVLGGFFADWCSDEARAAVAVAASALGATEEVTLPQAELARSAAFIMTAAEGGNHYLPALRTQPERFEPNSRERLLAGAMLPAAWYVQAQRFRRHFQQQVLPLFDHYDVLVAPATPCTATTIGQETIHINGQDLPTRASMGMLTQPISFLGLPVCSVPLLTASGLPIGLQLIAAPFNEQLALRAAWALQQQGVTLPQTSFMDA

SEQ ID NO: 200904 - protein, 711 aa, Glycine max
  Coding DNA Sequence Number=SeqID_84126
  Gene Ontology: Mol. function=protein serine/threonine kinase activity; Biological process=protein amino acid phosphorylation
  Homolog annotation: Hit_ID=Q1T4M8; Match level="QueryCoverage=84%, HitCoverage=94%, E-value=0.0, Identity=79%"; Hit description=Protein kinase-like
  Pfam annotation: Domain name=Pkinase; Domain location=148-423; Score =48.2; E_value=2e-11; Accession=PF00069.15; Description=Protein kinase domain
  Pfam annotation: Domain name=Pkinase_Tyr; Domain location=148-405; Score=-152.7; E_value=0.0042; Accession=PF07714.7; Description =Protein tyrosine kinase
  Pfam module annotation: Pfam domain module=Pkinase::Pkinase_Tyr; Domain location=148-423::148-405
  Subcellular localization annotation: CTP_CleavageSite=41; ConfidenceScore=5.16e-01
MPVLRSGARKGRAAPKQQQQKQQQSPVVEGEAIATRTRRRRAAAAAAAAVPESNNNNNNTNNQQQQVEQVAVVNENVAVAAREEDNRVAEEEGVVRGGGAEREEVAEKKMGGCDSGGRSNGKANAAGEDDANTPQVPQKIQVGNSPSYKVEKKLGKGGFGQVYVGRRTGGNLNERTGPGAVEVALKLEHRTSKGCTYGPPYEWQVYNTLGGSHGVPQVHYKGRQGDYYVMVMDMLGPSLWDVWNNSNHHMTTEMVACIAIEAISILEKMHSRGYVHGDVKPENFLLGAPGTPDEKKLFLVDLGLATKWRDSTTGSHVEYDQRPDVFRGTVRYASVHAHLGRTASRRDDLESLAYTLIFLLRGRLPWQGFQGENKGFLVCKKKMGTSPETLCCFSPLPFKQFVEHVVNLKFDEEPNYAKYISLFDGVVGPNPDIRPINTEGAQKLIGHKRGRLVMEEEDDEQPKKKIRIGLPASQWISVYNARRPMKQRYHYNVSDTRLSQHIEKGNEDGLYISSVASCQNLWALIMDAGTGFTAQVYELSPFFLHKEWIMEHWEKNYYISAIAGAVNGSSLVVMSKGTQYLQQSYKVSDSFPFKWINKKWREGFYVTAMATSGSRWGVVMSRGAGFSDQVVELDFLYPSEGIHKRWDCGYRITATAATWDQAAFVLSVPRRKPLDETQETLRTSAFPSTHVKEKWAKNLYIASICYGRTVS

SEQ ID NO: 200905 - protein, 505 aa, Glycine max
  Coding DNA Sequence Number=SeqID_84127
  Gene Ontology: Mol. function=nucleobase transporter activity; Cellular component=membrane; Biological process=nucleobase, nucleoside, nucleotide and nucleic acid transport
  Homolog annotation: Hit_ID=Q74S68; Match level="QueryCoverage=96%, HitCoverage=96%, E-value=0.0, Identity=75%"; Hit description =Putative permease
  Pfam annotation: Domain name=Transp_cyt_pur; Domain location=38-473; Score=242.2; E_value=1.1e-69; Accession=PF02133.6; Description =Permease for cytosinepurines, uracil, thiamine, allantoin
MKLRGAGFMPNHSEVTSAVASEANAHYSPRLCNDDLAPTRNQSWSWYNIFSFWMSDVHSMGGYVVAASFFTLGLASWQVLLCLLVGICIVQLCANLVAKPSQMAGVPYAVISRQAFGVFGANIPAVIRGLIAFAWYGIQTYLAANALMLVLLKFYPSLSSMTQSSWLGLSQLGWCCFGVMWLLQAMVFWHGMSAIKRFIDIAGPAVYVVMVALAGWIVYKTGFDGISFTLASKSLSAGEQTWQMITATALVVSYFSGPLLNFGDFSRYGKSMGEIRRGNRWGLPFNFLLFSIVTVVIVSGTQSLFGKMITDPIETVSMVGNDVAVAIGLLTMITATIGINIVANFVSPAFDFSNCSPQKISFRAGGMIAAVGSVLLTPWNLFQSPELIHYTLDVLGSFIGPLFGILIADFYLIKRSKVYVDDLFNDTPKGRYWYRGGFNPKAIAALLPSVGICLVISFIPSLHAVANFSWFIGVALGAGCYRWLARAEREVPQATYRAEVAVQKD

SEQ ID NO: 200906 - protein, 526 aa, Glycine max
  Coding DNA Sequence Number=SeqID_84128
  Gene Ontology: Mol. function=hydrolase activity, acting on carbon -nitrogen (but not peptide) bonds; Cellular component=spore wall (sensu Fungi); Biological process=carbohydrate metabolic process
  Homolog annotation: Hit_ID=Q0JYA9; Match level="QueryCoverage=56%, HitCoverage=89%, E-value=1e-122, Identity=65%"; Hit description =Chitooligosaccharide deacetylase
  Pfam annotation: Domain name=Asp_Glu_race; Domain location=4-202; Score=61.0; E_value=3.8e-15; Accession=PF01177.12; Description =AspGluHydantoin racemase
  Pfam annotation: Domain name=Polysacc_deac_1; Domain location=283 -404; Score=46.5; E_value=9e-11; Accession=PF01522.11; Description =Polysaccharide deacetylase
  Pfam module annotation: Pfam domain module=Asp_Glu_race::Polysacc _deac_1; Domain location=4-202::283-404
MTATIGAAARAVAAPGTEIVAVCPSEGVPSIEGHFDEAIAAVGVLEQVKRGKEQGVSGHIIACFGDPGLLAARELASGPVIGIAEAAMHTATLVATRFSIVTTLPRTLVIARHLLQQYGFSHHCAALHAIDLPVLALEDGSGVAQEKVRERCLQAKREDGSGAIVLGCGGMASLAQDLTKELGLPVIDGVSAAVKMVESLLALGFGTCRMSDVSEKKEYSFNKNYPRDLIGYAGQPPHAQWPGEARVAVQFVLNYEEGAENNVLHGDAGSEQFLSDIIGAASYADRHMSMDSLYEYGSRAGFWRIHQEFQQRGLPLTIFGVAMALARHPQIVEAIKAADYDVVSHGWRWIHYQGMDAKTERQHMQQAVDVLTELFGKAPTGWYTGRDSPNTRRLVVEQGGFSYDSDYYGDDLPFWTQVTCQDGTVKPHLIIPYTLECNDMRFATPQGFNTAEQFYTYLRDTFDVLYEEGATAPKMMSIGMHCRLLGRPGKFRALQRFLDHIQQHDKVWVCTRQQIADHWMKTHPAA

SEQ ID NO: 200907 - protein, 358 aa, Glycine max
  Coding DNA Sequence Number=SeqID_84129
  Gene Ontology: Mol. function=oxidoreductase activity
  Homolog annotation: Hit_ID=O24417; Match level="QueryCoverage=71%, HitCoverage=72%, E-value=2e-10, Identity=24%"; Hit description =Gibberellin 2beta,3beta-hydroxylase
MPDITVDFRAPPPSPVASGRSSTVTNDDVLTEFLEASLRVPDLVLPDKIFPKQNHLEAPPEVDFVSLCFHCDDALRDIVSDSLARIGCFQLLNHGIPLQLMTAVAEAAAGIFQVPPANRVSATRSPEKPWGFEEYHAGEEEGDGSEEFVWCNDHELKSKMDGIWPIGYPNFSEKMEKLKSRIEMVGRKMLGVILKKGSIEFVGSGHEVGTLCCVYKHRRDDHSISSSLKYDVIRMLIRGTDYSHSLCFHVCNGSSQFHVYSKKSWLSFFPQPGALIVTAGDQTQTFSGGEYKHVIGRPIFKGEKEETISMAFLYSTQTTKDNFQTSRGRTISLGQQAILALILPLVYHVINFFYKKLN

SEQ ID NO: 200908 - protein, 1204 aa, Glycine max
  Coding DNA Sequence Number=SeqID_84130
  Gene Ontology: Mol. function=nucleoside-triphosphatase activity; Cellular component=integral to membrane; Biological process=defense response to fungus, incompatible interaction
  Homolog annotation: Hit_ID=Q1T3I2; Match level="QueryCoverage=98%, HitCoverage=98%, E-value=0.0, Identity=61%"; Hit description=AAA ATPase
  Pfam annotation: Domain name=ABC2_membrane; Domain location=510-723; Score=229.3; E_value=8.3e-66; Accession=PF01061.14; Description=ABC -2 type transporter
  Pfam annotation: Domain name=ABC_tran; Domain location=185-408; Score= 55.9; E_value=1.3e-13; Accession=PF00005.17; Description=ABC transporter
  Pfam annotation: Domain name=ABC_tran; Domain location=917-1107; Score=114.0; E_value=4.3e-31; Accession=PF00005.17; Description=ABC transporter
  Pfam annotation: Domain name=PDR_assoc; Domain location=728-794; Score=122.3; E_value=1.3e-33; Accession=PF08370.2; Description=Plant PDR ABC transporter associated
  Pfam module annotation: Pfam domain module=ABC2_membrane::ABC _tran::ABC_tran::PDR_assoc; Domain location=510-723::185-408::917 -1107::728-794
MDGNNFSRSISRSISRSSWKMEEVFASGRYSRRTSHVDEDEEALKWAAIEKLPTYDRLRTSIIQTFAEGDQAGVHKEIDVRKLDVNDRQQIIDKIFKVAEEDNEKFLKKFRNRIDKVGIRLPTVEVRFQNLTVEADSYVGSRALPTLPNVALNLLESALGIFGISTAKRTKLTILKNTSGIVKPSRMALLLGPPSSGKTTLLLALAGKLDSELRVKGEITYNGHKLNEFEPRKTSAYISQNDVHVGEMTVKETLDFSARCQGVGTRYDLLTELARREKEAGIFPEADVDLFMKATAMEGTESSLITDYTLKILGLDICKDTIVGDEMHRGVSGGQKKRVTTGEMIVGPTKTLFMDEISTGLDSSTTYQIVKCLQQIVHLNEGTILMSLLQPAPETFNLFDDIILISEGQIVYQGPREHIVEFFESCGFRCPERKGTADFLQEVTSRKDQEQYWADKNMPYRYVTVTEFANKFKRFHVGIRLESELSVAFDKSSAHKAALVYSKNSVPTMDLFKACWDKEWLLIKRNSFVYIFKTAQIIFIAFIAATLFLRTEMHRKNEDDAALYIGAILFTMIMNMFNGFAELALTIGRLPVFYKHRDHLFHPAWTYTLPNFLLRIPISVFESLVWVGVTYYIIGFAPDASRFFKQLLLVFLIQQMAAGMFRVISGVCRTMIIANTGGALMLLLVFLLGGFILPKREIPDWWVWAYWVSPLTYGFNALSVNEMLAPRWMHPQTSSDKNTTLGLSVLRNFDVYAKKDWYWIGAAALLGFTVLYNVLFTLALMYLNPLGKKQAIISEEDASEMESGGDTNEEPRLVRPPSNRESMLRSLSTADGNNSREVAMQRMGSQATSGLRKVESANDSATGVAPKKGMILPFQPLAMSFDTVNYYVDMPAEMRDQGVTEDRLQLLRGVTSSFRPGVLTALMGVSGAGKTTLMDVLAGRKTGGYIEGDIRISGFPKNQETFARVSGYCEQTDIHSPQVTIRESLLYSAFLRLPKEVSKEEKIQFVDQVMDLVELDNLKDAIVGLPGVTGLSTEQRKRLTIAVELVANPSIIFMDEPTSGLDARAAAIVMRTVRNTVDTGRTVVCTIHQPSIDIFEAFDELLLMKRGGQVIYSGPLGRNSHKITEYFEGLVSSFIPCPWSQAIPGVPKIKEMYNPATWMLEVSSVAAEVRLGMDFAEYYKTSSLFQRNKALVKELSTPPPGATD

SEQ ID NO: 200909 - protein, 115 aa, Glycine max
  Coding DNA Sequence Number=SeqID_84131
MTVRHKEDFTAKLEGDNVKLQKVEGKRKQRKKHGVRQMLLACDGDFRLSYAMMSLFFPIICLSFSYFLSLSTPPPCPLFHISLCRRRPRGKGICEINKGEDRLTCVVEWGVTVRR

SEQ ID NO: 200910 - protein, 588 aa, Glycine max
  Coding DNA Sequence Number=SeqID_84132
  Gene Ontology: Mol. function=oxidoreductase activity, acting on the CH-OH group of donors, NAD or NADP as acceptor; Cellular component =chloroplast; Biological process=malate metabolic process
  Homolog annotation: Hit_ID=Q9M4Q9; Match level="QueryCoverage=99%, HitCoverage=91%, E-value=0.0, Identity=80%"; Hit description=NADP -dependent malic protein
  Pfam annotation: Domain name=Malic_M; Domain location=304-557; Score =462.4; E_value=5.7e-136; Accession=PF03949.5; Description=Malic enzyme, NAD binding domain
  Pfam annotation: Domain name=Shikimate_DH; Domain location=306-413; Score=-20.1; E_value=0.019; Accession=PF01488.10; Description =Shikimate  quinate 5-dehydrogenase
  Pfam annotation: Domain name=malic; Domain location=113-302; Score =402.6; E_value=5.6e-118; Accession=PF00390.9; Description=Malic enzyme, N-terminal domain
  Pfam module annotation: Pfam domain module=Malic_M::Shikimate _DH::malic; Domain location=304-557::306-413::113-302
MENETNGSSTVDDFDVNPIPSGGVRDVYGEDKATEDQFVTPWSISVASGYSLLRDPHYNKGLAFTEKERDAHYLRGLLPPSVISQETQVTKMIRHIRQYEVPLHKYIAMMDLQERNERLFYKLLLDHVEELLPVVYTPTVGEACQKYGSIFMHPQGLYISLKEKGRILEVLRNWPEKNIQVIVVTDGERILGLGDLGCQGMGIPVGKLSLYSALGGVRPSACLPITIDVGTNNQKLLHDELYFGLRHKRATGQEYTELLHEFMNAVKQNYGERILVQFEDFANHNAFDLLEKYRSTHLVFNDDIQGTASVVLAGVVSALKLVGGDLTDHRFLFLGAGEAGTGIAELIALETSKRTNVPLDEVRKNIWLVDSKGLIVSSRKESLQHFKKPWAHEHEPVKELVDAVKEIKPTVLIGTSGQGRTFTKDVIEAMASINEKPIILSLSNPTSQSECTAEEAYTWSQGRAIFASGSPFAPVEYDGKVFVPGQANNAYIFPGFGLGLIMSGTIRVHDDLLLAASEALASQVTQKDYDKGLIYPPFSNIRKISARIAANVAAKAYELGLATSLPQPKDLVKFAESSMYTPLYRGYR

SEQ ID NO: 200911 - protein, 57 aa, Glycine max
  Coding DNA Sequence Number=SeqID_84133
MGYHVEASTSEGPEKRQYLFFPYLIKNVHKFCSSSSQQNPLVGRHNILLKAASMHAH

SEQ ID NO: 200912 - protein, 205 aa, Glycine max
  Coding DNA Sequence Number=SeqID_84134
  Gene Ontology: Mol. function=protein binding; Biological process=two -component signal transduction system (phosphorelay)
  Homolog annotation: Hit_ID=Q9LU15; Match level="QueryCoverage=62%, HitCoverage=100%, E-value=1e-43, Identity=66%"; Hit description =Histidine-containing phosphotransfer protein 4
  Pfam annotation: Domain name=Hpt; Domain location=98-184; Score=52.8; E_value=1.1e-12; Accession=PF01627.13; Description=Hpt domain
MDRNQSRRQVAAMKQSLFDQFFASTSFIGKCKNACQLVVNENYIFHFIRILITFNHKTRESCVMFIAGIALVTMGLLDEQFIQLEELQDDANPNFVEEIVTLHYRDSSRLISSIEQALKERNPLDFNKLDTLMHQFKGSSSSIGAKKVKTECNLFREYCRAGNAEGCMRSFQQLKREYAALRKKLEAYFQLARQAGPQETACRSK

SEQ ID NO: 200913 - protein, 693 aa, Glycine max
  Coding DNA Sequence Number=SeqID_84135
  Homolog annotation: Hit_ID=Q6ZD92; Match level="QueryCoverage=67%, HitCoverage=98%, E-value=1e-113, Identity=49%"; Hit description =Proline-rich protein-like
  Pfam annotation: Domain name=Paf1; Domain location=271-693; Score= -24.5; E_value=1.9e-09; Accession=PF03985.4; Description=Paf1
MASYRPFPPQSSQIPNPIPGGNHQYNNNNNQNQNWGAYGDPSTSSFPQIPPNSNYHQNQHHVPYAPAPSNPHHPPHYPYPPPPPPPPPPEASYQPPPPPPPPAPMYYPSSSQYSNQPPPPPPPLSPPPPPPPVSPPPPPPATQNNNEERRFKEPSKSGRREYEHSNHGIAHKQHKQQQPPLPVKKMNNGPPGRAETDEEKRLRKKREFEKQRQEEKHRQQLKESQNTVLQKTHLLSSGKGHGMIAGSRMGERRSTPLLGAERVENRLKKPTTFLCKLKFRNELPDPSAQPKLMSFKKDKDQYVILLSVVTLHQCVARKYTDKDQYAKYTITSLEKMYKPKLFVEPDLGIPLDLLDLSVYKYCPQFLLVRPPLAPEDEELLRDDEAATPIKKDGIKRKERPTDKGVAWLVKTQYISPLSMESTKQSLTEKQAKELREMKGRGILDNLNSRERQIREIQASFEAAKSDPVHATNKDLYPVEVMPLLPDFDRYDDQFVVAAFDNAPTADSEMYAKMNKSVRDAFESKAVMKSYVATGLDPANPEKFLAYMAPAPGELSKDIYDENEDVSYSWIREYHWDVRGDDADDPTTFLVAFDESEARYLPLPTKLVLRKKRAKEGRSGDEVEQCPVPARVTVRRRSSVAAIERKDSGVYTSSKGNSFKRVGLEMDDGLEDQHRGAPHQDNYQSSGAEDYMSD

SEQ ID NO: 200914 - protein, 388 aa, Glycine max
  Coding DNA Sequence Number=SeqID_84136
MGLGSEVEDDLHRLRYLSSLLHQIDELVVQAIEVNYCNNKTISKEGKTQIESFSRVLSDMLSSLEPWVPKIQKALNPQNTVSDDETIECDSPEETTLNLVSPSPLVSWRANCTVERGRQMFMLTPLPLSSKHHQPKPHFPPPTTSSTTTFKDSVMVKPTPIKQQLPNNQDGSMLLMMTPCLKMSPPRSCLLLEPISEISRLGDRNARKGTPYPVGIHCSDSESSSSDDSSRDLSLMYPELLGIHKSGIGKKTVEASPDWFTSPPKTCVLLEPPDEKIDEHLCVQIADSILNEQVSKFEDDDVSKDHDQAKKSCNQDHFVGNLSHVKSTPLPESSFQTGKCPGENTLKKELWTKFEAASTWGCQPKVPTGQKSAHKGFLDLLEEASCDE

SEQ ID NO: 200915 - protein, 124 aa, Glycine max
  Coding DNA Sequence Number=SeqID_84137
MTQLLQKFSRVRSNFEHPILISYSGILNSFKNEGILEFLVAFTEELGRAIVVVRGGGEVGDSGLGLDVGEVAEAKKGGIVECEVGLGGKDNEEVEAVGVETVKLTLIAEARDDGLDAHERRKLL

SEQ ID NO: 200916 - protein, 114 aa, Glycine max
  Coding DNA Sequence Number=SeqID_84138
  Gene Ontology: Mol. function=protein serine/threonine kinase activity; Biological process=protein amino acid phosphorylation
  Homolog annotation: Hit_ID=Q1EP39; Match level="QueryCoverage=41%, HitCoverage=34%, E-value=7e-14, Identity=75%"; Hit description =Protein kinase family protein
  Pfam annotation: Domain name=LysM; Domain location=42-85; Score=26.7; E_value=8.1e-05; Accession=PF01476.10; Description=LysM domain
MDAYDGLAFLPNTTRMARNGAVVSLTLFCGCSSGLWNYLVSYVMRDGDSVESLASRFGVSMDSIESVNGIGNPDNVTVGSLYYIPLDSVPGDPYPLNNAAPPVPVPSPSFDNFS

SEQ ID NO: 200917 - protein, 39 aa, Glycine max
  Coding DNA Sequence Number=SeqID_84139
MEGGRTGMPKKARDSLVEDEILIVSTSVTRPTIIITPFN

SEQ ID NO: 200918 - protein, 293 aa, Glycine max
  Coding DNA Sequence Number=SeqID_84140
  Gene Ontology: Mol. function=hexokinase activity; Cellular component =integral to membrane; Biological process=glycolysis
  Homolog annotation: Hit_ID=Q9FVD3; Match level="QueryCoverage=99%, HitCoverage=58%, E-value=1e-123, Identity=73%"; Hit description =Hexokinase
  Pfam annotation: Domain name=Hexokinase_2; Domain location=47-289; Score=254.8; E_value=1.8e-73; Accession=PF03727.6; Description =Hexokinase
VGQDVVAELTKAIRRQGLDMRVNALVNDTVGTLAGGRYTNSNVIAAIILGTGTNAAYVERVQAIPKWHGPLPDSGDMAINMEWGNFRSSHLPLTEYDCALDAESFSPGDQIFEKMTSGLYLGEIVRRVLCKIAEEAFFFADNVPPKLKIPFILSTPDMCAMHHDSSTDLNVVGSKLKNILEISDTSLEVRKVVVEICNIIATRGARLSAAGILGILKKLGKDTKSEVEGQKNVIAMDGGLYEHYTEYSKCLENTLKELVGEDISESIIIEHFNDGSGVGAALLAASHSQYLDA

SEQ ID NO: 200919 - protein, 272 aa, Glycine max
  Coding DNA Sequence Number=SeqID_84141
  Gene Ontology: Mol. function=DNA binding
  Homolog annotation: Hit_ID=Q1S0F5; Match level="QueryCoverage=86%, HitCoverage=47%, E-value=2e-17, Identity=31%"; Hit description=IMP dehydrogenase/GMP reductase
MARIAGGEYQGSAWRRRLKLWPVKESEHHSSTLVDLAAIDTFLAYHHSKESPVIAVLADAYDTFDLRCEKSSARIVYCTPAFYVWLVSHVFNHESRSVCPLQGHRICVEKDKANWEELLAGMTRASISWFPWWKEGGEGVLCSCEGFPNVPWMGTRGCINYNPMLAIRQLGYPMRGAPSEETIAPFITRGFNEANVKTLQRIYKEWNKAERKDKELSGSSQGVIGSYHKWLKSRTQGITWLPKLKFLSGEEAEMLELSEDVQALKAELEHTR

SEQ ID NO: 200920 - protein, 65 aa, Glycine max
  Coding DNA Sequence Number=SeqID_84142
MARTAPFEVKDSFYVNNKSADNKKQADTTIVEVKEAATTTIEIKEKMDIDSIKEKKKKMDIDTIE

SEQ ID NO: 200921 - protein, 135 aa, Glycine max
  Coding DNA Sequence Number=SeqID_84143
MGNDSVTLVKNIVASGNEVFQHELQQQLQCTDQFTFFFFWGFILKPNAMLGMVLDSAEKVLSEAVQEPEIESTIDSLDISGNVWKWQLFKWRKKRASNLGLLDRSSMQIGTDLHQAEELELRFVSLCTVCIFLCI

SEQ ID NO: 200922 - protein, 50 aa, Glycine max
  Coding DNA Sequence Number=SeqID_84144
MRRLLSLGEAAISTMYGGCGRDESEGRMTIILGRQREKGIFGLKDAQELR

SEQ ID NO: 200923 - protein, 540 aa, Glycine max
  Coding DNA Sequence Number=SeqID_84145
  Gene Ontology: Mol. function=polynucleotide adenylyltransferase activity; Cellular component=nucleus; Biological process=RNA polyadenylation
  Homolog annotation: Hit_ID=Q5Z7G3; Match level="QueryCoverage=90%, HitCoverage=65%, E-value=0.0, Identity=78%"; Hit description =Putative poly(A) polymerase
  Pfam annotation: Domain name=NTP_transf_2; Domain location=73-170; Score=35.7; E_value=1.6e-07; Accession=PF01909.13; Description =Nucleotidyltransferase domain
  Pfam annotation: Domain name=PAP_RNA-bind; Domain location=361-497; Score=191.6; E_value=1.9e-54; Accession=PF04926.5; Description =Poly(A) polymerase predicted RNA binding domain
  Pfam annotation: Domain name=PAP_central; Domain location=11-360; Score=543.7; E_value=1.9e-160; Accession=PF04928.8; Description =Poly(A) polymerase central domain
  Pfam module annotation: Pfam domain module=NTP_transf_2::PAP_RNA -bind::PAP_central; Domain location=73-170::361-497::11-360
MGGSEGVGASSKQFGVTKPISMAGPTVTDLQRTRELEKFLAVSGLYESKEEAAKREEVLHRLGEIVKNWVKQLTRLRGYTDQMVEDANAVILTFGSYRLGVHGPGADLDTLCIGPSYVNREEDFFYTLHDILANIEEVTELQPIPDAHVPVMKFKFDGISIDLLYASISRLIVPEDLDISDVSVLHNVDEPTVRSLNGCRVADQILKLVPNVEHFRTTLRCLKFWAKRRGIYSNVTGFLGGVNLALLVARVCQFYPKAVPSMLVSRFFRVYTQWRWPTPVMLCPIEENDLGFPVWHPGKNPRDRSHHMPIITPAYPCMNSSYNVSMSTLRVMMEQFQYGNKICGEIELSKDCWKALFEKYSFFESYKNYLQVDVVAADADDLRSWKGWVESRLRQLTLMIERDTFGKLQCHPYHHEFVDTSRQCAHCAFFMGLHRKEGEVVQEGQQFDIRGTVEEFRHSVNMYMFWKPGMEIYVSHVRRRQIPCYVFPDGYKRSRPSRPTSQFENCKSFHNNEVSVTEHVERIRKRKNNDGVGCEGGCYS

SEQ ID NO: 200924 - protein, 402 aa, Glycine max
  Coding DNA Sequence Number=SeqID_84146
  Homolog annotation: Hit_ID=Q9LK76; Match level="QueryCoverage=94%, HitCoverage=91%, E-value=6e-65, Identity=40%"; Hit description =Arabidopsis thaliana genomic DNA, chromosome 3, P1 clone: MDC8
  Pfam annotation: Domain name=IQ; Domain location=114-134; Score=32.1; E_value=1.9e-06; Accession=PF00612.17; Description=IQ calmodulin -binding motif
  Pfam annotation: Domain name=IQ; Domain location=136-156; Score=20.5; E_value=0.0059; Accession=PF00612.17; Description=IQ calmodulin -binding motif
  Pfam annotation: Domain name=IQ; Domain location=162-182; Score=3.9; E_value=16; Accession=PF00612.17; Description=IQ calmodulin-binding motif
  Pfam module annotation: Pfam domain module=IQ::IQ::IQ; Domain location=114-134::136-156::162-182
MGKASRWLKGLLGMKKEKDHSDNSGSLAPDKKEKKRWSFAKPPPSSVPATDNNNTWLRSYISETENEQNKHAIAVAAATAAAADAAVAAAQAAVAVVRLTSQGRGALFSGSREKWAAVKIQTFFRGYLARKALRALKGLVKIQALVRGYLVRKRAAATLHSMQALIRAQTAVRTQRARRSMSKEDRFLPEVLARKPVERFDETRSEFHSKRLPTSYETSLNGFDESPKIVEIDTYKTRSRSRRFTSTMSECGEDMSCHAISSPLPCPVPGRISVPDCRHIQDFDWYYNVDECRFSTAHSTPRFTNYVRANAPATPAKSVCGDTFFRPCSNFPNYMANTQSFNAKLRSHSAPKQRPEPKKRLSLNEMMAARNSISGVRMQRPSSNFFPDSRRILEFFTITRNI

SEQ ID NO: 200925 - protein, 98 aa, Glycine max
  Coding DNA Sequence Number=SeqID_84147
MYHQLFQIKFQYLALRVDKRAGSSLIRSTCWWLHDGGAVVAQGKRNDPCDDNRCYTMHTPKEIHARRTGGTVVNACVAVAMIVRCNVRCGGSDGEEGT

SEQ ID NO: 200926 - protein, 43 aa, Glycine max
  Coding DNA Sequence Number=SeqID_84148
MSNRLSLIAIKRTIFGHLLSGLLEKATTKKFFDALGKRYQVME

SEQ ID NO: 200927 - protein, 198 aa, Glycine max
  Coding DNA Sequence Number=SeqID_84149
MNEIEKVQEQMKADMEALKEKMATMVEAMMSIKEIVEVSAAYQTRARARVMGEVEKVQEQMKADMEAMKEQMATMMEAIISMKKIREVDTVAVAATSAVAKVNPVPPFGLNQMNHPTSNMVGKDLGSTDGPMMCKFKTSMPSHHMACLPTIHHPMWHTLSMKISITPLRYSLRTNNPKLIMHMSLKPWGRHMKFPITI

SEQ ID NO: 200928 - protein, 110 aa, Glycine max
  Coding DNA Sequence Number=SeqID_84150
MEGLVDLAAIDAFLAFHHGKESPVVAILAMYDTFDRGCEKSSARIVCCALALYVWLVSHLFSPRRSQELPRLLAKAKAVADTYSAPEEIHGLLSYCQHMIDLMDHMIRNR

SEQ ID NO: 200929 - protein, 56 aa, Glycine max
  Coding DNA Sequence Number=SeqID_84151
MNPCGIGNIRCAYAMSGLSEIMNKRWIARVKTSVKVCEPASIGNCGLNNGRTSREY

SEQ ID NO: 200930 - protein, 85 aa, Glycine max
  Coding DNA Sequence Number=SeqID_84152
  Homolog annotation: Hit_ID=Q7XZD1; Match level="QueryCoverage=52%, HitCoverage=32%, E-value=7e-07, Identity=73%"; Hit description =Succinate dehydrogenase iron-sulfur protein subunit
MQVHGPQHVHQDQKWDMPLVSHILSRVPSVPIKDKGIYNSCMMNIQDCNNLACLTDNNVAVTLVRDKGFGSRHDELLQPISQAKK

SEQ ID NO: 200931 - protein, 87 aa, Glycine max
  Coding DNA Sequence Number=SeqID_84153
MPKLIYCLINDVVIIEGSSVATIVALAMVLAIGTDATTTRNELKVDVGMLDIGCVTINAVGTIVVVVIRNDGIPNFFQKVDAYTDVN

SEQ ID NO: 200932 - protein, 284 aa, Glycine max
  Coding DNA Sequence Number=SeqID_84154
  Gene Ontology: Mol. function=transferase activity, transferring glycosyl groups; Cellular component=membrane; Biological process =cellulose biosynthetic process
  Homolog annotation: Hit_ID=Q6J8X1; Match level="QueryCoverage=99%, HitCoverage=39%, E-value=3e-36, Identity=80%"; Hit description =Cellulose synthase
LSGQICQIYGDELEVTVNGEPFVDCNECAFPVCRPCYEYERREGNRVFPQCKTKYKRIKGSPRVEGDEEEDDTDDLESEFDIGMSLFNVTINDGDAVQPRPMDPKKDIVVYVYGSVAWKERMEDWKKKQSEKLLVVRHEGDKDSDELDDPDLPNGPYEGTSTHYCKHNYVYPCYGLSGGQGCMLEIDFSVVLFSAIPVLSTYTGTTGKGAAEKPGPACYVSNDGAAMLTFEALSGTYDFARKWVPFYKKFCIKPRAPKWYFAQKVDYLKDRVDAAFIRERHAIK

SEQ ID NO: 200933 - protein, 122 aa, Glycine max
  Coding DNA Sequence Number=SeqID_84155
  Gene Ontology: Mol. function=exonuclease activity; Cellular component= intracellular
MGLFLVKIEHVVDIEFPILLVQEHVLESEMSRLLRHKIPNTVNNETLHKIVLGDFKIELKPSRRGQGVNYSALEIFKIPQEADEAYENVQGSQLKRALEMHEAVDVSKTTKMDPKIEEDMPP

SEQ ID NO: 200934 - protein, 103 aa, Glycine max
  Coding DNA Sequence Number=SeqID_84156
  Homolog annotation: Hit_ID=Q1S5Z7; Match level="QueryCoverage=47%, HitCoverage=4%, E-value=7e-11, Identity=69%"; Hit description=DNA topoisomerase II; Serine/threonine-specific protein phosphatase and bis(5-nucleosyl)-tetraphosphatase
VAKCNVLMVEVGSWVFVVVIVEDRVMRSIWVMVWCLEMKVEGEGREGKNDGSRGLETSPVVELRLAPTYIVVNAILEKKEDELGSRCGHLLTAVEAIGEEGTP

SEQ ID NO: 200935 - protein, 153 aa, Glycine max
  Coding DNA Sequence Number=SeqID_84157
  Homolog annotation: Hit_ID=Q5Z9H6; Match level="QueryCoverage=45%, HitCoverage=16%, E-value=7e-14, Identity=51%"; Hit description =Nodulin-like protein
MEGVLVSGGELWKAHVSMVMVQLFSGGYHVISKLALNVGVNRIVFCVLRDLIALLILSPLAYIRENHKRDDLKITSCLQDQGTDLSKKCLSSKPTLDVPNDKRIHRLWIFVMVSTQSKNASATATYSSPVTKATTCPTMEENVQLAEFMEMPR

SEQ ID NO: 200936 - protein, 214 aa, Glycine max
  Coding DNA Sequence Number=SeqID_84158
  Gene Ontology: Mol. function=hydrolase activity; Cellular component =membrane; Biological process=auxin mediated signaling pathway
  Homolog annotation: Hit_ID=Q9FHJ9; Match level="QueryCoverage=76%, HitCoverage=46%, E-value=1e-49, Identity=61%"; Hit description =Nodulin-like protein
  Pfam annotation: Domain name=DUF6; Domain location=24-137; Score=3.6; E_value=0.041; Accession=PF00892.11; Description=Integral membrane protein DUF6
MAAVSGGGGTEIWKAHTAMAMVQLFNGGYHVITKVALNVGVNQIVFCVFRDLIALAILAPLAYIREKIFGNHLLFLIGLSYTNPTYAAAIQPATPVFTFLLAVMMGTERVNLLRYEGLAKVGGTFSCVLGAVLMVLYRGPALIGYSETDFVSHSEISAKGQPEPSGCNTMTVAGTAGEKCFLPLRILKGLGKSSLNEKIKHGQQSKWWFWKANE

SEQ ID NO: 200937 - protein, 62 aa, Glycine max
  Coding DNA Sequence Number=SeqID_84159
  Gene Ontology: Cellular component=membrane
  Homolog annotation: Hit_ID=Q8GW30; Match level="QueryCoverage=79%, HitCoverage=14%, E-value=5e-15, Identity=76%"; Hit description =Putative nodulin
MGIPWDLLHLPLIMDSLHGATRSWGQPWLLFIIHFNLELLLSYPEFFLEVQFTWEGTFSITS

SEQ ID NO: 200938 - protein, 70 aa, Glycine max
  Coding DNA Sequence Number=SeqID_84160
MDFVVAFALLCLFTMEPWRVLSQQQQRLLVNMTLVPNARASGALGESDIFCSLFGRKFTGVSLAQRIWSW

SEQ ID NO: 200939 - protein, 420 aa, Glycine max
  Coding DNA Sequence Number=SeqID_84161
MNYDHVYTIFVAYEALPPDAIVALDTPSWTRPVYPNLVKMGPHWIPNGTTKTIHPSLMVVEEKQKKATTSSDPSDKVLNTLPATAINMDPSKENPIPQTQWSKEVDICTLHTKSIPSNPTCLRPSKQDLDMIGDILKQMYIPNQATTYPSGLHISKCTNFKMVSNKTCPRLRIYDEGKKKCFKLCFNEEMLSGGQKTRLVNHSRCKSLKFYTGAYFKSKGFHSSVASNQVYHFDDAKTCFVNNPEDDFLECLKKMPIILYHRIFDIKKMSMKKLEACVQHLHGLQQTNNAKKQRERPIQKTDAKLLSRERLKQRRKRLDQATLKVVESTPIPIVEKPKNKVDEAPTEPTSNEAISKDTNVVIVHTTLLRSKGLRMMSLDPPPQTTLPQTLSPPPTHSDTPPPPNHPPPSQPPPHLTQDQQ

SEQ ID NO: 200940 - protein, 132 aa, Glycine max
  Coding DNA Sequence Number=SeqID_84162
MTNSSKNTAPTMTIITTNTTTVHTERESTIHIEHFFNKAISMIHNMRNAKLKGWKTIVSKVLGKEVVLPMESIAYVTWCVREGSTYQEDWEKTYDSHVPKDLYGKNLKEADEKRKVQYNFLCDMAKVWYNIT

SEQ ID NO: 200941 - protein, 620 aa, Glycine max
  Coding DNA Sequence Number=SeqID_84163
  Gene Ontology: Mol. function=hydrolase activity; Cellular component =membrane; Biological process=cell-cell signaling
  Homolog annotation: Hit_ID=Q1SEI2; Match level="QueryCoverage=97%, HitCoverage=80%, E-value=0.0, Identity=61%"; Hit description =Nucleoside phosphatase GDA1/CD39
  Pfam annotation: Domain name=GDA1_CD39; Domain location=79-547; Score= 89.6; E_value=9.9e-24; Accession=PF01150.8; Description=GDA1CD39 (nucleoside phosphatase) family
MVFGKHPGVKNHLRISSSLQDLSSYRYDLEHGPTPNNFTSSFSKTKPVQLPNPVRRKHLFLFPILILLLFLLLFFLYTLYSHHSSPKYYVVLDCGSTGTRVYVYRAQIQHNDKKTTLPISIQSLKDGLRKNPSSGRAYDRMETEPGLDKLLHNRTGLKTALVPLLKWAQKQIPETSHKTTSLFLYATAGVRRLPFDDSKWLLDNAWSFLKSSSPFVCKRDWVKIISGTEEAYFGWIALNYDSGILGVKPRRETYGALDLGGSSLQVTFEGNSNKEPQHLFNSETSLYVRIGSVNHHLTAYSLAGYGLNEAFDKSVAHVFKEFGYGMEDVVKGNLEVKHPCLQIGYKERYSCSHCSSAVKKGGESLMVEGNGNVVGKKEGGSRTVVTLVGAPNWLKCSTLAKVAVNLSEWSDVRPGLDCEVHPCALRGNLPQPMGHFYVISGFFVVYRFFNLTAEATLEDVLEKGREFCDKRWDVARKSVAPQPFIEQYCFRAPYIASLLREGLHITDKHITVGSGSITWTLGVALLEAGKAYSVRFGLRGFYLLQMKMNPLILIPILILSFILLLCALSWVVNWMPRFFRRQYLPFFRHNSASSASGINIPSPFRFQRWSPMNSGKLRVK

SEQ ID NO: 200942 - protein, 82 aa, Glycine max
  Coding DNA Sequence Number=SeqID_84164
MYLLGITNQLNRKPALDHGSGAGVPAPPFSADTSFFCFVHRIPMLQALSLISYNYRDTCSHLTHLPFSDHCYNNIYSMQVVN

SEQ ID NO: 200943 - protein, 53 aa, Glycine max
  Coding DNA Sequence Number=SeqID_84165
MKKKQSKRRKQNDEERKPVAEEMTQLEAVAFKLQTDITIKALSTGHPKCPKTL

SEQ ID NO: 200944 - protein, 40 aa, Glycine max
  Coding DNA Sequence Number=SeqID_84166
MKAVDYGVHKLWEANNVGLGIYRMMPQRNNLLKSARRLAQ

SEQ ID NO: 200945 - protein, 152 aa, Glycine max
  Coding DNA Sequence Number=SeqID_84167
  Gene Ontology: Mol. function=oxidoreductase activity; Cellular component=integral to membrane; Biological process=electron transport
  Homolog annotation: Hit_ID=Q75LK7; Match level="QueryCoverage=67%, HitCoverage=19%, E-value=3e-40, Identity=71%"; Hit description =Putative cytochrome P450
MIKRNDDITASVAEFDAWPFEEEHRRIIENRKSGTNLTWSEVNNMPYTAKVISETLRRATILPCFSRKASQDFEINGYKVRKGWSINLDVVSIHHDPEVFSNPEKFDPSRFDEPLRPFSFLGFGSGPRMCPRMNLAKLEICVFIYHLINKYT

SEQ ID NO: 200946 - protein, 129 aa, Glycine max
  Coding DNA Sequence Number=SeqID_84168
MTFPTDLRIKKETVATYPSAGGRRETRGMRVPRKEYARSRHQRLFEENVGKTGKYAIYELLSERLGSCIYARGRHQRLFEQKERNVKAFGPLTISWGGRQKRGFCSYVSSIAMRKSDLRSSCKSGKVTC

SEQ ID NO: 200947 - protein, 386 aa, Glycine max
  Coding DNA Sequence Number=SeqID_84169
  Gene Ontology: Mol. function=helicase activity; Biological process =viral genome replication
  Homolog annotation: Hit_ID=Q2R1R7; Match level="QueryCoverage=92%, HitCoverage=22%, E-value=1e-66, Identity=41%"; Hit description=AT hook motif-containing protein, putative
SSSNFMTPFEDCQSPTNQPVINTEGYSDLGDQLIQCRYCNAQMWYDERISKNKNCLNPRFSLCCGDDKVELPLLQNPPQYLQQLLFHDDTIDSKNYQHNSRAYNMMFAFTSARIKLDKTINNSRGPPTIRIQGQPCHRIGSLLPMPRKKPKFAQLYIFDTENEVQNRINVMSQYSRIQNHIVSALSHMFDQHNSHAKSFRMPRDRLATDQANNIKLQLIAARGKDGRVYNMPNVPEIAALIVGDFHPGSKRDIIVETQNVELQRIHELHPSYLPLQYPLLFPYGEDGYRADILHRFTSSSKKRKRNRLTMREWFAYRLQSRSNEAQTLLHSRKLFQQFIVDGYTMVESERLSYIRNNQKKLRVDKYSSLQTSLDTGTAKGLTKGKR

SEQ ID NO: 200948 - protein, 477 aa, Glycine max
  Coding DNA Sequence Number=SeqID_84170
  Gene Ontology: Mol. function=sulfate porter activity; Cellular component=integral to membrane; Biological process=sulfate transport
  Homolog annotation: Hit_ID=P53393; Match level="QueryCoverage=94%, HitCoverage=70%, E-value=1e-175, Identity=71%"; Hit description=Low affinity sulfate transporter 3
  Pfam annotation: Domain name=Sulfate_transp; Domain location=185-477; Score=435.2; E_value=8.6e-128; Accession=PF00916.10; Description =Sulfate transporter family
  Pfam annotation: Domain name=YibE_F; Domain location=197-396; Score= -145.8; E_value=0.042; Accession=PF07907.2; Description=YibEF-like protein
  Pfam module annotation: Pfam domain module=Sulfate_transp::YibE_F; Domain location=185-477::197-396
MSSAPSMRVSEQEHFHLEDTSDIERSIWVLNPPNPPPLRNKLFSPLKKTVSFFSSKKKTCLGHAVSFLESLFPILTWFTNYKASKFKEDLLAGLTLASLSIPQSIGYANLAKLDPQYGLYTSVVPPLIYAVMGSSREIAIGPVAVVSLLLSSLVPKVVDPAVDPDAYRNVVFTVTLFAGIFQAAFGIFRLGFLVDFLSHAALVGFMAGAAIMIGLQQLKGLLGITHFTNKTDVISVLESVYKSLHQQITSGEKWYPLNFVIGCSFLIFLLIARFVGRRNKKLFWLPAIAPLLSVILSTLIVYLSKADKNGVNIIKHVKGGLNPSSVQQLQFHGPQVGQAAKIGLISAVIALTEAIAVGRSFASIKGYHLDGNKEMLAMGCMNIAGSLSSCYVATGSFSRTAVNFSAGCQTSVSNIVMAVTVFLCLELFTRLLYYTPVAILASIILSALPGLIDISEACYIWKVDKFDFLACIGAFLG

SEQ ID NO: 200949 - protein, 248 aa, Glycine max
  Coding DNA Sequence Number=SeqID_84171
  Homolog annotation: Hit_ID=Q9ZVD2; Match level="QueryCoverage=87%, HitCoverage=82%, E-value=2e-17, Identity=29%"; Hit description =Expressed protein
  Pfam annotation: Domain name=Hin1; Domain location=102-236; Score =55.9; E_value=1.3e-13; Accession=PF07320.4; Description=Harpin -induced protein 1 (Hin1)
MEERVSSSSLPSPSPPPLEKNHNTDKLKLPDLDPGTYVVQVPKDQVYRVPPPENAQIAESHKKSPPNKEAKTSRCCLCCVLFFIIFLVLAILLGAVLGGLFSMLLTPEDPKFSITSFKVVETKPHPKYDVTLEVHNPNSDVGILYNGKGHVSLSLRRQENIASGAYPTFRQDSHDTTTFGLTLTSSSKAGLPKEVEESVRNDKKKVSVTFSLAIHALAHMKMGLLRSGTMKFDVTCKVKLDTLAKTTH

SEQ ID NO: 200950 - protein, 196 aa, Glycine max
  Coding DNA Sequence Number=SeqID_84172
  Gene Ontology: Mol. function=RNA-directed DNA polymerase activity; Cellular component=nucleus; Biological process=RNA-dependent DNA replication
  Pfam annotation: Domain name=RnaseH; Domain location=18-157; Score= -33.2; E_value=0.071; Accession=PF00075.14; Description=RNase H
MQNILSLKCVKVVWRPLPEDWLKWNVDGSVVLIGLGPSLVLNGSKASCGGVLRNCFGAWISGFLRNIGTTYVLSAELWGIFSTLDISWRVGHRRVLVECDSKVTAKLMSKGCLSSHPYSPLIHSIQRFFSRSWVLRVNHVYRKRNAVADSLAALAHSKPIGLFLLQSHPPLCSSLLLKDLVAGPIVRAVAFVALVM

SEQ ID NO: 200951 - protein, 257 aa, Glycine max
  Coding DNA Sequence Number=SeqID_84173
YPPLYENQDHHHPQLMMPNGLGQQSGAFLQQWSQGLPNQNSEYNQRMNTHNLQRESNTSSQASQSRILGHSSNGTIEGTSSQVFSTREAEIAPVSRAQPSEAIRRILDMNPTRLVTHAPTNNMQIGRCTHNYDLGNQLLSLREIRYEPPRRGRPRKRRDDEEESSSQSGKKRSEPPRRGRPRKQRDDATESFSQRGKSRKVSSKAQKAETTYASQQIPQQTPDSVMNTDQNAILTNTVYDMEFETKGIPPPPPPPEN

SEQ ID NO: 200952 - protein, 252 aa, Glycine max
  Coding DNA Sequence Number=SeqID_84174
  Subcellular localization annotation: CTP_CleavageSite=70; ConfidenceScore=5.19e-01
MERQKQAKTIVPTSHEEFSISSTPESTAAPTLVPNPLTLSLSNSSTSLISGTQSSHPFLSPDGLALEGVVSSTQGQDMTQTGHFNQFIDMQNEISFALQGTKQSTLGTKHNPNPNNPHFVPNTIENNNFNGVNPALFNPNPVHARPENHQFSNSDFYGARYATNYTQSPQPFNTMQNQQVGHASGMQQMFDLQSQNPMRLEPYSNLEPVVATMPPNPAQQGYRSVLADPAAPSASILATTRNSFGHRSSMPP

SEQ ID NO: 200953 - protein, 98 aa, Glycine max
  Coding DNA Sequence Number=SeqID_84175
  Subcellular localization annotation: CTP_CleavageSite=19; ConfidenceScore=5.66e-01
MMIGSRHATSTSPHPSRTPSSPPSPLLFSTSQPYSNCDPDLSNLNRLSVWSLISLEGPDVLEKGGPKMHQRFEDGFQGRIYAGHKLASVNTFFMVFGG

SEQ ID NO: 200954 - protein, 131 aa, Glycine max
  Coding DNA Sequence Number=SeqID_84176
MRGCISYNPVLAIRQLGYPMRRAPLEEEIVPVISRGFNKTNVETLQKVCKAWEVVRKKDKELRGSNNGPIDGYREWLRAHVQGLDWLPSLRTAKREEVEAPEEDEEVQVLRAELEQAQTVKERFKSAALKI

SEQ ID NO: 200955 - protein, 122 aa, Glycine max
  Coding DNA Sequence Number=SeqID_84177
  Gene Ontology: Mol. function=RNA-directed DNA polymerase activity; Biological process=RNA-dependent DNA replication
  Homolog annotation: Hit_ID=Q1SD42; Match level="QueryCoverage=96%, HitCoverage=13%, E-value=8e-26, Identity=60%"; Hit description=RNA -directed DNA polymerase
MVKHLVNTLTIRNQRYFSTSTHPGAINIATLLGVSQTIGTLKYLELPSIIGRRKKAIFGFLKGKLWTKINHWSTKFLRKAGKEVLIITMAQSIPTYCMSVFLLPITLQGELEKNDELFLVGK

SEQ ID NO: 200956 - protein, 284 aa, Glycine max
  Coding DNA Sequence Number=SeqID_84178
MDGVQNMDGKSKPESLGVYINDDFVDNLPTLFPFGSLRDGFEEANLMESFNFQADLPTQNIQETISNLSVVPAPLEGLTLEGAVSSIEGQDMNQTGYLNQSHDMQNEDMLALQGIHHYDEQNPSNPLVSNITKNNNFNGVNNQASPYPASFHRNPVLTWPRIETGFSSGQLVTPKRPKLFPPRNNHIHISNSHAACNSRWSRPFNTMQNQQVGHATTSNSFLPRSLVPATSQGVPNQISKYNRRMNTPNLQRQSNTSWQRHRVAEIAPVLSKRSPYSRQQKKTS

SEQ ID NO: 200957 - protein, 153 aa, Glycine max
  Coding DNA Sequence Number=SeqID_84179
  Homolog annotation: Hit_ID=Q1T2D5; Match level="QueryCoverage=66%, HitCoverage=6%, E-value=2e-29, Identity=57%"; Hit description=Chromo
MVDNTRMKELTGDVKRILEMMENRNKEYAARFETLETTLEMTLKDIKLEILGVRNVKIDFPILDGSDVLQWIFKADQFFKYHKTPGEQRLIIASIHLDKEVVPCYQMMTRENSFKTWIAFTRALETEFGPSPYECPRSQLFKLAQIGSVQSYY

SEQ ID NO: 200958 - protein, 101 aa, Glycine max
  Coding DNA Sequence Number=SeqID_84180
MAQNTEHTFIYSQEANSSSMGGNPPQLAVNDANQLPLFSPSTSAPLLDPDETESNCYVPSMVGLISSEEAGLSVQAQDMTTPTLMNYYNQYHLTQNNNLPM

SEQ ID NO: 200959 - protein, 127 aa, Glycine max
  Coding DNA Sequence Number=SeqID_84181
  Homolog annotation: Hit_ID=Q1SAJ3; Match level="QueryCoverage=63%, HitCoverage=18%, E-value=5e-23, Identity=58%"; Hit description=WD-40 repeat
TDTTCSEARNGKDIQGIPWERLNYSRDKYRETRLKQYKNYQNFSLSPHHLHKECFQVQKGQTFYDFFFNTRLVKSTIVHFQIPEHSGVLGSFIWDVMPFTVTCRINGLYLQGVLTVVRSHTGCELSD

SEQ ID NO: 200960 - protein, 346 aa, Glycine max
  Coding DNA Sequence Number=SeqID_84182
  Gene Ontology: Mol. function=hydrolase activity, hydrolyzing O -glycosyl compounds; Cellular component=cellulose and pectin -containing cell wall; Biological process=carbohydrate metabolic process
  Homolog annotation: Hit_ID=Q8W011; Match level="QueryCoverage=92%, HitCoverage=40%, E-value=1e-106, Identity=61%"; Hit description=Beta- D-xylosidase
  Pfam annotation: Domain name=Glyco_hydro_3_C; Domain location=78-312; Score=261.8; E_value=1.4e-75; Accession=PF01915.12; Description =Glycosyl hydrolase family 3 C terminal domain
MDLECGSYLTYHAKSAVLQKKLGMSEIDRALQNLFSIRMRLGLFDGNPTRLSFGLIGSNHVCSKEHQYLALEAARNGIVLLKNSPTLLPLPKTSPSISLAVIGPNANSSPLTLLGNYAGPPCKYVTILQGFRHYVKNAFYHPGCDGGPKCSSAQIDQAVEVAKKVDYVVLVMGLDQSEEREERDRVHLDLPGKQLELINGVAEASKKPVILVLLSGGPLDITSAKYNHKIGGILWAGYPGELGGIALAQIIFGDHNPGGRLPTTWYPKDYIKVPMTDMRMRADPSTGYPGRTYRFYKGPKVYEFGYGLSYSKYSYEFVSVTHDKLHFNQSSTHLMVENSETISYKL

SEQ ID NO: 200961 - protein, 104 aa, Glycine max
  Coding DNA Sequence Number=SeqID_84183
  Gene Ontology: Mol. function=ATP-dependent helicase activity
  Homolog annotation: Hit_ID=Q8PMT6; Match level="QueryCoverage=98%, HitCoverage=12%, E-value=8e-26, Identity=62%"; Hit description =Helicase-related protein
  Subcellular localization annotation: CTP_CleavageSite=95; ConfidenceScore=5.49e-01
MPGAAPRRPACRSLPVPAAALGGPGCRAALRVRPMPTAGGRGHARAVRRRAGPPRPAAGAATAACRRAGWAPAGRLRVRCHGTGAAPARPGSLPRADRPAADRG

SEQ ID NO: 200962 - protein, 126 aa, Glycine max
  Coding DNA Sequence Number=SeqID_84184
  Gene Ontology: Mol. function=hydrolase activity
  Homolog annotation: Hit_ID=UPI00003CCC73; Match level="QueryCoverage =74%, HitCoverage=44%, E-value=3e-13, Identity=43%"; Hit description =COG1407: Predicted ICC-like phosphoesterases
MHVQCSIAFTPSQPLLVPGSAMRWPMQDVAQDPQLAAGMPVQQPLQALQVFAGAAAGQRDAGTTECIGLAQVQVGDQQCLPRRPVQCTRAKQNQRFAGAQQRQFIGHGGAPAAGPRVAHGCASLRC

SEQ ID NO: 200963 - protein, 69 aa, Glycine max
  Coding DNA Sequence Number=SeqID_84185
MPRIHDAILYYNGKWNMPPQNKFVGCAFTGKNPKKFQIPSTCTIDELKNLIKQVAPKKIPPLGIHESQT

SEQ ID NO: 200964 - protein, 40 aa, Glycine max
  Coding DNA Sequence Number=SeqID_84186
MEEARGEALAAQQHWFHRSNKPSGNRLQDVVIDYRLPILV

SEQ ID NO: 200965 - protein, 75 aa, Glycine max
  Coding DNA Sequence Number=SeqID_84187
METSAGLPWVVAKIRLYLISTTTLFCRKKKWSLSSSQNTIHSKTPKTETGEGLNRKTETGEGLNRKIPVNKIPGH

SEQ ID NO: 200966 - protein, 318 aa, Glycine max
  Coding DNA Sequence Number=SeqID_84188
  Gene Ontology: Mol. function=DNA ligase (ATP) activity; Cellular component=nucleus; Biological process=DNA recombination
  Homolog annotation: Hit_ID=Q5H1P2; Match level="QueryCoverage=99%, HitCoverage=58%, E-value=1e-118, Identity=71%"; Hit description=DNA ligase
  Pfam annotation: Domain name=DNA_ligase_A_M; Domain location=78-276; Score=126.1; E_value=1e-34; Accession=PF01068.12; Description=ATP dependent DNA ligase domain
  Subcellular localization annotation: CTP_CleavageSite=49; ConfidenceScore=5.48e-01
MDRTTSAGGGQSSRSSAPCGGRRRLAAAVQQRTPGVQQAADRCPARRCFAAAGTAGAGRMLLSPDELPLDRQQPYPFFLASPLEGEPAERLGPIDDWLLEWKWDGIRLQLLRRRGEVALWSRGEERLDGRFPEIEQAAMALPDGCVLDGELLAWDENANLPRAFTALQTRIQRRKPGAATLRNTPVRVLAYDLLEVDGADLRELPLQERRTRLTEVIGALDDVRIQLSPDVDADDWQRAAAMRDVARERGVEGLMLKRRVSPYQTGRRRGDWWKWKVDPLTIDAVLLYAQAGHGRRSTLYTDYTFGVWDGDTLVPVAK

SEQ ID NO: 200967 - protein, 95 aa, Glycine max
  Coding DNA Sequence Number=SeqID_84189
MAPGKLASKRSRKDKAVEEDKAAEGTSSAPEYDSHHFRSAEHQQRFKTIKGWSLLWEIRVQLRDDEYTNFQEEIVRRQWASLVTPMAKFDPDIVL

SEQ ID NO: 200968 - protein, 383 aa, Glycine max
  Coding DNA Sequence Number=SeqID_84190
  Gene Ontology: Mol. function=oxidoreductase activity; Cellular component=integral to membrane; Biological process=electron transport
  Homolog annotation: Hit_ID=Q1Z557; Match level="QueryCoverage=99%, HitCoverage=35%, E-value=1e-136, Identity=59%"; Hit description =Xanthine dehydrogenase family protein, small/large subunits
  Pfam annotation: Domain name=Ald_Xan_dh_C2; Domain location=1-383; Score=38.9; E_value=1.6e-15; Accession=PF02738.8; Description =Aldehyde oxidase and xanthine dehydrogenase, molybdopterin binding domain
MKYRAGVDDNGRILAIKIDILADSGGYAASSPFVTWRSSVQAAGPYNIDNVHIDVKAVYTNNSYTSAMRGFGSPQVVYANESFMDEIADVLNLSPVAVREVNALRQGDTSVTGQRFDKHTVSATEVLSKSVNASEFAAKRQHYRELNQKGGVYRYGIGLALSYRGCSIGAEGVDTSTALIQVNEDGSVNLATSVSENGQGLQTAMSLIAAEAFGIPLSELHFMEPPTSVIGDGGSTAATRGTMVGGGAILDAADKIKRRILSVVGDSIGTRELAETLWQDGFIINVQDSERRIDFKTAVNKTKWASVSLTEYGWFVPPPIHWDEEKGCGSPYFTWVYGCQVAEVRVNTSTGKTDLLHVTAAHDVGRVLNPVGFEGQVYRGVAQ

SEQ ID NO: 200969 - protein, 95 aa, Glycine max
  Coding DNA Sequence Number=SeqID_84191
  Gene Ontology: Mol. function=oxidoreductase activity; Cellular component=integral to membrane; Biological process=electron transport
  Homolog annotation: Hit_ID=Q1Z557; Match level="QueryCoverage=100%, HitCoverage=8%, E-value=4e-33, Identity=65%"; Hit description =Xanthine dehydrogenase family protein, small/large subunits
MIDNVVFAAERAAHHRAFDVNLALRAAHKLSHEAAYAVRVLNGAGDNQATIGRIKPGQYDFRFDVGVFLEAHFIFTFNHVTGFGKAFGDVALNSV

SEQ ID NO: 200970 - protein, 189 aa, Glycine max
  Coding DNA Sequence Number=SeqID_84192
  Gene Ontology: Mol. function=transcription factor activity; Cellular component=intracellular; Biological process=regulation of transcription, DNA-dependent
  Homolog annotation: Hit_ID=Q0M9M9; Match level="QueryCoverage=95%, HitCoverage=46%, E-value=2e-36, Identity=46%"; Hit description =Transcriptional regulator
  Pfam annotation: Domain name=LacI; Domain location=9-34; Score=21.7; E_value=0.0026; Accession=PF00356.11; Description=Bacterial regulatory proteins, lacI f
  Subcellular localization annotation: CTP_CleavageSite=21; ConfidenceScore=5.00e-01
MAGQNKRAVTSYDVAKAAGVSQSAVSRAFTEGAKISPATKEKVRKIAAELGYRPSFIAQSLITRRSTLIGVVVPGLVNPFYAAVLDELSQALNLMGYRVLLFSMYRDDDTTPIMEEILRHRVEALVLVSSSLSSHFAHECQQLGLPVLLLNRKNDSRSVSSVTSDNLAGGAAIADFLLDLGHQQLAFVA

SEQ ID NO: 200971 - protein, 84 aa, Glycine max
  Coding DNA Sequence Number=SeqID_84193
MTKARQKGVRKENKGRACHPARPGELSSPRRARLLPLEATAFWRNILEGPTFGMLRKLTDCITILPFDLRHVTEFHGLHNNASF

SEQ ID NO: 200972 - protein, 253 aa, Glycine max
  Coding DNA Sequence Number=SeqID_84194
  Gene Ontology: Mol. function=sulfuric ester hydrolase activity; Cellular component=integral to membrane of membrane fraction; Biological process=metabolic process
  Homolog annotation: Hit_ID=Q5DZ27; Match level="QueryCoverage=92%, HitCoverage=47%, E-value=6e-92, Identity=65%"; Hit description =Arylsulfatase
MVEHDKMIGEVLKKIKDLGIEDNTIVIYTTDNGPMIATWLDSGMTPFRGEKNTGWEGGFRVPAMIKWPGHIKPGTMINDIFGSNDWFPTLVAAAGVPDIKQQLLKGYKTSAMTYKVHLDGYNQLDFLQGKGPDQSNEFFYWSDDGDLLAMRYGRWKAHFMIQEHTGLDLWKYPFVKLRTPLIFDLEIDPLERGDSGMDYNHWFYDRLFLLGGAQKYAAEMLQSFKEFPPRQKPGSFTVSDVQKLIDEGSPATN

SEQ ID NO: 200973 - protein, 95 aa, Glycine max
  Coding DNA Sequence Number=SeqID_84195
MVIPKFKVPDFDKNKETTCPKNHLKMYCQKMGAYAKDEELLIHFFQESLTGVAVTCINTILIWLQIGCNYRTMCKKEHESFKRICPRGGGICQLK

SEQ ID NO: 200974 - protein, 68 aa, Glycine max
  Coding DNA Sequence Number=SeqID_84196
MVGKLIKIPIPIIQVGWLKAQKTSEELERLVMEMGKSALLTTACGNNKATKSQANQKGNDRIPPQADI

SEQ ID NO: 200975 - protein, 155 aa, Glycine max
  Coding DNA Sequence Number=SeqID_84197
  Gene Ontology: Mol. function=chitin binding; Cellular component =extracellular region; Biological process=chitin metabolic process
  Homolog annotation: Hit_ID=UPI0000612705; Match level="QueryCoverage =89%, HitCoverage=92%, E-value=3e-18, Identity=31%"; Hit description =UPI0000612705 related cluster
  Subcellular localization annotation: CTP_CleavageSite=78; ConfidenceScore=5.60e-01
MARACSPLKVRMCGPLKVRACSPTKVRTCSPLMARACSPLKVRACSPLLARTCSPLQARTCSPLRVRACSPMKVRTCSPMMARACSPLKVRVCSPLLARTCSPLQARTCSPLKVMGTSTQGSTLMRKQEIDSSRGPVIPNPQDLDIRCRKSMQLT

SEQ ID NO: 200976 - protein, 212 aa, Glycine max
  Coding DNA Sequence Number=SeqID_84198
  Gene Ontology: Mol. function=protein disulfide isomerase activity; Cellular component=endoplasmic reticulum; Biological process=cell redox homeostasis
  Homolog annotation: Hit_ID=P29828; Match level="QueryCoverage=76%, HitCoverage=32%, E-value=4e-59, Identity=69%"; Hit description =Protein disulfide-isomerase precursor
  Pfam annotation: Domain name=Thioredoxin; Domain location=5-106; Score=63.4; E_value=7.4e-16; Accession=PF00085.10; Description =Thioredoxin
MLDEAIEYLKQLQLQVQASFLSFGLCCHCKNLASKYEKVASILSSHNPLIVLAKVDANEEKNKDLASQYDVKGFPTINILRNRGNNVQEYKGPREADGIVDYLKKQSGPASTEIKFVDEPIAFVGWSFSREEFDNFSALAEKLRSKKLRSDNDFGHTLNAKLLPRGESSVSGPIVRLFKSFDELFIDFQVIIYIVYHHYYYYMVPYNCVVLS

SEQ ID NO: 200977 - protein, 81 aa, Glycine max
  Coding DNA Sequence Number=SeqID_84199
  Gene Ontology: Mol. function=oxidoreductase activity; Cellular component=membrane; Biological process=electron transport
  Homolog annotation: Hit_ID=Q2MIY9; Match level="QueryCoverage=96%, HitCoverage=49%, E-value=1e-27, Identity=73%"; Hit description =Cytochrome P450 monooxygenase CYP706E1
MQKILVNVWAIGRDPTIWENPEMFMPERFLECEIDFKGHDFELIPFGTGKRICPGLPLAHRKHEHGGAIWNKHKEGPIPSS

SEQ ID NO: 200978 - protein, 99 aa, Glycine max
  Coding DNA Sequence Number=SeqID_84200
MENHGDAKLISSDVIGSGCPENDALIGEVVEEARDCATDVGVYDEDLVYSRKCMSLADKPSIVDEDLEFVPLPFPSISISSRERMCSDTTPYASKKLYK

SEQ ID NO: 200979 - protein, 92 aa, Glycine max
  Coding DNA Sequence Number=SeqID_84201
  Gene Ontology: Mol. function=NADH dehydrogenase (ubiquinone) activity; Cellular component=integral to membrane; Biological process=ATP synthesis coupled electron transport
  Homolog annotation: Hit_ID=A0A380; Match level="QueryCoverage=70%, HitCoverage=12%, E-value=4e-27, Identity=97%"; Hit description=NADH -plastoquinone oxidoreductase subunit 2
MVSLGYMVHPGGEIELQEIVNGLINTQMYNSPGILIALLFITVGIGFKLSPAPSHQWTPDVYEGVRCYIVGSHPSETTSIIGASVNKRITLR

SEQ ID NO: 200980 - protein, 364 aa, Glycine max
  Coding DNA Sequence Number=SeqID_84202
  Gene Ontology: Mol. function=oxidoreductase activity; Cellular component=periplasmic space; Biological process=electron transport
  Homolog annotation: Hit_ID=Q74RZ7; Match level="QueryCoverage=97%, HitCoverage=47%, E-value=1e-152, Identity=70%"; Hit description =Putative biotin sulfoxide reductas2
  Pfam annotation: Domain name=Molydop_binding; Domain location=231 -352; Score=115.1; E_value=2e-31; Accession=PF01568.11; Description =Molydopterin dinucleotide binding domain
MLLNPGQPYAFQGETLHYPDIHLVHWAGGNPFHHHQQLNRLVEGWQRPDTVIVQDIVWTPAAQMADIVLPATTTLERNDIGGSSRDRFVLAMHQAIKPQHQARNDFDIFADLADRLGYRERFTEGRNEMQWIEHLYQQCAQAHAQLDIAFPEFEAFWQRGFVEIPQGGKPYVFMDDFRADPQAHPIHTASGKIELFCQTIADYQLADFAGHPEWRAPQEWLGAALSAQFPLHMISVQPADRLHSQLDATATVQAGKTAGHETLYMHVDDAAARGISDGDEIEVSNARGRMLAGVRLTDGLTPGVVIIATGAWFDPGFGKAWQPWDRAGNPNVLTLDIGTSSLTQGPNAMSCLVEIKKHASCTIG

SEQ ID NO: 200981 - protein, 192 aa, Glycine max
  Coding DNA Sequence Number=SeqID_84203
MVPTRHPLDTDKSNRALGFPVLITGLCQSYRVPVTPSKVIRLPITRAFIEKYCTPRQAHARPLGVERYLQHLVRQQAANHRGQGQGFAPFVCPTSKQFGAEVAWPGDWPDAQVGEEPAGSPGEADESHMDEDMIDLLGFLGQGWTFSPWVKVYGELGFWLKAHCRNLPFGGRATRDSRDACSTKGIRAESPP

SEQ ID NO: 200982 - protein, 136 aa, Glycine max
  Coding DNA Sequence Number=SeqID_84204
MHCWLQAADARSVAISEVTNQAGRADLWIRYRSDEAQNSAILELKVLREKSYHKEHQSAKKVADAVNKKAANDAITQADAYRTRLGTSRALACIFDMRKPPGNPDITKEAEATAVQKSVTFRLTPVNNAVSISRIS

SEQ ID NO: 200983 - protein, 91 aa, Glycine max
  Coding DNA Sequence Number=SeqID_84205
MPRSPANPSVRRAMCDRLARLLKTAYDDNWSELAEKLGYANASGMLSIKRGVAFPDVQRLNRISEWEIEGGFIPSLDWILTNKGPAVIRYE

SEQ ID NO: 200984 - protein, 58 aa, Glycine max
  Coding DNA Sequence Number=SeqID_84206
  Homolog annotation: Hit_ID=P41393; Match level="QueryCoverage=89%, HitCoverage=5%, E-value=5e-15, Identity=73%"; Hit description =[Protein-PII] uridylyltransferase
MEAGSHFIVWIKYLCQPLLQHGAHFSIQRTSFAVGKDEQILHPFADGTDAGAVQRNAE

SEQ ID NO: 200985 - protein, 121 aa, Glycine max
  Coding DNA Sequence Number=SeqID_84207
MPEPHTEKQVRGFLGHLNYIASCGIRTNLSNGTTTAKWHLAVATYPSAGGRRVTRGMRVPRKEYARSRHQRLFEENVGKTGKDEIYELFSERFGSCIYARGRVFPFAPTYSSIWDEKIRPT

SEQ ID NO: 200986 - protein, 118 aa, Glycine max
  Coding DNA Sequence Number=SeqID_84208
MDISCLHFSFIIFMHCICINHCITTHLHLACSFVPITAVATYPSAGGRRETRGMRVPRKEYARSRHQRLFEENVGKTGKDAIYELLSERFGSCIYARGRVFPFAPTYSSICDEEIRPT

SEQ ID NO: 200987 - protein, 70 aa, Glycine max
  Coding DNA Sequence Number=SeqID_84209
  Gene Ontology: Mol. function=DNA binding; Biological process=DNA integration
  Homolog annotation: Hit_ID=Q1STR6; Match level="QueryCoverage=66%, HitCoverage=6%, E-value=5e-15, Identity=74%"; Hit description =Integrase, catalytic region; Ribonuclease H
MSHERLYQRWVKNAFDKKAKKDNRGKWDPNYEGPFIVKKAFSGGALVLASMDDEELPSPVNTDIVKRYYA

SEQ ID NO: 200988 - protein, 334 aa, Glycine max
  Coding DNA Sequence Number=SeqID_84210
EYPHVLEPLLRPETDAVNVEEQGEGQGIRSSSPHGSSQKSSSEENFSDEEAIQEAEAGGSDIYPASSTSKLSASVGIAEETFIKMQDEDPAAALRLLLNTSQAHTSSEKIPGASSSSDAEINSSVRQDCLLLKLSMEYARADVLKSIEENPSAAFGHLNFLKKLHNPLTSDEILGKVIQIESIINQFASTVQKKRENDARLDAQKQAHILLLEKAQTAQHEVERLTKEAKEGSSEIKACDDNISSWEATIMDLLSQVDDLRQKIVTEQAKRKELQEKAAHSIQKLIAEKGREGLKAFSASQAVADEARVMEGADQVLTKEMATLKKLYEDLIMT

SEQ ID NO: 200989 - protein, 119 aa, Glycine max
  Coding DNA Sequence Number=SeqID_84211
MDLSALRKEGDVDLNASPQALDRLLGYVLAFKVKVQPKFRNVVVLRYSNELDLINVVLDMLPDIEQSVSVTAEHDPIVGFSLAPKKCLSSDEIDDEPRSSQISPTQLSSNKLARHSQIE

SEQ ID NO: 200990 - protein, 95 aa, Glycine max
  Coding DNA Sequence Number=SeqID_84212
MSHLGIPTETKAFVVGNADARSWVFAHLLTVGYSKMEEYVMYDLVATRWKLLRGLIMDSISSYVELVEPQSYSKGHKSSSAYTTSFKIVAEGLRS

SEQ ID NO: 200991 - protein, 136 aa, Glycine max
  Coding DNA Sequence Number=SeqID_84213
  Gene Ontology: Mol. function=hydroxyethylthiazole kinase activity; Biological process=thiamin biosynthetic process
  Homolog annotation: Hit_ID=Q9LIQ4; Match level="QueryCoverage=54%, HitCoverage=27%, E-value=1e-16, Identity=63%"; Hit description =Hydoxyethylthiazole kinase-like protein
VGCDRQRWGRAPTICRASCIGMQGLHGREPGGGERANIEDEGSDARGEVGELLNGMEHGGAGASREECVGNDVHGDEVGDDWIRGDWERSLERSKGLIDLNATSGRSVDEVFALLCKPRKLRYVDEIIAQMPDKSV

SEQ ID NO: 200992 - protein, 72 aa, Glycine max
  Coding DNA Sequence Number=SeqID_84214
  Gene Ontology: Mol. function=protein binding
  Homolog annotation: Hit_ID=Q6H678; Match level="QueryCoverage=83%, HitCoverage=15%, E-value=5e-13, Identity=57%"; Hit description=F-box protein-like
MDDGWLAGVSFCENLKTLRVQSCKVIDGSPGLEEHLGCCEALERVHLQKFQMRDRNGVGALDFLNWDAFMYY

SEQ ID NO: 200993 - protein, 70 aa, Glycine max
  Coding DNA Sequence Number=SeqID_84215
MDHGKSPNVTGEGGPYTRVCESKGFQVNHDLGLESKRGCRGSRRGEEIVYFPDFPKEGYRHHHEVGILEL

SEQ ID NO: 200994 - protein, 123 aa, Glycine max
  Coding DNA Sequence Number=SeqID_84216
MVELINQKITKEEVETTLFKIHPTKVPRLDGTCSNPARMKHRTLGELVLLGGLVGACALSATLARLACISEFWFSARLFTQRIDLGSVLSGISPCSANMHNSSFFQILPRAQSKECCAQRMAR

SEQ ID NO: 200995 - protein, 74 aa, Glycine max
  Coding DNA Sequence Number=SeqID_84217
VDSPEDVMSAYEADSTRIVALERWRSVEALHHSRQLIGLEFDDCIHVAKATTVDTFALDDTMYFAKLPYFGQLK

SEQ ID NO: 200996 - protein, 122 aa, Glycine max
  Coding DNA Sequence Number=SeqID_84218
MPEHSTRQTSLERLEEAVHKLTQHQATLAQNNQIEFLQPGGSTSSRAAATAVELQFALYWRNSEEARTDRPSQQLRSLNGEWDAPCSGALSAAGVVVTRSVTATLASADVRRCFCRYAPPRQ

SEQ ID NO: 200997 - protein, 258 aa, Glycine max
  Coding DNA Sequence Number=SeqID_84219
  Gene Ontology: Mol. function=transporter activity; Biological process= transport
  Homolog annotation: Hit_ID=Q2JYZ3; Match level="QueryCoverage=82%, HitCoverage=51%, E-value=4e-20, Identity=29%"; Hit description =Putative sugar ABC transporter, substrate-binding protein
  Pfam annotation: Domain name=SBP_bac_1; Domain location=8-245; Score =37.8; E_value=3.7e-08; Accession=PF01547.15; Description=Bacterial extracellular solute-binding protein
MKKLRVGAVVAVAGVAVAMTGCASSGGSGGSADGDTIVVDMWAGSEADVEALEAQVAFAQEQNPDITIKLQTSPWSDFFTKLTTNMASGNMACVTGMSGAQLGGYTGGFRELSADDLKTAGIDWADFNPSADGILSFEGKVYGVPFDVATMLVYYNQDMLTAAGAATPEIGWTFDDFDAIAADATKDGKYGFGMGMGGYQWMSMPIAYSAKQPASEDGALHIDDEDFVDAASWYAGLVTDKKVAAPVASASDTGWGEN

SEQ ID NO: 200998 - protein, 98 aa, Glycine max
  Coding DNA Sequence Number=SeqID_84220
DAGVEERLHAEPDRRRRDAESGGQLRPRSRLPARDEIEDAPGVRVVDGGVGGVRHGGSFVSEHRQRSGRRRCFRGVTNYHPPINIGCSACGLFRSMTA

SEQ ID NO: 200999 - protein, 110 aa, Glycine max
  Coding DNA Sequence Number=SeqID_84221
MEEFLSQVAWPGVHPSPSRGGEASTAQEPLLEEKDEPIPPEPYVCETDPASAQEEVASPKPIPHPSPAPVLDAPESSTPAPVPDQPLAQDPPAASVLDLNEHAEYHLLND

SEQ ID NO: 201000 - protein, 231 aa, Glycine max
  Coding DNA Sequence Number=SeqID_84222
  Gene Ontology: Mol. function=hydrolase activity, hydrolyzing O -glycosyl compounds; Cellular component=beta-galactosidase complex; Biological process=carbohydrate metabolic process
  Homolog annotation: Hit_ID=Q5ETW7; Match level="QueryCoverage=98%, HitCoverage=31%, E-value=2e-63, Identity=48%"; Hit description=LacZ
MEAVEMQPAAGFVLQQMAVRGGAQLLKAVAAEREGKVAADLPAAAIQLARAAAQAILTRKDSQPAHLVRDLSQLAAQADARGRRQTGGLLYIDADSQFAIATDAITLMAGKQMLTLTQYAMPGFNLHAVLQAVDLHRQQLCLQPIIARAFPALDPGVRVDIGSFAGADIIIDRCANKALLQRCQHGFTIVHPPLQQRAAAATEVPALRGQHHRHQIVIGFQLGRAGAERRQ

SEQ ID NO: 201001 - protein, 229 aa, Glycine max
  Coding DNA Sequence Number=SeqID_84223
  Gene Ontology: Mol. function=chitin binding; Cellular component =extracellular region; Biological process=chitin metabolic process
  Homolog annotation: Hit_ID=UPI00006A17C9; Match level="QueryCoverage =94%, HitCoverage=100%, E-value=1e-22, Identity=33%"; Hit description= UPI00006A17C9 related cluster
MTGRHRRTDTSAGGDQHYDHWAEWRLCEAAWVKSCPGMHSSCVIASLSGCAYTVGRPPILGDVEHTEMRTRSPLKVRACNPLKARMYSPLEVKACSPLKVRACSPLLARTCSPLKVKACSPLLARTCSPLKVRACSPTKVRTCSPLMARACSPLNVRTCGPLKVRACSPTKVRACSPLKARTCSPLEVRACSPLMVRTCSPLQARTCSPLNGEGEGVQPSDGEDMKSSE

SEQ ID NO: 201002 - protein, 105 aa, Glycine max
  Coding DNA Sequence Number=SeqID_84224
MQGLNAGKQIGRREGLSRREERRGRLEGGEPRFAAESGSRRFRKDWSEAEIESERMGGREEQRGEEGLMEWTRVFREAFEDLRIFFVAEDCRDERSLFSTALYPL

SEQ ID NO: 201003 - protein, 582 aa, Glycine max
  Coding DNA Sequence Number=SeqID_84225
  Gene Ontology: Mol. function=binding; Cellular component=nucleus; Biological process=mitotic chromosome condensation
  Homolog annotation: Hit_ID=Q10GR2; Match level="QueryCoverage=95%, HitCoverage=46%, E-value=1e-114, Identity=41%"; Hit description=HEAT repeat family protein
MVEGEFGGKRVLNFSESPIPAVKVAHPEEEGGRAQGLRASRGVRSVRFRRREHRGFEAVTEHGRRFLAFVFGLSDQLGKEFLAMIRSQISFGRKSMLEAYGDILFRVWRATQVDSRTGIENGFLQELIEAAIHAGSGVFAWYIRRVFGTFINQRTTDGVEKMLYRLAEPVIFSSLQVNAIIDETLPPPLNLNVGFTCRFSQPRKIPQPLACVVHVLEMHEKAMNHVANSNVRQNALHLLLDMFPLEDPDATKEEKDTLLDKQFFLLERLLTDDCLEVRIIAVEGSCRILHLFWEVIPSPIITKVMTKIFDDMSHDGCNEVRLSTLNGIIYLLGNPCSHEILKVLLPRLQHLMLDKVAELDVLLSALASDQPPVAQKITKLLIPSYFPSKIPIEEACNRCITLLKRAPMAGARFCQVAILEGAFKSHLMELVKVFLSWILAPDKLDANQIEGFLFATSYVCDSLACEPCYINALKELLDGEKMKGLLTVASKGQAQSSLFNIVSIVCPDDVAGLLEWIGVVTNCSGLPEDVDQQTKIRSAHKLLLSLGGFDDLIEALTAFLHKAAYRCHIKFGADMPSQCFIC

SEQ ID NO: 201004 - protein, 403 aa, Glycine max
  Coding DNA Sequence Number=SeqID_84226
  Gene Ontology: Mol. function=transporter activity; Cellular component= membrane; Biological process=transport
  Homolog annotation: Hit_ID=Q1Q9P5; Match level="QueryCoverage=99%, HitCoverage=51%, E-value=2e-44, Identity=29%"; Hit description =Fimbrial biogenesis outer membrane usher protein precursor
  Pfam annotation: Domain name=Usher; Domain location=1-403; Score= -491.1; E_value=0.0015; Accession=PF00577.10; Description=Fimbrial Usher protein
MLAEGLSSGSLDIGWMRQNYALRSNDYAASPMLDAGWRYGVNNQLTLALHTEQQSKLRNVGTGVDWLISPGTGIISQHVAISDSPYGQGKQWGLGWQWNGRGTGISASTVRTDATFADNARMSGTLPVRRSDSVWVSQSIPHSGTFGAGWVQQNIQGTKQRYLNASWSASLPAHISTTLSYTRSFTDASSHVQLMLSIPLGREDTLSVQASRDMPRMDYRHQPDDQVGGWSWQLGRGFGEHRETYADVGYLGHAGEWHVGMAQGANYASAEGSLTLLDGSLHTLRYSQQSLALVSTHGVGHVPVMLENRPAGETDEKGYLLLTDLPRYHASKVSINPLDLPADVIAPVTDMQARPGNGGAVKVDFNVHHAVTVQARLVDSHHNPLPLGSIVSTPRGATIVGRD

SEQ ID NO: 201005 - protein, 65 aa, Glycine max
  Coding DNA Sequence Number=SeqID_84227
  Homolog annotation: Hit_ID=Q1SGR1; Match level="QueryCoverage=71%, HitCoverage=5%, E-value=9e-17, Identity=89%"; Hit description =Kinesin, motor region; Prefoldin
MENGTPGKQYTIKHDANGNTQVSDLKVVDVHSAKEVAFLLNQPANSRCNKLLHLLAIYEGDAMLS

SEQ ID NO: 201006 - protein, 44 aa, Glycine max
  Coding DNA Sequence Number=SeqID_84228
MAGTLLLLKQQNSLEVMSGMPQNPLTRAKREGGAKCNVANSDPI

SEQ ID NO: 201007 - protein, 37 aa, Glycine max
  Coding DNA Sequence Number=SeqID_84229
MNVMLPRPSRRDRLRMNVIPKTVFMWRDRLRMNDIQT

SEQ ID NO: 201008 - protein, 428 aa, Glycine max
  Coding DNA Sequence Number=SeqID_84230
  Gene Ontology: Mol. function=protein binding; Cellular component =integral to membrane; Biological process=defense response to fungus
  Homolog annotation: Hit_ID=Q1SWI7; Match level="QueryCoverage=99%, HitCoverage=89%, E-value=8e-82, Identity=37%"; Hit description =Leucine-rich repeat
  Pfam annotation: Domain name=LRR_1; Domain location=104-129; Score =3.4; E_value=65; Accession=PF00560.23; Description=Leucine Rich Repeat
  Pfam annotation: Domain name=LRR_1; Domain location=131-153; Score =11.6; E_value=1.9; Accession=PF00560.23; Description=Leucine Rich Repeat
  Pfam annotation: Domain name=LRR_1; Domain location=155-177; Score =11.7; E_value=1.8; Accession=PF00560.23; Description=Leucine Rich Repeat
  Pfam annotation: Domain name=LRR_1; Domain location=179-201; Score =9.0; E_value=5.9; Accession=PF00560.23; Description=Leucine Rich Repeat
  Pfam annotation: Domain name=LRR_1; Domain location=203-225; Score =20.8; E_value=0.005; Accession=PF00560.23; Description=Leucine Rich Repeat
  Pfam annotation: Domain name=LRR_1; Domain location=227-249; Score =12.6; E_value=1.3; Accession=PF00560.23; Description=Leucine Rich Repeat
  Pfam annotation: Domain name=LRR_1; Domain location=256-278; Score =8.9; E_value=6.1; Accession=PF00560.23; Description=Leucine Rich Repeat
  Pfam annotation: Domain name=LRR_1; Domain location=280-303; Score =10.7; E_value=2.9; Accession=PF00560.23; Description=Leucine Rich Repeat
  Pfam annotation: Domain name=LRR_1; Domain location=3-25; Score=11.6; E_value=2; Accession=PF00560.23; Description=Leucine Rich Repeat
  Pfam annotation: Domain name=LRR_1; Domain location=305-328; Score =2.5; E_value=96; Accession=PF00560.23; Description=Leucine Rich Repeat
  Pfam annotation: Domain name=LRR_1; Domain location=353-375; Score =5.2; E_value=31; Accession=PF00560.23; Description=Leucine Rich Repeat
  Pfam annotation: Domain name=LRR_1; Domain location=378-400; Score =5.4; E_value=27; Accession=PF00560.23; Description=Leucine Rich Repeat
  Pfam annotation: Domain name=LRR_1; Domain location=402-425; Score =2.0; E_value=1.2e+02; Accession=PF00560.23; Description=Leucine Rich Repeat
  Pfam annotation: Domain name=LRR_1; Domain location=54-75; Score =10.8; E_value=2.8; Accession=PF00560.23; Description=Leucine Rich Repeat
  Pfam annotation: Domain name=LRR_1; Domain location=80-102; Score =7.2; E_value=13; Accession=PF00560.23; Description=Leucine Rich Repeat
  Pfam module annotation: Pfam domain module=LRR_1::LRR_1::LRR_1::LRR _1::LRR_1::LRR_1::LRR_1::LRR_1::LRR_1::LRR_1::LRR_1::LRR_1::LRR _1::LRR_1::LRR_1; Domain location=104-129::131-153::155-177::179 -201::203-225::227-249::...
  Pfam module annotation: Domain location=256-278::280-303::3-25::305 -328::353-375::378-400::402-425::54-75::80-102
MTSLTHLDLSLTGFYGKIPPQIGNLSNLVYLDLGNYFSEPLFAENVEWVSSMWKLEYLYLSYANLSKAFHWLHTLQSLPSLTHLSLSGCTLPHYNEPSLLNFSSLQTLHLSFTSYSPAISFVPKWIFKLKKLVSLQLWSNKFQGSIPCGIRNLTLLQNLDLSGNSFSSSIPDCLYGLHRLKSLEIHSSNLHGTISDALGNLTSLVELDLSYNQLEGTIPTSLGNLTSLVALYLKYNQLEGTIPTFLGNLRNSREIDLTILNLSINKFSGNPFESLGSLSKLSSLWIDGNNFQGVVKEDDLANLTSLTDFGASGNNFTLKVGPNWIPNFQLTYLEVTSWQLGPSFPLWIQSQNQLQYVGLSNTGILDSIPTWFWEAHSQVLYLNLSHNHIHGELVTTIKNPISIQTVDLSTNHLCGQANAIRISQSCIK

SEQ ID NO: 201009 - protein, 74 aa, Glycine max
  Coding DNA Sequence Number=SeqID_84231
MVQVEEVGGHCHEIGGVAYGIWINLKKSETLIWLDFVECPKKLKKSETLIWVDFVECPKVQDEKMEDLHMDLME

SEQ ID NO: 201010 - protein, 334 aa, Glycine max
  Coding DNA Sequence Number=SeqID_84232
  Gene Ontology: Mol. function=protein binding; Cellular component =integral to membrane; Biological process=xylan catabolic process
  Homolog annotation: Hit_ID=Q1S5Q4; Match level="QueryCoverage=99%, HitCoverage=67%, E-value=9e-52, Identity=33%"; Hit description =Leucine-rich repeat
  Pfam annotation: Domain name=LRR_1; Domain location=119-141; Score =6.8; E_value=15; Accession=PF00560.23; Description=Leucine Rich Repeat
  Pfam annotation: Domain name=LRR_1; Domain location=143-165; Score =3.6; E_value=60; Accession=PF00560.23; Description=Leucine Rich Repeat
  Pfam annotation: Domain name=LRR_1; Domain location=167-189; Score =2.4; E_value=1e+02; Accession=PF00560.23; Description=Leucine Rich Repeat
  Pfam annotation: Domain name=LRR_1; Domain location=19-38; Score =11.1; E_value=2.4; Accession=PF00560.23; Description=Leucine Rich Repeat
  Pfam annotation: Domain name=LRR_1; Domain location=237-260; Score =7.6; E_value=11; Accession=PF00560.23; Description=Leucine Rich Repeat
  Pfam annotation: Domain name=LRR_1; Domain location=274-295; Score =2.4; E_value=1e+02; Accession=PF00560.23; Description=Leucine Rich Repeat
  Pfam annotation: Domain name=LRR_1; Domain location=47-68; Score=8.5; E_value=7.2; Accession=PF00560.23; Description=Leucine Rich Repeat
  Pfam annotation: Domain name=LRR_1; Domain location=71-93; Score=9.9; E_value=4.1; Accession=PF00560.23; Description=Leucine Rich Repeat
  Pfam annotation: Domain name=LRR_1; Domain location=95-117; Score =14.4; E_value=0.41; Accession=PF00560.23; Description=Leucine Rich Repeat
  Pfam module annotation: Pfam domain module=LRR_1::LRR_1::LRR_1::LRR _1::LRR_1::LRR_1::LRR_1::LRR_1::LRR_1; Domain location=119-141::143 -165::167-189::19-38::237-260::274-295::47-68::71-93::95-117
  Subcellular localization annotation: CTP_CleavageSite=43; ConfidenceScore=5.12e-01
VIDLSSNLFKVRLPSVSANVEVLNVANNSISGTISPFLCGKPNATNKLSVLDFSNNVLSGDLGHCWVHWQALVHVNLGSNNMSGEIPNSLGYLSQLESLLLDDNRFSGYIPSTLQNCSTMKFIDMVNNQLSDTIPDWMWEMQYLMVLRLRSNNFNGSITQKMCQLSSLIVLDHGNNSLSGSIPNCLDDMKTMAGEDDFFANPSSYSYGSDFSYNHYKETLVLVPKGDELEYRDNLILVRMIDLSSNKLSGAIPSEISSYLLCGQIPQSLSDLSFLSFLNLSYHNLSGRIPTSTQLQSFEELSYTGNPELCGPPVTKNCTSKEWLRESASVGHGD

SEQ ID NO: 201011 - protein, 134 aa, Glycine max
  Coding DNA Sequence Number=SeqID_84233
  Homolog annotation: Hit_ID=Q2HRE8; Match level="QueryCoverage=96%, HitCoverage=56%, E-value=3e-15, Identity=50%"; Hit description =Lipopolysaccharide-modifying protein
  Pfam annotation: Domain name=DUF821; Domain location=3-134; Score= -321.0; E_value=0.019; Accession=PF05686.3; Description=Arabidopsis thaliana protein of unknown function (DUF821)
MAYFVGRVERRHYEDTMAEQRALCLLERIGFENHKRGSTNQTCQVNALIDIRCTLKVLLGQSVKNTFCHVTLPLYVYDYMFHLLNSYAKLFRYKPSISANATELCVESMVCGAEGSVKKFMMESLVKVPANGNI

SEQ ID NO: 201012 - protein, 131 aa, Glycine max
  Coding DNA Sequence Number=SeqID_84234
  Gene Ontology: Mol. function=RNA-directed DNA polymerase activity; Cellular component=intracellular; Biological process=RNA-dependent DNA replication
MVKKEVMKLLVAGIICPIQDSARVSLVQVVPKKSDITVWPTAGKIALTIGYLIMQLARTISLSYSLSRFWRGWQLHVDSYCTGGPTLLLSDEHFMHLHLLHVTPWFADIVNFIVASIVPPHASRSQIDRQT

SEQ ID NO: 201013 - protein, 121 aa, Glycine max
  Coding DNA Sequence Number=SeqID_84235
  Subcellular localization annotation: CTP_CleavageSite=60; ConfidenceScore=5.01e-01
MTNEERCRSRLRSQFGSASTSFFSSFFFLSLISLNFSQCWTLEPFTWPPSHLFIEKYGIRGHGSSPGSRHNKNSHSDSNNSSPPPKHSKLSHSDNNNNSSNLHLHLNNRCTTKILDLPWRS

SEQ ID NO: 201014 - protein, 151 aa, Glycine max
  Coding DNA Sequence Number=SeqID_84236
MVILFNVEDPLHNNEPLAKRTQGILVSIACWNIWKARDSDVFQDRPINTTSVVIKNYATTISMRHTRKVAWSRPPMGNAKINPDDGNLIHGFPCSCSFSSSTCAKLHASALFDCARGLAMTFICPSNCKNSKLQIICMELDSHTHQQVNTV

SEQ ID NO: 201015 - protein, 44 aa, Glycine max
  Coding DNA Sequence Number=SeqID_84237
MNSLSEHAAAFSEELAKCAYRAKRVQLLRMNIHPLAEMPVAKRG

SEQ ID NO: 201016 - protein, 567 aa, Glycine max
  Coding DNA Sequence Number=SeqID_84238
  Gene Ontology: Mol. function=RNA-directed DNA polymerase activity; Cellular component=chromatin; Biological process=chromatin assembly or disassembly
  Homolog annotation: Hit_ID=Q1RVR4; Match level="QueryCoverage=49%, HitCoverage=80%, E-value=3e-38, Identity=33%"; Hit description =Peptidase aspartic, active site; Aldehyde dehydrogenase
  Pfam annotation: Domain name=RVP_2; Domain location=358-472; Score= -27.4; E_value=0.00014; Accession=PF08284.2; Description=Retroviral aspartyl protease
  Pfam annotation: Domain name=zf-CCHC; Domain location=295-312; Score =14.4; E_value=0.0042; Accession=PF00098.13; Description=Zinc knuckle
  Pfam module annotation: Pfam domain module=RVP_2::Retrotrans_gag::zf -CCHC; Domain location=358-472::90-180::295-312
MEKSLGKSILTEEEGEDGDEGPAESGGDGSGKKTASSASRKMPSDVISEFRQSAKKVELPMFDGEDPAGWISRAEVYFRVQDTTPAVKVDLAQLCMEGPTIHFFNSLLNEEEELTWERLKGALVERYGGHGEGDVYEQLTALRQVGTVDEYITEFEYLTAQIPPLPDKQFSGYFLHGLKADIKGKVRSLSAVGNLSRGKLLQVTRVVEREVRGDARTGISKHPKSGHGSPKPGFGGSSKGGGADWVMVKGKENGPSGGSKGGGFGPRSEKGRNGPLDRGFSHLSYNELLERKQKGLCFKCGGPFHPKHQCPDKHLRVLITEEEETEEGGGKLLAVEVEDEEGGSEGEMSILSLLQLGQLGTDKPQSIQLKGAVNGVPVVILVDSGATHNFIDKRLVQKMSWAVDNSTSMCIKLGDGTKAQSIGVCPDLGVEVGEVQLAIRAHLFDLGGVDIVLGVDWLRTLGDIIMNWNKHTMSFWHNKKWVTLQGLNDNMETLNSIVGGTNRGGKGWMWSIEKKRGDENDLNIGQQKELEGLLSKYEHIFKEPRGLPPRRKKEHAINLKGGLEAVN

SEQ ID NO: 201017 - protein, 433 aa, Glycine max
  Coding DNA Sequence Number=SeqID_84239
  Gene Ontology: Mol. function=protein binding; Cellular component =mitochondrion; Biological process=defense response
  Homolog annotation: Hit_ID=Q19PN1; Match level="QueryCoverage=66%, HitCoverage=20%, E-value=5e-38, Identity=36%"; Hit description=NBS -LRR type disease resistance protein
  Pfam annotation: Domain name=NB-ARC; Domain location=145-422; Score =111.8; E_value=2e-30; Accession=PF00931.13; Description=NB-ARC domain
MIAKEILQKNWNDKDMIGWSFSRRIGQLCIFQQVEMSGGTHNQNNETGDVKDHTNGGSNGDDALTINQLLSRLTRAEDNIDKKLQWLEFQGNKRKRQDDDWLDKLKDLKKRAIDVKNSLHQSGSTNEFPEPYELGDEFDELLLMKPWMLLDERDENMEKMWDLLEHEEVLIIGIDGMGGVGKTFMATHFKNEIKRKGTFKDVFWVTVFDDFTTFKLQHDIAATIQVKLYGDEMTRATILTLELEKRGKTLLILDDVWEYIDLQKVGIPLKVNGIKLIITTRLKHVCLQMDCLPNNIIRMHPLSGEEAWELFLLKLGHRGTPARLPPHVLEIARSVVMKCDGLQLGISVMARTMKGKNEIYWWRHALNILDRLEMGEEVLSVLKRSYDNLIEKDIQKCFLRSALFPNETRKEEWVMMVVESGGTVSLFVIFQQA

SEQ ID NO: 201018 - protein, 116 aa, Glycine max
  Coding DNA Sequence Number=SeqID_84240
  Homolog annotation: Hit_ID=Q5ZDK4; Match level="QueryCoverage=34%, HitCoverage=14%, E-value=9e-09, Identity=77%"; Hit description=50S ribosomal protein L22-like
  Subcellular localization annotation: CTP_CleavageSite=34; ConfidenceScore=5.13e-01
MVQSWSRQHKSWSGKRQIRKLSPKKVNLVAALVRGMLVKDASMQLESTIKRAAKTVYQVKEFHRRDGFEVASADKMAKSCMMTRDLKEECRASILSYPIPIHGLRMLQEFGILVDQ

SEQ ID NO: 201019 - protein, 105 aa, Glycine max
  Coding DNA Sequence Number=SeqID_84241
MAIDRMGLTIDTIQDLSDGGPCVNNIVEECAKECLQEVVNDMKLVSRFWGDAISDESEGEDLAAEKEPPYYIPVVSKSSKNKNSKSSKISKKKPSSRASSLSPVL

SEQ ID NO: 201020 - protein, 209 aa, Glycine max
  Coding DNA Sequence Number=SeqID_84242
  Gene Ontology: Mol. function=transcription factor activity; Cellular component=nucleus; Biological process=regulation of transcription, DNA-dependent
  Homolog annotation: Hit_ID=Q1STW9; Match level="QueryCoverage=98%, HitCoverage=51%, E-value=2e-34, Identity=42%"; Hit description =Pathogenesis-related transcriptional factor and ERF
  Pfam annotation: Domain name=AP2; Domain location=13-62; Score=5.0; E_ value=0.00015; Accession=PF00847.10; Description=AP2 domain
MYNRKSSGFSRRASIYRGVTRYLSSTQEEAAETYDIAAIKFRGLNAQQPSSSNLSFAIPIKQDPSDYWSILGYHNTPLDNSGIRNTTSTVTTTTFPSSNNGTASSLTPFNMEFSSAPSSTGSDNNAAFFSGGGIFVQQQTSHGHGNGSSGSSSSSLSCSIPFATPIFSLNSNTSYESSAGYGNWIGPTLHTFQSHAKPSLFQTPIFGME

SEQ ID NO: 201021 - protein, 197 aa, Glycine max
  Coding DNA Sequence Number=SeqID_84243
  Gene Ontology: Mol. function=structural constituent of ribosome; Cellular component=intracellular; Biological process=translation
MVMSSITFPPNSDDYIGTESCTDLQNIDHVIDNHQSFKSNDAGNKTKVKNNIKMKENKVFPPPIPLLARTQNLASHMPWVLKRYYTNEGRLILKEEKVKHHEYFRAHSANGRLTLQLVNVPFDDHDEYFEEATPSLMKMKRMRLGIVADELSTEQGSDVVVAGSGRVKKCLNSSNVRSGPACNIFGVPGHPIRTVRG

SEQ ID NO: 201022 - protein, 170 aa, Glycine max
  Coding DNA Sequence Number=SeqID_84244
  Homolog annotation: Hit_ID=Q8RY79; Match level="QueryCoverage=47%, HitCoverage=26%, E-value=4e-13, Identity=40%"; Hit description =Tyrosine decarboxylase 1
MEFCDDSEATFRRAFNLLQDGCVYATGLNDFGQLRVSERKGGGVRQGTASEAVLVVLLAARDKILRRVGRNALPKLVMYAYDQTHSALLKAWQVGTTSSTAVDPLLALGKIAKATDVECFSILRRSSAIVVENLSFFTTPPTTTVVNRCRKTYLTDVESLLCSSDWSAIL

SEQ ID NO: 201023 - protein, 211 aa, Glycine max
  Coding DNA Sequence Number=SeqID_84245
  Gene Ontology: Mol. function=nucleic acid binding
MEDEFERLLIVVEEEEGFTFNLEEANEATTDISFCLAGHFLTDKSINGHIMKEDGGCLERIVESASWSFDNHMLVLGRLSTGDMLTQIPLFNIPLWVQLHDVPTGFVTPMVGKHMENFIREFLEYDSKNNTGGSRPFMRIKVLVGLRNPLKTGKKLIKPKGEWQMIESNCERLVEVSVQLTQQLAESETDLLMAGFIIINFKYIYGIVSNS

SEQ ID NO: 201024 - protein, 116 aa, Glycine max
  Coding DNA Sequence Number=SeqID_84246
MPSSLRFTTFSSKETLENTFRRRNLRIPGILPSGEGSMVPMWGKNGRRRNCGQGIRVGCEKPNRLERSWGRWNCGEGNSKNDKALVEREVSLSKPVGKRKFFFLQKNALRRERGEE

SEQ ID NO: 201025 - protein, 74 aa, Glycine max
  Coding DNA Sequence Number=SeqID_84247
  Homolog annotation: Hit_ID=Q1SIP3; Match level="QueryCoverage=61%, HitCoverage=7%, E-value=4e-08, Identity=62%"; Hit description=TRNA -binding arm
MDNVLQTLKLVVYILRLWMQEEEHVDGSCRGSRSQNTEDVYTKINAYEQQLMTVNEKLRLSEEEITKLTIELEK

SEQ ID NO: 201026 - protein, 81 aa, Glycine max
  Coding DNA Sequence Number=SeqID_84248
  Homolog annotation: Hit_ID=Q9SGA9; Match level="QueryCoverage=47%, HitCoverage=8%, E-value=4e-09, Identity=69%"; Hit description =Putative serine carboxypeptidase II
MKVIHVFQLPGNGFESSNATKATKTMLTSKNALDENSLANPTKISGYVTVNKVAGRALLYWLTEVTLNPLTKPLVIWLNGG

SEQ ID NO: 201027 - protein, 173 aa, Glycine max
  Coding DNA Sequence Number=SeqID_84249
  Gene Ontology: Mol. function=2-oxoglutarate decarboxylase activity; Biological process=menaquinone biosynthetic process
  Homolog annotation: Hit_ID=Q15KI9; Match level="QueryCoverage=61%, HitCoverage=6%, E-value=1e-34, Identity=64%"; Hit description =Chloroplast Phyllo
MPGFRFNRLAWLVQSEFYNTAHKIPLVLNHRQYTAHLPCTEIQHFIKRTKTARLNSIHVTLGLYAFILFCNDSLDHANELSNSLKESANINTVWASLIVEECTRLGLMYLCIAPGSRPSPVAVAVASHKLITCISCFDERSLAYDAVGYGRGSHIPAVAITSSGTAVSNLLPA

SEQ ID NO: 201028 - protein, 50 aa, Glycine max
  Coding DNA Sequence Number=SeqID_84250
MEDVQLMFSMHIRRMVKQTICNYFRRPCSIIFFKEEWMNELVFRDGRFSC

SEQ ID NO: 201029 - protein, 121 aa, Glycine max
  Coding DNA Sequence Number=SeqID_84251
  Homolog annotation: Hit_ID=Q68VB5; Match level="QueryCoverage=36%, HitCoverage=22%, E-value=3e-09, Identity=56%"; Hit description=ALY protein
MALIFTFPHRRLNNFPICTLLIVAFLLSPPKVLTFPICTLLNVQIIRSSSDYLKKFKFESQVQPRLKVTPNSLFNLDHGVADDDIKVIHYDQIGRSKGTTEVVFVRHYDALAAIKKYNNEV

SEQ ID NO: 201030 - protein, 110 aa, Glycine max
  Coding DNA Sequence Number=SeqID_84252
  Subcellular localization annotation: CTP_CleavageSite=67; ConfidenceScore=5.14e-01
MQFMQVFDGGSGRASISTWRTKKGTVQNQHKVRPLELLIPRKSPVPLAISSCIRSSQSNWQVPSTARCSWGVGGGQGCSATGGAGAGRTRQSYWRFAEREDSPVQLTSCF

SEQ ID NO: 201031 - protein, 80 aa, Glycine max
  Coding DNA Sequence Number=SeqID_84253
MESRAPSGPFLGIGLKFLNRDVAADGNVRESGDVGGGPGKELSFLFNSLPTLETAQPEVGSSGLEEHRTSRGVRCAPGGP

SEQ ID NO: 201032 - protein, 74 aa, Glycine max
  Coding DNA Sequence Number=SeqID_84254
KITILSKEQERITEPVSHGPASEHQFPAQEFHILQSCVETQGIDRQRVAVEAEEYSQQMVERGHGMYYTPPTFY

SEQ ID NO: 201033 - protein, 172 aa, Glycine max
  Coding DNA Sequence Number=SeqID_84255
  Gene Ontology: Mol. function=RNA-directed DNA polymerase activity; Cellular component=signal recognition particle, endoplasmic reticulum targeting; Biological process=SRP-dependent cotranslational protein targeting to membrane
  Pfam annotation: Domain name=zf-CCHC; Domain location=110-127; Score =27.8; E_value=2.5e-05; Accession=PF00098.13; Description=Zinc knuckle
MELLFLRVGLREEERTSIARFLSGLNMEVRDKVELLPYRDLDELVQLCIRVEQQLKRKPSSKSYGFHSYPKKDKAQGILGAAPSKPKEDKGKTIEKSAPKTSFQERTSNIKCFKCLRRGHIASQCPINGSNVAKDQLTMKDKRDDEEKLEEQKKKKTSKALSSKAKGKDKED

SEQ ID NO: 201034 - protein, 105 aa, Glycine max
  Coding DNA Sequence Number=SeqID_84256
MNQLLYRRLKLWGQKLIGLTNPKSNQKPHIDKGQSNQTRSHAKQEQKQQHIERRPATPQQDLTIRLDRQWDLFDLEMPKEDRFQQYKCYQWHITQNDKPITQYII

SEQ ID NO: 201035 - protein, 215 aa, Glycine max
  Coding DNA Sequence Number=SeqID_84257
  Gene Ontology: Mol. function=RNA-directed DNA polymerase activity; Cellular component=intracellular; Biological process=RNA-dependent DNA replication
DYSRGYIYLGCYTENKRGYISCGSIQVEGTSTWLFKENKGGYIPCGSLACKGFYKVEINLKNRWLLGNWMPLDPTKISVRGIEVDKAKIDVIEKLPPPTNVKGIRSFLGHAGFYRRFIKDFSKVAKPLSNLLNKDVTFVFDEECMKAFNDLKTKLVSAPMIIAPDWGQEFELMCDASDYLVGVVLGQRKGKNLHTIYYASKVLNDAQMNYATTEK

SEQ ID NO: 201036 - protein, 74 aa, Glycine max
  Coding DNA Sequence Number=SeqID_84258
MLEEEEDKWVWKEDKNGIYSIKLAYQVIKANIGGAKDVLFFEKMWEMKQGLLFPLKLDAKPKGLRSIGVASWET

SEQ ID NO: 201037 - protein, 104 aa, Glycine max
  Coding DNA Sequence Number=SeqID_84259
MNTYINHHSEKQNFEERTCRSDGTEWRSLKWLELQQERSEQKSPETTVPVELTEASGETVVSGNCVSEERNWKEAVVFLFLEMECWLEEGCSMAAIVREQRIHT

SEQ ID NO: 201038 - protein, 300 aa, Glycine max
  Coding DNA Sequence Number=SeqID_84260
  Gene Ontology: Mol. function=nucleic acid binding; Cellular component= chromatin; Biological process=DNA integration
MVRCMLCDKQVPKAFWPEAAKWTVHVLNRSPTLTVKDKTPEEMWSGIKPKVDYFKVFGCLTHVHVPDQKRTKLDDKSLQCVLLGVSDESKAYRLFDPVARKIIVSRDVSFEEDKGWNWGRTAEEVKHDVLIWEGSNDSEDASSENEEEAVVEGAKKIGVKWVFRTKLNENGEVDKLKARLVAKGYAQQQGIDYNEVFAPVARWDTIRMVLALAAQKGWNVYQLDVKSAFLHGELTEDVYVEQPPGYVRKGEEEKVYKLKKALYGLKQAPRAWYSKIEAYFVKEGFERCDHEHTLFVKTGG

SEQ ID NO: 201039 - protein, 176 aa, Glycine max
  Coding DNA Sequence Number=SeqID_84261
MDTILSPLRQHKTRCYLADGLENFIRELEIYESTIINFFACNHLYEFDIHFTPPLHRQTCSRPRHLCRKHIWSVKITQAMVPVLEPLKLPPSAEIPLNACGHHMTVLRQFGPPLQWPVETLNPGIAAKAIAQPWYDFLVETDFDHGDEVSFYYRPFDKVWEIVIRRQKDWDDSDTH

SEQ ID NO: 201040 - protein, 39 aa, Glycine max
  Coding DNA Sequence Number=SeqID_84262
  Gene Ontology: Mol. function=nucleic acid binding
  Homolog annotation: Hit_ID=Q1RWN2; Match level="QueryCoverage=92%, HitCoverage=2%, E-value=2e-12, Identity=83%"; Hit description =Peptidase S8 and S53, subtilisin, kexin, sedolisin; Integrase, catalytic region; Zinc finger, CCHC-type
MSAESSNFVQPAIPKFDGHYDHWAMLMENFLRSKEYWHL

SEQ ID NO: 201041 - protein, 102 aa, Glycine max
  Coding DNA Sequence Number=SeqID_84263
MTKCSSEETIGEGWRRRHMEQPKLEAGCGWLCLNWKRREENRRRKKGRVTGEIEREMELGIVEERKEEAREKWTAVESRGDTCHHLEHGHNRHFHIHLIYKT

SEQ ID NO: 201042 - protein, 179 aa, Glycine max
  Coding DNA Sequence Number=SeqID_84264
  Gene Ontology: Mol. function=transferase activity, transferring nitrogenous groups; Biological process=biosynthetic process
  Homolog annotation: Hit_ID=Q1RSX0; Match level="QueryCoverage=76%, HitCoverage=35%, E-value=8e-55, Identity=61%"; Hit description =Aminotransferases class-I pyridoxal-phosphate-binding site
MKAPSCYDPEVKARIRGSSASKKKRIWHMCLGGICKLLWWVAIEISSFSKFAGFTGVRLGWTVVPEELLYADGYPIIKDYDRIVCTCFNGASNIVQAGGLACLSPQGFQVYGGKNGPYVWVHFPGLRSWEVFNKILERAAIVTVPSIEFGPGGEGYIRVSAFGHRESVLEASRRLRKLL

SEQ ID NO: 201043 - protein, 201 aa, Glycine max
  Coding DNA Sequence Number=SeqID_84265
  Gene Ontology: Mol. function=transcription factor activity; Cellular component=nucleus; Biological process=regulation of transcription, DNA-dependent
MARNHQLPTWSGFLQAIEACFALSPYEDPTGQLFNLVQKVRRLSLEELASRRERGLCFYCDEKYNRGHCCASRFFLLVADEDPDDDPLNPNISPPLSPKSTRPDNSNNPIHSQPDPPQAQISLHALSGHTTPETLRMTGRISHQPVVILIDSGSTHNFVQARLVKSLGLNPQPTPTLRVLVGNGNEVVCSQVCLAVTIHLQ

SEQ ID NO: 201044 - protein, 180 aa, Glycine max
  Coding DNA Sequence Number=SeqID_84266
MAAGVELAEAYVSWKQHKEKMKETEKGRAKMNKIGAKANTSSGCFSWFPKRLRRHTWVRDGDEKDLIKSKPPLSISLALITLTRNVAHSHRRCRRWPSSSSAGLVAVSSLHPHHFVSQFFIMLSMLLYAFDFWNKELQRTYGGEVSLGWDVDLFLSQLLVVRKLKMLDFSDFADTEFELT

SEQ ID NO: 201045 - protein, 989 aa, Glycine max
  Coding DNA Sequence Number=SeqID_84267
  Gene Ontology: Mol. function=RNA-directed DNA polymerase activity; Cellular component=chromatin; Biological process=chromatin assembly or disassembly
  Pfam annotation: Domain name=Chromo; Domain location=897-948; Score =17.0; E_value=0.0097; Accession=PF00385.14; Description='chromo' (CHRromatin Organisation MOdifier
  Pfam annotation: Domain name=rve; Domain location=594-750; Score =112.5; E_value=1.2e-30; Accession=PF00665.16; Description=Integrase core domain
  Pfam annotation: Domain name=zf-H2C2; Domain location=535-576; Score =12.3; E_value=0.0084; Accession=PF09337.1; Description=His(2)-Cys(2) zinc finger
  Pfam module annotation: Pfam domain module=Chromo::RVT_1::rve::zf -H2C2; Domain location=897-948::128-338::594-750::535-576
MKFLHQGQLIELKGTTDMHLLAVSPPQLRHMLQTQSVSEFFHIRVCPPTSPSPTTHPEILSILDQFGPLFQPPTTLPPSRSTNHSIHFLPNSPPVNTRPYRYPNFQKQEIESQVSAMLHNGIIRPSTSPFSSPVLLVKKRDGSWCFCVDYRALNALTVKDRFPIPTIDELLDELGRAHWFSKLDLLQGYHQILMAPEDISKTTFRTHHGHYEFLVMPFGLCNALASFQATMNQTLGPYLQKFQVEYLGHLVSEKGVEPVPAKVTAVQQWPTPRITRALRGFLGLSGFYRRFIKGYTSLAAPLTALLAKDQFHWNEEADRAFSQLKLALCQAPVLGLPDFNSSFVIETDASGIGMGAILSQNHHPLAFFSKPFCSKLLRASTYVCVLAAITTAVKKWRQYLLGHYFVILTDHRSLKELMAQAVQTPEQQIYLARLMGFDYTIQYRVGKANLAADALSRLPPSNQGECYVLTIPNCLFLQELRAALAVNQDFLSRRQQLQDDPHPDWELREDFIMYQGRIWLPPKFPLIPAILIELHSTLTGGHMGVMKTLARVRENFVWTSMKQNVHHFVTTCLTCQQIKSDNRRSSGLLCPLPVPARPWEDLSLDFIVGLPLHCGHSVILVIVDRFSKGLHLGSLPQHHTAAGVAKLFMEISGKLHGMPKSLVSDRDPLFLSHFWQELFKLSGTKLCMSSAYHPQSDGQTEAMNRVVEQYLRAFVHQNPSSWGCYLLWAEWSYNTSTHSATGMSPYEITFGKKPPCFPQYLEGASKVEAVDEWLTQRDRMVTSLVKKLSKAQQRMKEIADRHRHDVSYKEGDQVLVKLRPHRQTSVSGGAYSKLAKKFYGPFSVIKKIGKVAYQLQLPPGSQIHPVFHCSLLKPYHPSAEDNPATLPILSEDNQPCITPLVILDTKWVSSPAGRNLMVLVQWTGLLPEDSSWESWDILKRDYNLEDKVVLEACRDVMNNESTEARDTEHGTGTKRKSQKPRYLRDYVAK

SEQ ID NO: 201046 - protein, 131 aa, Glycine max
  Coding DNA Sequence Number=SeqID_84268
MWRLLAVRDLVRWRVCLDLVGVGVGAVVVEGRWKAEELGFGVLGREGGGGEDEEESEEEDKEGEVKLEGEEVVVGFGRWAYERECMGCSGSSSYVMIAMLTTHCSELHYDYKTKGCECWLRGQYHCVSNGA

SEQ ID NO: 201047 - protein, 56 aa, Glycine max
  Coding DNA Sequence Number=SeqID_84269
MGRSRSEGNLQMLEELHVKFEYPLVELQRIQAQQKMDDLQQKTHKQKLLDKWPQIS

SEQ ID NO: 201048 - protein, 92 aa, Glycine max
  Coding DNA Sequence Number=SeqID_84270
MGTATAGGWEWHLEWRRFFREVEVDIVAKLMKDIEAVTVQVNQQDNWGWRLDPCGVYTVGSAYKERLPTKVNLRRRNVELNDILCPFCGSNE

SEQ ID NO: 201049 - protein, 179 aa, Glycine max
  Coding DNA Sequence Number=SeqID_84271
MEAYKVLPSNVVVALDTPSWTRPVHSNLVKMQLHWLIQRTQQYVRPASDEEGAKKDDTLQAFSSGYDGSDNANHKDSIQVLHPVKTYHYDDACTCFVKDTKDDAVISKLKALPIIFNYTIYDLTKMDEWDFKDHMIQLCEVQMPKREKVEKTYQEILATNKVAEKASKEQAKKEARPEQ

SEQ ID NO: 201050 - protein, 110 aa, Glycine max
  Coding DNA Sequence Number=SeqID_84272
MYKDKWTQHWPMGSKIYPEVHENPRAFFNSSSLILLEPLAHGSGNWSLPREDCIKLLEKDWVQESLSPCVVPVLLVTENDVMEQRGLKLKERRKEVIPEGKRRGRAKVQS

SEQ ID NO: 201051 - protein, 81 aa, Glycine max
  Coding DNA Sequence Number=SeqID_84273
MGFKDAALKYVLKGKHGFVLCEDPRYLVPANTINIREVSVSQCNCRYPSYGEGVVSLSFENSSGVVKKSLDEENKRSFQCS

SEQ ID NO: 201052 - protein, 75 aa, Glycine max
  Coding DNA Sequence Number=SeqID_84274
MTQRRKRRTTTRKNRKPTIATTATRKNLTVKDILALSPRVLDVPTKMLGAQSNTLEWWVHLTTSSNHTTWAIRLK

SEQ ID NO: 201053 - protein, 183 aa, Glycine max
  Coding DNA Sequence Number=SeqID_84275
MVGEKVNLLEVIFFYWLQAFKDRFHAKDKKNLIPYGMLFTQIMRSSGADVSVMEPSTRATQLKGLTFDKMGIVANFPKYAQKHVKRKVQQQFLNPEPRAASQQTHREQAQDLDPMEKETLEEVMLQSVIEALVNESRDNIIEIDPGVEPIKSRPMSNANERKIYFVLSKVEGEENIEHFEAIY

SEQ ID NO: 201054 - protein, 134 aa, Glycine max
  Coding DNA Sequence Number=SeqID_84276
MSDRSFSFMVIFPFFRFFFTLHVDPIIEEVEFDIDVASGSLAVQVYNPPPSQAYVQLLLKELIRTREAIAKALKDLAHAKKKARRWSLIGEFIYNNDIGWKPLHSLTPLASLTISFDFKDSGDEFLKKLKLNII

SEQ ID NO: 201055 - protein, 75 aa, Glycine max
  Coding DNA Sequence Number=SeqID_84277
MTTPTMEVAHLEMKLPNCELLNSILRWNHTFILQILLSNVDLYMSQPTLWREGDAGLKGVSFKGGRRAESPPMFI

SEQ ID NO: 201056 - protein, 112 aa, Glycine max
  Coding DNA Sequence Number=SeqID_84278
MEEKRRKEREDTPLDVNPFAQGLRMDLQRFFLFNKYKIQKMEWIRRKKVASLWRAEWKGFGSKFECVWIENDDDNNGVQVRLKAELRHKNMWKNAQLLVSQEAATSLEFPPY

SEQ ID NO: 201057 - protein, 172 aa, Glycine max
  Coding DNA Sequence Number=SeqID_84279
  Gene Ontology: Mol. function=nucleic acid binding; Biological process= DNA integration
  Homolog annotation: Hit_ID=Q1RSG2; Match level="QueryCoverage=99%, HitCoverage=22%, E-value=5e-42, Identity=75%"; Hit description =Integrase, catalytic region; Zinc finger, CCHC-type
MTVVELQGSIERLVTRILEKTEKVSEEALKSQVNLNNVAKTSQNAENRGRDNFNNGRRGNFTDETVKSTMRFGNNAKIPIMGKGQITIRLNDSSQSFIFDVFYALGLHQNLLSMGQLLEKGYNMQIHHDHCTLIYINGRFVAKVKMTPNCLFPLRIHHEKLSCLSSVIPNDD

SEQ ID NO: 201058 - protein, 102 aa, Glycine max
  Coding DNA Sequence Number=SeqID_84280
  Gene Ontology: Mol. function=protein binding
MALCNIMLLLLFMALQIMNEDNASDFIRVGGVQRRQDGEFIVQATKDCVSKTLKRLEENFVINLFYKARYGKKQEGMTTKEDLKWKMEVTKSDQKVGTHKIL

SEQ ID NO: 201059 - protein, 172 aa, Glycine max
  Coding DNA Sequence Number=SeqID_84281
  Gene Ontology: Mol. function=hydrolase activity; Biological process =metabolic process
  Homolog annotation: Hit_ID=Q9SJM7; Match level="QueryCoverage=58%, HitCoverage=34%, E-value=4e-32, Identity=63%"; Hit description =Expressed protein
MPRGTLEVTLISAKDLKDSDFFNAEEVAHNLMKELSHLRNMLESYASSCEIACRENISIAQGSPEPLKGGTPCVADFVHGKDGLGNTFLPPPKGEKIEKSACEFLVEKVSEYPGEAIKGDFAFASKVKRIVILGGAFFALGNVNPVAEANHKIYKSSIEHLDLVSSKKYFVS

SEQ ID NO: 201060 - protein, 149 aa, Glycine max
  Coding DNA Sequence Number=SeqID_84282
  Homolog annotation: Hit_ID=Q2HVU5; Match level="QueryCoverage=29%, HitCoverage=5%, E-value=2e-07, Identity=73%"; Hit description=Na+/H+ antiporter-like protein
MVPIPNLHHQGGRSSEGNGGDRSGAGDSAEVGVAIGADDGGVSGPLTDGGGVGGRDGGEGRAGGGVGGGRRGGLKHLRRMRAAVEVDGAKLLNAAAEVDGATSLNAAAAMAVSPTHVVTSFNPARMRVSTGSQARERVDAKMKSQAREK

SEQ ID NO: 201061 - protein, 398 aa, Glycine max
  Coding DNA Sequence Number=SeqID_84283
  Homolog annotation: Hit_ID=Q1T132; Match level="QueryCoverage=36%, HitCoverage=25%, E-value=4e-12, Identity=33%"; Hit description=IMP dehydrogenase/GMP reductase
  Pfam annotation: Domain name=DUF1723; Domain location=121-170; Score =45.2; E_value=2.2e-10; Accession=PF08330.1; Description=Protein of unknown function (DUF1723)
MARTKQASCVVGHDHFHEGPSHEGDNVAERHQRLTVPKRGWRSAMPELEGPPTVPQTLGIVGPPFGGGPIDLSLLQSYKDHYVGELVSHGVHVLPLPTASTVKAYMLWSGLASLVTVRYPTANKGFMNAFVERWHQETSSFHLPVREMTITPDDVSSLLHLPMTSKPIDHIPSAFERDSMKIPLMSLLGISTEEEAMVATTTGAKLGYSMRVVTTYLLHLFDNTIFVENSLTHVHVAYLLYLDNRMLAQVRMGSHCTSLPIRPFLLCEPVPNNVCTSANIHYSEHVIDALDDRVPTDGSQPKVLALLFRLGRSWMSYKWMLLCGVLMRATEVSQFSHKCPYALSNVVPPRGLWACTPNYLPWFYKVSHPYVIPLVDGQPPCPPVHLPPIPYSYHLNSH

SEQ ID NO: 201062 - protein, 104 aa, Glycine max
  Coding DNA Sequence Number=SeqID_84284
MALQFLKHPLTISRGLQNETTLTFLSRLRNPKLPLSGFLLNNNNNNNHDDDDDDDEKCGGGALIFLLLFFHELTLVRCEDNVQIPTSFRSYATAKSEKVLQVKK

SEQ ID NO: 201063 - protein, 186 aa, Glycine max
  Coding DNA Sequence Number=SeqID_84285
MPISLYESIDWSVSSRHRGCAHKTHSGPGGAQQGPGVSNSGYGPLSVLHGVRPPSKGSRPEDTQWTRRSPTGPWGFQLGLRASVSPTGCPSPQQGIVPARHPVDPKESNRVLELPALITGLCRFYGVHVAPSKVIRPPTNRAFIKKYCAPRQAQDETPQQPGDGRQRATDAPPPPLEFTSAHPQKG

SEQ ID NO: 201064 - protein, 367 aa, Glycine max
  Coding DNA Sequence Number=SeqID_84286
  Gene Ontology: Mol. function=tetracycline:hydrogen antiporter activity; Cellular component=integral to membrane; Biological process=tetracycline transport
  Homolog annotation: Hit_ID=Q6D4Y4; Match level="QueryCoverage=83%, HitCoverage=81%, E-value=7e-78, Identity=44%"; Hit description =Putative transporter
AVSVPLYGRLADIWGRKRLFFIGVTLFLLGSVLCGFAHRTGCRGDYAADHHHRGGHLFAARARQRAGLALQRLGCRGRHRSAQRRLAASGRNAESDRQLLVDDQRHRTAGGAATGGSAGVLAGAVSGAGAAGRLAAETSRAARRCAAVSAGAVAQPPDCGRQCREPDYRGHHDGHQRVSADVDSGHYWRHAAAGGQRAGDDVNWLAAGQYAQRAPDADHLVSFYRAARRIFTDCRQRAVTAAARRQQHHAGRADGVCYWHRDGHDQHHLSGVGQRSDAENYGTGEPSGAAAGTVTLLDRADCQFAALGICGGIADCAADVVDCVADAASAAGGGIKQGGRPAARRDYCAGASCELPALSGTLLSASR

SEQ ID NO: 201065 - protein, 99 aa, Glycine max
  Coding DNA Sequence Number=SeqID_84287
CNEVLVKINKFVINKEGLVCVETLCMPVTKPERFELDAFELDEPEDAGRYIVRKSIKSAKDIVRFPFQQDATILYLLHTVYRGRENLPLLTVHYLFYLY

SEQ ID NO: 201066 - protein, 162 aa, Glycine max
  Coding DNA Sequence Number=SeqID_84288
  Gene Ontology: Mol. function=1-deoxy-D-xylulose-5-phosphate synthase activity; Biological process=terpenoid biosynthetic process
  Homolog annotation: Hit_ID=Q8L693; Match level="QueryCoverage=60%, HitCoverage=13%, E-value=6e-44, Identity=86%"; Hit description=1 -deoxy-D-xylulose 5-phosphate synthase 1 precursor
MRKEKIPHQAPFAIQAAQLLGRAIGAGLFAITPAGERGMCCKAIKLGNARMKKRPCGVYASLSESGEYYSHRPPTPLLDTVNYPIHMKNLSAKELKQLADELRSDVIFSVSRTGGHLGSSLGVVELTVALHYVFNAPQDKILWDVGHQVGFQLPCCFLLYLF

SEQ ID NO: 201067 - protein, 120 aa, Glycine max
  Coding DNA Sequence Number=SeqID_84289
MGVNTRDVQRVRIRYLYAMDVNARDGEGVNTQDVERGVNILYAMGVNIQDAKGVNTRYAMGMKVEHVGSRKALKAGGLHTAPMFHRPVHDFKPFSCLSIQGLCTVPAVHRLVYDFKPRRA

SEQ ID NO: 201068 - protein, 106 aa, Glycine max
  Coding DNA Sequence Number=SeqID_84290
  Homolog annotation: Hit_ID=Q1SW57; Match level="QueryCoverage=57%, HitCoverage=11%, E-value=6e-08, Identity=38%"; Hit description =HEC/Ndc80p
LLLDAVVEVHDGIILVVDVVHVVVDSVLVERVVLFRGRREVDVEFGNLDEAMDESEECWPLGPMMAKRCVGIWRMEELEARVFFDAKVSWVESGFGLWMLGYGYLT

SEQ ID NO: 201069 - protein, 109 aa, Glycine max
  Coding DNA Sequence Number=SeqID_84291
  Gene Ontology: Mol. function=acyltransferase activity; Cellular component=integral to membrane; Biological process=metabolic process
  Homolog annotation: Hit_ID=Q1RU17; Match level="QueryCoverage=92%, HitCoverage=24%, E-value=6e-22, Identity=42%"; Hit description =Phospholipid/glycerol acyltransferase
MGATSSLNLLKLYVTAERGFWGLERVVLVPEKANTGADKLKGNAVPKVNLQMERNSPRGNHMKKAREDAGVGLNANLPSWKINGFGYLSFGRTCQFLLSSELNIKQTFC

SEQ ID NO: 201070 - protein, 127 aa, Glycine max
  Coding DNA Sequence Number=SeqID_84292
  Gene Ontology: Mol. function=1-acylglycerol-3-phosphate O -acyltransferase activity; Cellular component=integral to membrane; Biological process=phospholipid biosynthetic process
  Homolog annotation: Hit_ID=Q9SHJ5; Match level="QueryCoverage=99%, HitCoverage=21%, E-value=7e-47, Identity=70%"; Hit description =Glycerol-3-phosphate acyltransferase 1
MDKLLSLGNLVVCPEGTTCREPYLLRFSPLFAELTDDIVPVAVDVKVSMFYGTTASGHKCLDPFFHFMNPNPTYFIKILDRVPLSETCLGGGRSRIEVANFVQREIGNALGFACTSLTRKDKYMILA

SEQ ID NO: 201071 - protein, 197 aa, Glycine max
  Coding DNA Sequence Number=SeqID_84293
MEPMKEQMTTMMEAMMIIRRMMEVNAATVVATNTTTEVDPTHPPGIQPRIRLSPAMVERGKFDHIEERLRAIEGGGDYAFADMAKLCLVPDVVIPMKFKVPDFDKYKGTTMRRWWRDLAAQVVPPMMEREMIKMIVDTLSVFYYEKMVGYTPSSFADLVFADERIEVDLRRGKFDYPAMMNRKPWENGEDKKEGGTH

SEQ ID NO: 201072 - protein, 85 aa, Glycine max
  Coding DNA Sequence Number=SeqID_84294
YADESGGGGLDDEGMSLALALFLEAIYPTKPKTFRNDVRLALPEPRLAVRSVSSTCRSKLHDESRLIQRCFDDDKGDDKKLKDQE

SEQ ID NO: 201073 - protein, 87 aa, Glycine max
  Coding DNA Sequence Number=SeqID_84295
MVVITKKGENVNLAGFDDVKKNLLDNDCYHQKGRECESCIGYIYLRIVILRTREGTSLVDQFKWKGTSTWLVKENKGGYNSLWIFGL

SEQ ID NO: 201074 - protein, 35 aa, Glycine max
  Coding DNA Sequence Number=SeqID_84296
MENKVVNFVGLNKIKWWLDRNIEMGITEATGLQMR

SEQ ID NO: 201075 - protein, 94 aa, Glycine max
  Coding DNA Sequence Number=SeqID_84297
  Gene Ontology: Mol. function=nucleic acid binding
MPTRMTLQLVDHSITRPYGVIEDGLVKVKHLIFPVDFLVIDIEEDADIPLILGRPFMSTIAYPLSANLALSTISPRAKLSLLALSAKTPDWLAE

SEQ ID NO: 201076 - protein, 279 aa, Glycine max
  Coding DNA Sequence Number=SeqID_84298
  Gene Ontology: Mol. function=transporter activity; Biological process= transport
  Homolog annotation: Hit_ID=Q0TI56; Match level="QueryCoverage=90%, HitCoverage=58%, E-value=1e-103, Identity=72%"; Hit description =Bacterial extracellular solute-binding protein YcjN
EPHNWEQLLQASQRLNDPAKKHYGIALPTAESVMTEQSFSQFALSGGANVFDAKGNVDIDTPEMAKALAFYKALAATTMPGSNDVMEIKDAFMNGSAPMAVYSTYILPAVYKDGNPANLGFVVPTENSSAVYGMITSLTITTGQTEEETKAAEKFVTWMEQAQNATDWVMMSPGAALPVNKGVVGTDTWKNNDVIKAFGQLPYELIAQFPNVQVFGAVGDKNFTRMGDVTGSGIISSMVHNVTVGQKELNTTYAFRHAAVGPQPDSAGGHGGLANDFQY

SEQ ID NO: 201077 - protein, 116 aa, Glycine max
  Coding DNA Sequence Number=SeqID_84299
DVRKKAQAIQKQNTAPHVWSREGYDYLEQKLMAEKTKKKLEEAAHRVRVAGAGVTIKQYFGSAPRSSCISSFIPPEELEQLTQQIRDQLEESITEKVIGQLMASFSQMQPQLQSQM

SEQ ID NO: 201078 - protein, 77 aa, Glycine max
  Coding DNA Sequence Number=SeqID_84300
  Gene Ontology: Mol. function=sequence-specific DNA binding; Cellular component=nucleus; Biological process=regulation of transcription, DNA-dependent
  Homolog annotation: Hit_ID=Q8S9N6; Match level="QueryCoverage=82%, HitCoverage=24%, E-value=3e-22, Identity=79%"; Hit description =Homeobox-leucine zipper protein ATHB-17
  Pfam annotation: Domain name=Homeobox; Domain location=15-69; Score =61.8; E_value=2.2e-15; Accession=PF00046.19; Description=Homeobox domain
MEDEEEGSNGDPPRKKLRLTKEQSRLLEESFRQNHTLNPKQKESLAMQLKLRPRQVEVWFQNRRARPHESESDAIPP

SEQ ID NO: 201079 - protein, 88 aa, Glycine max
  Coding DNA Sequence Number=SeqID_84301
MGLHFPNCTFSLLQIFDHMKEKREFRCFLDDGYGDTRVDESASLFEEVHPIDVVVDCLPHALHVVDADFVGKGNMDGRGRCRIQRAQS

SEQ ID NO: 201080 - protein, 98 aa, Glycine max
  Coding DNA Sequence Number=SeqID_84302
MKMRREEFFQRVAGAVARDPKIKKREKRRIVIGYIESGRGIKREREQEQRKAEETSVKIMGVMNARNGIKERKRVGEMKKSVVISKRVSGGCFFASDF

SEQ ID NO: 201081 - protein, 647 aa, Glycine max
  Coding DNA Sequence Number=SeqID_84303
  Gene Ontology: Mol. function=sequence-specific DNA binding; Cellular component=nucleus; Biological process=regulation of transcription, DNA-dependent
  Homolog annotation: Hit_ID=P48731; Match level="QueryCoverage=51%, HitCoverage=65%, E-value=4e-74, Identity=51%"; Hit description =Homeobox protein ATH1
  Pfam annotation: Domain name=Homeobox; Domain location=547-605; Score= -1.5; E_value=0.0071; Accession=PF00046.19; Description=Homeobox domain
  Pfam annotation: Domain name=POX; Domain location=364-504; Score =79.6; E_value=9.6e-21; Accession=PF07526.2; Description=Associated with HOX
  Pfam module annotation: Pfam domain module=Homeobox::POX; Domain location=547-605::364-504
MFLRVPAMNRSLNRENPDILNMMIAGKQIIRGVEDDKRDQRERKMGPVYFLTIVDHTSLEVKLFWKITAKSRVMESDMYTAALDISGREATVIDEISQHSASNPLIQCYSLDLNNQSHIISGISMLSGEQGEPINNVHADACFINPSIIADSSPLVISQGKTIVAVGDASNPMENTELQEHLAGGMPITPSSLAAILAARTGLEENLGNSSSALPPSLCSMGALGAFFNNLQGTSNSNPLSATFEDCGYNEVSSKWNANKFPKAPEIDGTCQPYPFIANLDQNEWPSSNVANMANHAYHSSHFSKELSLSLATSTTAGMCSEVSCSNVTPCMNGTMSGLEQASCSSSRELSMNLGGNKYVEFSPEVLESRYLVGIQEILAQIGRYSFENLEQLNYSAGNHRSGGNKSSSAFPPKRRILIDHNANSTYEAHAESPLQRHAAESKKSQLLTLLQLVDNRYSQCLDEIHTVVSAFQAATELDPQIHAHFALQTISILYRDLRERISNYILAMGSNFNNSCSEENEWSVETSFLQKQWALQQLKRKDQLWRPQRGLPERSVSVLRAWMFQNFLHPYPKDAEKHLLAVKSGLTRSQVSNWFINARVRLWKPMIEEMYAEMNKRKACRNEEGMQSNHGTRISTTNERFNQCQL

SEQ ID NO: 201082 - protein, 196 aa, Glycine max
  Coding DNA Sequence Number=SeqID_84304
  Gene Ontology: Biological process=response to biotic stimulus
  Homolog annotation: Hit_ID=Q6H5Z4; Match level="QueryCoverage=87%, HitCoverage=87%, E-value=1e-58, Identity=62%"; Hit description=Bet v I allergen-like
MAVMEEQINIMYYLRKRNTSLVGSHSDLAEFLKVKLNDSVNKHLSINTGVSFGYVDDVRLQHNGVNLTVVGSLELVDGGDGAIVVEAVLAADDAEAEEVVVVVEDLEALGAGGGGEARDDGDFPDAADAAVAGAHVAALDEVLVLLRVLEAPDEGPDRVRRRVDALRYDGAADFRGSLELVVRVDGAFEFGEFLWG

SEQ ID NO: 201083 - protein, 343 aa, Glycine max
  Coding DNA Sequence Number=SeqID_84305
  Gene Ontology: Mol. function=metal ion transporter activity; Cellular component=integral to membrane; Biological process=metal ion transport
  Homolog annotation: Hit_ID=Q8LE59; Match level="QueryCoverage=99%, HitCoverage=98%, E-value=1e-126, Identity=63%"; Hit description =Fe(II) transport protein 3, chloroplast precursor
  Pfam annotation: Domain name=Zip; Domain location=21-340; Score =327.8; E_value=1.9e-95; Accession=PF02535.12; Description=ZIP Zinc transporter
MTNSSCGGAELELCRDESAALVLKFVAIASILLSGMAGIAIPLIGKHRRFLRTDGNLFVAAKAFAAGVILATGFVHMLSDATKALRHPCLPAFPWSKFPFTGFFAMLAALLTLLLDFVGTQYYERKQGMNRAPSEEPVRVGSSEPGGNGKVFGEEESGGMHIVGMHAHAAHHRHNHPHGNDACHGIGNIKEQVLELGIVSHSVIIGLSLGVSQSPCTIRPLIAALSFHQFFEGFALGGCISQAQFKASSATIMACFFALTTPLGVGIGMAISSGYNPYSPGALIAEGILDSLSSGILVYMALVDLIAADFLSKRMSCNFRLQILSYCMLFLGAGLMSSLAIWA

SEQ ID NO: 201084 - protein, 229 aa, Glycine max
  Coding DNA Sequence Number=SeqID_84306
  Gene Ontology: Mol. function=nucleic acid binding; Cellular component= nucleus; Biological process=regulation of transcription
  Homolog annotation: Hit_ID=Q1SX77; Match level="QueryCoverage=96%, HitCoverage=98%, E-value=2e-47, Identity=48%"; Hit description=Myb -like DNA-binding region, SHAQKYF class
  Pfam annotation: Domain name=Myb_DNA-binding; Domain location=112 -159; Score=51.1; E_value=3.6e-12; Accession=PF00249.21; Description =Myb-like DNA-binding domain
  Pfam annotation: Domain name=zf-CCHC; Domain location=5-22; Score =19.0; E_value=0.00073; Accession=PF00098.13; Description=Zinc knuckle
  Pfam module annotation: Pfam domain module=Myb_DNA-binding::zf-CCHC; Domain location=112-159::5-22
  Subcellular localization annotation: CTP_CleavageSite=21; ConfidenceScore=5.57e-01
MGIARKCSYCGNLGHNARTCKSTPGQGQLKLFGVQLDVSSSSSSSNSFSSSSPSYSGMKRSFSTNYLLSSWASSSVPSSFSSPSLLGANENSDSYLLNANSLISTIQDTKKGVPWTEEEHRIFLIGLEKLGKGNWRGISKSFVTTRTPTQVASHAQKYFLRQSQNSFNKRKHRPSPNLFDNWLSHRPHSLLNWVTTLTSTNNCTVQSASPDLELKLATPTPLELSVADA

SEQ ID NO: 201085 - protein, 61 aa, Glycine max
  Coding DNA Sequence Number=SeqID_84307
MRGTEKEKHCYSYYSLIAVSFLGGGQTQRRLIHSFKADVVPNIFAKIWDECGCKMDQIQNN

SEQ ID NO: 201086 - protein, 684 aa, Glycine max
  Coding DNA Sequence Number=SeqID_84308
  Gene Ontology: Mol. function=glycine dehydrogenase (decarboxylating) activity; Cellular component=glycine dehydrogenase complex (decarboxylating); Biological process=glycine metabolic process
  Homolog annotation: Hit_ID=P26969; Match level="QueryCoverage=89%, HitCoverage=57%, E-value=0.0, Identity=86%"; Hit description=Glycine dehydrogenase [decarboxylating], mitochondrial precursor
  Pfam annotation: Domain name=GDC-P; Domain location=1-153; Score= -210.4; E_value=2.8e-07; Accession=PF02347.6; Description=Glycine cleavage system P-protein
MLDVTSNVIGKEKSNGNKMEWKHRRESSVGNGLVLVLGHSGNHVLVLFELALLANMAAMYAVYHGPEGLKTIAQRVHGLAGVFAQGLKKLGTVEVQDHPFFDTVKIKTANAHAIADAARKNEINLRVVDGNTITVAFDETTTLEDVDNLFKVFSDGKPVSFTAASLAPEVQTAVPSGLTRNSPYLTHPIFNTYHTEHEVLRYIHRLQSKDLSLCHSMIPLGSCTMKLNATTEMMPVTWPSFANIHPFAPIEQAQGYQEMFENLGKLLCTITGFDSFSLQPNAGAAGEYAGLMVIRAYHLARGDHHRNVCIIPVSAHGTNPASAAMCAMKIVSVGTDAKGNINIEELRKAAETHKDNLAALMVTYPSTHGVYEEGIDEICKVIHDNGGQVYMDGANMNAQVGLTSPGWIGADVCHLNLHKTFCIPHGGGGPGMGPIGVKKHLAPFLPSHPVVSTGGIPAPGKSQPLGTISAAPWGSALILPISYSYIAMMGSKGLTEASKTAILNANYMAKRLENHYPVLFRGVNGTVAHEFIVDLRGFKNTAGIEPEDVAKRLMDYGFHSPTMSFPVPGTLMIEPTESESKSELDRFCDALISIRQEIAEIEKGKADINNNVLKCAPHPPPVLMGDAWTKPYSREYAAFPASWLRVSKFWPSTGRIDNVYGDRNLVCTLLPTSQAVEEQAAATA

SEQ ID NO: 201087 - protein, 146 aa, Glycine max
  Coding DNA Sequence Number=SeqID_84309
MGRDLHRWQQFDHVQSSKPQGCNLRAQVLVASDLERENGFDMEENASSTEALTRKLDEILTETENDAGQFCFKEETVEKFMQELYKEIIASPPTPSNAVQVQNDSVGLQVVIGEDKTDEGHFDEDDWLARVLRWGQVLHTSHCFCF

SEQ ID NO: 201088 - protein, 279 aa, Glycine max
  Coding DNA Sequence Number=SeqID_84310
  Homolog annotation: Hit_ID=Q5JMS6; Match level="QueryCoverage=72%, HitCoverage=67%, E-value=2e-38, Identity=38%"; Hit description =Membrane protein-like
MMGLGWVAKPNNRQCRRWTTSRIWGATFLCCMCLIFFTPRIPRSPKHHQFVDMRNLLDSPGVPNTLNVMTNFPFLVVGVLGLVLALEGGVFNISSQGEVWTWALFYAGIAGVAFGSAYYHLKPDDHRVLWDTLPMMVAFSSLLSSLVVERLGQRIGLCCMFALNLAAFLCVVYERIYNDIRFCMMFQLTLPLAIPVIAVLYRSKYTHSRYWFISTGFRACQHHIDALSTFIVLKIIIYEVQLPWLHIFGSHHFQCIHYTFISNWKCRALIILDKVHHYT

SEQ ID NO: 201089 - protein, 194 aa, Glycine max
  Coding DNA Sequence Number=SeqID_84311
MEQALKQLPREKIHVATKFGITVAKFPNFQIKGTPKWVNLRNLWKRHIALLVEAFLVPKVERTEYVASKQNSSFGPMFTGATFVQPNKPGFKINGHSIRLNEFKAMRKNNTKKIEIRLDLSVVGNLEIERSRENENAQRTVAERIASNVHSKMVSNNRLRMSVVKSIFHFTNYKITTAILSKTVPQRTALETVS

SEQ ID NO: 201090 - protein, 433 aa, Glycine max
  Coding DNA Sequence Number=SeqID_84312
  Gene Ontology: Mol. function=glycine dehydrogenase (decarboxylating) activity; Cellular component=glycine dehydrogenase complex (decarboxylating); Biological process=glycine metabolic process
  Homolog annotation: Hit_ID=P26969; Match level="QueryCoverage=84%, HitCoverage=35%, E-value=1e-162, Identity=77%"; Hit description =Glycine dehydrogenase [decarboxylating], mitochondrial precursor
  Pfam annotation: Domain name=GDC-P; Domain location=109-433; Score =644.9; E_value=6.6e-191; Accession=PF02347.6; Description=Glycine cleavage system P-protein
  Subcellular localization annotation: CTP_CleavageSite=41; ConfidenceScore=5.70e-01
MAEAANGFAPSVNSSSPKTRVHNKEKKSRANHFARFRNKCKANTSTSTAAGTSQAILKRLISTAGDNSHSLLRPKPENSILGSNRKLSHYVPSRSISLAALKPSDSFPRRHNSATSEEQTKMAQTCGFDTLDSLIDATVPKSIRLSDMSFSVFNEGLTESEMMSHMNSLASKNKCFKSYIGMGYYNTHVPPVILRNIMENPAWYTQYTPYQAEISQGRLESLMNFQTVISDLSALPMSNASLLDEGTAAAEAMSMCNNIHKGKRKTFIIANNCHPQTVDVCVTRAAGFGIKVVTVDVKDVDYKSGDVCGVLVQYPGTEGEVLDYGEFVKEAHAYGVKVVMATDLLALTVLKPPGEMGVDIVVGSAQRFGVPMGYGGPHAAFLATSQEYKRMMPGRIIGVSVDSGGKPALRMAMQTREQHIRRDKATSNICTAQ

SEQ ID NO: 201091 - protein, 174 aa, Glycine max
  Coding DNA Sequence Number=SeqID_84313
  Homolog annotation: Hit_ID=Q1SX97; Match level="QueryCoverage=39%, HitCoverage=62%, E-value=5e-24, Identity=77%"; Hit description =Thioredoxin fold
MEFENGVYLGGGDPSFVVQLWVLRSVVPCNDLTPDGTSKMKKAIRSSLIPHGGAVTVAGDVEADQGFEAADAGAAYKGRGGAGVGEGGDLLVVQFDDGGVDADGGEELLHDVAHAAGGSGEDDDRRGGGVAHSGTQLQLPYDVVLEAAYAYAYALHPLLSTVHSLLLLVQQKKE

SEQ ID NO: 201092 - protein, 317 aa, Glycine max
  Coding DNA Sequence Number=SeqID_84314
  Gene Ontology: Mol. function=transporter activity; Cellular component= mitochondrial inner membrane; Biological process=transport
  Homolog annotation: Hit_ID=Q1SX96; Match level="QueryCoverage=63%, HitCoverage=62%, E-value=1e-89, Identity=80%"; Hit description =Mitochondrial substrate carrier
  Pfam annotation: Domain name=Mito_carr; Domain location=124-212; Score=75.6; E_value=1.6e-19; Accession=PF00153.17; Description =Mitochondrial carrier protein
  Pfam annotation: Domain name=Mito_carr; Domain location=26-119; Score= 90.1; E_value=6.7e-24; Accession=PF00153.17; Description =Mitochondrial carrier protein
  Pfam module annotation: Pfam domain module=Mito_carr::Mito_carr; Domain location=124-212::26-119
MTYFFQQDLYKSMLRGGNSSDNLLPGATANFAAGAAAGCTTLVMVYPLDIAHTRLAADIGRREVRQFRGIYHFLATIFHKDGVRGIYKGLPASLHGMVVHRGLYFGGFDTMKEIMSEESKPELALWKRWVVAQAVTTSAGLISYPLDTVRRRMMMQSGIEQPVYNSTLDCWRKIYRTEGLASFYRGAVSNVFRSTGAAAILVLYDEAMEDQKFDMMKGDFDCQERIGEIRTKKLCKVLNCKVREQPHVCGSKIAGQKAIGLDRSMKSSNRMEELIDINNSKDDSILSLENVNLTIFCLSCNLVKTRRRWNVPKKYMG

SEQ ID NO: 201093 - protein, 121 aa, Glycine max
  Coding DNA Sequence Number=SeqID_84315
  Gene Ontology: Mol. function=oxidoreductase activity; Cellular component=membrane; Biological process=electron transport
  Homolog annotation: Hit_ID=Q2MIZ8; Match level="QueryCoverage=66%, HitCoverage=14%, E-value=6e-21, Identity=67%"; Hit description =Cytochrome P450 monooxygenase CYP711A12
MVFMDYLEWLLPIPSVPSASAMFTLLALIGGLLVYLYAPYWGVRKVPGPPSLPLVGHLPLLAKYGPDVFSVLAKQYGPIYRKKVVSLDWISIFLFLCPLKCLKLLLKNDMILGRITMADKF

SEQ ID NO: 201094 - protein, 251 aa, Glycine max
  Coding DNA Sequence Number=SeqID_84316
  Gene Ontology: Mol. function=oxidoreductase activity; Cellular component=membrane; Biological process=electron transport
  Homolog annotation: Hit_ID=Q2MIZ8; Match level="QueryCoverage=71%, HitCoverage=32%, E-value=3e-61, Identity=70%"; Hit description =Cytochrome P450 monooxygenase CYP711A12
RGIQVVEDDGVWGMEEEVLALVTDVVDLEPEEEGQPVQKVVRHGGGRMGGGNRTLPPEGGGGKGRERDSQWSIMRNTILSMYQPSYLSRLVPTMQSFIESATQNLDSQKEDIIFSNLSLRLATDVIGHAAFGVNFGLSSPHSVCDSIKNVNVNNNNNNASASSSNSNDNEVSDFINQHIYSTTQLKMDLSGSLSIILGLLLPILQEPFRQILKRIPGTMDWKIEHTNQKLSGRLDEIVEKRMKDKTRIRRF

SEQ ID NO: 201095 - protein, 344 aa, Glycine max
  Coding DNA Sequence Number=SeqID_84317
  Gene Ontology: Mol. function=transporter activity; Cellular component= mitochondrial inner membrane; Biological process=transport
  Homolog annotation: Hit_ID=Q8S1A3; Match level="QueryCoverage=97%, HitCoverage=97%, E-value=4e-90, Identity=52%"; Hit description =Mitochondrial carrier protein-like
  Pfam annotation: Domain name=Mito_carr; Domain location=144-242; Score=86.7; E_value=7.3e-23; Accession=PF00153.17; Description =Mitochondrial carrier protein
  Pfam annotation: Domain name=Mito_carr; Domain location=245-334; Score=79.6; E_value=9.6e-21; Accession=PF00153.17; Description =Mitochondrial carrier protein
  Pfam annotation: Domain name=Mito_carr; Domain location=30-143; Score= 39.0; E_value=1.6e-08; Accession=PF00153.17; Description =Mitochondrial carrier protein
  Pfam module annotation: Pfam domain module=Mito_carr::Mito_carr::Mito_ carr; Domain location=144-242::245-334::30-143
MDSSQGSTIAGFVDNASIKRNESSFDGVPVYVKELIAGGFAGILDLESSRNTREGGENFKYNTSFMMSLLSLQLQNALEWVYLTRTPGFHSLGVYQSMNKLLKHEGFLGLYKGNGASVIRIVPYAALHFMTYERYKSWILNNYPVLGSAAGGTSVLCTYPLDLARTKLAYQVADTRGLIKDGMKGVQPAHNGIKGVLTSVYKEGGVRGLYRGAGPTLTGILPYAGLKFYMYEKLKTHVPEEHQKSIMMRLSCGALAGLFGQTLTYPLDVVKRQMQVGSLQNAAHEDVRYKNTIDGLRTIVCNQGWKQLFHGIVPSAAISFTTYDMVKSWLGIPPQQKSQSVSAA

SEQ ID NO: 201096 - protein, 188 aa, Glycine max
  Coding DNA Sequence Number=SeqID_84318
  Gene Ontology: Mol. function=oxidoreductase activity; Cellular component=membrane; Biological process=electron transport
  Homolog annotation: Hit_ID=Q2MIZ8; Match level="QueryCoverage=83%, HitCoverage=32%, E-value=1e-68, Identity=74%"; Hit description =Cytochrome P450 monooxygenase CYP711A12
MGLVQWIRYQLLKIFMTSFLILIRFVQNEHKILDKLDVPTCKGRVIKEAMRFYTVSPLVARETSNEVEIGGYLLPKGTWVWLALGVPAKDPRNFPEPDKFKPERFDPNFEEMKRRHPYAFIPFGIGPRACIGRQFSLQEIKLSLIHLYRKYLFRHSPNMENPLELQYGIVLNFKHGVKLRAIKRKEAC

SEQ ID NO: 201097 - protein, 210 aa, Glycine max
  Coding DNA Sequence Number=SeqID_84319
  Gene Ontology: Cellular component=membrane
  Homolog annotation: Hit_ID=Q00WF6; Match level="QueryCoverage=43%, HitCoverage=31%, E-value=2e-10, Identity=35%"; Hit description =Homology to unknown gene
  Pfam annotation: Domain name=Multi_Drug_Res; Domain location=24-97; Score=-29.3; E_value=0.08; Accession=PF00893.10; Description=Small Multidrug Resistance protein
MWESIVLTVVATAGNNIGKILQKKGTVIRAYALNKTWLIGFVMDIFGALLMLRALALAPVSVIQPVSGCGLAILSVFSHFYLKEVMNIVDWVGITLAGFGTIGVGAGGEEQEAAALSIFHIPWLAFVVFILFVETIVQIMLNGWLRIFKRNRREQEMDGICNIKDGVSVLGARLPQAVGSYLHHHKCLFKWYRLLLPGILKASFMPFTFV

SEQ ID NO: 201098 - protein, 100 aa, Glycine max
  Coding DNA Sequence Number=SeqID_84320
MKNSEFVRGYCGVRVSETRRVVVVVVVVAVAVAVRGGRNREGVGESSTLLCCIWHFVLVAREKKENKSQKTTKTPNLLEGNKYPSHPQTTNLSSHPECFE

SEQ ID NO: 201099 - protein, 126 aa, Glycine max
  Coding DNA Sequence Number=SeqID_84321
MEERETCVQKGATSILCINWHQNQSSKTQVSPRPFVASGVEKPSLIANRLMERDEGECFYDCLLANKGGANSNIRKRSRFICCCRGLLKKVRNSWQINYLTGNPLSESTAKSSRILKEYIVDNGKF

SEQ ID NO: 201100 - protein, 110 aa, Glycine max
  Coding DNA Sequence Number=SeqID_84322
MKLWLFTDHLIHKPLTDQVDPEESYGSSNFPMAVSAIAGNNGGRRRKAKEKRTSKKKQKLEEEAATQRRSFHLIPTTMAATKMRKKQKREEEDRRRRGSAKKKKTEEDAE

SEQ ID NO: 201101 - protein, 313 aa, Glycine max
  Coding DNA Sequence Number=SeqID_84323
  Gene Ontology: Mol. function=oxidoreductase activity; Biological process=metabolic process
  Homolog annotation: Hit_ID=Q1B5U9; Match level="QueryCoverage=49%, HitCoverage=96%, E-value=6e-55, Identity=68%"; Hit description=MaoC -like dehydratase
  Pfam annotation: Domain name=MaoC_dehydratas; Domain location=166 -289; Score=65.4; E_value=1.9e-16; Accession=PF01575.9; Description =MaoC like domain
  Subcellular localization annotation: CTP_CleavageSite=68; ConfidenceScore=5.46e-01
MDRRALTGAPRDVWKPRWTTRRAARSSAAALSTRQNAQFTLARMRPGCTPPAWHGTTPPGCGTREAVRGSRRRRQARRRRGRDGQCQGRDPDLRRERLHERVPRRASLPGLEDPGDRRGHHRGAAARDRPWTRAGRVALPHAGPDTTEGVEVSTRDIVQRGLYYEEFEIDTRYLHRPGRTATEADNVLFTTLTMNTQALHLDAAFADAQEPFRSRLMNSMWTLSTMVGASVAQLTQGTLVAQLGFGEIAFPHPLFAGDTLYTDSTIVEKRLSASRPGQGILTIAHTGRNQDDTVVATAVRSVLVHCLPEGSAR

SEQ ID NO: 201102 - protein, 551 aa, Glycine max
  Coding DNA Sequence Number=SeqID_84324
  Gene Ontology: Mol. function=inorganic phosphate transporter activity; Cellular component=1-2nm peptidoglycan-based cell wall; Biological process=phosphate transport
  Homolog annotation: Hit_ID=Q6D2D4; Match level="QueryCoverage=82%, HitCoverage=81%, E-value=3e-66, Identity=50%"; Hit description =Phosphate ABC transporter permease protein
  Pfam annotation: Domain name=BPD_transp_1; Domain location=25-220; Score=-4.7; E_value=0.012; Accession=PF00528.12; Description=Binding- protein-dependent transport s
  Subcellular localization annotation: CTP_CleavageSite=41; ConfidenceScore=5.05e-01
MGALPSVVIGLIAGVWLAPHISRALPGVMLLPLVLAATLLVCGVLSPRLPARWRRPGFEVLLLMPLLLLVTLLTLWLPTLWWPQMGEQLAHYEQRNLLVAALAMGFALVPLIFTLAEDALFSVPVALGQGSLALGATPWQTLTRVVLPGASAGIFAALMIGFGRAVGETMIVLMATGNTPGVRAFWPQPVDQYQFQPPQGAPLRVLGETLDRQQQGDRWRYVVKTGNRDFAAPDFRVIVSQGEAQTRRPAEALVLQRRSGGNAYGWLVELREDNEVLTARDRDALLQQRLKQVHEQLRQASNIRRIEMARLNAQLESLQQQADEQRRGGHFSLQDQSELDANSAALHKRFGALAQQLAHLQHESQRDTLVLRDVQGDDHLIPLAQVVAACDCHAAGRGGRRLAARIRRAQRTHPAGAHCGGESGGRAVDCVWRVWPRLFCLADWRHPRSAVLLPLAAQSYLRHAWPAVGGADAGAADAAGSDCRHRRGAVAYSGQSASGLAGAGRNPGRNPVARGAAAGGTGDAHRPDSGGGARRRRNRTADAGGRGQNGA

SEQ ID NO: 201103 - protein, 114 aa, Glycine max
  Coding DNA Sequence Number=SeqID_84325
  Gene Ontology: Mol. function=transporter activity; Cellular component= integral to membrane; Biological process=transport
  Homolog annotation: Hit_ID=P0AGM7; Match level="QueryCoverage=71%, HitCoverage=19%, E-value=2e-39, Identity=97%"; Hit description =Uracil permease
QQQHRRDKGKAGAKIGRDFAFTDKQIQQRADAVEQQHGGRVDVEQNWHQHGGAEHGEQVLQAERNGLKKRWAFANAYGSASHHLSPIRLFLCSFVNAAPYRSGAIHCALSGWAP

SEQ ID NO: 201104 - protein, 375 aa, Glycine max
  Coding DNA Sequence Number=SeqID_84326
  Gene Ontology: Mol. function=phosphoribosylformylglycinamidine cyclo -ligase activity; Cellular component=cytoplasm; Biological process =purine nucleotide biosynthetic process
  Homolog annotation: Hit_ID=P08178; Match level="QueryCoverage=78%, HitCoverage=85%, E-value=1e-148, Identity=87%"; Hit description =Phosphoribosylformylglycinamidine cyclo-ligase
  Pfam annotation: Domain name=AIRS; Domain location=1-127; Score =158.4; E_value=1.8e-44; Accession=PF00586.14; Description=AIR synthase related protein, N-terminal domain
  Pfam annotation: Domain name=AIRS_C; Domain location=138-306; Score =182.8; E_value=8.3e-52; Accession=PF02769.12; Description=AIR synthase related protein, C-terminal domain
  Pfam module annotation: Pfam domain module=AIRS::AIRS_C; Domain location=1-127::138-306
MGGLGGFGALCALPQKYREPVLVSGTDGVGTKLRLAMDLKRHDSIGIDLVAMCVNDLVVQGAEPLFFLDYYATGKLDVDTASAVITGIAEGCLQSGCALVGGETAEMPGMYHGEDYDVAGFCVGVVEKSEIIDGSKVQDGDVLIALGSSGPHSNGYSLVRKILEVSQTDPTTKQLEGKPLADHLLAPTRIYVKNILSLIEQVDVHAIAHLTGGGFWENIPRVLPDNTQAVIDEKSWQWPAVFSWLQQAGNVSRHEMYRTFNCGVGMVIALSPADADKAVQLMTAAGEQAWKIGVINASDAEERVSILDACESGRINGSVAAVFSNKASAYGLTRAQQASVPAHALSAQDFTDRDAFDRQLMQQIDAYAPDLVVLA

SEQ ID NO: 201105 - protein, 61 aa, Glycine max
  Coding DNA Sequence Number=SeqID_84327
  Subcellular localization annotation: CTP_CleavageSite=56; ConfidenceScore=5.49e-01
MESVEPAVVPMSGKLSLRSARTPTAGVSSSAGIRAASTDFFNRKVMPMFCGGVSFSAAALS

SEQ ID NO: 201106 - protein, 496 aa, Glycine max
  Coding DNA Sequence Number=SeqID_84328
  Homolog annotation: Hit_ID=Q3J8J6; Match level="QueryCoverage=65%, HitCoverage=88%, E-value=4e-24, Identity=41%"; Hit description =Hypothetical protein precursor
  Pfam annotation: Domain name=DUF1791; Domain location=294-419; Score =8.9; E_value=3.4e-05; Accession=PF08754.1; Description=Domain of unknown function (DUF1791)
MNGQVLLTGQLATRDDSINPHDEALSFAVHPSACACRRVSMRSVVSYALIAIVGGMVGAAVIKSDDLYQRIAGHFSAEPADPDGFWSTPAVAGYGKIHYEADAAFKPAVGLSNKVVFQLTRNEGDIKRPNLGLERVARVVNLYIAAGVPAEQLQFVVSMTGDATPATLDNAHFKQFYGVDNPNLALIGALNKLGVKVSVCDQSVAFHHYPRDWIDRRSVMRPASYIVIAALAGFVGGNMLQLPELVDKVSGKFADQKTEPADFWSTPAIAGYGKIHFVNTPDYNPANTPGLSNKIVFQINRSEGDIHQPNLGLERVARVTNLYYAAGVPLNQLNFVVSINSDAVPAALNNDQFRKAYGSDNPNLKLIDELKKAGVKVTICDQSVAFHQLERDWIDTRVTHTLSSGTTVASLQNEGLLSSFRHPFAMSLSQFAVSLGANEIDLIGTLRGEHVRLTHGGKAGRRFTRHGRARLFRSPSAAERHAGESAGGVGAARLSS

SEQ ID NO: 201107 - protein, 71 aa, Glycine max
  Coding DNA Sequence Number=SeqID_84329
DPEKSNRVLGFLALITGFCQFYGVPVTPGKVIRSPTNQAFIKNSSQLIHNKVRALPTTHGRPIGDHSPKPK

SEQ ID NO: 201108 - protein, 94 aa, Glycine max
  Coding DNA Sequence Number=SeqID_84330
MAKGTMDVAALAKKLSEKFKRKIEVVLPKKEKEKGKEKESEKEGGGKGENDSAKKKKMGGNGGGREGHNDKGNEGGGGNGQRKTEQIEHCQLLW

SEQ ID NO: 201109 - protein, 116 aa, Glycine max; identical to SEQ ID NO: 159914
  Coding DNA Sequence Number=SeqID_84331
  Gene Ontology: Mol. function=RNA-directed DNA polymerase activity; Biological process=RNA-dependent DNA replication

SEQ ID NO: 201110 - protein, 232 aa, Glycine max
  Coding DNA Sequence Number=SeqID_84332
  Homolog annotation: Hit_ID=O21999; Match level="QueryCoverage=21%, HitCoverage=33%, E-value=7e-22, Identity=100%"; Hit description=LacZ- alpha
  Subcellular localization annotation: CTP_CleavageSite=76; ConfidenceScore=5.18e-01
GRSIWKNASNAAFLRFLAFCWPFAHMFFPALSPDSVDNRITAFEKRKSAQYANRLSPRVGRFINAAGTTGFPTGKRAVSATQLIYDHDYEFELGTVVAVAVAEVKAGELVGVSACVLGDMASRPNFGLNELDFVFSTLVVGAILNFTLMYLLAPTMTSSAASNLPALFASCPKSHMFEPGMQAWHWPSFYNVVTGKTLALPNLIALQHIPLSPAGVIAKRPAPIALPNSCAA

SEQ ID NO: 201111 - protein, 72 aa, Glycine max
  Coding DNA Sequence Number=SeqID_84333
MSSHQERRERHKERSKEVKSYFYPLPRKSKHTGEKSSYRERYKSSYGERYPVSVYLLFVRIIDFKILLVSYN

SEQ ID NO: 201112 - protein, 54 aa, Glycine max
  Coding DNA Sequence Number=SeqID_84334
MVMMVVDNSDNSVDGIYNSDSGAVLAAATMATTVVKYIRHGYFLANICYFLFQH

SEQ ID NO: 201113 - protein, 191 aa, Glycine max
  Coding DNA Sequence Number=SeqID_84335
  Homolog annotation: Hit_ID=O21999; Match level="QueryCoverage=28%, HitCoverage=35%, E-value=3e-22, Identity=94%"; Hit description=LacZ -alpha
RNRKSAQYANRLSPRVGRFINAAGTTGFPTGKRPVSATQLIYDHDYEFELGTLVNASDSGFYGILLSGASSWHKLCISRGRRRSNKSTRSKKSYCDVRQWQMWENLVVNIRDFTRQGMRYRSYINDNLAISIDYSITTSMQAWHWPSFYNVVTGKTLALPNLIALQHIPLSPAGVIAKRPAPIALPNSCAA

SEQ ID NO: 201114 - protein, 107 aa, Glycine max
  Coding DNA Sequence Number=SeqID_84336
MPISLYGSISWSVSSRHRDRDHKAPCGPGGVRQGPGVSSSGYGPLSVLQDAHTPSKVMPSWHRDHAHKTPSGPGEVQQGPGVSSSGYGPLLVLQGARSPQQGHAIMT

SEQ ID NO: 201115 - protein, 251 aa, Glycine max
  Coding DNA Sequence Number=SeqID_84337
  Homolog annotation: Hit_ID=O21999; Match level="QueryCoverage=17%, HitCoverage=28%, E-value=1e-14, Identity=86%"; Hit description=LacZ -alpha
DAGSRQARQGASAGVAGCRGWLNYAASEQIVLRVHHMRAIGAGLFAITPAGERGMCCKAIKLGNARVFPVTTLSTLEDPQRLAERITSLSRFLPRIVKKARLIMNLLIKAKIFVWDEDCKEVFRQLKETLATPPILSKLDTTKKLIVYLSIMVKAISLVLVQKEGIGAQVLADFINEFHPPPLHFEQEWWTMRVGDFSNGRETCRASCINESANARGEAVCVLGALPLPRSLTRCARSFGCGERYQAHSKA

SEQ ID NO: 201116 - protein, 179 aa, Glycine max
  Coding DNA Sequence Number=SeqID_84338
  Subcellular localization annotation: CTP_CleavageSite=27; ConfidenceScore=5.41e-01
MNKAKDPKCPTLQPYLQHNVSRTTSISVAAGVSSGVPLVSHPVLPPALAAAPGLHKPRWRLCSINMIASVLKVEVPKGAVGTRAGAGAGAGAGVGASAEVDAGVEVGAEVEASEGSQALVLWVPEKVIMGSSGFQQFFRIKAKLMAGLRDSKVRESGTTPLAMHKAMIMAGKPSREELD

SEQ ID NO: 201117 - protein, 146 aa, Glycine max
  Coding DNA Sequence Number=SeqID_84339
MRKKTDNKEEKKTKSELAREKNKEAIPSTGKVAREWPPEREKHPLPDLKNHKTLQDSYLRLLGSDMNRYDEYQKELERRRWHKALTRQPDNHIDMALVKEFYVNLYDPEDKSPRQVRGKLIKFDVKTLNTFLETPVVLELGEKYSA

SEQ ID NO: 201118 - protein, 173 aa, Glycine max
  Coding DNA Sequence Number=SeqID_84340
MLQPYEISIGLKEHSNPVTPKAYTPKSPSGPLPPDSVIPPTAPIEFPNVRETEKRLKPPLIMSSCDSFFSLHECYLANPNGGSFYQDSSGFLRERKRLQCEGCFSQFRDDIEIPNGENSRNSVANMILKFHDDTTVNGFEIVVFLRLVWWAAGKRKGFERRRGKTKMRPKGGS

SEQ ID NO: 201119 - protein, 320 aa, Glycine max
  Coding DNA Sequence Number=SeqID_84341
  Gene Ontology: Mol. function=protein dimerization activity; Cellular component=nucleus; Biological process=regulation of transcription, DNA-dependent
  Homolog annotation: Hit_ID=Q0GPE9; Match level="QueryCoverage=92%, HitCoverage=52%, E-value=2e-55, Identity=48%"; Hit description=BZIP transcription factor bZIP28
MGENEEATTTDMLQRLHFLKQPLNMEQLSIPQFNPSQMRARHHHQNQNQFDGGNSNKRAGIPPSHPHQIPPISPYSQIPLSRQHSNINSNSNISPTPTHTRSLSQPSFFSLDSLPPLSPSPFRDSSSTSVSEAADVSMEDRDVSSHSLLPPSPFSRTLNTNNSNLPLPPRKAHRRSNSDIPFGFSTVLQSSPPLIPLRNPVSAKPAQLVKRETPWDRVVEHNTNTNNNNNVEGSGEKKSPEGEVVDDLFSAYMNLDSFDALNSSGTDDKNGGENRDDLDSRASGTKTNGGDSSDNEAESSVNESGHGGSEKREGMKRSAG

SEQ ID NO: 201120 - protein, 585 aa, Glycine max
  Coding DNA Sequence Number=SeqID_84342
  Gene Ontology: Mol. function=transcriptional elongation regulator activity; Cellular component=cytoplasm; Biological process =regulation of transcription, DNA-dependent
  Homolog annotation: Hit_ID=Q9FJY0; Match level="QueryCoverage=96%, HitCoverage=89%, E-value=1e-171, Identity=57%"; Hit description =Arabidopsis thaliana genomic DNA, chromosome 5, TAC clone:K1F13
  Pfam annotation: Domain name=DUF547; Domain location=360-506; Score =316.5; E_value=4.8e-92; Accession=PF04784.5; Description=Protein of unknown function, DUF547
ETGYLTECGKPRKKQTPTNDVQHSLKQEILQLEKRLQDQFEVRCTLEKALGYRPTSLVNSNETILPKPTSKLIKEIAVLELEVMHLEQYLLSLYRKAFDQQLPSVAPFTKEEKVKSLPSTPRARFVEVSKPEVLIKRGSSAVQSIDHELDTMQKEYNGYEPETLGKEYNVHQPEGKHLDAGVYRCHSSLSQCTTFTTRASAPVAEVLTESLRACHSQPLFMMEYAQNVDASSRIISLAEHLGTRISDHIPDTPNRLSEDMVKCISAIYCKLADPSMTNPGLSSPSSSLSSTSAFSIGDQGDMWSPGLRNNSSFDVRLDNPFHVEGLKEFSGPYSTMVEVSWIYRENQKLGDTEQLLKNFRSLISQLEEVDPGKLKHEEKLAFWINIHNALVMHAFLAYGIPQNNVKRVFLLLKAAYNIGGHTISADTIQNTILGCRLPRPGQWFRLFFSPRTKFKAGDGRRAYPIERPEPLLLFALCSGNHSDPAVRVYTPKRVLQELEVAKEEYIRATFGVRKDQKILFPKLVESFAKDSGLCSAGTMEMIQQSLPESLRKNVKKCDLAKPKKNIEWIPHNFTFRYLIPKELIK

SEQ ID NO: 201121 - protein, 47 aa, Glycine max
  Coding DNA Sequence Number=SeqID_84343
MATTTYKALLGWYVAGLRMTATLRDGKGDTVRMTVTLRVSAATRESE

SEQ ID NO: 201122 - protein, 904 aa, Glycine max
  Coding DNA Sequence Number=SeqID_84344
  Gene Ontology: Mol. function=binding; Biological process=embryonic development ending in seed dormancy
  Homolog annotation: Hit_ID=Q1S6U5; Match level="QueryCoverage=66%, HitCoverage=66%, E-value=1e-106, Identity=36%"; Hit description =Pentatricopeptide repeat
  Pfam annotation: Domain name=PPR; Domain location=416-450; Score =13.1; E_value=0.21; Accession=PF01535.11; Description=PPR repeat
  Pfam annotation: Domain name=PPR; Domain location=502-536; Score =25.0; E_value=0.00027; Accession=PF01535.11; Description=PPR repeat
  Pfam annotation: Domain name=PPR; Domain location=537-570; Score=5.1; E_value=1.8; Accession=PF01535.11; Description=PPR repeat
  Pfam annotation: Domain name=PPR; Domain location=571-605; Score =19.8; E_value=0.0096; Accession=PF01535.11; Description=PPR repeat
  Pfam annotation: Domain name=PPR; Domain location=641-674; Score =13.2; E_value=0.2; Accession=PF01535.11; Description=PPR repeat
  Pfam annotation: Domain name=PPR; Domain location=675-709; Score =26.0; E_value=0.00013; Accession=PF01535.11; Description=PPR repeat
  Pfam annotation: Domain name=PPR; Domain location=722-756; Score =17.7; E_value=0.042; Accession=PF01535.11; Description=PPR repeat
  Pfam module annotation: Pfam domain module=PPR::PPR::PPR::PPR::PPR::PP R::PPR; Domain location=416-450::502-536::537-570::571-605::641 -674::675-709::722-756
  Subcellular localization annotation: CTP_CleavageSite=54; ConfidenceScore=5.55e-01
MGIVGFEINANSASASALHYYGANSFSSHTVPFSLRPFFGNALNVNTRVAGKIRASHARKPKFGAVIVASLSGGSNNAGLISDAVLPKDSEFKPSFDEYLKAMSVRTVRVKKRAATTQKHKKTENGDNNKIDREDEVGVYKEGCSTRSNNNGKVRRTATKGFTSENDGNLDDVKAKQKKSGANVRQNGPLKRRSRSLEPESYDGSEIGKSGSGRMSKSIVRSSLNGSHGSVRERGVTHDLYSSKMLGEKIVSNRQRDYNTQGKPPPGGNKIVARQQQVQDRGLDRKRHTENGSLAYRNGSRKRFIDRGYDSDNLEVERAAFENLEDPNNVIRKSQFSHKEMEEKIQKLANSLNGADINLPEWMFSKMIRSARLKFNDYAITRIIIILGKLGNWRRVIQVIEWLQKRERFKSHKLRHIYTAALDALGKSRRPVEALNIFHAMQQQMSSYPDLVAYHSIAVTLGQAGHMKELFDVIDIMRSPPKKKFKTGIFENWDPRLEPDIVVYHAVLNACVRRKQWEGAFWVLQQLKKQGQPPSATTYGLVMEVMLSCGKYNLVHEFFRKLQKSFSPNSLTYRVLVNTLWQEGKPDEAILAVQEMERRGIVGSASLYYDLARCLSAAGRSHEALKQIDKICKVANKPLVVTYTGLMQASLDAGNIQDGAYIFEKMKEICAPNLVTCNIILKAYLEHGMFQEAKVLFEQMSENANRLRGNTDYKMLVVPDTYSFNTMLDACVAEKRWDYFDHVYQRMLYHGYHFNPKRHLRMILEASKAGKERPLEITWKHLTDTDRIPPAPLIKERFCAKLEKDDYVAALTCIINNPPKDLQPFSKSSWLKLFKENSQRFQKDTIVGLMNEASNIVSNNSFPNPTLEYLIQSCKEFLFATVLSTADMDSGFYFHASSTGNSPK

SEQ ID NO: 201123 - protein, 49 aa, Glycine max
  Coding DNA Sequence Number=SeqID_84345
MTLVLDGFLGRGFEGLVPRHKRSKSFPDKKRDEDDNPDNHLEASDRTKL

SEQ ID NO: 201124 - protein, 258 aa, Glycine max
  Coding DNA Sequence Number=SeqID_84346
  Gene Ontology: Biological process=response to DNA damage stimulus
  Homolog annotation: Hit_ID=Q1SYF5; Match level="QueryCoverage=97%, HitCoverage=97%, E-value=1e-113, Identity=82%"; Hit description =Proteinase inhibitor I25, cystatin
  Subcellular localization annotation: CTP_CleavageSite=30; ConfidenceScore=5.31e-01
MDISLRDSTTSHSTFSGSNVSSLTENNFIAAAVTAGVCLMRNAWKEDQHPSFINFISTFLSANSFRLNFVPIAPDFIFNCGGLSVAFIFVTNWDCNNVAPIFNRVKKLKMQFARFYVVITLPAKEQFDSLIQSYFKFGMVIGKPTFVPVQDSEMGFEKMVKIAHSSGVYKQERIGEKLKAERKQLVQGMNFYLKVLTSIPGIDNHDANSLSQAIGSVQAIAKASKEQILENTDLSTDKAEMVSRFLRDPKFYLCPKIN

SEQ ID NO: 201125 - protein, 57 aa, Glycine max
  Coding DNA Sequence Number=SeqID_84347
MTFESWRFCSQRKISVAFHESTWRRVPIRAMTSFWRLQRVLGPAGGIISPFRILLPR

SEQ ID NO: 201126 - protein, 148 aa, Glycine max
  Coding DNA Sequence Number=SeqID_84348
  Homolog annotation: Hit_ID=Q1RSZ9; Match level="QueryCoverage=52%, HitCoverage=8%, E-value=4e-09, Identity=38%"; Hit description =Polynucleotidyl transferase, Ribonuclease H fold
MIGLAVEMFELIGLTEEMGELIGSAEVMVDLSRLTHLFEEWLDCEDDGSREEKVHHLGNHKWRKLDLGDLMGNLERHKVWNEVGCGNIKCCLLWLRSKETRLFWPELHWAWPNYMWDMDMATQSKEHLAATPTVKEPAIAAAVHGYHR

SEQ ID NO: 201127 - protein, 202 aa, Glycine max
  Coding DNA Sequence Number=SeqID_84349
  Homolog annotation: Hit_ID=Q6AWY4; Match level="QueryCoverage=26%, HitCoverage=15%, E-value=4e-24, Identity=88%"; Hit description =Growth-regulating factor 5
  Pfam annotation: Domain name=WRC; Domain location=11-56; Score=100.8; E_value=3.9e-27; Accession=PF08879.1; Description=WRC
SYCSFYGKKVDPEPGRCRRTDGKKWRCSKEAYPDSKYCERHMHRGRNRSRKPVESQTMTHSSSTVTSLTVTGGSGASKGTVNFQNLSTNTFGNLQGTDSGTDHTNYHLDSIPYAIPSKEYSFWKQQGSPNGVTAGKHMAFDVNQSCLFFYVKIKESWSGLEDERSNQTAFSTTQLSISIPMSSNFSATSSQSPHGEDEIQFR

SEQ ID NO: 201128 - protein, 908 aa, Glycine max
  Coding DNA Sequence Number=SeqID_84350
  Gene Ontology: Mol. function=microtubule motor activity; Cellular component=microtubule associated complex; Biological process =microtubule-based movement
  Homolog annotation: Hit_ID=Q0WLK7; Match level="QueryCoverage=98%, HitCoverage=99%, E-value=0.0, Identity=56%"; Hit description=Kinesin like protein
  Pfam annotation: Domain name=Kinesin; Domain location=30-358; Score =430.0; E_value=3.2e-126; Accession=PF00225.13; Description=Kinesin motor domain
MGAIAGEELLKWEKMQGVSSREEKILVSIRLRPLNEKEIAANESADWECINDTTILYRNTLREGSTFPSAYTFDRVFRGDCVTRQVYEEGAKEVALSVVSGINSSIFAYGQTSSGKTYTMVGITEYAVADIFDYIERHEERAFILKFSAIEIYNEVVRDLLSTDNNTPLRLRDDPEKGPILEKLTEETLRDWEHLKELLAFSEAQRQVGETYLNEKSSRSHQIIRLTSINGVAIFQTMESSAREFLGKGNSATLIASVNLVDLAGSERASQASSAGMRLKEGCHINRSLLTLGTVIRKLSNGRHGHINYRDSKLTRILQPCLGGNARTAIICTLSPARSHVEQTRNTLLFACCAKEVTTKAQVNVVMSDKALVKHLQKEVARLESELKTPGPVPSNCDYAALLRKKDVQIEKMEKEIRELTKQRDLAQSRVEDLLRMVGKEQISGKASINNHLNLQEGEDIWEDDCSVSESSSICGPHRPNTHIREFNNPHYNDEDSDPDDDPDDYCKEVRCVENGELALPISGEESGTSQEISSHLNEDTGDSQIQENSTLLEQRLHVVQSTIDSLVCPSPDEHSPQVMSENNKNLRLTRSWSCTEHHMAGSPKSGGGVQRTPANGYEKGFPGRPDGLQRKFPPLNYDGSTRLLRNGSQSSMGSLSVDDLRASSIRTSADEDITSIQTFVAGMKEMVKQEYEKQLVDGQDQETGRKNVKDVGVDPMLEAPGGTPLDWSLQFKRHQKEIIELWQSCCVPLTHRTYFFLLFRGDPSDSIYMEVELRRLSFLKESFSDGNKSVRDSQTITLASSVKALRRERGMLVKLMQRRLSEKERRRLYEECGIALDSKRRRVQLANSLWSENDMNHVMQSATIVAKLVRFWERGKALKEMFGLSFTPQLTGRRSSYPWKNSSASLL

SEQ ID NO: 201129 - protein, 113 aa, Glycine max
  Coding DNA Sequence Number=SeqID_84351
MTPEKQILLGLLLAKHVSLESDANTSTNTTTSLTVEDRTLLVKEAVAQGLKGERSFASVNLPFSSRTNDNSKPPRAQAGSYTTCGCEWMNGYFHITTHLRIFVVPACSIIYFC

SEQ ID NO: 201130 - protein, 126 aa, Glycine max
  Coding DNA Sequence Number=SeqID_84352
MVIFWNFQDLNSPRAAVCLPGPWESFNLKQPARLGEIQLTWARSSSPRRADTFKPKQLACMGELPLHQMAFSYKYPCRGRVSRVGKLRKERKNTKRRKKRRNKEKSRSCQIKPWIVSYISLASLVP

SEQ ID NO: 201131 - protein, 119 aa, Glycine max
  Coding DNA Sequence Number=SeqID_84353
  Homolog annotation: Hit_ID=Q9FIL3; Match level="QueryCoverage=43%, HitCoverage=35%, E-value=2e-21, Identity=82%"; Hit description =Arabidopsis thaliana genomic DNA, chromosome 5, TAC clone:K19M22
  Subcellular localization annotation: CTP_CleavageSite=38; ConfidenceScore=5.74e-01
MASALGSRVESVRNSHLLSFSLNSIRSLSSSSSSAVSSAQNPKTKKSKRRKKNLFDVAQFLPNWGIGYHMAKTHWNEVSYEITKINLYKDGRHGKAWGVAFKNGTGNHAALLFFNEIVG

SEQ ID NO: 201132 - protein, 204 aa, Glycine max
  Coding DNA Sequence Number=SeqID_84354
  Gene Ontology: Mol. function=zinc ion binding; Biological process =regulation of transcription
MVDVHKLICQTCNNVGVGDGSDGFFYCLRCGSQCEDVMDTAVDDDDLFNKSAVYLPSHQRQRSVAIKAEPISQYDSFYDSHSNFIRNLGLEDENPQRNDHVQVKREEEFDAAQFDEASPSVPADFGGSQVACFEDYHNEIRMRYVMGLQMMIELQCEALVKEFKVTPLICGLVGPIWLRFVSKTGIFGDDWADKVIHDSETQNE

SEQ ID NO: 201133 - protein, 690 aa, Glycine max
  Coding DNA Sequence Number=SeqID_84355
  Gene Ontology: Mol. function=transferase activity; Cellular component= intracellular; Biological process=translation
  Homolog annotation: Hit_ID=Q9FGR7; Match level="QueryCoverage=98%, HitCoverage=97%, E-value=0.0, Identity=56%"; Hit description =Similarity to salt-inducible protein
  Pfam annotation: Domain name=PPR; Domain location=248-282; Score =27.7; E_value=4e-05; Accession=PF01535.11; Description=PPR repeat
  Pfam annotation: Domain name=PPR; Domain location=319-353; Score =22.9; E_value=0.0011; Accession=PF01535.11; Description=PPR repeat
  Pfam annotation: Domain name=PPR; Domain location=354-388; Score =54.8; E_value=2.8e-13; Accession=PF01535.11; Description=PPR repeat
  Pfam annotation: Domain name=PPR; Domain location=389-423; Score =32.5; E_value=1.5e-06; Accession=PF01535.11; Description=PPR repeat
  Pfam annotation: Domain name=PPR; Domain location=424-459; Score =10.2; E_value=0.46; Accession=PF01535.11; Description=PPR repeat
  Pfam annotation: Domain name=PPR; Domain location=460-494; Score =38.7; E_value=2e-08; Accession=PF01535.11; Description=PPR repeat
  Pfam annotation: Domain name=PPR; Domain location=495-529; Score =21.5; E_value=0.0031; Accession=PF01535.11; Description=PPR repeat
  Pfam annotation: Domain name=PPR; Domain location=530-564; Score =35.4; E_value=2e-07; Accession=PF01535.11; Description=PPR repeat
  Pfam annotation: Domain name=PPR; Domain location=565-599; Score =35.9; E_value=1.4e-07; Accession=PF01535.11; Description=PPR repeat
  Pfam annotation: Domain name=PPR; Domain location=600-634; Score =32.0; E_value=2e-06; Accession=PF01535.11; Description=PPR repeat
  Pfam module annotation: Pfam domain module=PPR::PPR::PPR::PPR::PPR::PP R::PPR::PPR::PPR::PPR; Domain location=248-282::319-353::354-388::389- 423::424-459::460-494::495-529::530-564::565-599::600-634
  Subcellular localization annotation: CTP_CleavageSite=47; ConfidenceScore=5.57e-01
MALNLTPSSYFHHPFISHQIHFHTLSKPFSLTHSKTSTFSVSKTLCLCASPSNTPIFLPYLRQLEPENHEQGEGIETIVEEQEYDPDDPIYKFFKTRTRFSSQDPGKEGKLSLQKNRRISWHLASDLIEEEEEPEMGLIEEKEKTVFQKKALPLPEGIVGEIVQLARNLPQNLTLEEALAEYEGRRVSEKECWEVLKLLGDEQLLEPSLVTPRACTVLFPLLGKAKMGDKLMVLFTNLPSSREFRDSHVYNAAISGLLSSARYEDAWKVYESMEADNVLPDHVTCSIMVIVMRKLGHSAKDAWQFFEKMNGKGVKWGEEVLGALIKSFCVEGLMSEALIILSELEKKGVSSNTIVYNTLMDAYCKSNRVEEAEGLFVEMKTKGIKPTEATFNILMYAYSRKMQPEIVEKLMAEMQETGLKPNAKSYTCIISAYGKQKNMSDMAADAFLKMKKDGIKPTSHSYTALIHAYSVSGWHEKAYAAFENMQREGIKPSIETYTALLDAFRRAGDTQTLMKIWKLMRREKVEGTRVTFNTLVDGFAKHGYYKEARDVISKFANVGLHPTVMTYNMLMNAYARGGRHSKLPELLEEMAAHNLKPDSVTYSTMIYAFLRVRDFSQAFFYHQEMVKSGQVMDVDSYQKLRAVLDAKAAIKNRKDRRSMIGVVRNKMGVVKPKRKKDELWKYRKRHVKQK

SEQ ID NO: 201134 - protein, 124 aa, Glycine max
  Coding DNA Sequence Number=SeqID_84356
  Gene Ontology: Mol. function=unspecific monooxygenase activity
  Homolog annotation: Hit_ID=O04892; Match level="QueryCoverage=93%, HitCoverage=36%, E-value=7e-30, Identity=83%"; Hit description =Cytochrome P450 like_TBP
  Subcellular localization annotation: CTP_CleavageSite=61; ConfidenceScore=5.44e-01
PTPGRTHNRIRSPRGTASGRWNNVGKGSRQNGSVTSGKGLALRAGHGGPSPEPVGCRWTARAASAARAGRRVPVGGRIGNGPFGASSPGVEQSTQNCETTAKGTGLAESAGKEDPVELDSSPTL

SEQ ID NO: 201135 - protein, 272 aa, Glycine max
  Coding DNA Sequence Number=SeqID_84357
  Gene Ontology: Mol. function=identical protein binding; Cellular component=cellulose and pectin-containing cell wall; Biological process=negative regulation of enzyme activity
  Homolog annotation: Hit_ID=Q9MAP7; Match level="QueryCoverage=96%, HitCoverage=32%, E-value=6e-66, Identity=49%"; Hit description=First of four adjacent putative subtilase family >
MNVAQPDIAAPGVNILAAWSPASSARLVSDAENEDETELHPLNFNIESGTSMACPHITGIVALIKTIHPTWSPAAIKSALVTTASLKNEYKEYIWAEGAPHKQADPFDYGGGHVDPNKVTDPGLVYDMKNSDYIRFLCSMGYNNTAISILTGFPTKCHKSHKFLLNMNLPSITIPELKQPLTVSRTVTNVGPVKSNYTARVVAPIGISVIVEPSTLAFSSKRKKMKFKVTFSSKLRVQSRFSFGYLLWEDGLHEVRIPLAVRSAVHEFCGQI

SEQ ID NO: 201136 - protein, 162 aa, Glycine max
  Coding DNA Sequence Number=SeqID_84358
  Subcellular localization annotation: CTP_CleavageSite=82; ConfidenceScore=5.22e-01
MEVTKDEAATPGAGGAQPRNPNPNPNPTPNPNPNPNPPHTTRGSKGKSCKGCTYYSSLHKAKSKNPTCVGFSRTLQQESELEASKEGRSLTNFKYACVGYSVYLDNKDSSADSQDKTAKLPFCVGLEVVLEEKASNSHAGHVPATHKTEGIEILGFYFYLQF

SEQ ID NO: 201137 - protein, 422 aa, Glycine max
  Coding DNA Sequence Number=SeqID_84359
  Gene Ontology: Mol. function=hydrolase activity, hydrolyzing O -glycosyl compounds; Cellular component=cellulose and pectin -containing cell wall; Biological process=carbohydrate metabolic process
  Homolog annotation: Hit_ID=Q2LAH9; Match level="QueryCoverage=94%, HitCoverage=66%, E-value=1e-130, Identity=91%"; Hit description=Endo- 1,4-beta-glucanase precursor
  Pfam annotation: Domain name=Glyco_hydro_9; Domain location=1-410; Score=237.7; E_value=2.5e-68; Accession=PF00759.9; Description =Glycosyl hydrolase family 9
MDTARTTYAVDAPNAASDVAGETAAALAAASMAFRSSDPGYSETLRRNAITAFQFADNYRGAYSDNDNVKYNACPYYCDFDGYQGESLGVVLESKYQGWQGLEGLGGRVDDLKIVCGQHFWQHTSGFRGVWVQTRWPEIAYYAHGVHFGACIEKFWKLNLLDELLWGAAWLRRATQDDNFLNYIQTNGKTLGADDNINEFGWDNKHAGLNVLVSKEVIEGNMYSLESYKSSAESFICTLIPESPSSHIEYTPGGLVYRPGGSNLQHATSIAFLELVYANYLTHASQAINCGNVYVSAQTLRQHAKRQVDYILGDNPMGLSYMVGYSNYYPQRIHHRGSSLPSIKDHPQFIACKEGSIYYNSTNPNPNVLVGAIVGGPDENDDYVDDRVDFRKSEPTTYINAPFVGIYAEDVSHLEKIKRVEA

SEQ ID NO: 201138 - protein, 514 aa, Glycine max
  Coding DNA Sequence Number=SeqID_84360
  Gene Ontology: Mol. function=zinc ion binding; Biological process =regulation of transcription
EPEDYKLRAKYRTEPHNMFGKRAVMIWFRSLKKRIPLPCTVAVSFLACHVAREAVLPSDMMKWTLEGKLPYFSAFVEIEKRMGQPTSACPISSSVMFRPQQAIPVQKLESFAASIAQFIGLELPPVNFYAIAYLFLQKLSLPVEKILPYACRIYEWSMPPDLWLSLSSNYFRLPTHVCVMSILVVAIRILYNINGFGEWEKSLSRDDDAKDNSEMGNAFASDNGHDFGKESKDSAEDQVGSQKHELDSAWLLQHLQARYNEIADTYGYSKDLATYLKYCRDVVFAGSEPSYGNHEEEKMIEYLWKFYQNEEDTKPSENVEQSNTSFNQTSSRDKGCIGKISKEEKIRKKGFNELFPDDDTSLEDVSNNNSHESLSDSEDSDSQEHSSGKSHVKEAIRQMKLEMEENRFYYIPPSVKRKRLDYIHYVRKRDEGALTYVAHADYYILLRACARIAQVDIRILHIGVLRLERRLAWLEKRIDQCLHSKPTSISCQFCCNKATENGSDGLPGLSNLNI

SEQ ID NO: 201139 - protein, 456 aa, Glycine max
  Coding DNA Sequence Number=SeqID_84361
  Gene Ontology: Mol. function=identical protein binding; Cellular component=cellulose and pectin-containing cell wall; Biological process=negative regulation of enzyme activity
  Homolog annotation: Hit_ID=Q1SB16; Match level="QueryCoverage=98%, HitCoverage=57%, E-value=1e-117, Identity=50%"; Hit description =Protease-associated PA; Proteinase inhibitor I9, subtilisin propeptide
  Pfam annotation: Domain name=PA; Domain location=350-452; Score=65.8; E_value=1.4e-16; Accession=PF02225.12; Description=PA domain
  Pfam annotation: Domain name=Peptidase_S8; Domain location=98-447; Score=-18.5; E_value=8.7e-06; Accession=PF00082.12; Description =Subtilase family
  Pfam annotation: Domain name=Subtilisin_N; Domain location=8-89; Score=75.7; E_value=1.5e-19; Accession=PF05922.7; Description =Subtilisin N-terminal Region
  Pfam module annotation: Pfam domain module=PA::Peptidase _S8::Subtilisin_N; Domain location=350-452::98-447::8-89
MLAVVVEQVHIVYMGDRMSQSEQQLVEDSHLDILLRILGSKVAARRSILYSYKHGFSGFAAVLSQPQAKLIADFPGVVRVIPNKILSLHTTRSWDFLHVKQDIVTGALSRGQSGRGTIIGIMDTGIWPESESFRDEHMDNPPLHWRGICQEGESFDHSHCNSKIIGARWYIKGYEAEIGKLNTSDGVEYLSPRDASGHGTHTSSTAAGVAVENASFMGLAKGLARGGAPSAWLAIYKICWSTGGCSSADILAAFDDAIFDGVDILSASLGSDPPLPTYVEDALAIGSFHAVAKGISVVCSGGNSGPYPQTVINTAPWLVTVAASTIDREFSSRIILGNNQTLQGQSLYTGKDLSKFYPIVFGEDIAASDSDEESARSCNSGSLNSTLAKGKAILCFQSRSQRSATVAIRTVTEAGGAGLIFAQFPTKDVDTSWSKPCVQVDFITGTTILSYMEATR

SEQ ID NO: 201140 - protein, 491 aa, Glycine max
  Coding DNA Sequence Number=SeqID_84362
  Gene Ontology: Mol. function=drug transporter activity; Cellular component=membrane; Biological process=multidrug transport
  Homolog annotation: Hit_ID=Q1S149; Match level="QueryCoverage=94%, HitCoverage=96%, E-value=1e-146, Identity=54%"; Hit description =Expressed protein
  Pfam annotation: Domain name=MFS_1; Domain location=22-427; Score= -51.8; E_value=0.074; Accession=PF07690.6; Description=Major Facilitator Superfamily
  Pfam annotation: Domain name=MatE; Domain location=114-280; Score =54.3; E_value=3.9e-13; Accession=PF01554.9; Description=MatE
  Pfam module annotation: Pfam domain module=MFS_1::MatE; Domain location=22-427::114-280
  Subcellular localization annotation: CTP_CleavageSite=47; ConfidenceScore=5.79e-01
MAFKLKSLPLLCSLHSPSRQNPNSTLSNHHFSRRFFAPSIPPTLCLSGAASASTFHRHRFFVTARSQDEDQITEALEQEEEKDNEEISRQGEKKELAKQGIWDQIKEIVMFTGPATGLWICGPLMSLIDTAVIGQRSSIELAALGPATVVCDYMCYVFMFLSIATSNMVATALAKQDKEEVQHHISVLLFVGLSCGIAMLLFTRLFGAAIITGIENAFTGPKNVHVVPAASNYVKIRGLASPALLVGWVAQSASLGMKDSLGPLKALAAATVINVAGCVLLCTYLGYGIVGAAWATMVSQGYNALAFSIPSGKELLTIFGLAAPVFITLMSKVAFYALLIYFATSMGTHTMAAHQARMLLRSLVIIGAILGLLLGIIGTSVPWLFPNIFTPDRMVIQETIGHMLTAAFVMTQMHKVLIPYFIALAVTPPTVSLEGTLLALSSRYGLLGCWFSLALFQWARFSMALQRLLSPKGILYSEDTEQYKLLKLRTA

SEQ ID NO: 201141 - protein, 95 aa, Glycine max
  Coding DNA Sequence Number=SeqID_84363
MAMNVGSFSVVISGCAALENCNSTSHDDLSNFFLRMQCEGFKADAFTVASLLPLCCGDTGKWDYGREFHCYVVKNGLDLKMDSDVHLAPQKLAVC

SEQ ID NO: 201142 - protein, 174 aa, Glycine max
  Coding DNA Sequence Number=SeqID_84364
  Gene Ontology: Mol. function=drug transporter activity; Cellular component=membrane; Biological process=multidrug transport
  Homolog annotation: Hit_ID=Q1S4K7; Match level="QueryCoverage=91%, HitCoverage=34%, E-value=4e-38, Identity=57%"; Hit description =Enhanced disease susceptibility 5
  Subcellular localization annotation: CTP_CleavageSite=62; ConfidenceScore=5.84e-01
MALKLSSLSLHSSLRHQHPNSSHSNHRIPLRFFAPSLPPTSCLSGAASVSTFHRTLFAVTVRAFQSQDESKSSDVFEEEEKDEEISRQGEKKELAKQSIWSQIKEIVMFTGPATGLWICGPLMSLIDTAVIGQRSSIELAALGPATVVCDYMSYVFMFLSIATSNMVATALAKQ

SEQ ID NO: 201143 - protein, 308 aa, Glycine max
  Coding DNA Sequence Number=SeqID_84365
  Gene Ontology: Mol. function=drug transporter activity; Cellular component=membrane; Biological process=multidrug transport
  Homolog annotation: Hit_ID=Q1S149; Match level="QueryCoverage=91%, HitCoverage=61%, E-value=1e-99, Identity=59%"; Hit description =Expressed protein
MESALGIFVLQHILDNNNSLVLKGSFTGPKNAHVVPAASNYVKTKIRGLAWPALLVGWVAQSASLGMKDSLGPLKALAAATVINFAGCILLCTYLGYGIVGAAWATMVAQVVAAYMMIQNLNMKGYNALAFSIPTGKEILMILGLAAPVFLTLMSKVVSIWGEPLSQTAQSFMPELIYGVNRSLSKARLLLKSLVTIGAMLGLLLGIVGTSVPWLFPYVFTPDRMVIQEMHKVLIPYFIALAITPPTHSLEGTLLALSSRFGLLGCWFSLALFQWARFSIALRRLLSPKGILYSEDTDQYKLRKLRTA

SEQ ID NO: 201144 - protein, 117 aa, Glycine max
  Coding DNA Sequence Number=SeqID_84366
MSLPSAVHVSSIIKRGASGDWEIKKEGAETRIVITERAGWTISVSYLCFPLISDVRSRDVPKIKRKQAYAIRENSVMRQKSKGGRVQIAIRPTWAFEILPPEGCCFWRKQPGSPARA

SEQ ID NO: 201145 - protein, 341 aa, Glycine max
  Coding DNA Sequence Number=SeqID_84367
  Gene Ontology: Mol. function=chitin binding; Cellular component =extracellular region; Biological process=chitin metabolic process
  Homolog annotation: Hit_ID=UPI00006A17C9; Match level="QueryCoverage =92%, HitCoverage=100%, E-value=6e-43, Identity=34%"; Hit description= UPI00006A17C9 related cluster
RLLVFRGLHALTFRGLHALPFRGLDVLDCRGIDVLTLRGLEVLAIRVLHALAFKGLHILLFRGLHVLVFRGLHALTFRGLHILAIRGLHALTIRGLLVLAFRGLHVLVFRGLHALTCRGLHALPFRGLDFLACRGIDVLTLRGLEVLAIRVLHALAFRGLHGLVFRGLHVLVFRGLHALTFRGLHVLAIRGLHAITFRGLHVLDFRVLHVLYFRGLHALTFRGLHALAFRGLHVLAYRGLHVLIFKGLHALTFRGVHVLSIRGLHVLTFRELHILTFRGLHARSFRGLDVLACRGLDVLFFRGLEVLTIRGLHTLTFRGLHVLAIRRATHPHLKSTTHPRH

SEQ ID NO: 201146 - protein, 85 aa, Glycine max
  Coding DNA Sequence Number=SeqID_84368
DCRDPWERGRKKIPSGRVWGWGPGGSWGRRRGARKYSPPGTNEEIDDLYNARDVVMKRMVKDEYFNMDDKKWDDIVEDGIKHSRV

SEQ ID NO: 201147 - protein, 54 aa, Glycine max
  Coding DNA Sequence Number=SeqID_84369
MIEITLDEKVIPWLKNAPITNARGLRDTKYALSYVNSPDVLARCMSWSGTCLLI

SEQ ID NO: 201148 - protein, 270 aa, Glycine max
  Coding DNA Sequence Number=SeqID_84370
  Homolog annotation: Hit_ID=Q47522; Match level="QueryCoverage=17%, HitCoverage=59%, E-value=2e-21, Identity=97%"; Hit description=LacZ protein
RVPFAIQAAQLLGRAIGAGLFAITPAGERGMCCKAIKLGNARVFPVTTLNSMRVATREQELIKYAKALRDREGDWMKEKEMRMKIEVKALKLEETLADRNADAKRVNELLEKKQAEIEELSKIRMLLSEAKREIEDLSRREKTHLAEIDQITTRERRLFAEVEDLNSLQRKNTAEISRLNARQATLLQDLETTRITESKQRQELEDMTQSSLSIPSTSRGGPVPAFVPFSEVGKPVVPAALMNRPTRGERRFAYWALAECILAYYVGTDE

SEQ ID NO: 201149 - protein, 135 aa, Glycine max
  Coding DNA Sequence Number=SeqID_84371
  Gene Ontology: Mol. function=nucleic acid binding; Biological process= DNA integration
  Homolog annotation: Hit_ID=Q1SIY6; Match level="QueryCoverage=99%, HitCoverage=14%, E-value=3e-18, Identity=38%"; Hit description =Integrase, catalytic region; Zinc finger, CCHC-type
MPKRYEASIVSLENTKDLSKITLAEVVHFKPSIMTLRTAERKISRRTSQQAMKMVQTTKIKVRKKGKITHLVNIAENWVTHHSSVGENHMQSTQPKANAQVVEQDEEDYIFAATCYSMRSTSECWLIDSGCMNHV

SEQ ID NO: 201150 - protein, 119 aa, Glycine max
  Coding DNA Sequence Number=SeqID_84372
  Gene Ontology: Mol. function=sequence-specific DNA binding; Cellular component=nucleus; Biological process=regulation of transcription, DNA-dependent
  Homolog annotation: Hit_ID=Q1T3Q1; Match level="QueryCoverage=50%, HitCoverage=76%, E-value=5e-25, Identity=93%"; Hit description =Transcription factor, MADS-box
  Pfam annotation: Domain name=SRF-TF; Domain location=9-59; Score =103.5; E_value=6.4e-28; Accession=PF00319.9; Description=SRF-type transcription factor (DNA-binding and dimerisation domain)
MGRGKIVIRRIDNSTSRQVTFSKRRNGLVKKARELSILCDAEVGLIVFSSTGKLYDYASTRDAFEIKEYYCGIYLKLARKTLPTWCGDTFIWESMNFINTGMLKHFPLILFKRPGYILL

SEQ ID NO: 201151 - protein, 88 aa, Glycine max
  Coding DNA Sequence Number=SeqID_84373
WMDIDYVIRKDEPPGITETSAVDLYEKWERSNCMSVMFIKTNIFASIRSSVDQHEKVKDLLKAIDDQFITSDKALASTLIMQFSSLKL

SEQ ID NO: 201152 - protein, 120 aa, Glycine max
  Coding DNA Sequence Number=SeqID_84374
  Gene Ontology: Mol. function=transcription factor activity; Cellular component=nucleus; Biological process=regulation of transcription, DNA-dependent
  Homolog annotation: Hit_ID=Q1T3Q6; Match level="QueryCoverage=96%, HitCoverage=66%, E-value=5e-29, Identity=55%"; Hit description=Helix- turn-helix, Fis-type; Transcription factor, K-box
  Pfam annotation: Domain name=K-box; Domain location=2-85; Score=40.3; E_value=6.8e-09; Accession=PF01486.8; Description=K-box region
LWQREVASLRQQVQYMQECHRQMMGQELSGLGIEELGNLEKRLEMSLKGVRMKKGSLAHQENVELNRKINLIRKENEELQKVIEAKCRKGVAASNPPFTINYGCNMLAPISLQLSLPEST

SEQ ID NO: 201153 - protein, 157 aa, Glycine max
  Coding DNA Sequence Number=SeqID_84375
MHKALRSSAPLPYPQLVTLFIHHFEIPLNSESFVQIKRSFAIGVGAVTSFSYRKDKDGQWLKKDAQPPQDERTPSPLSQRDDSSTLMHEVLSELRGLRTYVGERFDSLDGRIDVVATCPLRASEGEAHGCAFQRRKGRQKRGFCSYVPSIEEEIRPT

SEQ ID NO: 201154 - protein, 231 aa, Glycine max
  Coding DNA Sequence Number=SeqID_84376
  Gene Ontology: Mol. function=pectinesterase activity; Cellular component=cell wall; Biological process=cell wall modification
  Homolog annotation: Hit_ID=Q9APQ1; Match level="QueryCoverage=64%, HitCoverage=91%, E-value=8e-79, Identity=95%"; Hit description=ElsC
YVEGDVDLVSGRGAVVFENTDFRVVNSRTQQEGYVFAPATQSNLFYGFLAVNSRFNAAGDGVAQLGRSLDVDSATNGQVVIRDSVINEGFNMAKPWADAAISKRPFSGNTGAVDDKGNVQRNLNDANFNRMWEYNNRGLGSKVVAEPKQCVGYTRSPRDSACGLAPSEPAQALSTSPLIYLSAACHQRCVGYFSMCSTVKALSAPPDSQDLKRILNCGTAAHRTNKEKYIN

SEQ ID NO: 201155 - protein, 124 aa, Glycine max
  Coding DNA Sequence Number=SeqID_84377
MSGFTCDSPQISASPYQLDLAPYASEPYNAQWNAPGLLRDKHMLRSSRILEEMEVDEPWLGLLLPLNYQVDMGASFLAAKFISWLVFLDCAKGMAFVDNWAVGKEKVCYWLSNDIVGLVGNLAV

SEQ ID NO: 201156 - protein, 183 aa, Glycine max
  Coding DNA Sequence Number=SeqID_84378
  Gene Ontology: Mol. function=transcription factor activity; Biological process=regulation of transcription, DNA-dependent
  Homolog annotation: Hit_ID=Q8Z281; Match level="QueryCoverage=97%, HitCoverage=59%, E-value=6e-66, Identity=68%"; Hit description =Hypothetical lysR-family transcriptional regulator
  Pfam annotation: Domain name=LysR_substrate; Domain location=1-179; Score=72.6; E_value=1.2e-18; Accession=PF03466.10; Description=LysR substrate binding domain
QYPGIELELSSSDRLVDVIREGFDCVVRVGTLKDSGLIARPLGKLSVINCASPDYLARFGYPETLDDLGSHAVIHYAAMLGTRPQGFEFYNGSTTQWIKTGGVLTVNSTETYQAACLAGLGIIQVPRVGVRDSLRAKKLIEILPQYRAEPMPVSLIYPHRRNLSRRVHLFMEWLTELTKAYVD

SEQ ID NO: 201157 - protein, 275 aa, Glycine max
  Coding DNA Sequence Number=SeqID_84379
  Gene Ontology: Cellular component=integral to membrane; Biological process=protein secretion
  Homolog annotation: Hit_ID=P40727; Match level="QueryCoverage=60%, HitCoverage=48%, E-value=9e-36, Identity=44%"; Hit description =Flagellar biosynthetic protein flhB
GHHRGGIQRAKALIHRGKFTGCCHCMTMNQFYAVHFAGDQGVIRHGRWRRFTSRQPAGVRRDICPLMVLKGIAASLTQPVRHGFCLAAPLNPYCAAKVAEPFAGDWPAPGADSAFARADFGTDAAGRAADHLAGRPQYGATAGQHGGHRLPLRPRHGGDRAAAADGRAGDRCHRRADDSGRNQHQRKIHQIRFQKAQPVTGHCAHVLRSDVGGTGEGDPQSGAGGAGGWLVSVESLAGDAASDERIAGECAAAWPVDDRHQLRAGDAGSDPDGWL

SEQ ID NO: 201158 - protein, 305 aa, Glycine max
  Coding DNA Sequence Number=SeqID_84380
  Homolog annotation: Hit_ID=Q4IYW9; Match level="QueryCoverage=31%, HitCoverage=16%, E-value=6e-07, Identity=33%"; Hit description =Forkhead-associated
MCPPKPSRLARLAGPLAAARITTWCCPTNRALFAHAGAGAPVARRRVPPDQPGQRHFSGAERRGATARLAVCDPACQNAPQDDPLAFFADSAADPLGMQQDESVPEPEVLPQSDSPRHERRPDARLAIDPQSDAPVMPAVLPGADQDKLIAALLEGMGLNNGHQTPITEEQMRVTGRMLSLFSQDVPEPDAWLYATGSSGARCAGGLQAHQLGMIAGIRAIIAAMLQSFNPQRLEEEARKDGVLPKMPFSGGRKAALWDYFLRHYQRTAGEIEDDFHTLFGEAFLHAYDMEVNQYKDSQTRTEDA

SEQ ID NO: 201159 - protein, 143 aa, Glycine max
  Coding DNA Sequence Number=SeqID_84381
  Subcellular localization annotation: CTP_CleavageSite=63; ConfidenceScore=5.37e-01
MAMNHAAAAIEPVTPRNVRRLSPALFAAAAVSLLAVVVVVWKANRPSDAPPVAASSVPAATPSAGSAPASSAPTMATVYPQLQAGENIVLNGEAKDVKPASSGLASMNLAAGSYRIELHHGSQVRSQMLTINQPGTWLINPGN

SEQ ID NO: 201160 - protein, 209 aa, Glycine max
  Coding DNA Sequence Number=SeqID_84382
  Gene Ontology: Mol. function=cation transporter activity; Cellular component=integral to membrane; Biological process=cation transport
  Homolog annotation: Hit_ID=P31801; Match level="QueryCoverage=97%, HitCoverage=55%, E-value=5e-66, Identity=65%"; Hit description =Calcium/proton antiporter
MAGHEKTRHSEYSLIFPILALAVLSFFGGQTALLPVIGINLLALVAILSSAFSVVRHADVLAHRLGEPYGSLILSLSVVILEVSLISALMATGDAAPALMRDTLYSIIMIVTAGLVGCALLLGGRKFATQYVNLAGVKQYMIAIFPLAILVLVFPNALPGGNFTTAQALIIAAISAAMYGVFLLIQTKTHQSLFVYEHEDESDDGDPHH

SEQ ID NO: 201161 - protein, 294 aa, Glycine max
  Coding DNA Sequence Number=SeqID_84383
  Gene Ontology: Mol. function=protein binding; Cellular component =cytosol; Biological process=transport
  Homolog annotation: Hit_ID=P39163; Match level="QueryCoverage=73%, HitCoverage=93%, E-value=8e-89, Identity=72%"; Hit description =Cation transport protein chaC
  Pfam annotation: Domain name=ChaB; Domain location=8-63; Score=14.8; E_value=0.0013; Accession=PF06150.3; Description=ChaB
  Pfam annotation: Domain name=ChaC; Domain location=118-287; Score =256.0; E_value=7.9e-74; Accession=PF04752.3; Description=ChaC-like protein
  Pfam module annotation: Pfam domain module=ChaB::ChaC; Domain location=8-63::118-287
MPYSSNRELPDSVRHVLPGHAQTIYQKAFNSAWDQYKDEDDRRVDAAGAACKIADSGSYIDRKVSAVEEIAVLTREFLLKADCKTSFGDIDEALLWSCEKRAASLCATLACRPDQSPVWIFGYGSLMWNPVFEAEEVATGRLEGWHRAFCLRLTAGRGTVAAPGRMLALKEGGSTSGLAFRLPEARLHEELELLWKREMITGCYLPTWCELTLEDGRTVTALVFIMDPRHPLYEADSCRSTIAPLIAQASGPLGSNAQYLFSLEQELGKRGMQEEALTRLAAEVRALQQSPARG

SEQ ID NO: 201162 - protein, 851 aa, Glycine max
  Coding DNA Sequence Number=SeqID_84384
  Homolog annotation: Hit_ID=P0A715; Match level="QueryCoverage=32%, HitCoverage=96%, E-value=1e-133, Identity=87%"; Hit description=2 -dehydro-3-deoxyphosphooctonate aldolase
  Pfam annotation: Domain name=DAHP_synth_1; Domain location=503-779; Score=384.1; E_value=2.1e-112; Accession=PF00793.10; Description =DAHP synthetase I family
  Pfam annotation: Domain name=MTS; Domain location=8-167; Score=-10.1; E_value=3.9e-08; Accession=PF05175.4; Description=Methyltransferase small domain
  Pfam annotation: Domain name=Methyltransf_11; Domain location=48-147; Score=23.2; E_value=0.00028; Accession=PF08241.2; Description =Methyltransferase domain
  Pfam annotation: Domain name=Methyltransf_12; Domain location=48-145; Score=39.7; E_value=1e-08; Accession=PF08242.2; Description =Methyltransferase domain
  Pfam annotation: Domain name=UPF0020; Domain location=26-149; Score= -56.0; E_value=0.019; Accession=PF01170.9; Description=Putative RNA methylase family UPF0020
  Pfam module annotation: Pfam domain module=DAHP_synth_1::MTS::Methyltr ansf_11::Methyltransf_12::UPF0020; Domain location=503-779::8-167::48- 147::48-145::26-149
PIAHLVGEREFWSLPLRVSDATLIPRPDTEVLVEQALLRLPATPSAVLDLGTGTGAIALALASERPDCQITGCDRIAAAVALAQDNAQRLHLTNAGFVRSHWFDDLPAQRFDLIVSNPPYIDAADEHLQQGLAAAGTRLAAGGGCTRAADPSRRDHHHAVSAAFLLADHRICPAAAPLGAHCAAHQRYIPAAQRCTAGADYPLLSVYPTRKLADGEAVSGYHLHRLRFRGIESSPAQHGDPLGRLFSRRGRIVAVQLDYSETPLSEAVIGATCAIRNDFSAPSVQQQLADLVEEARRYVSSEQDADLQLEKLLDLFYQQWGFGGASGVYNLSDALWIDKVLKSRQGTAVSLGVILLHIADELELPLMPVIFPTQLILRADWLDGEMWLINPFNGETLDTHTLEVWLKGNISPTAKLYSDDLDEAKTVSVMRKMLDTLKAALMDEKQMELALNVSQVLLQIDPDDPYEIRDRGLIYAQLECEHIALTDLTYFVEQCPEDPVSEMIKVQIHAIEQKQVANDLPFVLFGGMNVLESQDLAMRICEHYVKVTDKLGIPYVFKASFDKANRSSIKSYRGPGLDEGMKIFQALKQAFGVKIITDVHESWQAQPVADVVDVIQLPAFLARQTDLVEAMAKTGAVINVKKPQFVSPGQMGNIVDKFAEGGNDKVILCDRGSNFGYDNLVVDMLGFNVMKKVTNNSPVIFDVTHALQTRDPFGAASGGRRAQVAELARAGMAVGIAGLFIEAHPEPNSAKCDGPSALPLDKLEPFLAQMKAIDDLVRINAHPTLYGRRSWRPLHLTSQHNRQQIAGKQGQMRCAVEHVGAASGERDVAQNQHRAHHHHMRRLKAENQLLT

SEQ ID NO: 201163 - protein, 204 aa, Glycine max
  Coding DNA Sequence Number=SeqID_84385
  Homolog annotation: Hit_ID=Q4K5B8; Match level="QueryCoverage=90%, HitCoverage=64%, E-value=1e-19, Identity=32%"; Hit description=GGDEF domain protein
MAIAIVNAFEMIEVEQHCTVNIGLRQTCVAQQQFFCGLKQCAPVPDAGKRIVQRRQLMGDLRTLIDHRQDSEGQADDEEDRLQNHIHRKAGTANGTRYGCGHRIVKENARQQTNQRGGKDNAQQAHDQHAFRLAMIELRKGTKQGPQQRASDPAKTEWKAAKSTKGVEQGAVGQQHDDIPDRHRQKVQTGAAQAAEQHGGKRQY

SEQ ID NO: 201164 - protein, 126 aa, Glycine max
  Coding DNA Sequence Number=SeqID_84386
  Gene Ontology: Mol. function=two-component sensor activity; Cellular component=membrane; Biological process=two-component signal transduction system (phosphorelay)
  Homolog annotation: Hit_ID=Q4IXN6; Match level="QueryCoverage=61%, HitCoverage=19%, E-value=4e-12, Identity=53%"; Hit description=GGDEF
  Pfam annotation: Domain name=GGDEF; Domain location=1-84; Score= -40.8; E_value=0.00059; Accession=PF00990.12; Description=GGDEF domain
MPVEGQFARLGGEEFAALLPGDSEQAQRICERIRLATQLSLPNDIGYTVSIGFATASQRHQAFPALLALADEALYRAKAAGRNRVEGYQTPQAAMAEAAFVAVVTQPVIAVFHPLPPADACADQPQ

SEQ ID NO: 201165 - protein, 221 aa, Glycine max
  Coding DNA Sequence Number=SeqID_84387
  Gene Ontology: Mol. function=transition metal ion binding; Cellular component=cytoplasm; Biological process=protein amino acid phosphorylation
  Pfam annotation: Domain name=Transposase_21; Domain location=143-221; Score=-34.1; E_value=1.1e-11; Accession=PF02992.5; Description =Transposase family tnp2
  Pfam annotation: Domain name=Whi5; Domain location=58-82; Score=9.3; E_value=0.094; Accession=PF08528.2; Description=Whi5 like
  Pfam module annotation: Pfam domain module=Transposase_21::Whi5; Domain location=143-221::58-82
MQSGSQSEPFDVEMGDCLDMIRDLGQESFQQAHAPMYGTLQTDSKKPLYLGCNNSLTLLSTVLSLINVKVKYGWSDKSFSSLLQVVYNMLPDENTLPKSYYQAKKILCPMGMEYQKIHASPMIAYCTNMSLKKCTNALGVGYHDLTWHANGKNYEMLRHLADSSQWKKIDCLYPDFCKEARNLRLGLATDGMNPYDSLSTQHSSWPVLLVIYNLPPWLCMK

SEQ ID NO: 201166 - protein, 96 aa, Glycine max
  Coding DNA Sequence Number=SeqID_84388
MDYSSLISLTRISFPQCRNFQDVTMTGLRRSKSGNPSLEVLDWAIEVIWPEINAPMFIFMRETRPKISLALSTVKSEVCDVGPSWSMRGHSTPKLM

SEQ ID NO: 201167 - protein, 63 aa, Glycine max
  Coding DNA Sequence Number=SeqID_84389
MLKEKEKERLFLWICKFAGRKKVGMLFLCLISAAVFVWHQPELGLAEGTSFRNVANQGLNNAG

SEQ ID NO: 201168 - protein, 236 aa, Glycine max
  Coding DNA Sequence Number=SeqID_84390
  Gene Ontology: Mol. function=N-acetyltransferase activity; Biological process=metabolic process
  Homolog annotation: Hit_ID=Q397B8; Match level="QueryCoverage=99%, HitCoverage=57%, E-value=1e-81, Identity=60%"; Hit description=GCN5 -related N-acetyltransferase
  Pfam annotation: Domain name=Acetyltransf_1; Domain location=94-176; Score=35.8; E_value=1.4e-07; Accession=PF00583.14; Description =Acetyltransferase (GNAT) family
MSPQTNRYGQPIGPALEAWQPRPLPQGQIFTGQYCRLEPLDAARHGRELYAAYALAEDDRDWTWLPVGRFDDEASYLAFAQQCQQSPDYLHFAVIDRQSGRAVGSLALMRIEPQHGVMEVGFVVFSPLLKQTRMATEAHYLLMRYAFEQLGYRRYEWKCDSCNQPSYNAALRLGFRYEGTFRQVVVYKNRSRDTAWFSIIDSEWPQVKLGFERWLAADNFDARGQQRARLETLRQA

SEQ ID NO: 201169 - protein, 219 aa, Glycine max
  Coding DNA Sequence Number=SeqID_84391
  Homolog annotation: Hit_ID=Q3RD79; Match level="QueryCoverage=86%, HitCoverage=81%, E-value=8e-15, Identity=32%"; Hit description=Phage- related protein
MMNTHKAFKALQQAGVADHQAEVMVDIFAEMQQENSLTKTHLSQAMEGVMRANHATAQRVDKLAQSLRHFENEVRHTFKAIELRFDNVDEQFRKIDQRFKKVDEQFRLIDQRFEKVDAQFREIDKRFEKVDAQFRTIAQRFEQIDEQFRKIDQRFEQIDERFRQIDKRFEKVDERLLDLDHRMQLGFNELKRDNLWHRRLMMAMASAFVLSAAKYIFAG

SEQ ID NO: 201170 - protein, 119 aa, Glycine max
  Coding DNA Sequence Number=SeqID_84392
MQNSKRDVYLGAYLNGAYWQMVVILPKENLVVWFCSLHNRPDNYLKGIINSSLKGLDDTPQPNSEAGARQKGNTESGYYVMHWMSTIILGSFKNKLGNERLKALCIQWAKYYLKVRNET

SEQ ID NO: 201171 - protein, 51 aa, Glycine max
  Coding DNA Sequence Number=SeqID_84393
  Subcellular localization annotation: CTP_CleavageSite=44; ConfidenceScore=5.10e-01
MLHQRICYHSSPSDSSLDQGTPHLVTGGPTSLSCITRGSQLSTSAMPTSTP

SEQ ID NO: 201172 - protein, 196 aa, Glycine max
  Coding DNA Sequence Number=SeqID_84394
  Gene Ontology: Mol. function=transferase activity, transferring acyl groups, acyl groups converted into alkyl on transfer; Cellular component=intracellular; Biological process=branched chain family amino acid biosynthetic process
  Homolog annotation: Hit_ID=Q39891; Match level="QueryCoverage=89%, HitCoverage=31%, E-value=3e-91, Identity=94%"; Hit description =Probable 2-isopropylmalate synthase
  Pfam annotation: Domain name=HMGL-like; Domain location=41-195; Score= -16.4; E_value=1.2e-06; Accession=PF00682.9; Description=HMGL-like
MPTKTSTPSSQSPKLSHLRPQYIPNHIPDSSYVRILDTTLRDGEQSPGATMTAKEKLDIARQLVKLGVDIIQPGFPSASNSDFMAVKMIAQEVGNAVDDDGYVPVIAGFCRCVEKDISTAWEAVKYAKRPRLCTSIATSPIHMEHKLRKSKDQVIQIARDMVKFARSLGCNDIQFGAEDATRYESFICLTLFGSRF

SEQ ID NO: 201173 - protein, 467 aa, Glycine max
  Coding DNA Sequence Number=SeqID_84395
  Gene Ontology: Mol. function=RNA-directed DNA polymerase activity; Cellular component=chromatin; Biological process=chromatin assembly or disassembly
  Pfam annotation: Domain name=rve; Domain location=166-309; Score =14.0; E_value=0.0004; Accession=PF00665.16; Description=Integrase core domain
  Pfam annotation: Domain name=zf-H2C2; Domain location=124-161; Score =10.0; E_value=0.017; Accession=PF09337.1; Description=His(2)-Cys(2) zinc finger
  Pfam module annotation: Pfam domain module=rve::zf-H2C2; Domain location=166-309::124-161
MAQTIQTPEQQKYLTRLMGYDFIIQYCFGRSNVITNALSCTFDHSKGMVLTLLMPHFFFIDELKGELADNPEFNALRQDLQENPTNRPTLTYSDGLVLQNGRIWLPNKLNFIRLLLHKFHSTPTGSHMGVTKALARLQDNFTWNSIRQDVHDFVAQCLNCRHTKYVTRKPADCISTTFSYSAIGELITRFSLSNYRYIKETPQYWLLYIDSPKLRGMPRSLVSDRDPLFISKFWQELFKLSGTKLHLSLTYHPQSNGQTEVMNRIIEQFMCAFVHHRPSPWVDTLLTTWEAVFDSLRHKLLKAQAQMKHFANNNHPKVHYAKGDWALVKLRPQRQSSLTGPNKTKLAKRFYGPFKPFRHDARNKPSSLPLPGKDFDNRPLITPLTILNTRWVDTNNGPRLHVLVQRASLPVDDTSWEYWASLKEEYHLEDKVIFEGIRNDRPVNMHEAQHGRPQRKVTPPQRFCDYV

SEQ ID NO: 201174 - protein, 138 aa, Glycine max
  Coding DNA Sequence Number=SeqID_84396
EGTTLKQYLDEINIVLMELHDIDVKMKDEDLTIILLAFVPPSYDNFVSSLSAGKDSIALEEKKKKGKDDKKSKVDPKDIYNYYKELGHWKEDYPKKAKKDFVVALVQNDSSLENNLVMAIDRHWFVAYEKKFGGNVLI

SEQ ID NO: 201175 - protein, 108 aa, Glycine max
  Coding DNA Sequence Number=SeqID_84397
MAKSPCFTANTEKNPKEECKAVMIRSKMVIQVEESRAYQKVEGFKQQLADQLALEPVDDLVELKEIVEEAEGDEEGETPIRDCQEKIKKKEEKEKEEETKEKEEKVEK

SEQ ID NO: 201176 - protein, 84 aa, Glycine max
  Coding DNA Sequence Number=SeqID_84398
MSLEYFPLDLMVKFVQFQLTIWAQRASIDKRSFSTLRATEESGKASTSRSHAKCEISALSAAVVFSQAQRMIGTKLKSTYSREA

SEQ ID NO: 201177 - protein, 546 aa, Glycine max
  Coding DNA Sequence Number=SeqID_84399
  Gene Ontology: Mol. function=nucleotide binding; Cellular component =chromosome; Biological process=DNA metabolic process
  Homolog annotation: Hit_ID=P75828; Match level="QueryCoverage=99%, HitCoverage=100%, E-value=1e-155, Identity=53%"; Hit description =Hypothetical protein ybjD
MILEHIDIHGFRGINRLSLPLTDTNLLIGENAWGKSSLLDALTLLLAPAAEPYMFTEQDFHFPPGEVEARLHKLQLVFRFRAQGDEHEALFAPFWQQDDAGCYLRFSTLATRQGNEVKTRWRFIDAHGEVLPLAGTDAALAQLRAYYPVLRLRDARFGRRSRHSDNDTQRRADTLSALAQEMHSLTRDLVARPQTLSDELLRQGLHTMQQLMAHYFLVQQPDTGAARVAPELRDGSQGWRSLDQLNQLIAGTESRSRQVILLRMFSLLLQAHGSDALPAGARPLLLVEDPETRLHPIMLSVAWNLLALMPLQKIATTNSGELLSQVALEQICRLVREPDRVAAWRIGPEGLSAEEARRIGFHIRVNRPSALFARCWLLVEGETEVWIINELARQRGYHFAAEGVKVIEFAQSGLKPLLKYARRMGIAWHVLTDGDEAGKKYAATARSQLQPHEQESDHLTQFPAPDIEHFLYKQGFSDVYHQMAHLPLNVPMNARRIITKAIHHSSKPELAIAVAMAAAERGPQAIPPLLDQLFGRVMWLARGRAE

SEQ ID NO: 201178 - protein, 102 aa, Glycine max
  Coding DNA Sequence Number=SeqID_84400
  Gene Ontology: Mol. function=nucleic acid binding
  Homolog annotation: Hit_ID=Q1T035; Match level="QueryCoverage=83%, HitCoverage=9%, E-value=2e-14, Identity=50%"; Hit description =Integrase, catalytic region
MELLRGKIDNLGKFDAKSDEGIFLGYSLQSKAYRIYNKRTMNIEESIHVTFDESNGILSRKNMLGDIAEPLEQIHIHGQDSKGKGKGSNEDPPEEAKSNNEL

SEQ ID NO: 201179 - protein, 92 aa, Glycine max
  Coding DNA Sequence Number=SeqID_84401
  Subcellular localization annotation: CTP_CleavageSite=34; ConfidenceScore=5.02e-01
MVSEPTLRREGNARLTGVSSKGGRHAESPSTFIRGKRRKNKNVWSTNLNRERFESCFYAWRRREMLRRWTINGLLGVVDKNEAFAPTYPQLR

SEQ ID NO: 201180 - protein, 534 aa, Glycine max
  Coding DNA Sequence Number=SeqID_84402
  Homolog annotation: Hit_ID=Q7VVD4; Match level="QueryCoverage=38%, HitCoverage=47%, E-value=4e-49, Identity=53%"; Hit description =Putative membrane transport protein
  Pfam annotation: Domain name=TetR_N; Domain location=234-280; Score =60.3; E_value=6.3e-15; Accession=PF00440.13; Description=Bacterial regulatory proteins, tetR family
ADAGGAVGHQPPGHRHQRGGGARHGPNHPGPVAGLRQRREDGQEDQRAGGGAGGQQAHHQAAMLREPAVDHRGAHDHGDRARADAGEHAPRQQQVPRLGHVGAGGGREGHHRQRRDQHAAHAEAFHRGRRERPHQSIQEDADGGRERSGAAIPAKALLQRHQQHAGRRAQAGRDQERQEDHADDHESVLLSRAAEGDGRVGYTHVTDRKSPAGGNDVKSAATPAAKPPLAADRIRQTAREMFYRDGIRAVGVDAIVNQAGVTKPSLYRSFSSKDELAAAYLREYDAEFWARATARLPVGPERAGGAKRLSGLRPDQRGGRVSGGRPSGAGSRRRAQAGTAPAPDRDGGRNGRARCPGPGRRLAAPDRRRLRVEPVVRRGWAGRPGGGHGGHDDRRSSRPPLIVAMHNNGAGYGAGCTDVVERIMSDTALKNARMSDALEQSLIREAIKAETLSGPFSRSGWRRLKLRMRRFGGAIGEVLHDMDAGRRQHPTARCVSEGCRPENSRVIWSCMHLSASDGFGLSDGLPFSPECGLE

SEQ ID NO: 201181 - protein, 241 aa, Glycine max
  Coding DNA Sequence Number=SeqID_84403
  Subcellular localization annotation: CTP_CleavageSite=59; ConfidenceScore=5.50e-01
MASYGSELILDSSSPSSGNSNHLSSFSISLSFHFKRQRTPLMKKIQGLQALLGATLGCVVFEGSTTVHNVSLGNDQDKQGLAKPIDRLEPNDDPLYQMTLTILQLFLKPIQVTWDSTVFRVYNDDILLYIKHEDIFEITHGGQCLNISIIQLLILLRSGNASVYGFLDPQSIQRLRQSQFEPDDYIKKWMLNSQRDVYLRVYLNGSMAAEWRRKKDDWRHHFKEKMSQEQAHHHRKPWIRA

SEQ ID NO: 201182 - protein, 317 aa, Glycine max
  Coding DNA Sequence Number=SeqID_84404
  Gene Ontology: Mol. function=DNA binding; Biological process =regulation of transcription, DNA-dependent
  Homolog annotation: Hit_ID=Q1S9D7; Match level="QueryCoverage=90%, HitCoverage=86%, E-value=5e-69, Identity=48%"; Hit description =Transcriptional factor B3; Cupredoxin
  Pfam annotation: Domain name=B3; Domain location=181-283; Score=61.6; E_value=2.6e-15; Accession=PF02362.12; Description=B3 DNA binding domain
  Pfam annotation: Domain name=B3; Domain location=2-89; Score=47.7; E _value=3.9e-11; Accession=PF02362.12; Description=B3 DNA binding domain
  Pfam module annotation: Pfam domain module=B3::B3; Domain location =181-283::2-89
MRIQISGGKMLPNKFVEKYGEGLPNTLFLKAPNGAEWKLTLEKRDDKMWFQKGWREFAKHHSLDHGHLLLFRYQRTSHFQVHIFDGSGLEIEYPLGKVEGKMTSNYQKNKRPNGEKLEYEFLQPCMGSRKCVKVDNTMKPKLGCSACASYRQKGQRKTKMTTTEHVTAFDRASYFRPCNPSFLVVIYPSNARSRGPLNFPSKFCKKHIDLRKNRGDINLEVLNGRVWHARYRIRTAETRRRFELSSGWKTFAEDNNLKVGDVCTFELIPATKLTFQTLVKYSSLSKTEKRNENRHYYQLVTLKEFQFFCIKLYVGYN

SEQ ID NO: 201183 - protein, 204 aa, Glycine max
  Coding DNA Sequence Number=SeqID_84405
  Gene Ontology: Mol. function=nucleic acid binding; Biological process= RNA-dependent DNA replication
  Homolog annotation: Hit_ID=Q53KJ4; Match level="QueryCoverage=47%, HitCoverage=14%, E-value=3e-16, Identity=46%"; Hit description =Transposable element protein, putative
MEYGDLVELDLEIEATCKRNNTERRRKILQDRTISPILEEPRSSESASIFQQTRESDIGASEAHGMGEDQPRRVTLEDYSSFTVPQFFKSIARLEVQAHNITYPHSLIQLRQSNLFHGLPNDDPYADLATNIEICNTVKVAGVPEDAVRLSLFSFSLFGEAKRWLHSFKGNSLKTWDEIVEKFLKKYFPESKTAEGKAAISSFH

SEQ ID NO: 201184 - protein, 82 aa, Glycine max
  Coding DNA Sequence Number=SeqID_84406
MWGPSAFPVAGSTCTTCLSAPGGLVDNDRRREALRVRFTADGEADASEGGGGGEGGGGGGGGVEAENKEGNEQQFEGCTFRN

SEQ ID NO: 201185 - protein, 208 aa, Glycine max
  Coding DNA Sequence Number=SeqID_84407
YYRAGCQDIVSDIVDPAASLLDFYLALYSNSSILGQDVLDIVSDIVNPAATILHLTFHLALCIFSAWHYGPYALFWGTTRQEGVNIRDWEKDITQETVDIMLYGRARPITKDRVELIKFLRTVYLSYICRLIHNFMFNMVIPRLGFKDYVNYQDRFCMNKIMLQALKDMFNLKVKKNHAPYGMLFTQIMRNSSVDVSGMAPSGGATQL

SEQ ID NO: 201186 - protein, 87 aa, Glycine max
  Coding DNA Sequence Number=SeqID_84408
  Gene Ontology: Mol. function=zinc ion binding
MVIENDPSTLVPALISYIKSAEGYTTTYQKACFRSCIDGFQYCKLVVQVNGTWLYSKYKGTLLMVVAQDGNNKILPIAFVVIEGEIA

SEQ ID NO: 201187 - protein, 118 aa, Glycine max
  Coding DNA Sequence Number=SeqID_84409
MSHIGCFFEKTNLPRKKNTRSCKFRLPWQSEFSPIEFLKDVADKVTKAICLRSARKSSNRGPSCMGRSKPIGVSVDYYRTAAVEDCIEFIHSSFSRSNSVTATPGEEFPHTFLRNFES

SEQ ID NO: 201188 - protein, 68 aa, Glycine max
  Coding DNA Sequence Number=SeqID_84410
MALTFSQLCNYAMLKLCSWDDVFKVSVGLYLVGTVAFVPHRMVNFVDRGALEHIDQRDDNVSLKEELA

SEQ ID NO: 201189 - protein, 104 aa, Glycine max
  Coding DNA Sequence Number=SeqID_84411
MWGYVDGTFAKPLDEQNAKSTKELETWEVNNSKIGMQLAKYGLTKDVQNYLKMVKAQCPKLLKSQQQSQWRPPHNDGIGSGDNNDDGWGDRGGDGNNSCDSKKF

SEQ ID NO: 201190 - protein, 518 aa, Glycine max
  Coding DNA Sequence Number=SeqID_84412
  Gene Ontology: Mol. function=oxidoreductase activity; Cellular component=integral to membrane; Biological process=electron transport
  Homolog annotation: Hit_ID=P48422; Match level="QueryCoverage=95%, HitCoverage=95%, E-value=0.0, Identity=74%"; Hit description =Cytochrome P450 86A1
  Pfam annotation: Domain name=p450; Domain location=28-507; Score =142.1; E_value=1.5e-39; Accession=PF00067.12; Description=Cytochrome P450
MDTLHLLFTLAALLSAYFVWFHLLARTLTGPKVWPLVGSLPSMIVNRNRVHDWMAANLRQIEGSATYQTCTLTLPFFACKQAFFTVTSNPRNIEHILRTRFDNYPKGPHWQAAFHDLLGQGIFNSDGDTWLMQRKTAALEFTTRTLRQAMARWVNRTIKNRLWCILDKAAKENVSVDLQDLLLRLTFDNICGLTFGKDPETLSPELPENPFTVAFDTATEITLQRLLYPGIIWRFEKLLGIGKEKKIHQSLKIVETYMNDAVSAREKSPSDDLLSRFIKKRDGAGKTLSAAALRQIALNFLLAGRDTSSVALSWFFWLVMNHPDVEEKILDELTAVLTSTRGSDQRCWTEEAVDFEEAEKLVYLKAALAETLRLYPSVPEDFKHAIADDVLPDGTAVPAGSTVTYSIYAMGRMKSVWGEDCMEFKPERFLSVQGDRFELPKDGYKFVAFNAGPRTCLGKDLAYLQMKSVASAVLLRYRLSPVPGHRVQQKMSLTLFMKHGLRVFLQTRQLQPQATTSA

SEQ ID NO: 201191 - protein, 305 aa, Glycine max
  Coding DNA Sequence Number=SeqID_84413
  Gene Ontology: Mol. function=transition metal ion binding; Cellular component=integral to membrane; Biological process=nitrogen fixation
  Homolog annotation: Hit_ID=Q9SRD3; Match level="QueryCoverage=65%, HitCoverage=95%, E-value=6e-69, Identity=68%"; Hit description =Nodulin-like protein; 66117-66707
  Pfam annotation: Domain name=DUF125; Domain location=123-299; Score =228.9; E_value=1.1e-65; Accession=PF01988.9; Description=Integral membrane protein DUF125
  Subcellular localization annotation: CTP_CleavageSite=58; ConfidenceScore=5.41e-01
MTSHLQFCKISFQIMRLQGLLYSVLTISSINTLVGSVCPPHFLHIPSSSSSSSSSSPSSSSSSSINCSIFLIMSSNQASLNLNQAKFALPTNDDLEQQQQQATTTLEIESDEDTFDYSKRSQWLRAAVLGANDGLVSTASIMMGVGAVKHDIKAMILSGFAGLVAGACSMAIGEFVSVYSQLDIEVAQRKREKERGQRRVRDPEEDTNEEKESLPNPLQAAAASALAFSVGAMVPLLAASFIREYKVRLGVIVAAVTFALVVFGWLGAVLGKAPVLRSALRVLFGGWMAMAITFGLTKLIGSSAL

SEQ ID NO: 201192 - protein, 159 aa, Glycine max
  Coding DNA Sequence Number=SeqID_84414
  Gene Ontology: Cellular component=integral to membrane; Biological process=defense response to Gram-negative bacterium
  Homolog annotation: Hit_ID=Q9LTR7; Match level="QueryCoverage=81%, HitCoverage=91%, E-value=3e-34, Identity=50%"; Hit description =Arabidopsis thaliana genomic DNA, chromosome 5, P1 clone:MHM17
MVFHRNKLCHLCLAYARVEETVDLRTNVELVRSVSDKHHDLLRPSARNYSRGQSTDTTGRGKGKYALIRDPEDFQMGVYDKPLPCFGCGIGWFSFLFGFLCPPMWFYATILYFGNHYRKDPRERAGLGASAIAVISLLFLFARLVYLCVSVCSCIHFHM

SEQ ID NO: 201193 - protein, 232 aa, Glycine max
  Coding DNA Sequence Number=SeqID_84415
  Gene Ontology: Mol. function=nucleic acid binding; Cellular component= intracellular
  Homolog annotation: Hit_ID=Q207T2; Match level="QueryCoverage=87%, HitCoverage=67%, E-value=7e-11, Identity=27%"; Hit description=RNA -binding protein
MRATRGLHAPNLARDCVLHVTARGRDLCNTKATSKQTLLLHADGKKHRAKARAFHASKQPPVEADKSATDAKVAVEIAPNDEVRDDKIGELPKLQESSKQNNSKPGNEISSAKKKRKLEALEDDLIKKTKNDTSVDMGNGEVIQGEESNFKKEGSAVKNKIKWKKFIKSALKSHPDGILKMKKLRKVVLKALQESGIAVDDEAELSEALEQKINSSSRFAVENKYVRLLAKD

SEQ ID NO: 201194 - protein, 1926 aa, Glycine max
  Coding DNA Sequence Number=SeqID_84416
  Homolog annotation: Hit_ID=O64572; Match level="QueryCoverage=67%, HitCoverage=98%, E-value=0.0, Identity=44%"; Hit description =Expressed protein
  Pfam annotation: Domain name=PP2C; Domain location=1602-1909; Score =270.5; E_value=3.4e-78; Accession=PF00481.12; Description=Protein phosphatase 2C
  Subcellular localization annotation: CTP_CleavageSite=28; ConfidenceScore=5.34e-01
MATSSKFDPSSSSPDRPLYPGQRGSHIAASLDRSGSFQESMENPILSSLPNMLRSSSPATHGDVESFFNYVRFDPKLLTLEHKSNRQMDFKRHVNAALGISPDESPSSSSKGKLLPSPVPEDMKRVKDALGANIVKARERVKMFSEALSVFHEVFPAITSKKRSRAEGFSNDRSNAMLSDRPVLGPSIGKVGVQGHPVTGGFELEHQKSEERTKNVVPNKRTRTSMVDVRMDVRTNSLVRPSGTVDRDKEKLRIANNGVVQSEERTLPIGGDGWEKSKMKKKRSCIKLDGSPSTTLTKPVNTFQETKQGMQQRLATDSRSKLSNDSHSFRVLMVKGFSSKKENTVVRDFADIKGVSNGTVGAGKSDGISRQTGLGIRASTPRNNQDNISLVNDRRGRPVSSDKERVNFRAVNKATARDEFNSASPTSGAKMNTAIRAPRSGSGVAPKLSPVVHRAGVSNDWELSHSSPKPPAAGGTSNRKRVASARSSSPPVVPWQRPQKSSRTARRTNFMPIVSNSDEAPALDTASDVAGNDLGLGFARRLAGSSPQQIKLKGDPSSSAALSESEESGVADVKPKEKGRKAEEIDQKSGQNVQKVSNMVLPTRKNKLVSGEEHGDGVRRQGRTGRNLAATRSMIPMTSEKLGNIGTAKQLRSARLGSDKNESKAGRPPSRKLSDRKAYARQKPAINAAADFFVESEDGHEELLAAVKGVINSAHAFSSPFWRQMEPFFSLITEEDIAYWKQKVNLESSTLTPTPIPSNIDGVETIVNGYGLMGCERDAGFDAQWNAGIVAEQLQLSKGDHNVIPLCQRLIAALISEEECGGGSEHFKFDAYDTEFEPDGEPELNGLDHHSGTNFQFPCHSAYNGFRIMDKPEHDETERDIFGIPPTGLNSSFGKSINGFLRDKAMSSFTCSELQYDSLDINDKLLLELKSIGISPAPVPDMLQTDDEGISEDITRLEELYLGQISKKKSLLDGLFKSASVDKELQEKDFEQRALDKLVVMAYEKYMACWGPSPSGGKNTSNKMAKQAALGFVKRTLERCHQFKDTGKSCFSDPLFKDMFLAESSKPYASSLSVEARTASMGSLQSPSQFSQNMDNHDLNSSDVLPALNNSSEQTSGKEDLWSNRVKKRELSLDDVGGTPGISSAPGIESSATSSAKGKRSERDGKGHSREVQSRNGTTKVGRPASSSAKGDRKSKTKPKQKATQNSVSVNGLLGKLSEQPKPALPSVPKSNEMPTNSNAKEKDEFGLGGLDDHEPIDLSNLQLPGMDVLGVGDDQGQDLGSWLNIDDDGLQDHDDFMGGLEIPMDDLSDLNMMGSIIRRKKYKVLGPLLLAYKKSKTGEFRKDLEPSWCFRKEEAWGKRVEKKVVKGTATYWILEDKKTIATRQSKPMEEISSSVAVPFTLGVGNLIQKESAVTTHMEITGLKLMANTAAAALMLNPAVECLKENQVGAAALVSEMVIECESNWVLNESHNQAIKEDELMLAVDFQSLHSSSSQSVANGKSDPCREEAAALKSSFSEIDSPIMIKVDDDVDGKSGISELCPSMKPPVEETVSVAMDITSEDQSGSDESDPKPSAVLLDQLPGESKTWRTGNPNALELNSGPLWGCSSICGMRQEMEDAISVKPRLFQVSSQMLVNDHVNENEKQSLAHFFAVYDGHGGLQVANYCQERLHSKLIEEIETAQSTSAETNGRGDWQDQWKKAFINCFQKMDDDVGGIGASNRGNNSGGSESNIKTVAPETAGSTAVVAILSQTHIIVANCGDSRTVLYRGKEAMPLSSDHKPNREDEWARIEAAGGRVIHWKGYRVLGVLAMSRSIGDRYLKPWVIPEPEVNIVRREKNDECLILASDGLWDVMTNEEACEVANKRILLWHKKFGDNGPTGRSEGADPAAQSAAEYLTKLAIHRGSQDNISVIVIDLKAQRKIKRKP

SEQ ID NO: 201195 - protein, 82 aa, Glycine max
  Coding DNA Sequence Number=SeqID_84417
  Gene Ontology: Mol. function=nucleic acid binding; Cellular component= intracellular
  Homolog annotation: Hit_ID=Q8S8S8; Match level="QueryCoverage=93%, HitCoverage=28%, E-value=5e-25, Identity=67%"; Hit description =Expressed protein
  Pfam annotation: Domain name=zf-LYAR; Domain location=6-33; Score =60.4; E_value=5.8e-15; Accession=PF08790.1; Description=LYAR-type C2HC zinc finger
MSPNPLSCIDCGEIFGRDTVQDHTQCITEAEKYGPKGQGKTFNVATAKPNKDSKQRPEVDINVGLSDRPPWFCRVWDLSPTL

SEQ ID NO: 201196 - protein, 140 aa, Glycine max
  Coding DNA Sequence Number=SeqID_84418
  Gene Ontology: Mol. function=protein binding; Biological process =defense response
  Homolog annotation: Hit_ID=Q2PYY5; Match level="QueryCoverage=79%, HitCoverage=34%, E-value=1e-36, Identity=64%"; Hit description =Vernalization independence 3-like protein
  Pfam annotation: Domain name=WD40; Domain location=4-46; Score=37.0; E_value=6.6e-08; Accession=PF00400.22; Description=WD domain, G-beta repeat
  Pfam annotation: Domain name=WD40; Domain location=50-88; Score=21.4; E_value=0.0033; Accession=PF00400.22; Description=WD domain, G-beta repeat
  Pfam module annotation: Pfam domain module=WD40::WD40; Domain location=4-46::50-88
MKLGGLKSVENAHDDSVWAVTWVPATANRPPLLLTGSLDETVRLWRSDDLVLDRTNTGHCLGVASVAAHPLGSVAASSSLDSFVRVFDVDSNATIATLEAPPSEVWQMRFDPKFSREVLLPTLPLFKIFCGNGLIKVQNK

SEQ ID NO: 201197 - protein, 246 aa, Glycine max
  Coding DNA Sequence Number=SeqID_84419
  Gene Ontology: Mol. function=RNA-directed DNA polymerase activity; Cellular component=chromatin; Biological process=chromatin assembly or disassembly
MRISIWLDVNKVSVREEVDMALDGAVGREEDDSGWANTGAMWNRAEMLWALYSQHYICTAKRKMKQIKGKRIALNQEGNLVRNCVTIQCVVIANHHAEGCGWRRRKSKESSHSRLDKVMRAVAIHKNDELLMANRTEEAKGLRGEGTLHGIEANLGNHRRVYGGRRRGFDLISGGRETTCPRSGSTTPGRGEQRVPLPKALDWKFRGRGGSPTIFPPEDVRVPPLGEGKSTVVPELPSEVQGSNRR

SEQ ID NO: 201198 - protein, 125 aa, Glycine max
  Coding DNA Sequence Number=SeqID_84420
MLEHHTRQVTTDKLEEAVHRLTQGQASLTKSHASLSQGHHSLNTKIDSVHPFLTSKIDSLFDRLAAISVTPPSPTSPTHQPPSPASRHHHMKLDVPRFDGHDALGIPDQERLTIASFYMDGPALS

SEQ ID NO: 201199 - protein, 91 aa, Glycine max
  Coding DNA Sequence Number=SeqID_84421
MGFKLSVELLKLSVREEVKGLSILSLKLNDITALAKGCLDYGKIIGLMHWCGVGFGILWVCRILANRQSSVRPIKGDEDSLHNSVEEGAEA

SEQ ID NO: 201200 - protein, 278 aa, Glycine max
  Coding DNA Sequence Number=SeqID_84422
  Homolog annotation: Hit_ID=Q53Q54; Match level="QueryCoverage=37%, HitCoverage=10%, E-value=4e-39, Identity=66%"; Hit description=Major Facilitator Superfamily, putative
  Pfam annotation: Domain name=MA3; Domain location=138-228; Score =53.8; E_value=5.8e-13; Accession=PF02847.7; Description=MA3 domain
MGIGIGSKRMETEEWLKMQILKDMQQYLEGTLLLSIMYEVADSVSPRFTDVFAAMTAAVNTEFPQIIALELLTVLLEKPIDDSVEVARYKELKKSMLGEESEDDDEEGLDADESDNDNEEEEEHMQIKDEMETNLVNLRKTKYSAIMSSVDLEEAGHKLLEIKLEPGQEMELCGKVMILECCTINKVHQENLEKCFLQQYSMINRLETNKLHNVAKFFACLFGTDALPWHNMPCLIKQQQKDESGSSDSSDSDAESASSDQSDTENDRSGRKRPEDKG

SEQ ID NO: 201201 - protein, 353 aa, Glycine max
  Coding DNA Sequence Number=SeqID_84423
  Gene Ontology: Mol. function=nucleic acid binding; Cellular component= intracellular; Biological process=multicellular organismal development
  Homolog annotation: Hit_ID=Q8H6R5; Match level="QueryCoverage=99%, HitCoverage=99%, E-value=1e-61, Identity=41%"; Hit description=CTV.12
MDAQAKKKALFRAKLNAQKKEKRIESPLVRYNEFDQPVCRVCDVVLKSESLWDAHQVSRKHREAISNLKANAAGLTQHNNAKPVADSSFSKAKPEHSLDSQFKPPEASQLVSKPQSSSVLPPGFFDDSDSGKTRSGRKAGVSAKSQVSNLEKDKGQFDDNNVAKSNVSQATTDSRQTSVKTTDTEIQQVKGILPEGFFDNKEADLRARGIKLVKPDVNEGCTFEGIMQPLIENTPANSVLYGCTPHSRGVKPNGDEYKEFEKLIQEDLQEVDDRLEEEEIDAAEMIEEEEVVEQKMLSEKVEMLKKRRLELKAANAAKRSKSSEIVAKESRQEESSSDDESEENFAVDWRAQH

SEQ ID NO: 201202 - protein, 463 aa, Glycine max
  Coding DNA Sequence Number=SeqID_84424
  Gene Ontology: Mol. function=oxidoreductase activity; Cellular component=integral to membrane; Biological process=electron transport
  Homolog annotation: Hit_ID=Q75LK7; Match level="QueryCoverage=90%, HitCoverage=75%, E-value=1e-153, Identity=64%"; Hit description =Putative cytochrome P450
  Pfam annotation: Domain name=p450; Domain location=36-463; Score =164.9; E_value=2.1e-46; Accession=PF00067.12; Description=Cytochrome P450
MELIILLLSLILSSLVLMVLFLLCVTRSPKAMEGIPGSLGWPIVGESFSFLSDFSSPSGIFSFMNKRQKRYGKVFKSFVLGRFTVFMTGREASKILLTGKDGIVSLNLFYTGQQVLGPTSLLQTTGEAHKRLRRLIGEPLSIDGLKKYFHFINTQAMETLDQWQGRKVLFTLKVIGHMIMSLEPSGEEQEKFRSNFKIISSSFASLPFKLPGTAFHRGIKARDRMYEMLDSTISRRRSGQEFQQDFLGSLVMKHSKEDGEEDENKLTDKQLKDNILTLLVAGHDTTTAALTWLIKFLGENPIVLEQLREEHRQIVANRKSGTDLTWAEVNNMPYTAKVSNNNFSLQVISETLRRATILPWFSRKASQDFEIDGYKIKKGWSVNLDVVSIHHDPEVFSDPEKFDPSRFDETLRPFSFLGFGSGPRMCPGMNLAKLEICVFIHHLVNRYKKHDFRGEEERKTERN

SEQ ID NO: 201203 - protein, 69 aa, Glycine max
  Coding DNA Sequence Number=SeqID_84425
  Subcellular localization annotation: CTP_CleavageSite=51; ConfidenceScore=5.25e-01
MAINAARSSGLTHPSRAEKATQWGPPVRRRGYRLRLDIFVVCTTLPILALRSMKNVFRSFSRLLMRNWK

SEQ ID NO: 201204 - protein, 50 aa, Glycine max
  Coding DNA Sequence Number=SeqID_84426
MNQVGATTSSTVLSDGGGERSQHWTGGAENHHPKQEQHKCVYRTSTHVRV

SEQ ID NO: 201205 - protein, 363 aa, Glycine max
  Coding DNA Sequence Number=SeqID_84427
  Gene Ontology: Mol. function=protein binding; Cellular component =protein complex; Biological process=biological_process
  Homolog annotation: Hit_ID=Q6H592; Match level="QueryCoverage=98%, HitCoverage=99%, E-value=1e-134, Identity=61%"; Hit description =Proteasome protein-like
  Pfam annotation: Domain name=PCI; Domain location=233-349; Score =45.9; E_value=1.4e-10; Accession=PF01399.17; Description=PCI domain
MAYMSMGEAHRRITEYLNRFSDAISCQDGATFKSLFALSSNSPFLLSLGDALNLFQDANRLIKQSDNHSQFTDILVPLFRSLQNYRQNNLLEAYNAFEKTANAFIQEFRNWESAWAMEALYVIVYDIRVLAEKADKELVSNGKSPEKLKGAGSVLMKVFGTLAGKGSKRVGALYVTCQLFKIYFKLGTVHLCRSVIRSIETARIFDFEEFPKRDKVTYMYYTGRLEVFNENFPAYSKIVQALRRGDLRLLRCALQDHEDRFLRSGVYLVLEKLELQVYQRLVKKIYIIQKQRDPSRAHQVKLEVIVKALKWLVIDMDVDEVECIVAILIYKNLMKGYFAHKSKVVVLSKQDPFPKLNGKPVNS

SEQ ID NO: 201206 - protein, 117 aa, Glycine max
  Coding DNA Sequence Number=SeqID_84428
MDCWHKITKTWTSLSTRFKHHRKSSGRVGGAAQYSADCDGISAGLLKLRDDVQMCGYRDVQVMWNMLNVSLQHDQMPMEAARRSSNNAKFRKRGCSKQRSISRVLFWTNRDNLVNVQ

SEQ ID NO: 201207 - protein, 182 aa, Glycine max
  Coding DNA Sequence Number=SeqID_84429
  Pfam annotation: Domain name=LysM; Domain location=128-168; Score =26.7; E_value=8.2e-05; Accession=PF01476.10; Description=LysM domain
MSHLEYQCFLLQVERVFVPPKQKIYRHVSEAGKNNHECEIVAKVEMKANKEEKNSEEEAIHQFRITEVHVAGLKTEPLKKKFWGTSRRQQQQQSGSRWLIANGMGKNNKNSLVKSKVVSKSSAPITTANVQPGDTLWSISPRIYGTGTRWKELKELNPHIRNPNIKIPNKTSTWSARFNFLL

SEQ ID NO: 201208 - protein, 316 aa, Glycine max
  Coding DNA Sequence Number=SeqID_84430
  Gene Ontology: Mol. function=zinc ion binding; Cellular component =integral to membrane
  Homolog annotation: Hit_ID=Q06A78; Match level="QueryCoverage=99%, HitCoverage=100%, E-value=5e-54, Identity=73%"; Hit description=PHD2
  Pfam annotation: Domain name=C1_3; Domain location=261-291; Score =14.6; E_value=0.0099; Accession=PF07649.3; Description=C1-like domain
  Pfam annotation: Domain name=PHD; Domain location=262-312; Score =53.4; E_value=7.7e-13; Accession=PF00628.19; Description=PHD-finger
  Pfam module annotation: Pfam domain module=C1_3::PHD; Domain location= 261-291::262-312
MDGGGVNYNPRTVEQVFRDFKGRRAGMIKALTTDVEEFFQQCDPEKDNLCLYGFPNEQWEVNLPAEEVPPELPEPALGINFARDGMQDKDWLSLVAVHSDAWLLAVAFYFGARFGFDNADSISFLGGGRLEYLDCLLCKKSNEPEPNQSSEEVDDLSDSYSHGFSRSASASTSLHHIGVMSIVCWIFGLGGWRLHLSLLFDGSGAKRRFQQMRSESLNHLGSQVMVSATPRGSESGKYSKETKDEEEEVLDEEDDEEHEETLCGACGEHYASDEFWICCDICEKWFHGKCVKITPARAEHIKQYKCPSCSNKRARP

SEQ ID NO: 201209 - protein, 132 aa, Glycine max
  Coding DNA Sequence Number=SeqID_84431
MDKIEALSLEGLRIQSGMSNEGEPSNIIVQSFGDVCALQRKGVSISAGFLGLDGAAALQLLDTKDSSNEGVDGIIGLSITLDEWMRLDSGEIDDDDIDNISEHTSKLLAAHHANSMDMIRRSSKGERKQGKS

SEQ ID NO: 201210 - protein, 306 aa, Glycine max
  Coding DNA Sequence Number=SeqID_84432
  Gene Ontology: Mol. function=hydrolase activity; Cellular component =integral to membrane; Biological process=aromatic compound metabolic process
  Homolog annotation: Hit_ID=Q6YSE8; Match level="QueryCoverage=75%, HitCoverage=87%, E-value=7e-86, Identity=57%"; Hit description =Putative membrane protein
  Pfam annotation: Domain name=AXE1; Domain location=20-224; Score= -221.1; E_value=0.053; Accession=PF05448.3; Description=Acetyl xylan esterase (AXE1)
  Pfam annotation: Domain name=BAAT_C; Domain location=95-250; Score= -66.0; E_value=0.0024; Accession=PF08840.1; Description=BAAT  Acyl -CoA thioester hydrolase C t
  Pfam annotation: Domain name=Peptidase_S9; Domain location=60-251; Score=-45.6; E_value=0.00023; Accession=PF00326.11; Description =Prolyl oligopeptidase family
  Pfam module annotation: Pfam domain module=AXE1::BAAT_C::Peptidase _S9; Domain location=20-224::95-250::60-251
MVSYVNILLYGVGGLVVAGMALLVAFQEKLVYVPVLPGLTKSYAINPSRLRLTYEDVWLQSDDGVRLHAWFIKLFPNCRASDGYPSQHGITKDAQAALDHLSQRSDIDTSRIVVFGRSLGGAVGAVAALILENTFTSILDMAGVLLPFLKWFIGGSSTNGPKVLNFLVRSPWSTIDVVGQIKQPILFLSGLQDEMVPPSHMQMLYAKAAARNNQCLFVDFPTGMHMDTWLAGGDQYWRTIQQFLEQHAPEQKEDRSSQNANALLLAMSSVALCLLVVLILLPDIGASPQKHTVRRCFLLKHAAPRQ

SEQ ID NO: 201211 - protein, 185 aa, Glycine max
  Coding DNA Sequence Number=SeqID_84433
  Homolog annotation: Hit_ID=Q2LPI3; Match level="QueryCoverage=40%, HitCoverage=17%, E-value=4e-08, Identity=42%"; Hit description =Phosphoglycerate mutase
  Pfam annotation: Domain name=CBFB_NFYA; Domain location=48-101; Score= 32.2; E_value=1.8e-06; Accession=PF02045.6; Description=CCAAT-binding transcription factor (CBF-BNF-YA) subunit B
FPGRGVIEALGYDFEVSFDEVFVLVKLLSVKEIDDTLYLAEEKPPADEETIMSLIDDIRYFRHKGIEVEFKPTHGIDYRPYLHESRHRHALNRVRGSGGRFLSAKQLPQSNAELVTDAYQKKDASEAENHPSSTGENASITFTAISALTSMSSNSVNFPNMAGSSQCSGGLTFGAGALQCTSVGR

SEQ ID NO: 201212 - protein, 244 aa, Glycine max
  Coding DNA Sequence Number=SeqID_84434
DFTRSVAGRRVRIMLTSMTTLTQIWMTLQLNNILPSDHNSDLPLSKCQLVYAILTQMSVYVAQLISDAIYQFARIMPPRHPMDPEKSNRALGFPTLIMGLCQFYGVSVTPTKPIWPPINRVRHSSNRRRTGSSQPQMHRHRLYGSHHLWSPSLLTCEGWSSRCMHICSMGQVQLHESFYRYTLHQQSQDPNPFPWPTPEQFGATIAWPRDRPDFQTGAGPVGTLGDEGGAQDDDDMADVMDYFL

SEQ ID NO: 201213 - protein, 90 aa, Glycine max
  Coding DNA Sequence Number=SeqID_84435
  Subcellular localization annotation: CTP_CleavageSite=80; ConfidenceScore=5.47e-01
MADLNKVCKDLNLSRSSSTHPFYRPFHHWPPSITSSTRLRIFLALSTYVPTQPTTKLRFLEVFEISRTQVSPLTTINLICTERVTNLPGK

SEQ ID NO: 201214 - protein, 130 aa, Glycine max
  Coding DNA Sequence Number=SeqID_84436
  Gene Ontology: Mol. function=hydrolase activity, acting on ester bonds; Biological process=lipid metabolic process
  Homolog annotation: Hit_ID=Q9FHQ1; Match level="QueryCoverage=88%, HitCoverage=32%, E-value=7e-30, Identity=56%"; Hit description=GDSL -motif lipase/hydrolase-like protein
MDAAKLGITSPPAYLSVSQNVDTLLKAVNYAFGGVGIVNDTGLYFIQRLSFDDQINNFKKTKEVILAGIGEAAANKHCNEATYFIGIGNTSHSQNLLSMVCEMESDCIEDMDIEVLSSMWPEDVGTDIGK

SEQ ID NO: 201215 - protein, 64 aa, Glycine max
  Coding DNA Sequence Number=SeqID_84437
  Homolog annotation: Hit_ID=Q67U57; Match level="QueryCoverage=67%, HitCoverage=20%, E-value=8e-16, Identity=86%"; Hit description=Major intrinsic protein-like
  Pfam annotation: Domain name=DZC; Domain location=15-43; Score=34.3; E_value=4.3e-07; Accession=PF08381.1; Description=Disease resistancezinc fingerchromo
MVLCSNAHSSYDDIRTRENREMFNKWQAQRWWAENYDKVMELYNVQRFNRQAFPLPTPLRSEDE

SEQ ID NO: 201216 - protein, 220 aa, Glycine max
  Coding DNA Sequence Number=SeqID_84438
  Homolog annotation: Hit_ID=Q6YUB8; Match level="QueryCoverage=72%, HitCoverage=44%, E-value=2e-21, Identity=41%"; Hit description=Major intrinsic protein-like
MLTCIARPKKPDESDPDNATSAAKSQAIKSLTSQIRDMALKASGAYKHCAPCTGPATQGRVRSNATELDADSDRFRWSYRRTGSSSSTTTRTWGKEMEARLKGISSGEGTPNSASGRRAEPVVLFVEENEPKEWVAQVEPGVLITFVSLPRGGNDLKRIRFSSSGVVVFVGVGGLDRTTVMMTMSAFCYTSLVGSLSPLHTLLSYVWNETASHLDLRLLN

SEQ ID NO: 201217 - protein, 679 aa, Glycine max
  Coding DNA Sequence Number=SeqID_84439
  Gene Ontology: Mol. function=phosphatidylcholine-sterol O -acyltransferase activity; Cellular component=endoplasmic reticulum; Biological process=lipid metabolic process
  Homolog annotation: Hit_ID=Q67U60; Match level="QueryCoverage=93%, HitCoverage=91%, E-value=0.0, Identity=76%"; Hit description =Putative lecithin diacylglycerol cholesterol acyltransferase
  Pfam annotation: Domain name=LACT; Domain location=115-641; Score =158.8; E_value=1.5e-44; Accession=PF02450.6; Description =Lecithin:cholesterol acyltransferase
MSFLRRRKAPANPSPNEEKEKDKKKVIKEKKIIKGENIIIKRWSCVDSCCWFVGLICSIWWFLLFLYNAMPASFPQYVTEAITGPLPDPPGVKLRKEGLTVKHPVVFVPGIVTGGLELWEGRQCADGLFRKRLWGGTFGELYKRPLCWVEHMSLDNETGLDHPGIRVRPVSGLVAADYFAPGYFVWAVLIANLARIGYEEKNMYMAAYDWRISFQNTEMGFSPPSSFDQVRDQTLSRMKSNIELMVATNGGNKVVVIPHSMGVLYFLHFMKWVEAPAPMGGGGGSDWCAKHIKAVMNIGGPFLGVPKSVAGLFSIEARDIAVARTFAPGFWDKDVFGLKTLQHLMRMTRTWDSTMSMIPKGGDTIWGGLDWSADVSYNCSVKKNKNNDTYGAFQNGKENLGFMKNINYGRLISFGKDIADLHSSKLERLDFRGALKGRNLANTSNCDVWTEYHDMGVDGIKAVTDYKAYTADSILDLLHFVAPKMMKRGDAHFSYGIADNLDDQKYKHYKYWSNPLETRLPNAPDMEIYSMYGVGIPTERAYVYKLTPQSECHIPFQIDTSADGGNEYTCLRDGVYSSDGDETVPVLSAGFMCAKGWRGRTRFNPSGIQTFIREYDHAPPANLLEGRGTQSGAHVDILGNFALLEDIIRVAAGASGKDLGGDRVHSDIFKWSEKINLKL

SEQ ID NO: 201218 - protein, 116 aa, Glycine max
  Coding DNA Sequence Number=SeqID_84440
MSQNAGANTGKSLGEYLEYDDKNSNNPWRSFMRILVRLGTGMATTLSARHTTTTSWITWCKMTTHSTQVWESVGLWDIISDHILQVENKSGVVEPDRCPTRNIRSLSTPAAQRVDQ

SEQ ID NO: 201219 - protein, 176 aa, Glycine max
  Coding DNA Sequence Number=SeqID_84441
  Homolog annotation: Hit_ID=Q6YUB8; Match level="QueryCoverage=94%, HitCoverage=42%, E-value=5e-34, Identity=53%"; Hit description=Major intrinsic protein-like
SSKLESVEESPVTPPLNSERLPRNMYRPTGMGMGYSSSDSFDHQSMQSRHFYDSNGMNSTPKVSTISAAKTEISSMEASIRSSSSREADRSGDFSISNASELETEWVEQDEPGVYITIRALPGGARELKRVRFRSLWNLFLGVLMCYIAEKSLGRCMLDYGGKRTVPEYMNNTCEL

SEQ ID NO: 201220 - protein, 213 aa, Glycine max
  Coding DNA Sequence Number=SeqID_84442
  Gene Ontology: Mol. function=protein binding; Cellular component =ESCRT III complex; Biological process=protein transport
  Homolog annotation: Hit_ID=Q9SKI2; Match level="QueryCoverage=93%, HitCoverage=87%, E-value=5e-63, Identity=67%"; Hit description =Expressed protein
  Pfam annotation: Domain name=Snf7; Domain location=1-172; Score =189.8; E_value=6.4e-54; Accession=PF03357.11; Description=Snf7
MLDKSIREIDRERQGLQSQEKKLILEIKKSAKQGQMGAVKVMAKDLVRTKHQIEKFYKLKSQLQGVSLRIQTLKSTQAMGEAMKGVTKAMGHMNRQMNLPSLQKILQEFETQNERMELITEVMGDAIDDALEGDEEEEETEDLVNQVLDEIGIDINQELTVVTLLSAPSTAVAASAAKTKVPQVETVGNDDATIDSNLQARDSSYTGKTGAHL

SEQ ID NO: 201221 - protein, 68 aa, Glycine max
  Coding DNA Sequence Number=SeqID_84443
MFRDIEKMLIRLEVVNMDYYPPCPNKELTVGVGCYADLNYMIKDYMKNYSANALDRKKSLDFARINSA

SEQ ID NO: 201222 - protein, 139 aa, Glycine max
  Coding DNA Sequence Number=SeqID_84444
MLDLIAFALLILACSYWKLSGQLLNEENTERDLENVVSGEKQGDFANKESIKVYKEKILVIMAGDDPNLPQPPKGCTFVSYLNVRPKDLILKMDLDVVVMAKEATRSTTVMWWSHDSGMAEGKGKRENVVASWLGFVSV

SEQ ID NO: 201223 - protein, 408 aa, Glycine max
  Coding DNA Sequence Number=SeqID_84445
  Homolog annotation: Hit_ID=Q287W0; Match level="QueryCoverage=96%, HitCoverage=99%, E-value=1e-24, Identity=29%"; Hit description =Expressed protein
MHERSMKEAAGTCPQRRRTPSFSSSLLDAIYRSIDESKSNLHDDQQLGHHHHHDQTLATHSFTSEEKGGKKERMNLRRAVMLEDWMEKYGSSRSLNAQLLNSSSSSSECSSAGGIFSSSETDTTTTTLKKQRPARPTSEKKKKKKKKQDHIMSSEKKNKEGGFARTKLRALKIYGELNQRVKQPISPGSRIASFLSSIFNSQNVKKAKMCYVGAVEDVSFEHKSKSPCFSSTPSSFSRRSCMSKTPSSAKKPNNNGVKRSVRFYPVSVILGEDSEPQSNSHSHNKKCNNIYESESNLTVRKITRSSSIKELKKNTVRGKENATEEAAARGFVKGYRNSGKGEFDFIGFYGNGENENDENDDDDDVSCSSSDLFELDHLIGAARYQEELPVYETTNLETNKAIASGLCL

SEQ ID NO: 201224 - protein, 151 aa, Glycine max
  Coding DNA Sequence Number=SeqID_84446
  Gene Ontology: Mol. function=nucleic acid binding; Biological process= DNA integration
  Homolog annotation: Hit_ID=Q1SDY9; Match level="QueryCoverage=79%, HitCoverage=22%, E-value=2e-25, Identity=46%"; Hit description =Peptidase S8 and S53, subtilisin, kexin, sedolisin; Zinc finger, CCHC- type
MASNNVPLATPLIFTGKKLQNLGYEEERSHNEQVAKRAKALTILHPIVDDDAFMRISNLDTTKEIKEKLQDEFFGNEKAKKMQVLNLKRSLTMNEAENIKDFMTRLVKVMNQIKLLRGKFLESRIVEKVLVVLPERFEPKISSLKSQRISP

SEQ ID NO: 201225 - protein, 75 aa, Glycine max
  Coding DNA Sequence Number=SeqID_84447
MIPTQAGDQPRDAPAADPEEYIQPPSPQDDYDGYEVIAQRLERVLNLRMDCLTIARGGASANGSVRARQRRRTEH

SEQ ID NO: 201226 - protein, 183 aa, Glycine max
  Coding DNA Sequence Number=SeqID_84448
  Gene Ontology: Mol. function=zinc ion binding; Cellular component =integral to membrane; Biological process=ubiquitin cycle
  Homolog annotation: Hit_ID=Q1SGA9; Match level="QueryCoverage=71%, HitCoverage=39%, E-value=6e-18, Identity=36%"; Hit description=Zinc finger, RING-type; RINGv
  Pfam annotation: Domain name=zf-C3HC4; Domain location=109-150; Score= 19.5; E_value=0.0015; Accession=PF00097.15; Description=Zinc finger, C3HC4 type (RING finger)
  Subcellular localization annotation: CTP_CleavageSite=73; ConfidenceScore=5.29e-01
MGDFQGPFIVSPPPSLSSSDKSSTTMLYYGLVVVGIAAMALALYNFIIIKRSRRRHMQSQAAGANGLVEGAVMESSGTENCQRNNFNMLSSFKYKKEGIGNDGDYDYECPVCLSGFEEGEEVRKLPRCKHWFHAPCIDMWLYSHLDCPICRTPVGQFCHRFHSGLGLLESSGGGGGGGGVSVV

SEQ ID NO: 201227 - protein, 207 aa, Glycine max
  Coding DNA Sequence Number=SeqID_84449
  Gene Ontology: Mol. function=oxidoreductase activity
  Homolog annotation: Hit_ID=Q9LE86; Match level="QueryCoverage=97%, HitCoverage=70%, E-value=6e-48, Identity=42%"; Hit description =Arabidopsis thaliana genomic DNA, chromosome 3, P1 clone:MJM20 (Oxidoreductase 2OG-Fe(II) ...
  Homolog annotation: Hit description=oxygenase family protein)
MALSFNTSNSLYDFVVREGNGVKGVADLGLSELPERYIKPPEERMDKQDSRTCDAPPIDLSKLNVPEHEKVVVNHGVPLELLESLKDAAHTFFNLPPEKKAVYRAAIRPILVTKLGTSFVPEKVDLGMEGLYQGIVKILISKLGVSAYGSRIEQILGVKIVNMNNYPPCPNPELTVGVGRHSDLGTITVLLQDGIGDLYVKMEEDNC

SEQ ID NO: 201228 - protein, 51 aa, Glycine max
  Coding DNA Sequence Number=SeqID_84450
METTRVLNTEQEQLAPKPGEVVMQDYTKNFFENAHQRKKILDFVTFRLFFK

SEQ ID NO: 201229 - protein, 74 aa, Glycine max
  Coding DNA Sequence Number=SeqID_84451
MVHVKSFYVEPSQRRNWKYSNMNEAEAAGRGVRYLAQICLHFWAISSAPFSAVGSGSPESVVARRIYCTSNFPT

SEQ ID NO: 201230 - protein, 133 aa, Glycine max
  Coding DNA Sequence Number=SeqID_84452
  Subcellular localization annotation: CTP_CleavageSite=50; ConfidenceScore=5.07e-01
MQVSLSNHKSTKSAIRNLKVQVGQLAKQLVETSMNSFGTNTKKNPKEKCKVEAIEQEADLVGWHLKSVFLEEDEVKPVVNPAAPSIVLPRPRGVKAQTTPDAPPTPPPIILPPTTSSTANKPFSSSFQQEHLV

SEQ ID NO: 201231 - protein, 84 aa, Glycine max
  Coding DNA Sequence Number=SeqID_84453
MSRGRASLRGTWKALRLHLTRTSKQSSSLREGKVVDGGLPRKFERAQEGDCTAASFMAVISTETYSKEIFNNRLIMCVAKGIFH

SEQ ID NO: 201232 - protein, 169 aa, Glycine max
  Coding DNA Sequence Number=SeqID_84454
  Subcellular localization annotation: CTP_CleavageSite=18; ConfidenceScore=5.06e-01
MASGHRTFHMGSMSAPLYCSSFWLQSPMPFQSEFNEFLKATDTKVAIEEEALKSMMASLEEEMEEGEEAKSSPIPPVQKKAQPKKKAVTSDDVEIVEVRKLVEKRNIPNILNLEDGEFLKESGCFLLGRKIKVAVSTTRRVNSLGMQYFSMKALLIGGWMSLVGVTDTP

SEQ ID NO: 201233 - protein, 145 aa, Glycine max
  Coding DNA Sequence Number=SeqID_84455
SAEHQHWFEAIKGWSFLRERRVQLRDEEYVEFQEEIAQRQWAQLISPMAKFDPEDFAHTVAGRRVRIMRTSMTTLMQIWMTLLLNNILPSDHNSELTLPKCECTCCPTDFRCHLPVRRDYASETPSGPGEVQQGPRFPALITGLC

SEQ ID NO: 201234 - protein, 131 aa, Glycine max
  Coding DNA Sequence Number=SeqID_84456
MGMGETPPHQPAPVPPTGLLMKRCKFIWRLLLLSNLALGAYLFASAKPRDSMEINRRTAQKSHKGKASVEVSPEPTTSSIDFNYDDFLVPVTTPVKVQAPIPEEQQREIFQWMLEEKRKLKPKNPVEKKTN

SEQ ID NO: 201235 - protein, 91 aa, Glycine max
  Coding DNA Sequence Number=SeqID_84457
MQEKIQGYCLHSQPHGRNEERLKGRSIYPWLRVTFFKLKEGVGEHVKDEVLGAIRGIQRKFQFTCGGNFSPARAKGFFIASLEVFPGLNEP

SEQ ID NO: 201236 - protein, 423 aa, Glycine max
  Coding DNA Sequence Number=SeqID_84458
  Pfam annotation: Domain name=Dabb; Domain location=118-211; Score =58.2; E_value=2.8e-14; Accession=PF07876.3; Description=Stress responsive AB Barrel Domain
  Pfam annotation: Domain name=Dabb; Domain location=7-103; Score=99.8; E_value=8.4e-27; Accession=PF07876.3; Description=Stress responsive AB Barrel Domain
  Pfam module annotation: Pfam domain module=Dabb::Dabb; Domain location=118-211::7-103
MASTKTVEHIVLFKVKEETEPSKVSDMVNGLGSLVSLDPVLHLSVGPLLRNRSSALTFTHMLHSRYKSKEDLEAYSAHPSHVSVVKGYVLPIIDDIMSVDWVADDLATASLVPPPGSAVRVSFLKLKEDADKDTVLGVVRGIPESFKQISEFSLGENFSPGRAKGFSIASLAVFPGPRELEAVDSNEELVNYQKDKVRDQIESVVVVDYVVPAPPPAQRWMKPLFFFLTTQPILYLPGLCFVYVNCFVIYASTDTSAPCRVSCVRVSVRHRASVLVSDTDTTSVLRSIFWTLQVSVSCPVFVSVSMLHSLLCDFTRIMSLECCYDAVRLLVQTITCKWCKRARATSYTVTHLTLPGPFHTAIIGTPSLVLHSPGIFTLHEYFKHAWPKEAQSHSLLHKRNPNKSTPSIPFGGLYFPWTCGISS

SEQ ID NO: 201237 - protein, 109 aa, Glycine max
  Coding DNA Sequence Number=SeqID_84459
MRVHDSQASPRPSVTLVRPPLPMAHSDPVCEWRNLDDYPTLLAKQPENSQTEAKLHGESKVIQRCFDDNNDDDKGDDKKLKDQSKNNSSESKINQRTTKVNQEQFKSSR

SEQ ID NO: 201238 - protein, 124 aa, Glycine max
  Coding DNA Sequence Number=SeqID_84460
MVKVSTRLGELCIDLVSRQQKRCTSLGHFAWLQDDTGYSCTHLIMEVYSAEAVGLISKPGFMDHACFLAVSCYFRHIQRSQKTVADYVSKDALRCVQQVVVLEDPPYYIAASLAVDVDGTLPLL

SEQ ID NO: 201239 - protein, 90 aa, Glycine max
  Coding DNA Sequence Number=SeqID_84461
MTSSLKDEDPIFDLIEYLPISSVEKSKQILEEFIDIWKEVVSKKSLAGQFMHTEPNYAEYGLSDNYTSQHTAVQYAAALAQLIQSAQLRN

SEQ ID NO: 201240 - protein, 311 aa, Glycine max
  Coding DNA Sequence Number=SeqID_84462
  Gene Ontology: Mol. function=DNA-directed RNA polymerase activity; Cellular component=DNA-directed RNA polymerase III complex; Biological process=transcription from RNA polymerase III promoter
  Homolog annotation: Hit_ID=Q28DL8; Match level="QueryCoverage=39%, HitCoverage=34%, E-value=7e-09, Identity=28%"; Hit description =Polymerase (RNA) III (DNA directed) polypeptide D, 44kDa (Polymerase (RNA) III (DNA directed) polypeptide D)
  Pfam annotation: Domain name=RNA_pol_Rpc4; Domain location=187-301; Score=111.8; E_value=2e-30; Accession=PF05132.5; Description=RNA polymerase III RPC4
MASGSGKDGPGVPRKPKFKPRAPPRRVIKQEVKAEVVDDADAEQAAKENLLKRFNERESAMKAKYKVEKKEKQNEGIVKNTSEVLASQIAFGYGGESTSMKSYGIPRGGSSININLSSASSGGKEKEYQEPWDYYSNYPVTLPLRRPYSGNPALLDDEEFAEAAQSRTYEENASNSTMDLGLLEENPEASMFLINLPTKLPMIKQSATAGDKDVNEKSIPHGGSKNVEELCELNELSSGFMGKMLVYKSGAIKLKLGNTLYDVSSGMNCACAQDLVAVNTAQKHCCTIGEISKHVTITPDVDAIIDNLSDL

SEQ ID NO: 201241 - protein, 593 aa, Glycine max
  Coding DNA Sequence Number=SeqID_84463
  Gene Ontology: Mol. function=hydrolase activity, acting on acid anhydrides, catalyzing transmembrane movement of substances; Cellular component=integral to membrane; Biological process=metal ion transport
  Homolog annotation: Hit_ID=Q7Y051; Match level="QueryCoverage=83%, HitCoverage=54%, E-value=1e-175, Identity=65%"; Hit description=Paa2 P-type ATPase
  Pfam annotation: Domain name=E1-E2_ATPase; Domain location=154-436; Score=207.9; E_value=2.4e-59; Accession=PF00122.10; Description=E1 -E2 ATPase
  Subcellular localization annotation: CTP_CleavageSite=40; ConfidenceScore=5.40e-01
MATHLFRLSLSSQPKLCFNYTPNHALHFISPLPAKRRGSRCRHRREILRSPFAVSNSFGTEIGSPDLALLQDRREAKDSPVLLDVTGMMCGACISRNHILFLSGGCRQPSPRDNVAELLFDGLNAFKKGSPNMNSLYLTPAWHWDASFFDEPVMLLGFVLLGRSLEEKARIQASSDMNELLSLISTQSRLVITSTEGSPSTDTVLSSDAICVEVPTDDIRVGDSVLVLPGETIPIDLTKEIHEQGMVISGRSVVDESMLTGESLPVFKEKGLTVSEGTINWDGPLRIEASSTGSNTMISKIVRMVEDAQSREAPVQRLADSIAGPFVYSVMTLSAATFAFWYSVGSHIFPEVLLNDIAGPEGDPLLLSLKLSVDVFLQNLQTVFDLDSSHYSKLRHDAVVSCPCALGLATPTAILVGTSLGARKGLLIRGGDVLERLAGIHYIALDKTGTLTKGKPVVSAISSILYGESEILRLAAAVEKTASHPIAKAIVNKAESLELIFPVTKGQLVEPGFGTLAEVDGHLIAVGSLEWVHERFQTRGNLPDLTNLEHSLMNHSLNTTSSKYSKTVVYVKEKASLVLLPYLTLCVKMLNLL

SEQ ID NO: 201242 - protein, 629 aa, Glycine max
  Coding DNA Sequence Number=SeqID_84464
  Homolog annotation: Hit_ID=Q6ZGD1; Match level="QueryCoverage=91%, HitCoverage=69%, E-value=1e-122, Identity=42%"; Hit description=DENN (AEX-3) domain-containing protein-like
  Pfam annotation: Domain name=DENN; Domain location=56-470; Score= -52.8; E_value=0.00024; Accession=PF02141.11; Description=DENN (AEX -3) domain
MPCSFFYVETVLGADNSTLYGCCVLVEELVQKPSGLLSLISDKQPSYSSLRRHILTTQRCYCILSRLPAFDLLFGVLNSIFTQERLERLTKGVGDLNLEFDEGNHKEENLEGYSDSVLVSDEPIEDRLGGNMVISQSRVGKSTPENIVDDGQPEHLMVDGELQPYKERINYDDVLLTDPVNDRTTAKEDSGPANSENSDHYGDAFGTNKQSEDKHLPNAILPLLRYCQYESSESSCSFQGSPCEDRNFRSDVDDNETEEASFSGQEDLNDLNDILEWAKENNHGPLQIVSEFYRLSCPARGSSLTFHPLEHLHPLEYHRSAETVLRLAGSTVDLKTSSTGLGLADAHIALLVEEANALSVWAVACLCGTLRLENIWQHHFKVELICSYGFYIQDEDLVGIVNLITSTVLTFFAGVLLEKQIVVVCSNLVLPNDMLEFLDAPVPYVVGIKNKTSELQSKFTNVILVDADRNQRRFVEAQVRRVNKMEVKSPTIPQLPRQKELVSSLRPYHATLVGESYLGRRRPVYECTEVQIEAAKGFLSVLRSYLDSLCYNIRSHTITNVQSNDDKVSLLLKESFIESFPYRDQPFMKLSATLKSALGTKLGLPNQLQYCRGLGVVVLHSGFDFIFNC

SEQ ID NO: 201243 - protein, 228 aa, Glycine max
  Coding DNA Sequence Number=SeqID_84465
  Pfam annotation: Domain name=TATA_RF; Domain location=31-219; Score =105.7; E_value=1.3e-28; Accession=PF08612.1; Description=TATA -binding related factor (TRF)
MQAPCCRRAPPLKSSWRKRKENVSLSLPASMPIRCILHWQPNQGSVVNSQVLNEISQCVESLNGVKEGRCKASLTFYRPNLRDQSVTIDFPRDFLGISMLEQPNKYYFIIRGQKIVLEADSSILLIMEKLQSYKSKVALHFEGVLYKLGDFQMRVIKVVPSQAESLRGIMIETLKRMGVWEIVTAGKKSLVLHPGHETVMSVAAAIAVFAGASLQWSRNSGLEDFVML

SEQ ID NO: 201244 - protein, 182 aa, Glycine max
  Coding DNA Sequence Number=SeqID_84466
  Gene Ontology: Mol. function=metal ion binding; Cellular component =integral to membrane; Biological process=protein modification process
  Homolog annotation: Hit_ID=UPI00001633C9; Match level="QueryCoverage =80%, HitCoverage=48%, E-value=1e-34, Identity=42%"; Hit description =ubiquitin-protein ligase/ zinc ion binding
  Pfam annotation: Domain name=IBR; Domain location=103-165; Score =44.9; E_value=2.8e-10; Accession=PF01485.11; Description=IBR domain
MQTEAKQQKLLKGKSPLDHDPGEAKKSDQPSQFLCGLCFNDKPVSQMFKEGKCNHPFCTHCISKHVATQMHQNILKVMCPNPNCPVELKPEYFHNILASEVIVRWETVRCESLIVGLEKTYCPFKDCSVLLVNDGEKDVISAECPSCHRLFCARCKVPWHGIMSCEEFQEIERSKDEIVLKN

SEQ ID NO: 201245 - protein, 159 aa, Glycine max
  Coding DNA Sequence Number=SeqID_84467
  Homolog annotation: Hit_ID=Q1S6U1; Match level="QueryCoverage=91%, HitCoverage=56%, E-value=6e-20, Identity=72%"; Hit description=GRAS transcription factor
  Subcellular localization annotation: CTP_CleavageSite=75; ConfidenceScore=5.30e-01
MWMLNKLSSPYDDTDQKLASYFLQTFFSHITQAGDRTYKTLASASKKTCSFKSTRKTCSFVTAGTTAQKVMKEIKARMEKEADLDIGLEGFEFVKGFEECLRWFRVYFEALDRIFPRTSNEHLMLEREAGRAMVDLVACSLVESVERWGVWVFYGSTGG

SEQ ID NO: 201246 - protein, 245 aa, Glycine max
  Coding DNA Sequence Number=SeqID_84468
  Gene Ontology: Mol. function=nucleotide binding; Cellular component =membrane; Biological process=translation
  Homolog annotation: Hit_ID=P64612; Match level="QueryCoverage=99%, HitCoverage=65%, E-value=2e-97, Identity=70%"; Hit description =Hypothetical protein yhcM
  Pfam annotation: Domain name=AFG1_ATPase; Domain location=4-245; Score=261.3; E_value=2e-75; Accession=PF03969.6; Description=AFG1 -like ATPase
MQTSSPLARYEQALSQGEFRPDDVQRDAITRLDRIQQGLIARQQQPQPAAKGLFGRLSKLMNKAPESHEAPVRGLYMWGGVGRGKTWVMDLFFQSIPGDRKLRLHFHRFMLRVHEELTQLQGHSDPLLIVADRFKAETDILCFDEFFVSDITDAMLLGTLMEALFARGITLVATSNIPPDELYRNGLQRARFLPAIEQIKRHCDVMNVDAGIDYRLRTLTSAHLWNFPLNDATHAEMERMFSALS

SEQ ID NO: 201247 - protein, 342 aa, Glycine max
  Coding DNA Sequence Number=SeqID_84469
  Gene Ontology: Mol. function=serine-type endopeptidase activity; Cellular component=periplasmic space; Biological process=proteolysis
  Homolog annotation: Hit_ID=P0AEE3; Match level="QueryCoverage=88%, HitCoverage=86%, E-value=1e-121, Identity=73%"; Hit description =Protease degS precursor
  Pfam annotation: Domain name=PDZ; Domain location=244-335; Score =30.0; E_value=8.2e-06; Accession=PF00595.14; Description=PDZ domain (Also known as DHR or GLGF)
  Pfam annotation: Domain name=Trypsin; Domain location=44-241; Score =98.6; E_value=1.8e-26; Accession=PF00089.16; Description=Trypsin
  Pfam module annotation: Pfam domain module=PDZ::Trypsin; Domain location=244-335::44-241
MFLKLLRSVVMGLIVAGLLLVAIPALRMGSNVTFDHDSSADEAPFSFNQGVRRAVPAVVNVYNRSAHGNNNRGITTLGSGVIMNAKGYILTNKHVINNADQIIVALQDGRFFEATLVGSDAMTDLAVLKISASNLPVIPINAKRVAHIGDVVMAIGNPYNLGQTVTQGIISATGRIGLSSSGRQNFLQTDASINQGNSGGALINSLGELMGINTLTFDKSNDGETPEGIGFAIPTALATKIMDKLIRDGRVIRGYIGITGRELPPLHGQGSNLDRVQGIIVSEVTPGGPADRAGIQANDVLLQVNALSLSRGRGVQKRGVTSWRSTGESDYLTERHRPSAAA

SEQ ID NO: 201248 - protein, 175 aa, Glycine max
  Coding DNA Sequence Number=SeqID_84470
  Homolog annotation: Hit_ID=Q7MZX7; Match level="QueryCoverage=50%, HitCoverage=78%, E-value=2e-31, Identity=71%"; Hit description =Similar to putative lipoprotein YjeI of Escherichia coli
YGNMIDFGILDPTKVTRSALQYASSVAGLMITTEAMVTDLPKGDAPDLGAGAGGMGGMGGMGGMITSNQLSAAGERVTFVDQQPGSQCQLLGNVTGSQSNWLTGSGGEGSSLRGAANDLRNRAAEMGGNVIYGATSPTQNLLSAFAPLDSKMSGQFQHGRHQWRHYGDGAATGIL

SEQ ID NO: 201249 - protein, 212 aa, Glycine max
  Coding DNA Sequence Number=SeqID_84471
  Homolog annotation: Hit_ID=Q8ZIY4; Match level="QueryCoverage=45%, HitCoverage=100%, E-value=7e-42, Identity=88%"; Hit description=10 kDa chaperonin
  Pfam annotation: Domain name=Cpn10; Domain location=117-210; Score =147.6; E_value=3.2e-41; Accession=PF00166.12; Description=Chaperonin 10 Kd subunit
MVMLTLQFCCPARCVAARLTGDIDLNFHPGGARARRAADHAAEPGGGDDQKRVADHRRFSAAAAGLLYRFPRPAAVAAAGAEAPDAEADAAPARMARPGAGPGQRRHHGRRESYQMKIRPLHDRVIVKRKEVEAKSAGGIVLTGSAAGKSTRGEVLAVGNGRILENGDVKPLDVKVGDLVIFSEGYGAKTEKIDNEEVLIISESDILAIVEA

SEQ ID NO: 201250 - protein, 87 aa, Glycine max
  Coding DNA Sequence Number=SeqID_84472
MAGKCGRPAAGRRAATADRYPPHFLAHRRGDFSSRFSPPLFLLKEAPRAAKKAAAGEGDEPEGVDQPASGAADVAVGHAADFCQYVD

SEQ ID NO: 201251 - protein, 138 aa, Glycine max
  Coding DNA Sequence Number=SeqID_84473
  Gene Ontology: Mol. function=tetracycline:hydrogen antiporter activity; Cellular component=integral to membrane; Biological process=tetracycline transport
  Homolog annotation: Hit_ID=Q578Q5; Match level="QueryCoverage=99%, HitCoverage=69%, E-value=3e-48, Identity=49%"; Hit description=Multi- drug resistance efflux protein
MAAAALGSILSAPRLGRLADRIGHARVLIYGLLVCALLLIPQAFISAAWQLVLLRFLMGMALGGLMPCVTALIRHNVPQRQVGKMLGYATSAQYVGQVSGPLFGGFIGGAFGMRPVFLATCVIMALCALLNARVLRKA

SEQ ID NO: 201252 - protein, 136 aa, Glycine max
  Coding DNA Sequence Number=SeqID_84474
MAEPSKKRKGTSSRSQRHSRSQEAPIPPSIPSGSLFSSEEQHIRYTNLFSSHSIVDPKFIDMEFFSNENFECFQAFENSNLIPFMSLKLPLVGLGSSSSMDSFASWKMNGSGMEKGREREEMPLQGEDESRRSSPP

SEQ ID NO: 201253 - protein, 246 aa, Glycine max
  Coding DNA Sequence Number=SeqID_84475
  Gene Ontology: Mol. function=nucleotide binding
  Homolog annotation: Hit_ID=Q9FH12; Match level="QueryCoverage=77%, HitCoverage=28%, E-value=6e-83, Identity=80%"; Hit description=Axi 1 (Auxin-independent growth promoter)-like protein
  Pfam annotation: Domain name=DUF246; Domain location=1-218; Score =80.7; E_value=4.5e-21; Accession=PF03138.5; Description=Plant protein family
MEKKGLGEGDMIQLEDMGFESHIGSAIFCCGIYKFLGALAAKDMLAFTGCSHNLTAEEDEEMRQMRYEVSHWKEKEINGTERRLLGGCPLTPRETSLLLRALGFPSHTRIFLVAGEAYGRGSMKYLEDDFPNIFSHSSLSSEEELNPFKNHQNMLAGLDYVVALKSDVFLYTYDGNMAKAVQGHRRFEDFKKTINPDKMNFVKLVDQLDEGKISWKKFSSKDVFVKQDSSRDFPEGCLSFDGMAEL

SEQ ID NO: 201254 - protein, 256 aa, Glycine max
  Coding DNA Sequence Number=SeqID_84476
  Gene Ontology: Cellular component=membrane
  Homolog annotation: Hit_ID=Q10QZ1; Match level="QueryCoverage=57%, HitCoverage=64%, E-value=9e-45, Identity=61%"; Hit description=YGGT family protein, expressed
  Pfam annotation: Domain name=YGGT; Domain location=131-212; Score =60.1; E_value=7.5e-15; Accession=PF02325.8; Description=YGGT family
  Subcellular localization annotation: CTP_CleavageSite=91; ConfidenceScore=5.09e-01
MGANANDLSTEIDCTKKVSNCWGNGQIPFALPFLTLPNSNFTTLLSSPPQLLHTSFTTAADNFFRFVHSLASQNPFLNKVLSLPAEFHTLCVQERPYDIVDVWVQIRKQRNVGLVSSHNFAAVLPGGSVAGLVVANGVLNFLNIYNTLLIVRLVLTWFPNTPPSIVSPLSTICDPYLNIFRGLIPPLGGTLDLSPILAFLVLNAFTSTAAALPAELPVTEQSKQGLAAPLPSTTSQKKWMRRFQGNRSRTSGDDAK

SEQ ID NO: 201255 - protein, 332 aa, Glycine max
  Coding DNA Sequence Number=SeqID_84477
  Homolog annotation: Hit_ID=Q9FH12; Match level="QueryCoverage=97%, HitCoverage=53%, E-value=1e-87, Identity=52%"; Hit description=Axi 1 (Auxin-independent growth promoter)-like protein
  Subcellular localization annotation: CTP_CleavageSite=74; ConfidenceScore=5.74e-01
MAIFSESNHHHNTSDGVSQRVNSPRFSGPMTRRAHSFKRNNSSNNSNNTATTTSHGGGGGSGGVEIELQINSPRSEEASEGVPVGKHSHHHVTQRVHVRGLLKKPLASIVEDLGLRERKKIGHWMFLVFCGVCLFMGVLKICATGWLGSAIEITQSNKELSDSIPSLTLMDKSSLGYAYRGGASDVERTLKTVATGVDGSHTAMTEDSGIWSKPNSDNFTKCIDLPKLDAKTNGYIFVNANGGLNQMRFGVRLCSFLMICDMVAVAKIVKATLVLPSLDHTSYWADDSGFKDLFDWKHFINMLKDDVHIVEKLPPAYAGIEPFPKTPISWSK

SEQ ID NO: 201256 - protein, 812 aa, Glycine max
  Coding DNA Sequence Number=SeqID_84478
  Gene Ontology: Mol. function=RNA-directed DNA polymerase activity; Cellular component=chromatin; Biological process=chromatin assembly or disassembly
  Pfam annotation: Domain name=Chromo; Domain location=728-779; Score =34.1; E_value=4.9e-07; Accession=PF00385.14; Description='chromo' (CHRromatin Organisation MOdifier
  Pfam annotation: Domain name=rve; Domain location=500-614; Score= -9.4; E_value=0.036; Accession=PF00665.16; Description=Integrase core domain
  Pfam module annotation: Pfam domain module=Chromo::rve; Domain location=728-779::500-614
MKGYPLADCTVSPALQHVLHEAATQNSSLCSLQTQELPTDVALLNVIDQFPGVFQARMGLPPRRDHDHGITLLPHTKAVSVHPYRYAYHHKDKIEKQVHQLLEEGVIRHSISPFSSPVILATEVDKYPIPTIHKLLDELHGSTIFTKIDLTSGFHQIRMKEEDVHKTKFRAHDGHYEYLVMPLPPFNLPCVSSIFAQKCNFGLTSIDYLGHVISSHGIQMDPSKVHAVLKWPIPQTTKPVRGFLGLTGYYRWFICDYAFEQLKKCLASFSVLALPDFTKEFIIECDAFGRGIGSVLMQEGKPIAYFSKALSPTNVSKSVYEKEIMALALSIQKWQHYLLGRSFTIFTDHTSLCHLLQQRLTTPDQQCWLSKLMGYQFEVWYKSGPDNKAADEVQKINRSRIWGHFCQPLLDRFSNYSRRGSVDYLTLTALQTDPNSKPDYMAREGWLFFKGKLLLLASSSLIPTLLKDFHDTPAGGHSGMKRAIMEYIRGYDICQKNKYQAMLPTGLLQPIPIPEVDRLSKYAHFMALKHPFMTRFVAESFVREIAKLHGFPKSIISNRDPLFLSKFWHELFHLQGMVLRMSTSYHPQMDNQTEFWYNTSSNASTGMTPFEVVYGRKPPSLLCLLVGETQVESVANILLDRDEALRQLKFHLHPAQQSMKRYVDAHRRPLAFAVVIAKVGEVAYKLQLPATARVHPVFHVSLLKRSIKPGVVAAGLPPGLEVADVDPLEPEAILASREGKSKALEWLILWKSRPVEDASWESAPSIRARFPSFGLEDKANFPGSGIDRNLVKPFRLYYSRRPKRPNETLHAS

SEQ ID NO: 201257 - protein, 189 aa, Glycine max
  Coding DNA Sequence Number=SeqID_84479
  Gene Ontology: Mol. function=protein binding; Cellular component =cytoplasm; Biological process=ubiquitin cycle
  Homolog annotation: Hit_ID=Q9C597; Match level="QueryCoverage=86%, HitCoverage=30%, E-value=2e-34, Identity=46%"; Hit description=DNA excision repair protein
MKELIFKDCRKLTDASIKVIAEHCPGLCALDLMNLDKLTDLSLGYLTNSCQALRTLKLCRNLFSDEAIAAFLEITGESLKELSLNNIKKVGHHTTISLARHAKNLHTLDLSWCRNLTDNELGFIVDSCFSLRLLKLFGCSLVTDVFLNGHSNPEIQILGLKMSPLLQNVKVPEPYQGPLRYSPVSVDLV

SEQ ID NO: 201258 - protein, 895 aa, Glycine max
  Coding DNA Sequence Number=SeqID_84480
  Gene Ontology: Mol. function=protein binding; Cellular component =cytoplasm; Biological process=ubiquitin cycle
  Homolog annotation: Hit_ID=Q338L7; Match level="QueryCoverage=99%, HitCoverage=94%, E-value=0.0, Identity=52%"; Hit description=F-box family protein, putative, expressed
  Pfam annotation: Domain name=F-box; Domain location=98-145; Score =31.1; E_value=4e-06; Accession=PF00646.23; Description=F-box domain
  Pfam annotation: Domain name=FBA_2; Domain location=394-444; Score =4.7; E_value=0.049; Accession=PF07735.7; Description=F-box associated
  Pfam annotation: Domain name=LRR_1; Domain location=188-210; Score =0.3; E_value=2.5e+02; Accession=PF00560.23; Description=Leucine Rich Repeat
  Pfam annotation: Domain name=LRR_1; Domain location=236-257; Score =1.0; E_value=1.9e+02; Accession=PF00560.23; Description=Leucine Rich Repeat
  Pfam annotation: Domain name=LRR_1; Domain location=276-300; Score =2.6; E_value=93; Accession=PF00560.23; Description=Leucine Rich Repeat
  Pfam annotation: Domain name=LRR_1; Domain location=302-325; Score =4.2; E_value=47; Accession=PF00560.23; Description=Leucine Rich Repeat
  Pfam annotation: Domain name=LRR_1; Domain location=328-353; Score =6.3; E_value=19; Accession=PF00560.23; Description=Leucine Rich Repeat
  Pfam annotation: Domain name=LRR_1; Domain location=374-396; Score =9.3; E_value=5.1; Accession=PF00560.23; Description=Leucine Rich Repeat
  Pfam annotation: Domain name=LRR_1; Domain location=416-441; Score =2.6; E_value=92; Accession=PF00560.23; Description=Leucine Rich Repeat
  Pfam annotation: Domain name=LRR_1; Domain location=448-470; Score =3.1; E_value=74; Accession=PF00560.23; Description=Leucine Rich Repeat
  Pfam annotation: Domain name=LRR_1; Domain location=486-505; Score =0.1; E_value=2.7e+02; Accession=PF00560.23; Description=Leucine Rich Repeat
  Pfam annotation: Domain name=LRR_1; Domain location=507-529; Score =9.0; E_value=5.9; Accession=PF00560.23; Description=Leucine Rich Repeat
  Pfam annotation: Domain name=LRR_1; Domain location=549-571; Score =2.2; E_value=1.1e+02; Accession=PF00560.23; Description=Leucine Rich Repeat
  Pfam annotation: Domain name=LRR_1; Domain location=642-663; Score =10.7; E_value=2.8; Accession=PF00560.23; Description=Leucine Rich Repeat
  Pfam annotation: Domain name=LRR_1; Domain location=665-697; Score =3.1; E_value=74; Accession=PF00560.23; Description=Leucine Rich Repeat
  Pfam annotation: Domain name=LRR_1; Domain location=718-741; Score =1.0; E_value=1.8e+02; Accession=PF00560.23; Description=Leucine Rich Repeat
  Pfam annotation: Domain name=LRR_1; Domain location=816-833; Score =3.2; E_value=73; Accession=PF00560.23; Description=Leucine Rich Repeat
  Pfam annotation: Domain name=LRR_1; Domain location=837-860; Score =5.4; E_value=28; Accession=PF00560.23; Description=Leucine Rich Repeat
  Pfam annotation: Domain name=LRR_1; Domain location=862-885; Score =8.8; E_value=6.5; Accession=PF00560.23; Description=Leucine Rich Repeat
  Pfam module annotation: Pfam domain module=F-box::FBA_2::LRR_1::LRR _1::LRR_1::LRR_1::LRR_1::LRR_1::LRR_1::LRR_1::LRR_1::LRR_1::LRR _1::LRR_1::LRR_1::LRR_1::LRR_1::LRR_1::LRR_1; Domain location=98 -145::394-444::188-210::...
  Pfam module annotation: Domain location=236-257::276-300::302 -325::328-353::374-396::416-441::448-470::486-505::507-529::549 -571::642-663::665-697::718-741::816-833::837-860::862-885
MERNRRRSDGESSSVSAEDTRRKRARVYFDFDGPHCIVKCSNAGKSSASVDEFVDYDNFQRSSLRSNDDDALRSMSAGEESNFDEGDDSDISKVDDLEVKMDLTDDLLHMVFSFLDHPNLCKAARVCKQWWTASAHEVFWKSLNFEDRSISVEQFEDICRRYPNIMAIRMSGPACNQLVMKAISSLRNLEALTLGRAHIMDNFFHALADCSMLKRLTINDAILGSGIQEISVNHDRLCHLQLTKCRVMRIAVRCPQLETMSLKRSNMAQTALNCPLLQELDIGSCHKLPDSAIRSAVTSCSQLVSLDMSNCSSVSDETLREISMNCANLSFLDASYCPNLFLETVRLPMLTVLKLHSCDGITAASMAAISHSYMLEVLELDNCSLLTSVSLDLPRLQNIRLVHCRKFADLNLMTLTLSSILVSNCPVLHRINITSNSLQKLTIPKQDSLTTLALQCQSLQEVDLSECESLNNSVCNVFNDGGGCPMLKSLVLGNCESLTSVQFISTSLISLSLGGCRAITNLELTCPNLEKVILDGCDHLERASFCPVGLLSLNLGICPKLNTLSIEAPFMVSLELKGCGVLSEAFINCPLLASLDASFCSQLTDGCLSATTVSCPLIESLILMSCSSIGSEGLRSLYCLPNLTVLDLSYTFLVNMQPVFDSCLQLKVLKLQACKYLTETSLEPLYKGGALPALQELDLSYGTLCQSAIDELLACCTNLTHVSLNGCVNMHDLNWGSSRGQSDNFPAVNTPSWASSNEIISESSEHSARLLQNLYCVGCPNIRKVVIPLRENCFHLLFLNLSLSANLKVVDVTCLNLCFLNLSNCSSLEILKLECPKLTSLFLQSCNIDDEAVEAAISKCTMLETLDVRFCPKISSISMGRLRTICSSLKRIFSS

SEQ ID NO: 201259 - protein, 198 aa, Glycine max
  Coding DNA Sequence Number=SeqID_84481
MEIRVCPKMESVPNPNNGEEPTSWDELYNINLMPSELFLKFRKELQGIRVGLNMEFYNAPVNEYQAKLVLKPLTPEWKWKIIYEPLHQDVRVLSKKIPITKFLNLQVGVGHNFQMHATGWKWKLTTCLGGDGISRIRNKTSIGLFPGFDLRFGWRADYVLPEITGALGTDEPMFNMHSGRLQASLDRVEAILTHTDAP

SEQ ID NO: 201260 - protein, 306 aa, Glycine max
  Coding DNA Sequence Number=SeqID_84482
GSKIGATLWQELFTKLRDKLHCGSSYLIQNLRIVDNQSEYRVSQVPLLVYFLKTTSVKEIQRPEIASNIDLITPFADIISGVAPCHTLVDIVGVVADLIDVKTVNPPHRMTDYAIQLHDAIDKNLLLQEPFVVMLTLGKIKDAIGQCGVDKYPLNVQNVKFGSRLYVNTDIAKIQQFRQSLCVPFYCGGITHDKGGSQSQSSQSNLVEKFLHNARVVSIGEINNLRQDCYCLTVGTVEEIIIDAPWSYDSCPNCTTTFDSSKGGSACCSCQNSVTDTVPRNFLFWDATCIKLFGKTAAECRDELIA

SEQ ID NO: 201261 - protein, 305 aa, Glycine max
  Coding DNA Sequence Number=SeqID_84483
  Homolog annotation: Hit_ID=Q1RYY9; Match level="QueryCoverage=87%, HitCoverage=97%, E-value=3e-31, Identity=29%"; Hit description =Immunoglobulin/major histocompatibility complex
MDFGSSFFVTQEKFNLFHRMDRELYKILVVSLFRDPAESMQVHAMWLWLERVGFRNVVKRVLALPNILINDVADETVMCLNCINSNNNNLKMSSLFSSESSEIPLLQSLVDKEISLQFVYENRSSALQGVAKVMQEVCVRAFTDIMQQAMIRNSNDRAIRQSSSSENNNHNHGPVWFGSIGPANLRGEEVPADDRTLFVTFSKGYRVEEWEVREFFAMAYGDCMEALFMQEVQPNEQALFARIVFRNVSTIDMILRGANKAKFTINGKHVWARKFVPKRNATRSLLATSFNNFPGESSSSSSSSR

SEQ ID NO: 201262 - protein, 79 aa, Glycine max
  Coding DNA Sequence Number=SeqID_84484
MTLKNSLAIYSHQFQEDRMKGGQLRSSTTYSEKNVKKYARTKKTCMSQKPIVSGTCPDVQAQNQLQTVFGHHHRKQKTS

SEQ ID NO: 201263 - protein, 298 aa, Glycine max
  Coding DNA Sequence Number=SeqID_84485
  Gene Ontology: Mol. function=cytokinin dehydrogenase activity; Cellular component=vacuole; Biological process=electron transport
  Homolog annotation: Hit_ID=Q9FUJ1; Match level="QueryCoverage=95%, HitCoverage=55%, E-value=1e-111, Identity=67%"; Hit description =Cytokinin dehydrogenase 7
  Pfam annotation: Domain name=Cytokin-bind; Domain location=107-297; Score=161.0; E_value=3.1e-45; Accession=PF09265.1; Description =Cytokinin dehydrogenase 1, FAD and cyto
YVDVSGGALWEDVLKRCVSEFGLAPRSWTDYLSLTVGGTLSYAGVSGQTFRYGPQTSNVTELEVVTGKGDTLCCSQTENSELFFGALGGLGQFGIITRARVVLQEAPDMVRWIRVVYSEFEEYARDAESLVEEYCFDYVEGFVLVNSDNRANGWPTVPLGPEQVFDPTHIPFTAGPVLYCLELALHYRNADHPSRVDTDVDGLLGRLRFIQGLKFQVDVTYMEFLLRVKRVEEHAKGNGTWDAPHPWLNLFVSKSHIVDFDREVFKKILKDGVDGPILVYPLLRNKYVLGSLPTLHQL

SEQ ID NO: 201264 - protein, 515 aa, Glycine max
  Coding DNA Sequence Number=SeqID_84486
  Gene Ontology: Mol. function=calcium ion binding; Cellular component =mitochondrion; Biological process=protein amino acid phosphorylation
  Homolog annotation: Hit_ID=Q84NV9; Match level="QueryCoverage=81%, HitCoverage=65%, E-value=2e-53, Identity=29%"; Hit description =Putative CRP1 protein
  Pfam annotation: Domain name=PPR; Domain location=115-149; Score=5.0; E_value=1.9; Accession=PF01535.11; Description=PPR repeat
  Pfam annotation: Domain name=PPR; Domain location=150-184; Score =21.5; E_value=0.0031; Accession=PF01535.11; Description=PPR repeat
  Pfam annotation: Domain name=PPR; Domain location=185-219; Score =48.1; E_value=2.9e-11; Accession=PF01535.11; Description=PPR repeat
  Pfam annotation: Domain name=PPR; Domain location=220-254; Score =22.3; E_value=0.0017; Accession=PF01535.11; Description=PPR repeat
  Pfam annotation: Domain name=PPR; Domain location=256-290; Score =53.9; E_value=5.3e-13; Accession=PF01535.11; Description=PPR repeat
  Pfam annotation: Domain name=PPR; Domain location=291-325; Score =33.8; E_value=6e-07; Accession=PF01535.11; Description=PPR repeat
  Pfam annotation: Domain name=PPR; Domain location=326-360; Score =36.7; E_value=8e-08; Accession=PF01535.11; Description=PPR repeat
  Pfam annotation: Domain name=PPR; Domain location=361-395; Score =31.7; E_value=2.6e-06; Accession=PF01535.11; Description=PPR repeat
  Pfam annotation: Domain name=PPR; Domain location=396-429; Score =35.4; E_value=1.9e-07; Accession=PF01535.11; Description=PPR repeat
  Pfam annotation: Domain name=PPR; Domain location=430-464; Score =38.1; E_value=3.1e-08; Accession=PF01535.11; Description=PPR repeat
  Pfam annotation: Domain name=PPR; Domain location=80-114; Score=35.2; E_value=2.2e-07; Accession=PF01535.11; Description=PPR repeat
  Pfam module annotation: Pfam domain module=PPR::PPR::PPR::PPR::PPR::PP R::PPR::PPR::PPR::PPR::PPR; Domain location=115-149::150-184::185 -219::220-254::256-290::291-325::326-360::361-395::396-429::430 -464::80-114
MTFSFFTAIRASHYRTLTQATASDKGLIITTPDSWFLGYFREHLTPSHVLEVVKRFNNPNLGFKFFRFTRERLSMSHSFWTYNMLLRSLCQAGLHNSAKLLYDSMRSDGQLPDSRLLGFLVSSFALADRFDVSKELLAEAQCSGVQVDVIVYNNFLNILIKHNRLDDAICLFRELMRSHSCLDAFTFNILIRGLCTAGDVDEAFELLGDMGSFGCSPDIVTYNILLHGLCRIDQVDRARDLLEEVCLKCEFAPNVVSYTTVISGYCRLSKMDEASSLFYEMVRSGTKPNVFTFSALVDGFVKAGDMASALGMHKKILFHGCAPNVITLTSLINGYCRAGWVNHGLDLWREMNARNIPANLYTYSVLISALCKSNRLQEARNLLRILKQSDIVPLAFVYNPVIDGYCKSGNIDEANAIVAEMEEKCKPDKLTFTILIIGHCMKGRTPEAIGIFYKMLASGCTPDDITIRTLSSCLLKSGMPGEAARIKETLFENQESILKKSYHESMNADKKIPVH

SEQ ID NO: 201265 - protein, 92 aa, Glycine max
  Coding DNA Sequence Number=SeqID_84487
MNVIASGDWEICSSIVFWIGSFAKHYSKKEGVETRIIITERAGWTKSVSYLCFPLISDERYLAPFVAQYVKSRDVPKIKRKQAYAIRENSVM

SEQ ID NO: 201266 - protein, 433 aa, Glycine max
  Coding DNA Sequence Number=SeqID_84488
  Gene Ontology: Mol. function=cysteine-type endopeptidase activity; Cellular component=vacuole; Biological process=proteolysis
  Homolog annotation: Hit_ID=Q1KK73; Match level="QueryCoverage=87%, HitCoverage=96%, E-value=1e-142, Identity=66%"; Hit description =Cysteine protease
  Pfam annotation: Domain name=Inhibitor_I29; Domain location=54-110; Score=91.5; E_value=2.5e-24; Accession=PF08246.2; Description =Cathepsin propeptide inhibitor domain (
  Pfam annotation: Domain name=Peptidase_C1; Domain location=136-388; Score=339.5; E_value=5.7e-99; Accession=PF00112.13; Description =Papain family cysteine protease
  Pfam module annotation: Pfam domain module=Inhibitor_I29::Peptidase _C1; Domain location=54-110::136-388
MARLSLLIFAFCAVAVAVAVAGSSFDDANPIRLASDLESQVLDVIGQSRHALSFARFARRHGKRYRSVDEIRNRFRIFSDNLKLIRSTNRRSLTYTLGVNHFADWTWEEFTRHKLGAPQNCSATLKGNHRLTDAVLPDEKDWRKEGIVSQVKDQGNCGSCWTFRLLFEAEKLFGMTLVMCSTTGALEAAYAQAFGKNISLSEQQLVDCAGAFNNFGCNGGLPSQAFEYIKYNGGLDTEEAYPYTGKDGVCKFTAKNVAVRVIDSINITLLTLGRHGRIRSFVLQLLLYVGAEDELKQAVAFVRPVSVAFEVAKDFRFYNNGVYTSTICGSTPMDVNHAVLAVGYGVEDGVPYWIIKNSWGSNWGDNGYFKMELGKNMCERCGARYARVTAPCTSCFVSSILKGETLYCDKNLQYMLMFICKISLELGCSFSLS

SEQ ID NO: 201267 - protein, 128 aa, Glycine max
  Coding DNA Sequence Number=SeqID_84489
MATTKALEREIKRARKEEWGQNKFRGALRDSNSELKLRRAKRDQSRVEGMILEDKLKACQRSKRSLFESLSRMEQNMWAIIDQYKEKLNLAATYEQRLEDEYEKVSVLQAESESRERVIDSLHREAMM

SEQ ID NO: 201268 - protein, 178 aa, Glycine max
  Coding DNA Sequence Number=SeqID_84490
  Gene Ontology: Mol. function=chitin binding; Cellular component =extracellular region; Biological process=chitin metabolic process
  Homolog annotation: Hit_ID=UPI000044A8F0; Match level="QueryCoverage =86%, HitCoverage=99%, E-value=1e-14, Identity=29%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
MCSPLDGYTPPPSQGLMPSPSGDYIGLHGLAFRGLHALTLNGLQVLAFRGLHTLAVRGVHALALRGLHVLTFSGLTFLTFRGQHALTLKGLHALAFRGLHTLTFRGLHVLTFRGQHALTLKACTPSPSEGYTPSPSEDNSSFPSKDYTSSPSEDYTSPPSEGYMSSHSEGYTSSPSQG

SEQ ID NO: 201269 - protein, 43 aa, Glycine max
  Coding DNA Sequence Number=SeqID_84491
MALNRKQWFLLLPMVIAPRNLIRLAMPKLMEADVQFAVFTGRV

SEQ ID NO: 201270 - protein, 158 aa, Glycine max
  Coding DNA Sequence Number=SeqID_84492
  Gene Ontology: Mol. function=RNA-directed DNA polymerase activity; Cellular component=chromatin; Biological process=chromatin assembly or disassembly
  Homolog annotation: Hit_ID=Q1T2D5; Match level="QueryCoverage=98%, HitCoverage=10%, E-value=4e-49, Identity=60%"; Hit description=Chromo
  Pfam annotation: Domain name=RnaseH; Domain location=14-135; Score= -29.9; E_value=0.035; Accession=PF00075.14; Description=RNase H
AITKAPVLALPDFSKAFTLETDASGIGIRAVLSQEQHPIAFFTKKFTPRMQRQSAYIRESYAIIEAVAKFRHYLHGHRFVIKTDQRSLKSLTEQAIQTPEQQKWLHKLLGYDFSIENKLDNENLVADSLSRSFFMAWSEPKLKLIQLLKEAIQADSQL

SEQ ID NO: 201271 - protein, 923 aa, Glycine max
  Coding DNA Sequence Number=SeqID_84493
  Gene Ontology: Mol. function=hydrolase activity, acting on acid anhydrides, catalyzing transmembrane movement of substances; Cellular component=integral to membrane; Biological process =metabolic process
  Homolog annotation: Hit_ID=P22180; Match level="QueryCoverage=99%, HitCoverage=96%, E-value=0.0, Identity=81%"; Hit description=Plasma membrane ATPase 1
  Pfam annotation: Domain name=Cation_ATPase_N; Domain location=10-90; Score=108.8; E_value=1.6e-29; Accession=PF00690.16; Description =Cation transporterATPase, N-terminus
  Pfam annotation: Domain name=E1-E2_ATPase; Domain location=102-323; Score=308.1; E_value=1.6e-89; Accession=PF00122.10; Description=E1 -E2 ATPase
  Pfam annotation: Domain name=Hydrolase; Domain location=327-613; Score=74.2; E_value=4.1e-19; Accession=PF00702.16; Description =haloacid dehalogenase-like hydrolase
  Pfam module annotation: Pfam domain module=Cation_ATPase_N::E1-E2 _ATPase::Hydrolase; Domain location=10-90::102-323::327-613
MGDKSQVLEAVLKETVDLENIPIEEVLENLRCGREGLSSEAAEERLTIFGHNKLEEKKESKFLKFLGFMWNPLSWVMEAAAIMAIALANGGGKAPDWQDFVGIITLLLINSTISFIEENNAGNAAAALMARLAPKAKVLRDGRWNEQDAAILVPGDIISIKLGDIIPADARLLEGDPLKIDQSALTGESLPVTKGPGDGVYSGSTCKQGEIEAVVIATGVHTFFGKAAHLVDTTNQVGHFQKVLTAIGNFCICSIALGMVVEIIVMYPIQDRPYRPGIDNLLVLLIGGIPIAMPTVLSVTMAIGSHRLSQQGAITKRMTAIEEMAGMDVLCSDKTGTLTLNKLTVDKNLVEVFAKGVDPDTVILMAARASRLENQDAIDTAIVGMLADPKEARAGIQEVHFLPFNPTDKRTALTYLDQDGKMHRVSKGAPEQILNLAHNKADIERRVHSVIDKFAERGLRSLAVAYQEVPDGRKESAGGPWQFIGLLSLFDPPRHDSAETIRRALNLGVNVKMITGDQLAIGKETGRRLGMGTNMYPSSALLGQDKDESIVALPIDELIEKADGFAGVFPEHKYEIVKRLQARKHICGMTGDGVNDAPALKKADIGIAVADATDAARSASDIVLTEPGLSVIISAVLTSRAIFQRMKNYTIYAVSITIRIVLGFMLLALIWKFDFPPFMVLIIAILNDGTIMTISKDRVKPSPLPDSWKLAEIFTTGVVLGSYLAMMTVIFFWAAYKTNFFPRVFGVPSLEKTAHDDYRKLASAIYLQVSTISQALIFVTRSRGWSYVERPGLLLVFAFVVAQLIATLIAVYANWSFAAIEGIGWGWAGVIWLYNIIFYIPLDIVKFLIRYALSGRAWDLVIEQRIAFTRQKDFGKEQRELQWAHAQRTLHGLQPADTKFNERTHVSELNQMAEEAKRRAEIA

SEQ ID NO: 201272 - protein, 93 aa, Glycine max
  Coding DNA Sequence Number=SeqID_84494
MAMSEREHFSGQEVNLISPKTLKFVDKERSWTGWRLQNNSLTPTILIDSKVFTKGTKAANSVVSAIAKGLFDCKLDTAHRAVVYRDRFTLKFI

SEQ ID NO: 201273 - protein, 455 aa, Glycine max
  Coding DNA Sequence Number=SeqID_84495
  Gene Ontology: Mol. function=identical protein binding; Cellular component=cytoplasm; Biological process=negative regulation of enzyme activity
  Homolog annotation: Hit_ID=Q9ZUF6; Match level="QueryCoverage=89%, HitCoverage=53%, E-value=1e-155, Identity=65%"; Hit description =Subtilisin-like serine protease, putative
  Pfam annotation: Domain name=PA; Domain location=33-131; Score=101.5; E_value=2.5e-27; Accession=PF02225.12; Description=PA domain
  Pfam annotation: Domain name=Peptidase_S8; Domain location=56-259; Score=-85.4; E_value=0.033; Accession=PF00082.12; Description =Subtilase family
  Pfam module annotation: Pfam domain module=PA::Peptidase_S8; Domain location=33-131::56-259
MTVGAGTLDRDFPAYATLGNGKRFAGVSLYSGEGMGDEQVGLVYFSDRSNSSGSICMPGSLDAESVRGKVVICDRGLNSRVEKGAVVRDAGGVGMILANTAASGEGLVADSHLVAAVAVGESAGDEIREYASLDPNPTAVLSFGGTVLNVRPSPVVAAFSSRGPNGVTAQILKPDVIGPGVNILAGWSGAVGPSGTEDSRKTNFNIMSGTSMSCPHISGLAALLKAAHPDWSPSAIKSALMTTAYTNDNTESPIRDAKGEETISTPWAYGAGHVNPQKALSPGLVYEASTQDYIAFLCSLNYTLDHLRLVVKDPDANCSKKFADPAELNYPSFSLVFGSNKLLRYTRTLTNVGEPGSVYDLVLSVPSTVHVTVNPRRLQFRQLGESQTYTVTFLSNRTLNDSVTSDFGVQLKVVACSTAVHTTRGHFKVNTSSELLITSYFEGSYSKRSLAMNGY

SEQ ID NO: 201274 - protein, 270 aa, Glycine max
  Coding DNA Sequence Number=SeqID_84496
  Subcellular localization annotation: CTP_CleavageSite=39; ConfidenceScore=5.14e-01
MATTPTTVRSSSVPSLPPPSPKSPPEYPDLYGKRRETARVHMLEREITFLENQEEPPVMSLLEVALVPLVYPVTVSVFIPTLFVKRYDKKEIKYQSQAKNFFSTHAPFSFEYFLEKRKRLMTNERDPFCEHYGLALRNNTLELCLIIKIMACYLVILFSASNKHVGVLLNDAFSQQWLACPVLTSLGSAVVAAVKVAVAVVFHPSNAAPYQSGAVVALAPNQIAVKRVVVLEIVVLSHVVAILGVQLVHLAPLAAVANAPALALAQAVRR

SEQ ID NO: 201275 - protein, 504 aa, Glycine max
  Coding DNA Sequence Number=SeqID_84497
  Gene Ontology: Mol. function=transporter activity; Cellular component= membrane; Biological process=oligopeptide transport
  Homolog annotation: Hit_ID=Q9FRU2; Match level="QueryCoverage=95%, HitCoverage=84%, E-value=0.0, Identity=73%"; Hit description=Nitrate transporter NRT1-5
  Pfam annotation: Domain name=MFS_1; Domain location=50-485; Score= -28.1; E_value=0.0061; Accession=PF07690.6; Description=Major Facilitator Superfamily
  Pfam annotation: Domain name=PTR2; Domain location=102-504; Score =228.9; E_value=1.1e-65; Accession=PF00854.12; Description=POT family
  Pfam module annotation: Pfam domain module=MFS_1::PTR2; Domain location=50-485::102-504
MTKRETSENDEEESLLKNENSGTDDDSKINYRGWKVMPFIIGNEIFEKLGAIGTLSNLLVYLTTVFNLENIMATNIINIFNGSTNFATLLGAFLSDAFFGRYKILAFCTMASFVGLFAIQLTAAVEKLHPPHCEESTICQGPTEGQMTFLKTGLGLLMVGAAGIRPCNLAFGADQFNPNTDSGKKGIASFFNWYFFTFTVAQMISLTIIVYIQSNVSWAVGLGIPSALMFVSSIIFFMGSKLYVKVKPSGSPITSIVQVIVVATKKRRLKLPEYQYPSLFNYVAPKSVNSKLPYTYQFRFLDKAAIMTPQDQINPNGSATDPWNLCSMQQVEEVKCLLRVLPIWVSGILYFVVIVQQHTILVFQALLSDRRIGQSGFLIPGASYYVFLMISVAIWLPVYDRKVVPLLQKLTRKEGGITLLQRMGIGIFFSILSMLVSARVEQHRRTLALINPLGVETRKGAISSMSGLWLIPQLSLAGLAEAFMSVAQVEFYYKQFPENMRSIA

SEQ ID NO: 201276 - protein, 492 aa, Glycine max
  Coding DNA Sequence Number=SeqID_84498
  Gene Ontology: Mol. function=transporter activity; Cellular component= membrane; Biological process=oligopeptide transport
  Homolog annotation: Hit_ID=Q9FRU5; Match level="QueryCoverage=99%, HitCoverage=81%, E-value=0.0, Identity=87%"; Hit description=Nitrate transporter NRT1-2
  Pfam annotation: Domain name=PTR2; Domain location=4-402; Score =231.6; E_value=1.7e-66; Accession=PF00854.12; Description=POT family
MKGLLVIQLTAWIKKMHPPHCGRDSITCIGPTTGQMGFLLAGFGLLIVGAAGIRPCNLAFGVDQFNPNTESGKKGINSFFNWYFFTFTFAQMVSLSLIVYIQSNVSWAIGLGIPAALMLVSCTLYYMGSNYYVKVKATGPAPLTSIAQAIVVAVKKRRLNLSEYPLDSLFTYISPQSINSKLPHTSQFRLLDKAAIITPQDGINPDGSASDPWSLCSMQQVEELKCLLRVIPIWVAGIIFYVAIVQQNTMLVFQALQSDRRVLNTNFKIPAASYTIFQMLSLTIWLPIYDRILVPSLQRVTKKEGGITVLQRMGFGMFLSILCTMVSGVVEERRRTLALTNPIGVEPRKGAISSMSGLWLVPQLTLAGLSDAFTIVGQVEFFYKQFPENMKSLAGSLFFCGLAGSSYLSSLLISIINRVTAKSLTGNWLPQDLNQGRLDYFYYMITAIEVVNFGYFILCAKWYRYKGTGPSRSGDLELDQVSKPYERTVNSV

SEQ ID NO: 201277 - protein, 143 aa, Glycine max
  Coding DNA Sequence Number=SeqID_84499
  Gene Ontology: Mol. function=transporter activity; Cellular component= membrane; Biological process=oligopeptide transport
  Homolog annotation: Hit_ID=Q9FRU5; Match level="QueryCoverage=73%, HitCoverage=18%, E-value=2e-48, Identity=86%"; Hit description =Nitrate transporter NRT1-2
MAMKCAKLFVNYRSQKAKVATRIFTRNLIGKRMTGVEAMEKNEKSVTDEEPKINYRGWKVMPFIIGNETFEKLGTIGTLANLLVYLTTVFNLSSLAATNIVNIFNGSASLSTLLGAFLCDTYFGRYKTLGFSTMASFLVSISF

SEQ ID NO: 201278 - protein, 91 aa, Glycine max
  Coding DNA Sequence Number=SeqID_84500
  Subcellular localization annotation: CTP_CleavageSite=22; ConfidenceScore=5.05e-01
MVTRTFRQPGANKLVDAKRLTSSSTAFAIQGQRVGWQADHSRLSSTEGNKFDDIRFLLSSSGNIQAQRSSAMAKGSVVVAQLWYFQDTEVC

SEQ ID NO: 201279 - protein, 410 aa, Glycine max
  Coding DNA Sequence Number=SeqID_84501
  Gene Ontology: Mol. function=protein serine/threonine kinase activity; Cellular component=integral to membrane; Biological process=protein amino acid phosphorylation
  Homolog annotation: Hit_ID=Q9FM23; Match level="QueryCoverage=80%, HitCoverage=62%, E-value=1e-140, Identity=70%"; Hit description =Receptor-like protein kinase
  Pfam annotation: Domain name=LRRNT_2; Domain location=25-65; Score =41.1; E_value=3.8e-09; Accession=PF08263.3; Description=Leucine rich repeat N-terminal domain
  Pfam annotation: Domain name=LRR_1; Domain location=119-141; Score =14.2; E_value=0.47; Accession=PF00560.23; Description=Leucine Rich Repeat
  Pfam annotation: Domain name=LRR_1; Domain location=143-164; Score =10.2; E_value=3.5; Accession=PF00560.23; Description=Leucine Rich Repeat
  Pfam annotation: Domain name=LRR_1; Domain location=71-93; Score=2.6; E_value=92; Accession=PF00560.23; Description=Leucine Rich Repeat
  Pfam annotation: Domain name=LRR_1; Domain location=95-117; Score =9.4; E_value=5; Accession=PF00560.23; Description=Leucine Rich Repeat
  Pfam annotation: Domain name=Pkinase_Tyr; Domain location=284-410; Score=-144.6; E_value=0.0013; Accession=PF07714.7; Description =Protein tyrosine kinase
  Pfam module annotation: Pfam domain module=LRRNT_2::LRR_1::LRR_1::LRR_ 1::LRR_1::Pkinase_Tyr; Domain location=25-65::119-141::143-164::71 -93::95-117::284-410
MEMGTVAWIFLVIMVTFFCPSSLALTQDGMALLEIKSTLNDTKNVLSNWQEFDESPCAWTGISCHPGDEQRVRSINLPYMQLGGIISPSIGKLSRLQRLALHQNSLHGTIPNELTNCTELRALDLSSNSLKGAIPSSIGRLSHLQIMNLSTNFFSGEIPDIGVLSTFDKSSFIGNVDLCGRQVQKPCRTSFGFPVVLPHAESPTKRPSHYMKGVLIGAMAILGLVLVIILSFLWTRLLSKKERAAKRYTEVKKQVDPKASTKLITFHGDLPYTSSEIIEKLESLDEENLVGSGGFGTVYRMVMNDCGTFAVKQIDRSCEGSDQVFERELEILGSIKHINLVNLRGYCRLPSSRLLIYDYVALGSLDDLLHALLYVYSQASKFCHLSAQVFQTPAAGYTETEPCKWQELIK

SEQ ID NO: 201280 - protein, 196 aa, Glycine max
  Coding DNA Sequence Number=SeqID_84502
  Homolog annotation: Hit_ID=Q1S2G8; Match level="QueryCoverage=81%, HitCoverage=30%, E-value=5e-12, Identity=30%"; Hit description =Cyclin-like F-box; FBD
MADTISCLADAVLCNILSLSQPKNAMHFAELLCGCPNLEDLNAENLGCIYDEHGDEFYDDMEGIQARFKTLPKLVRAHIHKPDAVVPLEVVNNVEFMSIDWIRCVYLQYYMPEFHNLTHIEFGYLDLERASERLKLLKKDLGLHANEGADWSYPQSIPTCVSLHLKTCRLTNYVGSKAYQALQLTLVRTACLTLGY

SEQ ID NO: 201281 - protein, 597 aa, Glycine max
  Coding DNA Sequence Number=SeqID_84503
  Gene Ontology: Mol. function=transporter activity; Cellular component= membrane; Biological process=oligopeptide transport
  Homolog annotation: Hit_ID=Q5N7W6; Match level="QueryCoverage=88%, HitCoverage=89%, E-value=1e-120, Identity=40%"; Hit description =Putative nitrate transporter NRT1-5
  Pfam annotation: Domain name=MFS_1; Domain location=49-529; Score =11.6; E_value=9.3e-05; Accession=PF07690.6; Description=Major Facilitator Superfamily
  Pfam annotation: Domain name=PTR2; Domain location=111-513; Score =235.5; E_value=1.1e-67; Accession=PF00854.12; Description=POT family
  Pfam module annotation: Pfam domain module=MFS_1::PTR2; Domain location=49-529::111-513
MENVMNTDSHCALELEHERTPAPPSASSASSASSASSREAGGWRSIKYIIGNESFEKLASMSLISNLTVYLVTNYNLSGIFVVNVVQIWNGSSNIFSIIGAFISDSYLGRFRTLLYGCFSSLLGILTITLTAGIHQLRPHTCQDKERPHCQLPQAWQLAVLFAGLGLLSIGAGGIRPCNIAFGADQFDTNTEKGREQLESFFNWWYFTFTIALVIALTAVVYIQTNISWTLGFAIPTACLGFSITIFLLGRHTYICKKPQGSIFTDMAKVIAAAFRKRNIQASGRAIYNPTPASTLEKDRIVQTDRFEFLDKAAIIADPSELNEQGMARNVWRLCSLQQVEHFKCLLGILPVWVAGICCFIVMDQQNTFGVLQVVQTKRSIGPHFKVPPGWMNLTSMIALSIWIYIYERVYIPLVRKITKKPPRLSMRQRIRIGILLSILCMLVAAIVEKKRRDSALKHGLFISPLSFALLMPQFALSGLNEAFASVAIMEFFTLQMPESMRTVAGALFYLSLSVANYIGSLIVNIVHKATSQRGKTAWIGGHDLNMNRLDYYYYFISALGVLNFIYFNIFAIRYIISDEENGITDVQPENSIAVGE

SEQ ID NO: 201282 - protein, 150 aa, Glycine max
  Coding DNA Sequence Number=SeqID_84504
  Homolog annotation: Hit_ID=Q1SQL2; Match level="QueryCoverage=47%, HitCoverage=54%, E-value=4e-20, Identity=58%"; Hit description=4Fe -4S ferredoxin, iron-sulfur binding
  Pfam annotation: Domain name=DUF1677; Domain location=21-139; Score =159.8; E_value=6.8e-45; Accession=PF07911.4; Description=Protein of unknown function (DUF1677)
MAISGSETQSPLVKSVSQVEVECVKCDLCGFTEECTPAYITRVRQRYQGRWLCGLCVEAVKHEVVRSDSVITTEEALDRHISFCREFRSSTVTNNKTEHPIFAMGRVLRRSLDSPRPLRSNSSGALPSVDGLQQVGKAWSIETLCVFFCD

SEQ ID NO: 201283 - protein, 57 aa, Glycine max
  Coding DNA Sequence Number=SeqID_84505
MIREQPALVSFNMPVGIKLKAKRPLVHVVGPITATLIISKAKRVLLAKPLAVNLSNG

SEQ ID NO: 201284 - protein, 52 aa, Glycine max
  Coding DNA Sequence Number=SeqID_84506
MYSGARRLLAMQRQREVIIFFWWNREVNMVYSERYIATNGAEMGVAFGGSRE

SEQ ID NO: 201285 - protein, 112 aa, Glycine max
  Coding DNA Sequence Number=SeqID_84507
MKLDRRNKIEIKEREALGPTHTTNQATILEDAFNAEMPIKLPPIPPPKPRNLTITQQEQDPGVTKIIITEAKMRTEKGTKFRKEADKGITNKNANVNLSKSKKTSPPNKSKV

SEQ ID NO: 201286 - protein, 530 aa, Glycine max
  Coding DNA Sequence Number=SeqID_84508
  Gene Ontology: Cellular component=cell surface
  Homolog annotation: Hit_ID=Q1RTL8; Match level="QueryCoverage=87%, HitCoverage=64%, E-value=1e-179, Identity=69%"; Hit description=IMP dehydrogenase/GMP reductase
  Pfam annotation: Domain name=VWA; Domain location=326-487; Score =60.5; E_value=5.6e-15; Accession=PF00092.18; Description=von Willebrand factor type A domain
  Subcellular localization annotation: CTP_CleavageSite=46; ConfidenceScore=5.06e-01
MAQDFSKAVDDGLKLSKRIYFGKDRAVAPPKPPPPMTRSATAFLPSAPMVYAVISDPGIVDNPDIPSYQPHVYGRCDPPALIPLQMNAIQMEADCYHETAFITVSGTWRLHCVMGSRSCDCRIAVPVSHQGSILGVEVSVSRKSYSTQLVVMEDDNGNQNASPPQNGGFLIPDIFTLTIPQIDGGSNLSIKVRWSQKIVFSKGQFSLNVPFTFPDFVNPAGKKISKREKIQINVDAVTGGELLCKTLSHPLKEVRRHVGSMGFLYDSDVLSWSKVDFSFSYAVSSSHITGGVLLESASVHDFDQREMFYMYLSTGDIQSDKVFKKDIIFIIDISGSMRGKLIEDTKNALLTALSKLNQADSFNIIAFNGETYLFSKTMELASGDAVERATEWINTNFVAGGGTNISHPLNTAIEMLSNIQSSVPIIFLVTDGTVEDERQICAMVKNRMINGESICPRIYTFGIGSFCNHYFLRMLAMIGRGQYDAALDVGEVIIQKKSVARLKHMLNELEPLHRQLVGTKNEMGVIVNQD

SEQ ID NO: 201287 - protein, 382 aa, Glycine max
  Coding DNA Sequence Number=SeqID_84509
MLTENTPLLEDPPSPIERHVKWKMARTKRYGQITSKVAQEISENYKFMDSLQEQMTQGSFVPHGRDDILNTAIGRPEHPGCVRVAGSGVMINQYYGRASRGSSSSSISITRQQLADIIGSLKEKWRNEIIGNLKEEVRHETEEENKQSLEKLKQELKDDIKVEFSKMGSQYSPFLEESHISPKKLHEPVQRANNVSKHDPLRQLIKSLYDIYEKPVELMWDATKFGIPNVDASFFLTYSDCMDFLSLSQYTMQRTDMLNVNSTYKHRSRNLNERAHWQLLVLCPRNNVVACAMKTLKTAVDGKNGEETPKWIEVKSHVQSKGYECGYYMMHWMWNIVKGDLKNDWSMWFADGTSLDMETITTICKKWTAYFVKVQNIRCRKP

SEQ ID NO: 201288 - protein, 129 aa, Glycine max
  Coding DNA Sequence Number=SeqID_84510
  Subcellular localization annotation: CTP_CleavageSite=75; ConfidenceScore=5.14e-01
MTYMQFVMIMMKVYGRTFLHNNVVLMIMGTLPRSPTHSDGNSEATPKKTRQSTRLRGLTLRSLDQPRPCNFVEMLTSTKWRHFMQAKFDIPKASKVKKKVMSMVATRWRQFKSSLTTKFVYVDTDGRDK

SEQ ID NO: 201289 - protein, 359 aa, Glycine max
  Coding DNA Sequence Number=SeqID_84511
  Gene Ontology: Mol. function=polygalacturonase activity; Cellular component=cellulose and pectin-containing cell wall; Biological process=carbohydrate metabolic process
  Homolog annotation: Hit_ID=Q1SGW6; Match level="QueryCoverage=99%, HitCoverage=70%, E-value=0.0, Identity=87%"; Hit description =Glycoside hydrolase, family 28
  Pfam annotation: Domain name=Glyco_hydro_28; Domain location=5-331; Score=24.8; E_value=2.1e-10; Accession=PF00295.8; Description =Glycosyl hydrolases family 28
MPPLPSYGYGREHPGPRYGSLIHGQHLKDVVITGHNGTINGQGQSWWKKYRQKRLNHTRGPLVQIMFSSDIVITNITLRDSPFWTIHPYDCKNITIKGVTILAPVFGAPNTDGIDPGNLCEVPDFWEMCFKSVDSCEDMLIEDCYISVGDDAIAVKSGWDQYGIDYGRPSMNIMIRNLVVRSMVSAGISIGSEMSGGVSNVTVENLLIWDSRRGVRIKTAPGRGAYVRQITYRNITFENVRVGIVMKTDYNEHPDDGYDPLALPILRDISFTTVHGQGVRVPVRIHGSEEIPVRNVTFKDMSVGLTYKKKHIFQCAFVQGRVIGTIYPAPCENLDRYNEQGQLVKHSASQNVTDIDYDF

SEQ ID NO: 201290 - protein, 609 aa, Glycine max
  Coding DNA Sequence Number=SeqID_84512
  Gene Ontology: Mol. function=protein-tyrosine kinase activity; Cellular component=integral to membrane; Biological process=protein amino acid phosphorylation
  Homolog annotation: Hit_ID=Q1SGW7; Match level="QueryCoverage=95%, HitCoverage=96%, E-value=0.0, Identity=70%"; Hit description=Protein kinase
  Pfam annotation: Domain name=LRRNT_2; Domain location=24-64; Score =39.3; E_value=1.4e-08; Accession=PF08263.3; Description=Leucine rich repeat N-terminal domain
  Pfam annotation: Domain name=LRR_1; Domain location=115-138; Score =13.6; E_value=0.73; Accession=PF00560.23; Description=Leucine Rich Repeat
  Pfam annotation: Domain name=LRR_1; Domain location=140-162; Score =16.8; E_value=0.077; Accession=PF00560.23; Description=Leucine Rich Repeat
  Pfam annotation: Domain name=LRR_1; Domain location=164-182; Score =6.9; E_value=15; Accession=PF00560.23; Description=Leucine Rich Repeat
  Pfam annotation: Domain name=LRR_1; Domain location=185-207; Score =12.2; E_value=1.5; Accession=PF00560.23; Description=Leucine Rich Repeat
  Pfam annotation: Domain name=LRR_1; Domain location=92-113; Score =10.8; E_value=2.8; Accession=PF00560.23; Description=Leucine Rich Repeat
  Pfam annotation: Domain name=Pkinase; Domain location=337-604; Score =0.6; E_value=1.3e-08; Accession=PF00069.15; Description=Protein kinase domain
  Pfam annotation: Domain name=Pkinase_Tyr; Domain location=337-604; Score=-39.8; E_value=5e-10; Accession=PF07714.7; Description=Protein tyrosine kinase
  Pfam module annotation: Pfam domain module=LRRNT_2::LRR_1::LRR_1::LRR_ 1::LRR_1::LRR_1::Pkinase::Pkinase_Tyr; Domain location=24-64::115 -138::140-162::164-182::185-207::92-113::337-604::337-604
  Subcellular localization annotation: CTP_CleavageSite=69; ConfidenceScore=5.20e-01
MAAVRLLLFHLLLLLLLFPFSSFSLSENEALLNLKKSFSNPVALSSWVPNQSPCSSRWLGVICFNNIVSSLHLADLSLSGTIDVDALTQIPTLRSISFINNSFSGPIPPFNKLGALKALYLARNHFSGQIPSDFFSQLASLKKIWISDNNFSGPIPSSLTNLRFLTELHLENNQFSGPVPELKQGIKSLDMSNNKLQGEIPAAMSRFDANSFSNNEGLCGKPLIKECEAGSSEGSGWGMKMVIILIAAVALAMIFVLMRSKRRRDDDFSVMSRDHVDEVVQVHVPSSNHSRASERGSKKEFTSSKKGSSRGGMGDLVMVNDEKGVFGLPDLMKAAAEVLGNGGLGSAYKAAMNNGLSVVVKRMREMNKVSRDIFDAEMRRFGRLRNPNIITPLAYHYRKEEKLFVTEYMPKGSLLYVLHGDRGSSHADLNWPMRLNIVKGIARGLGFIYSEFPNEVLPHGNLKSSNVLLTENYEPLLSDFAFHPLINPNYAIQTMFAYKTPDYVSYQHVSQKTDVYCLGIIVLEIITGKFPSQYHSNGKGGTDVVHWVFTAISERREAELIDPELMSNHSNSLNQMLQLLQVGAACTESNPDQRLNMKEAIRRIEEVQV

SEQ ID NO: 201291 - protein, 116 aa, Glycine max
  Coding DNA Sequence Number=SeqID_84513
  Gene Ontology: Mol. function=transition metal ion binding; Cellular component=cytoplasm; Biological process=fucose metabolic process
MQSGSQSEPFDVEMGDRLEDMIATLDKSPSSKHMPLCMETRYGWSDKSFTSLLEVVHNLLPEDNTLPNSYYKAKKILCPMGMEYQKIHACPNDCILYRNESKKCQNALSVGLHGTK

SEQ ID NO: 201292 - protein, 315 aa, Glycine max
  Coding DNA Sequence Number=SeqID_84514
  Gene Ontology: Mol. function=hydrolase activity
  Homolog annotation: Hit_ID=Q2KTW6; Match level="QueryCoverage=63%, HitCoverage=71%, E-value=3e-52, Identity=50%"; Hit description=CAMP phosphodiesterase
MHVAPQQYPHLRPARQQLEQRLGIVDHHRVVPVVVDLHRVVVHGQQCVAPGRLGQRGLQQIQLAVGQVAGVRARHGGVQRDHTPCADVGHRRRPFGQFLAQRGWQVVVAGQATDAGAVQRRGGAEHGGQASIGGGLAVLGQIAGGQQQVGAFAVGLDLPQHGAQAGVGIDAKHHGFRLAEKMAIRQLDQHGGRVIAPCQGVDAYQVRLLRSFCTAPTLPKKHARARIARAGQGNETCGRTICSPESTGKPAILVKLLTSFTIGTRRYPWICPIRCCWRSSAACWASSCTSMAGRRAGSATSWIRWNASRFPPRLS

SEQ ID NO: 201293 - protein, 642 aa, Glycine max
  Coding DNA Sequence Number=SeqID_84515
  Homolog annotation: Hit_ID=Q337J6; Match level="QueryCoverage=87%, HitCoverage=52%, E-value=7e-83, Identity=34%"; Hit description=FF domain containing protein, expressed
  Pfam annotation: Domain name=WW; Domain location=381-410; Score=36.5; E_value=9e-08; Accession=PF00397.16; Description=WW domain
  Pfam annotation: Domain name=WW; Domain location=433-462; Score=33.5; E_value=7.3e-07; Accession=PF00397.16; Description=WW domain
  Pfam module annotation: Pfam domain module=WW::WW; Domain location =381-410::433-462
  Subcellular localization annotation: CTP_CleavageSite=67; ConfidenceScore=5.31e-01
MASPAWLPQESQPPVSGETPLPMASSAHTTPSTGKPTAPLRFLYDFNSSNVIPTESVKVTAHAKLFNATAFVAPAPAPPFAYGMLQNVNASGSSQQSSTHPGMKSNSAVNPMVVQPPGVSLHAAPSFSYNIPQSGAIFSSNQQHAQSSTNMPDSVAQDVGKLSSASSIPHSVPAHTSTSIMPPPSDPNYRPATSWMPTAMSFPVLPVMPTQGNPGPPGLASSAIISSNPAAPSTGTDSSPAALLRPNMPTSAIASDPTAPQKGLPYPSVPAMAAPPQGLWLQPPQMSGVLRPPYLQYPAPFPGPFPFPARGVALPAVPIPDSQPPGVTPVGAAGGTSTPSSSHQLRGTTALQTEVISGPADDKKKLNSVDTVNEDAANNDQLDAWTAHKTEAGIIYYYNAVTGESTYDKPAGFKGESHQVSAQPIPVSMMDLPGTDWRLVSTSDGKKYYYNNRTKTSCWQIPNEVAELKKKQDGDVTKDHLMSVSNTNVLSDRGSGMVTLNAPAINTGGRDAAALKPSSLQNSPSALDLIKKKLQDSGTPVASSSIPAPSVQTGPESNGSKTVDSTAKGLQVDNNKDKAKDTNGDANVSDTSSDSEDEDNGPSKEECIIQFKEMLKERGVAPFSKWEKELPKIVFDPRFKVL

SEQ ID NO: 201294 - protein, 311 aa, Glycine max
  Coding DNA Sequence Number=SeqID_84516
  Homolog annotation: Hit_ID=Q9LT28; Match level="QueryCoverage=83%, HitCoverage=84%, E-value=6e-27, Identity=53%"; Hit description =Genomic DNA, chromosome 3, P1 clone: MPN9
  Subcellular localization annotation: CTP_CleavageSite=46; ConfidenceScore=5.05e-01
MANAGNLISPRNFNPIIFNPYHYATKLKTLRLLSRFHSYNNNATVTASKRKDDLQSPLIGKNTSRAPRRLITISPGDGKYHGDWTCDYRVSLHDLELQDLIEDDNNSRKDAQVFINLSIQKSVEHGNASMLALVYRWMEESPHPSLENVAPVLLRIADSWVFVRLRKLSFGPLCLEFKIAWSRRYKDLMVESDSKAALALDTEWLRQAFHACFQLIDAKFNVWVLIARRDDRKIPLPDIGGDPNVIYVRPGYEVDLDSLVQDAIRLNSVVKDTCSELCEKSEGTIQYITGQGQASVDKRWSRLLELKKENL

SEQ ID NO: 201295 - protein, 69 aa, Glycine max
  Coding DNA Sequence Number=SeqID_84517
MMKNSWGLCTNREAMWVKLVRAKHLKVLPEMEIGKGDTVSFSNGIVLGKLIYKATCNVPAEHIDRKVSE

SEQ ID NO: 201296 - protein, 277 aa, Glycine max
  Coding DNA Sequence Number=SeqID_84518
  Gene Ontology: Biological process=cell redox homeostasis
  Homolog annotation: Hit_ID=Q1T1K3; Match level="QueryCoverage=93%, HitCoverage=23%, E-value=1e-107, Identity=72%"; Hit description =Thioredoxin domain 2
  Pfam annotation: Domain name=DUF179; Domain location=131-277; Score= -21.5; E_value=6.5e-07; Accession=PF02622.6; Description =Uncharacterized ACR, COG1678
MAEFWPSSMFRHPPLITLREVYPALILFPAEKKQPLLYEGDMAVIDVMKFVAEHGSNFHQLIRDKVLWVSEGAVKNQNLHDTLQTDIHPESLHSRNKYHGAPGPDRMLDQVVRPNLMNSPASNELHEASPHVVIGSVLIATEKLLGVHPFDGSKILIVAANQVTGFQGLILNKHIQWSFLPKLEEGLENLKEAPLSLGGPVMKTGMPLLSLTRTVSGNNLPEIIPGIYFLDQVTTIRKIEELKSANQPVGDYWFFLGYSSWGWNQLYDEMAEGAWNL

SEQ ID NO: 201297 - protein, 68 aa, Glycine max
  Coding DNA Sequence Number=SeqID_84519
MPHCMLASLYILVVPNSTTFVCYSGAVEQLTAAPKRCIALHLTVVAVTPLFMAKIAEFCDRCSCNSQV

SEQ ID NO: 201298 - protein, 667 aa, Glycine max
  Coding DNA Sequence Number=SeqID_84520
  Gene Ontology: Biological process=cell redox homeostasis
  Homolog annotation: Hit_ID=Q1T1K3; Match level="QueryCoverage=100%, HitCoverage=60%, E-value=0.0, Identity=66%"; Hit description =Thioredoxin domain 2
MLMHRNTEKLLADSIGATATPDETTLFYFHYSVSYKYRGRLRARNILSSLYPYISLAPEEVPLAALNTPLDFRLFVDSTERALVLVDFCGWTPKLLASDNNGTQNAFSVLGNHHGMGFSRGNNRMPVSKGKTNKKVAEEDTCKAELGVDKGFCEVPWLGEFTSLNYGPLEGSKDRNHHVLHSCSSEEFERFHSFYLKFMTVVREYFLPPEKNRFGLVSSRSMLSSLGVGDYGPWFAVHYLAGCSSCSNILKDEDDLKYVLQMNNYFVKELEGNGHDQEPVLPANKPSVLLFVDRSSDSSETRGKSKEALKAFRVLAQHYHRVNQTGNKNNNSHDKFSIRDYHGFKSTSEHPRLKLSRPAQKIKLKEKISSIMIMNEGKQVSLDNIPLDLQGSSLNDILAYLLQQKKDGKLSSLAKDLGFQLLSDDIDVRLANTQQSHSEVQSNQFPTETSQKGHTDIVMLDGDTYRSAGELEENPKSTELSSRKDEVKRPSIVTHEEIKSVETEESIADHELSTAKFMLPETDDSSGGNKDEGEQAHFLGFNGFFFYSDGNYQLLERLTGGRGIPSLVIVDPFWQQHYVYPDEKSFNFSSLCDFLSEFLNGTLLPYQQSEHVLQGQREATHPPFVNLDFHEVDSIPRIMAHTFSELVIGFNLSNKENTSNSWNKDVL

SEQ ID NO: 201299 - protein, 253 aa, Glycine max
  Coding DNA Sequence Number=SeqID_84521
  Gene Ontology: Mol. function=nucleic acid binding; Cellular component= lysosome; Biological process=regulation of transcription from RNA polymerase II promoter
  Homolog annotation: Hit_ID=Q1SGW2; Match level="QueryCoverage=99%, HitCoverage=60%, E-value=6e-89, Identity=67%"; Hit description=RNA -binding region RNP-1
  Pfam annotation: Domain name=RRM_1; Domain location=96-163; Score =25.0; E_value=0.00027; Accession=PF00076.12; Description=RNA recognition motif. (a.k.a. RRM, R
DARVMWDQKTGRSRGFGMFWFCDSIYQDAQSAINDLTGKWLGSRQIRCNWATKGASASDEKQTSDSRSVVELTNGSSEDGQETTNDDTPEKNPQYTTVYAVKLQVTSVDLHQHFHSLNAGTIEDVRVQRDKGFGFVRYSTHAEAALAIQMGNARILFGKPIKCSWGSKPTPPGTASTPLPPPTSANVSGFSLASLAAYERQMALSKMGGAHALMHQQGQHALKQVAMGMGAPGAGYDARFQNVATTQHLMYYQ

SEQ ID NO: 201300 - protein, 53 aa, Glycine max
  Coding DNA Sequence Number=SeqID_84522
MNPVPELIPSNLSLIHHLESGRERAWKNQNKKLFIAMAGGQPSEIMNISQLIG

SEQ ID NO: 201301 - protein, 605 aa, Glycine max
  Coding DNA Sequence Number=SeqID_84523
  Gene Ontology: Mol. function=aminoacyl-tRNA ligase activity; Biological process=alanyl-tRNA aminoacylation
  Homolog annotation: Hit_ID=P36428; Match level="QueryCoverage=46%, HitCoverage=28%, E-value=1e-147, Identity=85%"; Hit description =Alanyl-tRNA synthetase, mitochondrial precursor
  Pfam annotation: Domain name=RRM_1; Domain location=318-389; Score =4.2; E_value=0.059; Accession=PF00076.12; Description=RNA recognition motif. (a.k.a. RRM, R
  Pfam annotation: Domain name=tRNA-synt_2c; Domain location=64-538; Score=383.5; E_value=3.3e-112; Accession=PF01411.9; Description=tRNA synthetases class II (A)
  Pfam module annotation: Pfam domain module=RRM_1::tRNA-synt_2c; Domain location=318-389::64-538
  Subcellular localization annotation: CTP_CleavageSite=45; ConfidenceScore=5.59e-01
MKIGFGVRALLISSRNSNPLSSPPLLSLFSPFSAVRSLHSPPPFSAAEAMPETETHDVEWPAKRVRDTFISFFQDKNHVNWKSSPVVPFNDPTLLFANAGMNQFKPIFLGTADPNTALSKLSRACNTQKCIRAGGKHNDLDDVGKDTYHHTFFEMLGNWSFGDYFKVEAISWAWELLTKVYKLPSDRIYATYFGGDDKSGLAPDLEARDIWLKFLPPGRVLPFDCKDNFWEMGDTGPCGPCTEIHFDRIGNRDAASLVNNDDPTCIEIWNLVFIQFNREADGSLKPLPAKHVDTGMGFERLTSILQDKMSNYDTDVFLPIFDVIQRDVTEKNLWYHFKKWDDVRKIFISKQRNKNGRRYGFDRFKGGKDVHNLERQLDQIVIGGLKLYINIPKYGREMARKVAAQPKPMGYEEKHENTTAWWRQPQARMSSTSYATVVARNMCSSGQRKVTYNEPHSPVASLSLVHLDIPLNDKKWFSEAWVGRLKNLALFDRVEDDLLWDFGADITSKYMGDDMVLLPSLTDAKVEQMMQEEMDGEDSLFHSLEKWNSSLRIGHRLTWVQCWGIPLLAWDMTYIQKIVAAIGDMVEVDDDVKEVRRVDRARVLI

SEQ ID NO: 201302 - protein, 768 aa, Glycine max
  Coding DNA Sequence Number=SeqID_84524
  Gene Ontology: Mol. function=hydrolase activity, acting on glycosyl bonds; Cellular component=beta-galactosidase complex; Biological process=carbohydrate metabolic process
  Homolog annotation: Hit_ID=Q93X58; Match level="QueryCoverage=99%, HitCoverage=94%, E-value=0.0, Identity=69%"; Hit description=Beta -galactosidase
  Pfam annotation: Domain name=Gal_Lectin; Domain location=690-767; Score=144.6; E_value=2.7e-40; Accession=PF02140.8; Description =Galactose binding lectin domain
  Pfam annotation: Domain name=Glyco_hydro_35; Domain location=19-272; Score=410.9; E_value=1.9e-120; Accession=PF01301.10; Description =Glycosyl hydrolases family 35
  Pfam module annotation: Pfam domain module=Gal_Lectin::Glyco_hydro _35; Domain location=690-767::19-272
MGPNSSVQTPRSCSSFGFSNMWPDLIQKAKDGGLDVIQTYVFWNGHEPSPGKYYFEDRYDLVKFIKLVQQAGLYVHLRIGPYICAEWNFGGFPVWLKYVPGIAFRTDNEPFKIENEYGPVEWEIGAPGKAYTKWFSQMAVGLDTGVPWIMCKQQDTPDPLIDTCNGYYCENFTPNKKYKPKMWTENWTGWYTEFGGAVPRRPAEDMAFSVARFVQNGGSFVNYYMYHGGTNFDRTSSGLFIATSYDYDGPIDEYGLLNEPKWGHLRDLHKAIKLCEPALVSVDPTVTWPGNNLEVHVFKTSGACAAFLANYDTKSSASVKFGNGQYDLPPWSISILPDCKTAVFNTARLGAQSSLMKMTAVNSAFDWQSYNEEPASSNEDDSLTAYALWEQINVTRDSTDYLWYMTDVNIDANEGFIKNGQSPVLTVMSAGHVLHVLINDQLSGTVYGGLDSHKLTFSDSVKLRVGNNKISLLSIAVGLPNVGPHFETWNAGVLGPVTLKGLNEGTRDLSKQKWSYKIGLKGEALNLNTVSGSSSVEWVQGSLLAKQQPLAWYKTTFSTPAGNDPLALDMISMGKGQAWINGRSIGRHWPGYIARGNCGDCYYAGTYTDKKCRTNCGEPSQRWYHIPRSWLNPSGNYLVVFEEWGGDPTGITLVKRTTASVCADIYQGQPTLKNRQMLDSGKVVRPKAHLWCPPGKNISQIKFASYGLPQGTCGNFREGSCHAHKSYDAPQKNCIGKQSCLVTVAPEVFGGDPCPGIAKKLSLEALCG

SEQ ID NO: 201303 - protein, 520 aa, Glycine max
  Coding DNA Sequence Number=SeqID_84525
  Gene Ontology: Mol. function=oxidoreductase activity; Cellular component=nucleus; Biological process=electron transport
  Homolog annotation: Hit_ID=Q84XG2; Match level="QueryCoverage=99%, HitCoverage=99%, E-value=1e-163, Identity=56%"; Hit description =Putative polyamine oxidase
  Pfam annotation: Domain name=Amino_oxidase; Domain location=15-514; Score=233.1; E_value=6e-67; Accession=PF01593.14; Description=Flavin containing amine oxidoreductase
  Pfam annotation: Domain name=DAO; Domain location=7-390; Score=-52.9; E_value=0.019; Accession=PF01266.14; Description=FAD dependent oxidoreductase
  Pfam module annotation: Pfam domain module=Amino_oxidase::DAO; Domain location=15-514::7-390
MVVKKPQIVIIGAGMAGLTAANKLHSVSASKDLFEVCVVEGGNRIGGRINTSEFGGDRIEMGATWIHGIGGSPIHKIAQQIHALESEQHWECMDGNENKATTIAEGGFLVNPSLVDPITKLFNNLMDHAQGKIPTTTTTTTRTGLDAYCGSSKEEEELKGFGKWSKKLLDEAIFAVHENTQRTYTSAADLFNLDYAAESEYQMFPGEEITIAKGYLSIIESLASVLPPGLVQLGRKVTRIEWQPERHEAMNLENGRPCSSRPVMLHFCDGSIMSADHVIVTVSLGVLKASIRDDDSGMLMFNPPLPSFKAEAISRLGFGVVNKLFMQLSEPPHEHSKGFPFLQMVFHSPQSELRHKKIPWWMRRTATLCPIYNNSSVLLSWFAGEEALALESLKDEEIIEGVSDTISCFLSNSLEFCNGNVNSEKYSHEYKVKFSKVLKSKWGTDPLFLGSYSHVAVGSSGDDLDTMAEPLPKCLTCASPPLQILFAGEATHRTHYSTTHGAYFSGLREANRLLQHYSLC

SEQ ID NO: 201304 - protein, 224 aa, Glycine max
  Coding DNA Sequence Number=SeqID_84526
  Gene Ontology: Mol. function=two-component response regulator activity; Cellular component=membrane; Biological process=two -component signal transduction system (phosphorelay)
  Homolog annotation: Hit_ID=P80668; Match level="QueryCoverage=43%, HitCoverage=19%, E-value=1e-49, Identity=94%"; Hit description =Phenylacetaldehyde dehydrogenase
  Pfam annotation: Domain name=GGDEF; Domain location=1-124; Score =121.6; E_value=2.3e-33; Accession=PF00990.12; Description=GGDEF domain
MLDIDYFKRYNDTYGHQAGDECLTRVARVLKQSVRTPEDVVSRYGGEEFLVILFNCPEAIAEKVALRIQDGLRAEAIPHGASAVSDHVTVSMGITSMAEGLAGTEIIARADAALYRAKEAGRDRWSRFTPAVQPVRAKVASSAGLLHPAERQVGVNQRVAVYPNGARLQPVGILQRLADILRPDAGRQAIFGVVCQLERLFPVGDAHQVDHRAEHLFAGQAQPG

SEQ ID NO: 201305 - protein, 77 aa, Glycine max
  Coding DNA Sequence Number=SeqID_84527
MAVMAHPIYNMLLFRSLIRLSKPRSSAIDTEKVQKNAISLWESDHNFNIVPCSRTLPLGKNLNYLPQPPASSGSQRT

SEQ ID NO: 201306 - protein, 69 aa, Glycine max
  Coding DNA Sequence Number=SeqID_84528
MREGDVFCPQKLPPPPLIQKRDLTKLAVFAPPSHFWSHFSFILVFLLTPAILGLFMLDLLELRDCRGWP

SEQ ID NO: 201307 - protein, 75 aa, Glycine max
  Coding DNA Sequence Number=SeqID_84529
MWYHVSEKPHRAPRSTWQDKPHTRRPVRVTLFCKNAPTMWDRYRLKGALKPGVFTLKAYTLKSLSGSLPPDLGPT

SEQ ID NO: 201308 - protein, 112 aa, Glycine max
  Coding DNA Sequence Number=SeqID_84530
MGAKDSSFMNRCDHPEVRWGHPGLAMMYPVLEWVRDPRCSALLPCLQTYSMSAAPSLSLGASDGVAAGVSSGVSSASASASGYDSWAIGAWAVGALLPPKEKAGLLARPPRP

SEQ ID NO: 201309 - protein, 197 aa, Glycine max
  Coding DNA Sequence Number=SeqID_84531
  Homolog annotation: Hit_ID=Q9FS13; Match level="QueryCoverage=30%, HitCoverage=12%, E-value=1e-16, Identity=66%"; Hit description =Nucleotide pyrophosphatase-like protein
MGCYRTPEHVTCGVTYVVDNAVVGRVEPDDDGVVVGEGEGGKDRDELGLGLGVVFIKCMLGAGGLESVPESEVVGLDATFFSVPQQNHYPQTLFILLHCFPRFSAKPISRNSFTCALTHSPTHKYVYPDPVPEFAEHETQKFKFELFWKLSEEGVDEFGDDLHSVVDVCAQWDGSLWICLDKIVICLLYLRARLLGV

SEQ ID NO: 201310 - protein, 193 aa, Glycine max
  Coding DNA Sequence Number=SeqID_84532
  Homolog annotation: Hit_ID=Q9FGA2; Match level="QueryCoverage=46%, HitCoverage=55%, E-value=2e-19, Identity=56%"; Hit description =Arabidopsis thaliana genomic DNA, chromosome 5, P1 clone:MPF21
MGNCQAVDAAALVIQHPSGKIERLYWPVSASEVMRTNPGHYVSLIIPLAVPPDQGQINQAQKAVLFTRVKLLRPNETLTLGHAYRLVTTQEVVKAVKAKKHAKMRKPQVKAMEGNENRQIQTTEFHTCRAEAKIMASLFAEHLRVCKLSSARLLHWNEYLIYGQKKFSKGLNYRLLFHHQSHPQLNNHVPVTT

SEQ ID NO: 201311 - protein, 154 aa, Glycine max
  Coding DNA Sequence Number=SeqID_84533
MNCVFVHASSTHKFGAMRSDCLVQFSILIPFLEPMNCVFIHPSSTHEFGAMRSDCLVQFSILNPFPEPMNCVFVHVSSTHEFGALRSDCLVQFSIFNPFLEPMNCVFVHAFSTHEFGAMRSDCLMQFSILNIFSEPHELRFRSCVLHLRVWSHA

SEQ ID NO: 201312 - protein, 205 aa, Glycine max
  Coding DNA Sequence Number=SeqID_84534
AAGPMIRGDTLRLFAPLCHPEAADPMIRGDTLRLSAPLCHPEAAGPMIRGDTLRLSAPFCHPEAADPMTSRDKIWSFCTLVSSRGGGPDDTRRYLTVIRTLVSSRGGGPDDTRRYLTVIRTLVSSRGGGPDDKQRQNLAAGPMTSRDKIWSFCTLVSSRGGGPDDTRKYLSGYPYNILLLSVRQTLDSMQRLTSSSAPFVPPGTT

SEQ ID NO: 201313 - protein, 198 aa, Glycine max
  Coding DNA Sequence Number=SeqID_84535
  Homolog annotation: Hit_ID=UPI00005F9B4F; Match level="QueryCoverage =25%, HitCoverage=15%, E-value=2e-08, Identity=58%"; Hit description =COG0604: NADPH:quinone reductase and related Zn-dependent oxidoreductases
RSPACVGPAGHQPGPAEARKHRAADWACRGAGRLRPDHPRQGAWADCCGCECVSRSSGSTASDAVSMLRRMPTPLAYARVPIAAWTPDMPMTAFALAAALSGLPDITLERERAEDAHQLMLCQIHRDALKQNEGKEDAYPRAKAVCDLLAREYKDKWDFDAQDALAASAVDLDELIRRGDVVEALLKLARQYLDVYGM

SEQ ID NO: 201314 - protein, 58 aa, Glycine max
  Coding DNA Sequence Number=SeqID_84536
MTYKNIQGHQQLCVCGSKGSLNCKHHEPHDEGSSIKSVLYKLLVNLRSGVFMLQIDGF

SEQ ID NO: 201315 - protein, 389 aa, Glycine max
  Coding DNA Sequence Number=SeqID_84537
  Gene Ontology: Mol. function=nucleoside-triphosphatase activity; Cellular component=membrane; Biological process=defense response
  Homolog annotation: Hit_ID=Q1SI25; Match level="QueryCoverage=90%, HitCoverage=38%, E-value=1e-140, Identity=74%"; Hit description=NB -ARC domain, putative
  Pfam annotation: Domain name=NACHT; Domain location=88-242; Score= -40.8; E_value=0.087; Accession=PF05729.3; Description=NACHT domain
  Pfam annotation: Domain name=NB-ARC; Domain location=56-345; Score =138.9; E_value=1.4e-38; Accession=PF00931.13; Description=NB-ARC domain
  Pfam module annotation: Pfam domain module=NACHT::NB-ARC; Domain location=88-242::56-345
MVHLLGLLTENKRGYISCGSVLVEGTSTRLFKEHKGGNESEAIKTIVENVMRLLDKTELFIADNPVDVEPRVQEMIELIDQKQSNDVLLLGMWGMGGIGKMTIEKAIYNKIGHNFEGESFLAHIREVWEQDAGQVYLQEQLLFDIEKETNTKIRNVESGKVMLKERLRHKRVLLILDDVNKLHQLNVLCESREWFGSGSRIIITTRDMHILRGRRVDKVFRMIGMDEDESIELFSWHAFKQASPRENFIGLSRNIVAYSAGLPLALEVLGSYLFDMEVTEWKNVLEKLKKIPNDEVQEKLKISYDGLTDDTEKGIFLDIACFFIGMDRNDVIHILNGCGLCAENGIHVLVERSLVTVDYKNKLRMHDLLRDMGREIIRSKTPMELEEHS

SEQ ID NO: 201316 - protein, 66 aa, Glycine max
  Coding DNA Sequence Number=SeqID_84538
  Homolog annotation: Hit_ID=Q2R2F0; Match level="QueryCoverage=99%, HitCoverage=14%, E-value=1e-07, Identity=58%"; Hit description=AT hook motif family protein, expressed
MPITPRAILGRLPVHEVTLFKLRYGENVVEVHHNTKWTCLLVGIFATTVLAAGEKVGCLLAKYTVG

SEQ ID NO: 201317 - protein, 87 aa, Glycine max
  Coding DNA Sequence Number=SeqID_84539
MYIKYGPKYIMKHSQQNKLVVSFKTRKRKQGSKGLSKELIQGKSIWLEAYNNKIASIISKYACELGSINKNQAKAIVQAINGAKHTK

SEQ ID NO: 201318 - protein, 206 aa, Glycine max
  Coding DNA Sequence Number=SeqID_84540
  Homolog annotation: Hit_ID=Q1S6A4; Match level="QueryCoverage=82%, HitCoverage=40%, E-value=7e-07, Identity=24%"; Hit description =Peptidase C48, SUMO/Sentrin/Ubl1
MALKVAYSQLYRTRSVWCMPPAFAVDVINGSPVETLIQHYGKDWMPPFSNLNLIYITIVQNSAHWYLMVIDINDRKIYHLDCDLTSETAYERKDSIKIMANVMLSVLEIVFPTQEFVIGFDGMDCWDIVEARGIPNCGSSEKSSLWVLEWMQMEESFVSLLYGVLEEKAVRMKVAMIVLLGTHNQCKGELIRNAERNWHDCIHAKH

SEQ ID NO: 201319 - protein, 97 aa, Glycine max
  Coding DNA Sequence Number=SeqID_84541
MLFQDISSGQSEGILAIVGGKNKAHLWCPAKTIVRKTKSEYGNENERKKEAKKNGDPNRSALHLISMHEWNIAILISTNTKNTAKTIVLLWCVVVKG

SEQ ID NO: 201320 - protein, 210 aa, Glycine max
  Coding DNA Sequence Number=SeqID_84542
  Gene Ontology: Mol. function=glutamate-cysteine ligase activity; Biological process=glutathione biosynthetic process
  Homolog annotation: Hit_ID=Q8ZR41; Match level="QueryCoverage=84%, HitCoverage=53%, E-value=7e-33, Identity=35%"; Hit description =Carboxylate-amine ligase ybdK
VEFAPAVDVFQASVVGEGILRAETGAGKARIDALRMAQVHRFVPVVDAEVDVLAEHAGQLGKIAKAAGQLPVARVVADDLLAPVVAQMAAAAADVTAQALRAAPDGMGQGAQLGVQLIEIAVHRAVQLHHRFGELMFDAPAVADRADHPVGPIRKIVVLVIDQLQLYFGADGEPFRTFECERHGASFLQEQHKDKLTGVRHDVIDAAEAV

SEQ ID NO: 201321 - protein, 185 aa, Glycine max
  Coding DNA Sequence Number=SeqID_84543
MAFQIPKHQIMSSKWRLFSSVSVGRFESANAVTLTLHNYIEVPRAYHKQWAPHYPAYVQIQYNGAPHFIKVRKNGQQYYLADGLKDFRRNFNIHEGVLLLPIEAVDFVDASRPCMTVQHRSDVRDIWTISMHNGEQYVDDPWHRFLTDNDLMGGDEVVFYYRPNEHVWEIIFRKEPIWDEHDEST

SEQ ID NO: 201322 - protein, 55 aa, Glycine max
  Coding DNA Sequence Number=SeqID_84544
  Subcellular localization annotation: CTP_CleavageSite=39; ConfidenceScore=5.21e-01
MPKEELRRSDFLSKGGFSASNKNTTFHVFLRTPRYRQPSATSPATTRRHVLPAEV

SEQ ID NO: 201323 - protein, 199 aa, Glycine max
  Coding DNA Sequence Number=SeqID_84545
MHTLHWKRKDHADRAPTRGIRLYLDVLKMVLLLQSNTNLMAIVTRKILTSILFNEYYFYKATLTLGYCYGKDTRFYTLKPVSLLQNNTDLGLLLQKIYLLLHSYADITYTKQHRLGGYYYENYTDNKWQISPSGVELATMTGESGLNVGKPPVKLAGWVQARVAFSVQFAVAFCRGAGLKGSCSCHWRFECKLQLPLAI

SEQ ID NO: 201324 - protein, 127 aa, Glycine max
  Coding DNA Sequence Number=SeqID_84546
MHAGPKPPELVASLVSLSKSPAPMAIRACREETVSPNGDILSALGTASQTGEFHGRVAAGYVLPWQCSWVSAGETAITIGGLPCIGIAKKLLLPLAGCLGCAVFHCWYAISLLFILREFSVLGLVRM

SEQ ID NO: 201325 - protein, 120 aa, Glycine max
  Coding DNA Sequence Number=SeqID_84547
MAHIEPMGPKSTLRLMRTLEPSPASLTQSSWSLLSNALGGHYFKSSSVVVGVNDVDDNNGGARITKDVREGAMPRFMFDGEMNLTSGKQVLGKRGKMKGRWIEVPRKDDGEFVWNFGALA

SEQ ID NO: 201326 - protein, 234 aa, Glycine max
  Coding DNA Sequence Number=SeqID_84548
  Homolog annotation: Hit_ID=Q1RXU5; Match level="QueryCoverage=80%, HitCoverage=38%, E-value=1e-15, Identity=34%"; Hit description=UAS; UBA-like; Thioredoxin-like fold
MEGVLSANEQQSMVSSFLEVAQGQTAETARQFLQATSWKLEEALQLFLIGSEGGAVPLPVPPPPLLHTPPLENVDSWTDQQPLSEPRKDAAAASESIGLNDAEEVRPPLPVIRETLYDDAMLYGASRAGHRSHEPSSLVAFRNFEEEMRQPGVWESEQGAASTAEASRDNLASLYRPPFHLMFNGAFDKLINLNTCIYMSCILKNALHLNPFKHNKQGMKGSSVNNQNPNMAVS

SEQ ID NO: 201327 - protein, 152 aa, Glycine max
  Coding DNA Sequence Number=SeqID_84549
  Gene Ontology: Mol. function=DNA binding; Biological process=DNA integration
  Homolog annotation: Hit_ID=Q0KIN0; Match level="QueryCoverage=50%, HitCoverage=5%, E-value=2e-22, Identity=55%"; Hit description =Integrase core domain containing protein
MAQSTRLTTEMTKEVIHGHNSTTPRRKQPLSVGKFAQASCLLNGEGIYSPMRVACLGLKLHLSPGELDASLREFRRKYALDILEETGLFNAKPLGTPMDPSIKLLPNQGEPLLNPGRYRSCPNIAFAVSVVSQFLNSPCQDHWVKYIKKAPG

SEQ ID NO: 201328 - protein, 155 aa, Glycine max
  Coding DNA Sequence Number=SeqID_84550
MVNEECKEVSVSFKRLAKKESHFAIKTNIKETSLLRQPPHLLLCKRTLISIVTPIGLEVIPQVKELLDEGLVRIMRNRIPMLGDMMNVLSGATLFCKITHASNIIMIHIHKDSLGVEGRSPEFQEPMDLRSNPFQGGRNDAILPPRVLDRRLQED

SEQ ID NO: 201329 - protein, 95 aa, Glycine max
  Coding DNA Sequence Number=SeqID_84551
MVFLVSYTKAKAENVQVRNGLGHGNVAYTPDIFPKILTTKFCEDPIVNGGWAAFLPRQLMWLPQEASLRGFLKKLPRGFFEKLDPYLPTPLYKLN

SEQ ID NO: 201330 - protein, 77 aa, Glycine max
  Coding DNA Sequence Number=SeqID_84552
MSIDRDYFSLPLRQPEASERIDTQRPLWSSSPFVEDSMSIDQDYFSLPLRQLEASESVDISLYYLETIKSDGMQRQT

SEQ ID NO: 201331 - protein, 80 aa, Glycine max
  Coding DNA Sequence Number=SeqID_84553
MGEGEKMKNKKVAVAGVSLSEEYALSEQHPLSETSAHLASEENLPCMHVLSAPSDRLASHLSLLASSVPNSLSQKSLTRA

SEQ ID NO: 201332 - protein, 94 aa, Glycine max
  Coding DNA Sequence Number=SeqID_84554
MPASCRASKINLLEDDNKSLYDIGIGVNFGSFFTGGFLPALEFMPGLASPVGQGCARVEYTSEYYEGFAGIPAKQEPRGDIVKLPSIAFTTGPS

SEQ ID NO: 201333 - protein, 88 aa, Glycine max
  Coding DNA Sequence Number=SeqID_84555
  Gene Ontology: Mol. function=DNA binding; Biological process=DNA integration
  Homolog annotation: Hit_ID=Q8RUQ2; Match level="QueryCoverage=98%, HitCoverage=7%, E-value=6e-22, Identity=62%"; Hit description =Putative retroelement
QSPRQQYKRFEEFIVSHKYIISPYDSCVYHNKVEDGSHIYLLLCVDNMLIASQNVLAIQKLKSPLNSEFEMKDMGTAKKIMGIEIKKD

SEQ ID NO: 201334 - protein, 164 aa, Glycine max
  Coding DNA Sequence Number=SeqID_84556
  Gene Ontology: Mol. function=DNA binding; Biological process=DNA integration
MEDQDLEMILLASLPPSYENFLFGNGDEASTFGFLLVFDSSKRQKKNTGKDCPKKDYVVALVQNNSSSKRDLVLAIGEQLQQNFKQWVLDLGCSYHMCPYRHCFVTYEKKSSGNVHIGNDAPSLRLWELALDEVSISCAHNKGHVGLHPLCLMGAFESFITGGA

SEQ ID NO: 201335 - protein, 67 aa, Glycine max
  Coding DNA Sequence Number=SeqID_84557
MSLDLMGHDDKGAEEDGSLRVSTGLLAPDRKRVQKTTLVSACYQTLSLTDSERVFIRITTWVSPPAT

SEQ ID NO: 201336 - protein, 47 aa, Glycine max
  Coding DNA Sequence Number=SeqID_84558
MKTRSVTLHRDTLTTPSLWPTHSQKICTQGVIQSNCLIIVASIRSTS

SEQ ID NO: 201337 - protein, 106 aa, Glycine max
  Coding DNA Sequence Number=SeqID_84559
MEDAPVSLASPSRRRVGEEHKIQDYLGETTKERIQSLFYTESLRWVLRIWRQAVTARGGPWWSWVVEKISLSIILLGLGFALSIIPRVLSVTFRAEHNSLIGWNCI

SEQ ID NO: 201338 - protein, 53 aa, Glycine max
  Coding DNA Sequence Number=SeqID_84560
MDTTLLKSRMSSEASESLEVTKNVLSRLITTQNPPDVRGRFPLSIGSYPQFPT

SEQ ID NO: 201339 - protein, 60 aa, Glycine max
  Coding DNA Sequence Number=SeqID_84561
MRREHNNNRRSAPNVILSLITGTSLAMIWKVFPGYKSFMESLAKRQKCKEKVFYVTFMPL

SEQ ID NO: 201340 - protein, 174 aa, Glycine max
  Coding DNA Sequence Number=SeqID_84562
  Homolog annotation: Hit_ID=O82268; Match level="QueryCoverage=73%, HitCoverage=58%, E-value=5e-59, Identity=84%"; Hit description =Expressed protein
  Pfam annotation: Domain name=DUF640; Domain location=25-157; Score =304.0; E_value=2.8e-88; Accession=PF04852.3; Description=Protein of unknown function (DUF640)
  Subcellular localization annotation: CTP_CleavageSite=72; ConfidenceScore=5.57e-01
MDSIQEFMESCNTDITTTTATTTSNSLVGSSNSPSASSTTSSRYENQKRRDWNTFGQYLKNHRPPLSLSRCSGAHVLEFLRYLDQFGKTKVHTPICPFYGHPNPPAPCPCPLRQAWGSLDALIGRLRAAFEENGGKPETNPFGARAVRLYLREVRELQSKARGISYREEENGKA

SEQ ID NO: 201341 - protein, 127 aa, Glycine max
  Coding DNA Sequence Number=SeqID_84563
  Gene Ontology: Mol. function=nucleic acid binding; Cellular component= intracellular
  Homolog annotation: Hit_ID=Q6K653; Match level="QueryCoverage=74%, HitCoverage=22%, E-value=4e-21, Identity=53%"; Hit description =Ubiquitin-associated (UBA)/TS-N domain-containing protein-like
MALHLYISLQLNRRYKQGLPLEGQAAVRSSAIEIEQEKKSKSVYNTTAKAEQLRECLRNLKRNHQGEDARVRRAFQTILVYVGNVAKNPKEDKYRKIRLNNPLFQPKRKHVLKVLISSAKIESYQNL

SEQ ID NO: 201342 - protein, 517 aa, Glycine max
  Coding DNA Sequence Number=SeqID_84564
  Gene Ontology: Mol. function=histone-lysine N-methyltransferase activity; Cellular component=nucleus; Biological process=chromatin modification
  Homolog annotation: Hit_ID=O22781; Match level="QueryCoverage=93%, HitCoverage=77%, E-value=2e-97, Identity=47%"; Hit description =Histone-lysine N-methyltransferase, H3 lysine-9, H3 lysine-27, H4 lysine-20 and cytosine ...
  Homolog annotation: Hit description=specific SUVH2 (EC 2.1.1.43) (Histone H3-K9 methyltransferase 2) (H3-K9-HMTase 2) (H3-K27-HMTase 2) (H4-K20-HMTase 2) (Cytosine-HMTase 2) (Suppressor of variegation 3-9 homolog ...
  Homolog annotation: Hit description=protein 2) (Su(var)3-9 homolog protein 2)
  Pfam annotation: Domain name=Pre-SET; Domain location=381-479; Score =128.7; E_value=1.7e-35; Accession=PF05033.6; Description=Pre-SET motif
  Pfam annotation: Domain name=YDG_SRA; Domain location=202-354; Score =193.7; E_value=4.4e-55; Accession=PF02182.8; Description=YDGSRA domain
  Pfam module annotation: Pfam domain module=Pre-SET::YDG_SRA; Domain location=381-479::202-354
  Subcellular localization annotation: CTP_CleavageSite=15; ConfidenceScore=5.01e-01
MDSVLPDTSTNAIASSTPTSHPHSQPSLPQTLLVPKPEPFWDTHIETSDELDLYSEFNRVTELFHFAFGATNVVDPFGATNVACPEQTPLVPVPQELDSAAQPDPNSPSEDVLRAIVPVPPEQQDGAVATATVPRRKQSRQKELGRGSFARDREEDKAHIRLAASVDLRGGGEASRLSGSGGGGSSSSSDNTRGLSAGGWLHRQVAASPGRPAGCQPDERAWTVAEPAGIDFLPASMSSTGEPIATSVIVSGGYEDDMDDGEVIVYTGHGGQEKNSSRQISHQKLESGNLALERSMHYGVEVRVIRGMKYEGSAAGSGKVYVYDGVYRIVDCWFDVGRSGFGVYKFKLWRIEGQAKMGSAILKEARNVRRSELDLNPTSADMANRKENVAVRLFNDFDDDRGPLCYEYLVRTCFPKFVFHQSGKATGCDCVDGCGDGCFCAMKNGGEFPYTLQGHLVRGKPLIFECGPFCSCPPHCRNRVAQKGLKYRLEVFRSKQTSWGVRGCFDQGASSTLNNEW

SEQ ID NO: 201343 - protein, 82 aa, Glycine max
  Coding DNA Sequence Number=SeqID_84565
MASFGCVTLPSVCHRLVKGLVRNQLVWGTKTAEHENPRQRPMFSEFSTSLSCAASQPLPPMVTYTPAATSLVTLFGSDNCHL

SEQ ID NO: 201344 - protein, 179 aa, Glycine max
  Coding DNA Sequence Number=SeqID_84566
  Homolog annotation: Hit_ID=Q1S717; Match level="QueryCoverage=62%, HitCoverage=12%, E-value=8e-18, Identity=39%"; Hit description =Ovarian tumour, otubain
MNKEQLMYINIMFEEVDMNVKNKEDVDVKVEHVDCSDACKTPILVKGVVSINKSKKNDFVRTCIGSRKCGCTFKLRTKSVLGGERWMVKLICGVHNHEIAKTLVGHPYAGRLTKDEKIVVADMTKSMVKPRNILLTLKEHNVNNYTIIKQIYNVRHAYYSPIRGSNTEMQQLMMLLDGD

SEQ ID NO: 201345 - protein, 237 aa, Glycine max
  Coding DNA Sequence Number=SeqID_84567
  Gene Ontology: Mol. function=DNA binding; Cellular component =mitochondrion; Biological process=DNA integration
  Homolog annotation: Hit_ID=Q1SJY5; Match level="QueryCoverage=71%, HitCoverage=16%, E-value=3e-47, Identity=52%"; Hit description =Integrase, catalytic region
MSDAKEIKTLMHPTAHLGLDEESTKMGRSQYRAMIGSLLYHTTFRLDIMFIVCLHAKLQKEPREFHLTVVKRIFRYLLGTPNLGLMFKRRESSRLTSYCNTDYVGDKVDKKSTSGSYHFIGGNIATWICKRQRSTALSIVEAEYMSTANYCAQLLWINNQLEDYSVAFTALSSYAIVHLFPSQWTPSVQLTIVKMPPYWLALGTQQRVGPSTEVTPSQSWHSIKKLKDKKNSQGSIS

SEQ ID NO: 201346 - protein, 185 aa, Glycine max
  Coding DNA Sequence Number=SeqID_84568
  Gene Ontology: Biological process=regulation of transcription
  Homolog annotation: Hit_ID=Q70I19; Match level="QueryCoverage=53%, HitCoverage=25%, E-value=3e-26, Identity=60%"; Hit description=TCP -domain protein
  Pfam annotation: Domain name=TCP; Domain location=25-181; Score =138.8; E_value=1.5e-38; Accession=PF03634.4; Description=TCP family transcription factor
  Subcellular localization annotation: CTP_CleavageSite=61; ConfidenceScore=5.40e-01
MTSQVVLHNNFETKPSATVTTIVESPSVAPPSLAVAKRPSTKDRHTKVNGRGRRVRMPPLCAARIFQLTRELGHRSDGETIEWLLRHAETSIIAATGSGTVPAAPVSSVGPSAPSSEPMVACPVTAVGAQGMFAVPPQPSCRLDLSPPPGMEFAVNGYRHMPFTALLLQPATADENQNDESLGEQ

SEQ ID NO: 201347 - protein, 128 aa, Glycine max
  Coding DNA Sequence Number=SeqID_84569
  Gene Ontology: Mol. function=nucleic acid binding; Cellular component= cytoplasm; Biological process=regulation of transcription, DNA -dependent
  Homolog annotation: Hit_ID=UPI0000E451D4; Match level="QueryCoverage =51%, HitCoverage=46%, E-value=1e-26, Identity=89%"; Hit description =conserved hypothetical protein
  Pfam annotation: Domain name=CSD; Domain location=1-66; Score=151.3; E_value=2.5e-42; Accession=PF00313.12; Description='Cold-shock' DNA -binding domain
MTGIVKWFNADKGFGFITPDDGSKDVFVHFSAIQNDGYKSLDEGQKVSFTIESGAKGPAAGNVTSLRHQQMAPVVIQRTVKCQPVSLHSRQWVSFRPCKNASSCDTTSIAPGNVASALSIAWVDARSR

SEQ ID NO: 201348 - protein, 67 aa, Glycine max
  Coding DNA Sequence Number=SeqID_84570
  Homolog annotation: Hit_ID=Q7XXN8; Match level="QueryCoverage=54%, HitCoverage=69%, E-value=1e-13, Identity=81%"; Hit description =Hypothetical protein ROT4
MVLLPRPWLSAHANTEAWLHNGEECRISLAASSPVGCTSDQKTCRDHNFDAAAADDCFGLCCFPALP

SEQ ID NO: 201349 - protein, 154 aa, Glycine max
  Coding DNA Sequence Number=SeqID_84571
  Pfam annotation: Domain name=ubiquitin; Domain location=5-74; Score =21.1; E_value=0.0019; Accession=PF00240.13; Description=Ubiquitin family
  Pfam annotation: Domain name=ubiquitin; Domain location=85-154; Score= 8.9; E_value=0.033; Accession=PF00240.13; Description=Ubiquitin family
  Pfam module annotation: Pfam domain module=ubiquitin::ubiquitin; Domain location=5-74::85-154
MVYFKIAGGEIVPEIQMTLSATVYDLKQKIRNELDVEVHRQSLWHHNRMLRDHEYIENCDFQVRETLYLSVDPLPPHQNIHVLVKSLGSDGYVRVRETDKVSDLRNLVERYWGTPSNRVTLRRHNVVMEDCLPLYAYYVNEGSEVQLSISIEPR

SEQ ID NO: 201350 - protein, 120 aa, Glycine max
  Coding DNA Sequence Number=SeqID_84572
  Pfam annotation: Domain name=ubiquitin; Domain location=5-73; Score =16.9; E_value=0.0051; Accession=PF00240.13; Description=Ubiquitin family
MVLFKIDGGKRVPEIEMSLLDTILDLKQKIQELDVEVYRQRLWHKDRMLRDNELIHDQAFCASKTLHLTVTPLSPQHTLSVKVKFVGSDGYVEVKETDKVRDLCSKVERQWGIPSELIPL

SEQ ID NO: 201351 - protein, 91 aa, Glycine max
  Coding DNA Sequence Number=SeqID_84573
  Subcellular localization annotation: CTP_CleavageSite=56; ConfidenceScore=5.49e-01
MVLSSGVDSAASPRFVAPSPDSRERVASPTSGGHPLMNNFLREPFGCLVGSFFSLMAMAAIDDSNPFILHSSDNLGIALVSHPFIVFSAKA

SEQ ID NO: 201352 - protein, 128 aa, Glycine max
  Coding DNA Sequence Number=SeqID_84574
MDDDTWLSSQGTKLSWKCLPLNLISLPFIVAEKAKVVHSSCVLQSYWQMVMMSLQTISYWSCEDERQRWIRKKLVKIVHSLFDVPLDYFVLMLKKDICWENNEDVGEDDDVEEEGDESSMMVMMIALK

SEQ ID NO: 201353 - protein, 811 aa, Glycine max
  Coding DNA Sequence Number=SeqID_84575
  Gene Ontology: Mol. function=nucleoside-triphosphatase activity; Cellular component=nucleus; Biological process=protein transport
  Homolog annotation: Hit_ID=Q9LZF6; Match level="QueryCoverage=99%, HitCoverage=100%, E-value=0.0, Identity=86%"; Hit description=Cell division control protein 48 homolog E
  Pfam annotation: Domain name=AAA; Domain location=244-428; Score =329.5; E_value=5.9e-96; Accession=PF00004.19; Description=ATPase family associated with various cellular activities (AAA)
  Pfam annotation: Domain name=AAA; Domain location=517-704; Score =340.5; E_value=2.8e-99; Accession=PF00004.19; Description=ATPase family associated with various cellular activities (AAA)
  Pfam annotation: Domain name=AAA_2; Domain location=240-369; Score= -23.6; E_value=0.00056; Accession=PF07724.4; Description=ATPase family associated with various
  Pfam annotation: Domain name=AAA_5; Domain location=244-376; Score =11.7; E_value=0.00023; Accession=PF07728.4; Description=ATPase family associated with various
  Pfam annotation: Domain name=Arch_ATPase; Domain location=221-386; Score=-96.1; E_value=0.06; Accession=PF01637.9; Description=Archaeal ATPase
  Pfam annotation: Domain name=CDC48_2; Domain location=123-196; Score =3.7; E_value=0.099; Accession=PF02933.7; Description=Cell division protein 48 (CDC48), dom
  Pfam annotation: Domain name=CDC48_N; Domain location=27-113; Score =139.8; E_value=7.4e-39; Accession=PF02359.8; Description=Cell division protein 48 (CDC48), N-t
  Pfam annotation: Domain name=ResIII; Domain location=225-356; Score= -39.4; E_value=0.093; Accession=PF04851.6; Description=Type III restriction enzyme, res subunit
  Pfam annotation: Domain name=Sigma54_activat; Domain location=210 -372; Score=-175.0; E_value=0.0063; Accession=PF00158.16; Description= Sigma-54 interaction domain
  Pfam annotation: Domain name=Vps4_C; Domain location=721-774; Score= -13.5; E_value=0.027; Accession=PF09336.1; Description=Vps4 C terminal oligomerisation domain
  Pfam module annotation: Pfam domain module=AAA::AAA::AAA_2::AAA _5::Arch_ATPase::CDC48_2::CDC48_N::ResIII::Sigma54_activat::Vps4_C; Domain location=244-428::517-704::240-369::244-376::221-386::123 -196::27-113::225-356::210-372::721-774
MANQPESSDAKGTKRDFSTAILERKKAPNRLVVDEAVNDDNSVVVLHPDTMEKLQLFRGDTILLKGKKRKDTICIALADETCEEPKIRMNKIVRNNLRVRLGDVVSVHQCADVKYGKRVHILPVDDTIEGVTGNLFDAYLKPYFLEAYRPVRKGDMFLVRGGMRSVEFKVIETDPAEYCVVAPDTEIFCEGEPVKREDENRLDEVGYDDVGGVRKQMAQIRELVELPLRHPQLFKSIGVKPPKGILLYGPPGSGKTLIARAVANETGAFFFCINGPEIMSKLAGESESNLRKAFEEAEKNAPSIIFIDEIDSIAPKREKTHGEVERRIVSQLLTLMDGLKSRAHVIVIGATNRPNSIDPALRRFGRFDREIDIGVPDEVGRLEVLRIHTKNMKLAEDVDLERIAKDTHGYVGADLAALCTEAALQCIREKMDVIDLEDETIDAEILNSMAVTNEHFQTALGTSNPSALRETVVEVPNVSWEDIGGLENVKRELQETVQYPVEHPEKFEKFGMSPSKGVLFYGPPGCGKTLLAKAIANECQANFISVKGPELLTMWFGESEANVREIFDKARGSAPCVLFFDELDSIATQRGSSVGDAGGAADRVLNQLLTEMDGMSAKKTVFIIGATNRPDIIDPALLRPGRLDQLIYIPLPDEDSRHQIFKACLRKSPVSKDVDLRALAKYTQGFSGADITEICQRACKYAIRENIEKDIERERRKRDNPEAMEEDIEEEEVAEIKAAHFEESMKYARRSVSDADIRKYQAFAQTLQQSRGFGSDFTFANTSSGGGGAATGTASDPFASAGGADEDDLYS

SEQ ID NO: 201354 - protein, 60 aa, Glycine max
  Coding DNA Sequence Number=SeqID_84576
MVHINDWRWLKTDKDSLNFNKDRFENIFGPKHLLEARIKGNSNWTFIQSNFIIERLREVH

SEQ ID NO: 201355 - protein, 97 aa, Glycine max
  Coding DNA Sequence Number=SeqID_84577
MLSPPLPSTVTVAASMFIIVTTTTTDDDDSGGGSNDNDNDDSHDGGGGDSRGDDNNDDDDSHVGEGDDNHGDDDRWAKKETFVGVGNGLFGWREGKR

SEQ ID NO: 201356 - protein, 47 aa, Glycine max
  Coding DNA Sequence Number=SeqID_84578
MSTTKMIEVHRVKEFFLFIRIRVIGAKKVGSEAVVAGVNVTTTHVIN

SEQ ID NO: 201357 - protein, 68 aa, Glycine max
  Coding DNA Sequence Number=SeqID_84579
MTVTTSVGMTIAIVITITVMTVIVVITVAATTANNNGDNNNHGDNDVMVVATTVTKVMTAKVTSNVIT

SEQ ID NO: 201358 - protein, 195 aa, Glycine max
  Coding DNA Sequence Number=SeqID_84580
MNWLSWERLLIPKEKRGMGFRDLRGFNIALLGKKYCIRTSKALVKGAHWRVGKGTRIQGVFNERDARAIYSILVEVTSDEDMIIWSFSKDGRFTEKIMGFKGIPLKEKLDELNIVLMKLHGIDVKIEDEDLEIILLASLKKKKKNKKKKEEEEEEEEKVARKARLIQKAFNDSSSKNNLVLVKNYSNILNNGYWT

SEQ ID NO: 201359 - protein, 84 aa, Glycine max
  Coding DNA Sequence Number=SeqID_84581
MASIKIAFAVVFLALIACNGHGFKNIRRMTALGENHETDECWKTGCYHKGKPQCNVNRDCWFACPDYCDIAYCDMSTRKCVCPC

SEQ ID NO: 201360 - protein, 97 aa, Glycine max
  Coding DNA Sequence Number=SeqID_84582
LVEFSPTRGIYGRCLIRIRLNYHDESGSPISNLVPLDLEIEATSGRNKAKRRRKLLQVRTVASILEEETHFSDLLSPDSPSSRESETQLPEVITMAE

SEQ ID NO: 201361 - protein, 54 aa, Glycine max
  Coding DNA Sequence Number=SeqID_84583
MGEFWELVLRSLFVSIARIWFVKLVLASVWGAHSCSQGLILSEVIQIARCPLNA

SEQ ID NO: 201362 - protein, 40 aa, Glycine max
  Coding DNA Sequence Number=SeqID_84584
MEISQVSNAQDLGSAQEGVHFLKVSNKFFLPMQDLQQKWT

SEQ ID NO: 201363 - protein, 78 aa, Glycine max
  Coding DNA Sequence Number=SeqID_84585
  Homolog annotation: Hit_ID=Q949G7; Match level="QueryCoverage=82%, HitCoverage=7%, E-value=1e-10, Identity=54%"; Hit description=HcrVf3 protein
  Pfam annotation: Domain name=LRR_1; Domain location=27-44; Score=5.9; E_value=22; Accession=PF00560.23; Description=Leucine Rich Repeat
  Pfam annotation: Domain name=LRR_1; Domain location=3-25; Score=6.2; E_value=20; Accession=PF00560.23; Description=Leucine Rich Repeat
  Pfam annotation: Domain name=LRR_1; Domain location=52-78; Score=5.6; E_value=25; Accession=PF00560.23; Description=Leucine Rich Repeat
  Pfam module annotation: Pfam domain module=LRR_1::LRR_1::LRR_1; Domain location=27-44::3-25::52-78
MESLRNFYLSLSGFMGLIPHQLGNLSNLQHLNLGYNYALQIDNLNWISRLSSLEYLDLSGSDLHKQGPPKGKTNFTHL

SEQ ID NO: 201364 - protein, 61 aa, Glycine max
  Coding DNA Sequence Number=SeqID_84586
MEEKSEGCNHYSTDGGGVTRVVGCKKVIGSSLFIVGEIGGNDYGYPLSERKSGTSDKKRID

SEQ ID NO: 201365 - protein, 228 aa, Glycine max
  Coding DNA Sequence Number=SeqID_84587
  Homolog annotation: Hit_ID=Q6YS91; Match level="QueryCoverage=79%, HitCoverage=20%, E-value=8e-07, Identity=25%"; Hit description =Hydroxyproline-rich glycoprotein-like protein
MSILRPGRPTVPTERTEFDVPEASDLRTQKKILQTVGERWRQFKYDLTSKWALAVDKESVDDTVCEKYDISKEKWAQFCQTHKDPLWEAQAIQKKNTAPHVLSYGGYQYLENKLMDEKRKKKLEEVAQSGITDTMIDPSSPIRRHVKWKMARTKKIGQMMSEAAKEIADKIGSFAAHGRQDILTVAIWRLEHPGRMRATGAGVMIKQYFEPSPRTPHTSSSMAPKDLE

SEQ ID NO: 201366 - protein, 131 aa, Glycine max
  Coding DNA Sequence Number=SeqID_84588
MENEKGLKNVRVTLNKITKYKNLMKDPSTNFVFVSKGKNKERFGTCPLLLEHRLLAYVLTWIITLRGSNHVQLTEKYHILINLMPGQMKIDSVNVVVDNMLKTKRIEPDFEVKAKVFKKISYIEAEEEGRG

SEQ ID NO: 201367 - protein, 117 aa, Glycine max
  Coding DNA Sequence Number=SeqID_84589
  Gene Ontology: Mol. function=protein dimerization activity
MMLACRQRGKGKFVEASGRGVQATMNQLWKKDDKEKVDEQCFEFLYKSAIPFNVIRNPAFAKFCEMVGRYGVGYKSLSYHDIRDKLLKRVVDLKTLSLGHGHGTINTIVLFHNVPVS

SEQ ID NO: 201368 - protein, 149 aa, Glycine max
  Coding DNA Sequence Number=SeqID_84590
MGFIYEMPSAKEKIKCNFNNVKKSYKPIWKIIDERGLFSVEDAKDSRKAMQPREWWEMFGNGTPWLKRFVIRVLSLNYSSSRCEQEYKVELEHPQGEDDGGIDNAEFVGNVGGSSSDQTLNALDLDNLVLFEPDVDDAEECRSKYDMKF

SEQ ID NO: 201369 - protein, 368 aa, Glycine max
  Coding DNA Sequence Number=SeqID_84591
  Gene Ontology: Mol. function=1,3-beta-glucan synthase activity; Cellular component=1,3-beta-glucan synthase complex; Biological process=1,3-beta-glucan biosynthetic process
  Homolog annotation: Hit_ID=Q5Z5B8; Match level="QueryCoverage=95%, HitCoverage=20%, E-value=1e-150, Identity=77%"; Hit description =Putative callose synthase 1 catalytic subunit
MIPKSICRKFRVRFHYGHPDVFDRLFHLTRGGVTTLHYVKAMSLITSTYKWVKEGMWVLTRYQCLKQKSLLGMITVLTVYVFLYGRLYLALSGLEEGLNQKRAIRDNKALQVALASQSVVQIGFLLALPMLMEIGLERGFREALSEFVLMQLQLAPVFFTFSLGTKTHYYGRTLLHGGAEYKSTGRGFVVFHAKFADNYRLYSRSHFVKGIELMILLVVYHIFGHEYRGVLAYILITVTMWFMVGTWLFAPFLFNPSGFEWQKIVDDYTDWQKWISNRGGIGVSPEKSWESWWEKEHEHLRHSGKRGIATEIILSLRFFIYQYGLVYHLSITDKTQSVLVYGLSWMIIFVILGLMKGMLLSAHCLHMQ

SEQ ID NO: 201370 - protein, 337 aa, Glycine max
  Coding DNA Sequence Number=SeqID_84592
  Homolog annotation: Hit_ID=Q1T555; Match level="QueryCoverage=30%, HitCoverage=75%, E-value=1e-08, Identity=32%"; Hit description=RNA -binding region RNP-1
  Pfam annotation: Domain name=RRM_1; Domain location=77-147; Score =22.6; E_value=0.0012; Accession=PF00076.12; Description=RNA recognition motif. (a.k.a. RRM, R
MRESEGETERERGSGREREREGVSEWITVRNRRGGKPRREHLSDREDPRQLYRGNGLGQHANYQHQNWRNRTDITSYYFTRFPDDASEKDLWTLFKLWGDVKEVFISKQRNMRGRRYGFVRFKGVSDKNRLEKQLDSIIFGGLKMYVNLPRYGRAKAIPRNRTPDNGRQGQQQKQKGGAAVAPSSTLRNDASNRTYAEIVATNKQKEGHRRYSSSEHGGQGRSHSTVTLNIPQGPKRWYTDAWVGRLKKIDTFERAEDEITWTLGSDVTPKYLGDDMVILLGLMDMKAEELVNEEADKGTSLFYSLEKWKPEMKPGVRLVWIQCWGLPLDAWDIQYL

SEQ ID NO: 201371 - protein, 543 aa, Glycine max
  Coding DNA Sequence Number=SeqID_84593
  Gene Ontology: Mol. function=RNA-directed DNA polymerase activity; Cellular component=nucleus; Biological process=RNA-dependent DNA replication
  Homolog annotation: Hit_ID=Q1RTD3; Match level="QueryCoverage=93%, HitCoverage=79%, E-value=5e-96, Identity=36%"; Hit description=IMP dehydrogenase/GMP reductase
MQEMFIVNVYAPCDIDGKRALWDSIRQLKNPQNEGLWCVLGDFNSIRHPSERVSLSQRKGDLNSITEFNEWISDLAVEEVSCLGRKHTWIRPNGTAKSKPDRFFVSDEWVSKWPDSTQFILDRDFSDHCLILLRSKTIDWGPKPFRVLDCWLKNKQFQNMVKETWANTHPGGWGGFSLKEKLKILKQKIKLWNKDHFGDISEKIKQIQLELNHLEVSSNISLLSPDTAAARKKLQEDLWTAAQAHESLLRQKARTKWIKEGDCNSKYFHRLINYNRRVNAVKGVQIGGSWVEEPTRVKEEVRNLFQNRFNEPDYDRPEINGAYFRSIGHQQNEILVGRFHEEEIKAAVWQCGSDKSPGPDGLNFKSIKQFWELLKPDISRFLDEFHVNGVFPKGGNASFITLIPKVKHPQSLNDIRPISLIGCIYKIVAKILANRLKTVLPDLIDERQTAFLKGRHLLHGVLIANEVLEEAKRVPGKVVDKLVKIQRNFLWGGGVEQRRIAWVKWGTVCLPKERGVEMGDVPSEWTAVDQNLELKVWGMEKFR

SEQ ID NO: 201372 - protein, 247 aa, Glycine max
  Coding DNA Sequence Number=SeqID_84594
  Gene Ontology: Mol. function=1,3-beta-glucan synthase activity; Cellular component=1,3-beta-glucan synthase complex; Biological process=1,3-beta-glucan biosynthetic process
  Homolog annotation: Hit_ID=Q9AUE0; Match level="QueryCoverage=98%, HitCoverage=12%, E-value=1e-107, Identity=79%"; Hit description =Callose synthase 1 catalytic subunit
MMYIRQALELQAFLDMAKDEELMKGYKAAELESKESTTGERSLWTQCQSLADMKFTYVVSCQQYSIHKRSGDPRAKEILKLMIKYPSLRVAYIDEVEEHSKGSSRKTDKVYYSALVKAALPAKSNDSSEAVQSLDQVIYKIKLPGPAILGEGKPENQNHAIIFTRGEGLQTIDMNQDNYMEEAFKMRNLLQEFLKQHDGPRMPTILGLREHIFTGSVSSLAWFMSNQEHSFVTIGQRLLAYPLKILT

SEQ ID NO: 201373 - protein, 249 aa, Glycine max
  Coding DNA Sequence Number=SeqID_84595
  Gene Ontology: Mol. function=1,3-beta-glucan synthase activity; Cellular component=1,3-beta-glucan synthase complex; Biological process=1,3-beta-glucan biosynthetic process
  Homolog annotation: Hit_ID=Q9AUE0; Match level="QueryCoverage=99%, HitCoverage=12%, E-value=6e-92, Identity=66%"; Hit description =Callose synthase 1 catalytic subunit
MDLMLVPYSADRSLNLIQWPPFLLASKIPIAVSMAEDSLGKGQELEKRLSRDKYMKSAVEECYASFKSIINFLVLGERETMVIQNIFQRVDVHIENKAVLNELNLSAVPSLYERFVKLIERLLENKEEDKDSIVILLLDMLEIVTRDIMDGDIEGLLDSSHGGSYGKDERFTPLEKQYTFFGKLQFPVKTDIDAWTEKIKRLHLLLTVKESAMDVPSNLDARRRISFFSNSLFMDMPPAPKVRNMMSFS

SEQ ID NO: 201374 - protein, 410 aa, Glycine max
  Coding DNA Sequence Number=SeqID_84596
  Gene Ontology: Mol. function=1,3-beta-glucan synthase activity; Cellular component=1,3-beta-glucan synthase complex; Biological process=1,3-beta-glucan biosynthetic process
  Homolog annotation: Hit_ID=Q9AUE0; Match level="QueryCoverage=97%, HitCoverage=20%, E-value=1e-170, Identity=69%"; Hit description =Callose synthase 1 catalytic subunit
MAFELYGMLAGNVSPLTGEPVKPAYGGDNEAFLMKVVKPIYDVIAKEAERSNMGKAKHSHWRNYDDLNEYFWSVDCFRLGWPMRVDSDFFSVPFPQQQHQVNKHEENRGPASDRWSGKTNFVEIRTFWHIFRSFDRMWSFYILCLQAMIIIAWNGSGKLSSIFDGDIFKQVLSIFITAAILKLAQAILDVFLSWKARKVMSLHVQLRYIFKAILAAAWVIILPVTYAYTWKNPSGFAQTIKNWFGNGTGSPSLFILAVFIYLSPNILSALLFVFPFIRQFLERSNNGVVKLMMWWSQPRLFVGRGMQEGPISLLKYTCFWVMLILSKLAFSYYLEIKPLVAPTKAIMNARVSVYRWHEFFPHARNNIGVVIAIWSPIILIWYAIFSTIVGGIYGAFRRLGEIIRIDSFHI

SEQ ID NO: 201375 - protein, 258 aa, Glycine max
  Coding DNA Sequence Number=SeqID_84597
  Gene Ontology: Mol. function=GTP binding; Cellular component =intracellular; Biological process=small GTPase mediated signal transduction
  Homolog annotation: Hit_ID=Q8S7M9; Match level="QueryCoverage=93%, HitCoverage=64%, E-value=2e-52, Identity=45%"; Hit description =Putative GTPase domain containing protein
  Pfam annotation: Domain name=MMR_HSR1; Domain location=140-249; Score= 31.2; E_value=1.4e-06; Accession=PF01926.13; Description=GTPase of unknown function
MSAAARLGRRVGTTAKEELRRNKGAWRDPLPAAASRAIAERIPLADLVVQVRDARIPLSSECEILRNYPPSLKQIVALNKMDLVGTSNVKAWMGYFRERNCISCGVNAHNKENIKQLLSLIQRRVSELKGADQCDNNYTATVMLVGIPNVGKSALVNALHQVGRISAAEKGKLKHATVSPEPGETKDIRSFKIGSHPNIYVLDTPAILSPKVPNVDILSKLILTGGSLSILHQSYNEEEIEGDVNHKIQTRWMRWKNA

SEQ ID NO: 201376 - protein, 99 aa, Glycine max
  Coding DNA Sequence Number=SeqID_84598
MTVRRSHFLIPLAEDLLDELEHASVFKLKILNRDTTRFRSEQKTQSIVFYSVTPRDTNLKLKPRYNGPNAPTNNKKDKESSQNSKERRSLSSIASFIYI

SEQ ID NO: 201377 - protein, 451 aa, Glycine max
  Coding DNA Sequence Number=SeqID_84599
  Gene Ontology: Mol. function=transferase activity, transferring acyl groups, acyl groups converted into alkyl on transfer; Cellular component=cytoplasm; Biological process=tricarboxylic acid cycle
  Homolog annotation: Hit_ID=Q946X8; Match level="QueryCoverage=99%, HitCoverage=89%, E-value=1e-169, Identity=65%"; Hit description =Citrate synthase
  Pfam annotation: Domain name=Citrate_synt; Domain location=104-451; Score=538.0; E_value=9.7e-159; Accession=PF00285.11; Description =Citrate synthase
  Subcellular localization annotation: CTP_CleavageSite=41; ConfidenceScore=5.69e-01
MAFFRSVSALSRLRSRVGQQSNLANSVRWLQTPSSSNTVFSCSTLNGVSITVIVMEFGIGYCSLDLYSELKELVPEYQERVKKLKKDHGSVELGKITVDMVLGGMRGMTALVWLGSAVDPDEGIRFRGMSIPECQKKLPGAFPGGEPLPEAVLWLLLTGKIPSKAQVDSLSQELRSRATIPDYAYKAIDALPVSAHPMTQFTTGVMALQSEFQKAYEGGITKARYWEPTYEDTMNLIARLPAIAAYIYRRKYKDGKIIPLDDSLDYGANYAHMLGFDDPEMLEFMRLYISIHSDHEGGNVSSHTAHLVASPLSDPYLAFAAALNGLAGPLHGLANQEVLRWIRSIVAEFGTPNISTEQLADYINKTLSRGQVVPGYGHGVLRQTDPRYTCQREFALKHLPNDPYFQLVSKIKEVVPPILTKLGKVKNPWPNVDAHSGVLLNYYGLTEEKYG

SEQ ID NO: 201378 - protein, 34 aa, Glycine max
  Coding DNA Sequence Number=SeqID_84600
MEMELVRVLESKEELTDGDKVTQVSHRGKVIFHR

SEQ ID NO: 201379 - protein, 96 aa, Glycine max
  Coding DNA Sequence Number=SeqID_84601
  Gene Ontology: Mol. function=4 iron, 4 sulfur cluster binding; Cellular component=molybdopterin synthase complex; Biological process=Mo-molybdopterin cofactor biosynthetic process
  Homolog annotation: Hit_ID=Q39055; Match level="QueryCoverage=90%, HitCoverage=22%, E-value=3e-38, Identity=82%"; Hit description =Molybdopterin biosynthesis protein CNX2
  Pfam annotation: Domain name=Mob_synth_C; Domain location=1-95; Score= 56.1; E_value=1.1e-13; Accession=PF06463.4; Description=Molybdenum Cofactor Synthesis C
MKQFTSLKRVQDHPTDTAKNFTIDGHAGRISFITSMTEHFCAGCNRLRLLADGNFKVCLFGPSEISLRDPLRRGAEDDELREIIAAAVCTSSDYYC

SEQ ID NO: 201380 - protein, 141 aa, Glycine max
  Coding DNA Sequence Number=SeqID_84602
  Pfam annotation: Domain name=VQ; Domain location=24-54; Score=47.0; E_ value=6.5e-11; Accession=PF05678.4; Description=VQ motif
MTKLGINKDSHLVSKTKPKIRIIHVYTPEIIKTDAANFRELVQRLTGKPKEEGTGGSKSETALTKEPMDSHPKKAMIMQDEEEFLSLQNGTRLKNEHKEEEVQDDVWRSKSNEKFSGFLDGFSELDGFMEELSTLPAGNQN

SEQ ID NO: 201381 - protein, 66 aa, Glycine max
  Coding DNA Sequence Number=SeqID_84603
MVHAPEKGGTWWHVKLRRVAQGGRPWAKWCVTMMCGSPEDDGSDLVIMPEKRHDDCQRSFTIGTDT

SEQ ID NO: 201382 - protein, 116 aa, Glycine max
  Coding DNA Sequence Number=SeqID_84604
MAFQHFPHTQSYPSRGGSSLCEGMGEGYCTQPYPCIYKETVSGFEPMTNKSPRHNFTAAYAKSTYIVRIASHSSLMHPISTLSLTNERLQHTLFCQRLPASMWDINTFLFVHDYPP

SEQ ID NO: 201383 - protein, 111 aa, Glycine max
  Coding DNA Sequence Number=SeqID_84605
  Subcellular localization annotation: CTP_CleavageSite=72; ConfidenceScore=5.38e-01
MESSLGDMLVKVVVFILVQALVYLILSNSSNVFNKNMKKSNSFRPARSVSIRRMLALISDFPPEEEPSPSPKGAKTTSLHQNNFSLSGGHIKAQKPPNVAAAVVVTNCNLD

SEQ ID NO: 201384 - protein, 159 aa, Glycine max
  Coding DNA Sequence Number=SeqID_84606
MLPECLARSSSDCVLLCVVKGGSHRPAVSPFLIVCHFPRMNGRPSSCQIWELTKFDRVQFWSNIYDFSIDELGIYPHFFYSVGGVMIRNRRGSLLIIVQGQLVYSLDLETQILIQLPIAEGGLWTLYPAYYAESLFLLDKLEVVGPGGSPDGHADDDHH

SEQ ID NO: 201385 - protein, 143 aa, Glycine max
  Coding DNA Sequence Number=SeqID_84607
SRIATLSFPNLGAAILVLLDERVARGNVVERGPQPVEILFRQHRQPGNNLPPDLRHNAGNCLASAWGVIWSLQTAQRTTPLGSREERREGSVLENDVEEGGFGVVLGEGWGVHELEEVGVAVRAEERGGWERQGHAHVALVAP

SEQ ID NO: 201386 - protein, 235 aa, Glycine max
  Coding DNA Sequence Number=SeqID_84608
  Gene Ontology: Mol. function=nucleoside-triphosphatase activity; Cellular component=membrane; Biological process=cell division
  Homolog annotation: Hit_ID=Q9LJJ6; Match level="QueryCoverage=55%, HitCoverage=27%, E-value=5e-29, Identity=43%"; Hit description =Mitochondrial protein-like
ESGRVTLSGLLNFTDGLWSCCGEERIVVFTTNHRDSVDPALLRCGRMDVHVSLGTCGTHAFRELARNYLGVDSHVLFEAVEGCIRSGGSLTPAHVGEILLRNRGDVDVAMREVLAAMQGRMLVATAAADQPENEEASTAAGVRSPESVLMMGSPENWDVKRKEQHGCNNLDKKVKFFVSKFYFLVLIKDGNLRDTGGLGVSNMADNCYLLRQRGFIALTLSYGSDGTLDLTVKYN

SEQ ID NO: 201387 - protein, 521 aa, Glycine max
  Coding DNA Sequence Number=SeqID_84609
  Gene Ontology: Mol. function=nucleoside-triphosphatase activity; Cellular component=membrane; Biological process=cell division
  Homolog annotation: Hit_ID=Q9FKM3; Match level="QueryCoverage=78%, HitCoverage=80%, E-value=3e-92, Identity=44%"; Hit description =Similarity to AAA-type ATPase
  Pfam annotation: Domain name=AAA; Domain location=232-438; Score =29.7; E_value=1.2e-06; Accession=PF00004.19; Description=ATPase family associated with various cellular activities (AAA)
MEILSQMWSLLGLLTVLQNVLPSQLLSLLHSLYESLQDLLSPYSYFEIPEFNGYCGVELNDLYRHVHLYLNAANHAPAAACRRLTLSCSPSSNRISFAVAPNHTVHDAFRGHRVGWTHHVETAQDSLEERRSFTLRLPKRHRHALLSPYLAHVTSRAEEFERVSRERRLFTNNTTASGSFESGWVSVPFRHPSTFETLALEPELKKQIKNDLTAFADGKEFYKRVGRAWKRGYLLHGPPGSGKSSLIAAMANFLCYDVYDLELTKVSDNSELRSLLIQTTNRSIIVIEDIDCSVDLTADRTVKKTQAGKLSLRSSNKKTTTTSSFTRCEESGRVTLSGLLNFTDGLWSCCGEERIVVFTTNHRDSVDPALVRCGRMDVHVSLATCGAHAFRELARNYLGLESHVLFQAVEGCIRGGGALTPAQVGEILLRNRGDADVAMREVLAAMQGRMLAVAAAANDQAENEEAVGVRSPESVLLMGSPENWDAFSGKKRKEQHGCNNLDKKVKFFVRLRSLTRSDPGR

SEQ ID NO: 201388 - protein, 78 aa, Glycine max
  Coding DNA Sequence Number=SeqID_84610
MNHGACKHPGFLREWVYEIEMHIDLKVMQMVVVSAYKMVEILRKGTRKEKIKEGGKEKEACVWHIKSHEYGDGAKISV

SEQ ID NO: 201389 - protein, 66 aa, Glycine max
  Coding DNA Sequence Number=SeqID_84611
MCNGGSDKEPLNDGGGDKKCVSFKDTMMANKTPLAPHSKVDLIEQKLAMIVFLDDNPFKPMVHIAD

SEQ ID NO: 201390 - protein, 256 aa, Glycine max
  Coding DNA Sequence Number=SeqID_84612
  Gene Ontology: Mol. function=RNA-directed DNA polymerase activity; Cellular component=exocyst; Biological process=RNA-dependent DNA replication
MESFMDQVKLVLMVSPLLLLLVVHFLCNYGSGGVLSSLIPLPERESLHRAGGTPWGVGLVLVLLLFMDLFGLLRQAVGRGDFSCVGVGKKDVKVSMLQFTHDTSIFAKSNLKTVICIKSILRWFEIMSGFKLNFHKSSLIGVQQVEEGLVKRFANLLNCRISTLPFEYLGIQVGANPRSQLGEPIIQKIKKRLSTWKQKQLFLGVKVEDVEFSTKFMLQGAEIKESVVENNLAGHVGKECYAEMWKRKRISIIPST

SEQ ID NO: 201391 - protein, 188 aa, Glycine max
  Coding DNA Sequence Number=SeqID_84613
  Gene Ontology: Mol. function=sugar porter activity; Cellular component=integral to membrane; Biological process=transport
  Homolog annotation: Hit_ID=Q8S7U2; Match level="QueryCoverage=92%, HitCoverage=31%, E-value=9e-53, Identity=71%"; Hit description =Putative sugar transport protein
MGTIVEADNTYTKILGRWPVFYYGMGHMLNDITAACWFTYLLLFLTDIGLSPRNAAVVMLSGQVADGFVTIFVGELIDRFGHFKIWHGAGSLLVAISFSSVFGGCLPCKLFSSNSGTFETLSYSMYAAIFNVGWAATQLCDIYIGISHNFVEKSHSNERMMTVSSLIALLKVHGELHHAELYKQSGTG

SEQ ID NO: 201392 - protein, 116 aa, Glycine max
  Coding DNA Sequence Number=SeqID_84614
MNANSNKGRPRFLHWGDATQISMGSRWPMWHDGEGRWTIDLVSLGGQRSSVVMGDSGEQHMVRGVGSHGVRRMSERRGGENNLESGQKRKLVVLTNWVVRIVISPHPCLQLVMRIV

SEQ ID NO: 201393 - protein, 203 aa, Glycine max
  Coding DNA Sequence Number=SeqID_84615
  Gene Ontology: Mol. function=sugar porter activity; Cellular component=integral to membrane; Biological process=transport
  Homolog annotation: Hit_ID=Q8S7U2; Match level="QueryCoverage=93%, HitCoverage=42%, E-value=2e-39, Identity=43%"; Hit description =Putative sugar transport protein
MPAFEFPMKHNNNIMAYLAFFVINDLQMAQSAKALVPALIYICSFVVSIALQEIAWTGRMLKAYYSAGCILWIFCGAVILLLTTNMSYVMYIVSVFIGIANALMMVTGVSMQNFLIGENLNGCAFVVGSLSFLDKISCGLALYVLQSNQNLSPQLQATTQFPFSVTRIGLGLVPAFCALVGVVVTCTMDFHNPSKSLTAPLLA

SEQ ID NO: 201394 - protein, 67 aa, Glycine max
  Coding DNA Sequence Number=SeqID_84616
SFAASGEVGANDPSIHIHHSSSPHDFLFPWPYGKVVDGTGKSYASFLLSKSLKRVLEEGVIGLYFLI

SEQ ID NO: 201395 - protein, 98 aa, Glycine max
  Coding DNA Sequence Number=SeqID_84617
MEIHVKLHALSDLCFEGKESNLAAIVRLASSLDYTSSKSMLKLLLTLVQGRIVIDYTNMVIDYQRATLPEITACNRLHYYGNRLPVVILARKQKKKAF

SEQ ID NO: 201396 - protein, 176 aa, Glycine max
  Coding DNA Sequence Number=SeqID_84618
  Homolog annotation: Hit_ID=Q1RV13; Match level="QueryCoverage=30%, HitCoverage=12%, E-value=6e-07, Identity=49%"; Hit description=IMP dehydrogenase/GMP reductase
MRDKEVEVNLLQYADDKIFVGEFKLENVVVVKSTLRCFELVSSLKVNFHKGRFGGIGVDLEEIERVLDSKYVASQGLCEDEKELAKEFNTLVNTAKVEGVGCDTWLRLMETTHNFSVKSTYSSLHNLRIGSHENGEGAISCVLCNENDEDAQLLNISVITPRVVIVQKLGKQDGVQ

SEQ ID NO: 201397 - protein, 47 aa, Glycine max
  Coding DNA Sequence Number=SeqID_84619
MSEYKPPSERTTHHRESELIELPYPNAHLVNNISKLIMTPINLNNLV

SEQ ID NO: 201398 - protein, 46 aa, Glycine max
  Coding DNA Sequence Number=SeqID_84620
  Homolog annotation: Hit_ID=Q1RX76; Match level="QueryCoverage=97%, HitCoverage=8%, E-value=1e-16, Identity=89%"; Hit description =Glycoside hydrolase family 79, N-terminal
MALTHGRTCPLNYLLWDKEDKNLCTLCKAIQRDHNTSTQLGQQHHC

SEQ ID NO: 201399 - protein, 540 aa, Glycine max
  Coding DNA Sequence Number=SeqID_84621
  Pfam annotation: Domain name=DUF936; Domain location=1-540; Score =186.0; E_value=8.9e-53; Accession=PF06075.3; Description=Plant protein of unknown function (DUF936)
VNGRSCRASPQPPPLQSRGYFLKLSDSLHSAYVSVPDADADLICAGKLHLGQFVYVTRLDAASPVPLVRGLNVLPRRRPCVGNPTELVPSERLCVATPKKKKREEVVKKEKGLEMMRRLSLDSSRRVWDQSPVAKRKTASASSLSNNLKAKKSNSNPTSLNVIDKKVVSVKPDSPLKSPTSSVSPLKNKNENLCPKSLTITPPRKSTSTSTRSPCGGTVHSPLVKVPLNFKTWCYDTPACWEDVSLPMCDLGKQVVTHRTVAFLAAVRSLEEASATDSVIQCMCMYAELCQSGQTHSPGSLVKQFLELHLSLQRVTVLFDSLLNPLPETKSSSHSTLQCLTEDACKVPTRKNAISWVQAAVGTNLSKFNLFETQAKSEVLNGEKCHYVVIENTPEDINTETSPAQNKQNRVTQANHLPNSTAKRLPSSKRNLLAAKNKDADKHDRSKEIKLKEAASLAEKLLEASSEWFLKYLEESLSNEFGLKNEGNTEIASLLGQLKQVNHWLDNLAGGDKVDHRVEKLRKNLYRFLLEHVNSAVTSN

SEQ ID NO: 201400 - protein, 172 aa, Glycine max
  Coding DNA Sequence Number=SeqID_84622
MMRGDRVHADGPLARHCLFPRRRLDRLTPDVTIPPHLAASLLSDEEIDDRWMQFMHGHCSPDDLDWFYMISHPFMSLAQLGDPPRVLPVQQYDTFVEPDVYQQPMATVTPNEVDVDVHHVRHAVEKLLNLRILTEGTEAYTVTEECLGIARSYIGQPTIGHKSRRRWHIDSH

SEQ ID NO: 201401 - protein, 108 aa, Glycine max
  Coding DNA Sequence Number=SeqID_84623
MTNNSWMKFTTSSHSQIQLLCTISRTPDPYGILNLLEGTMTPTHEALLYYNGRWNMPRQNNFVGYAFTGKNPKKFDIPSGCTIDELKDLIKQVAPQGIPPHGIHESQT

SEQ ID NO: 201402 - protein, 249 aa, Glycine max
  Coding DNA Sequence Number=SeqID_84624
VFQKKKKALVQGPQLYDTRRFHSFEAWTRYIDNVLGRHILAKRKVEIYHTELDEFKAELERRNFHKRLTNLADSNFDLAFCEGVSCQPLQSRGAFTKTNSLNTFLETPVVLAEGESLPAYSRYCRMPTNNREIEAALRIPSRGFVLNVESHPRKILMKDLTTLAQVWSVLSYSNLAPTSHTSDLTLDRARLIFGLVSQLDMNVGALISGQITSMAQSNSSTLGFPALITTLCRSRGVASNSLVFERLSP

SEQ ID NO: 201403 - protein, 123 aa, Glycine max
  Coding DNA Sequence Number=SeqID_84625
MSLLHQWSPLLLEDQWKKNGEGGKLWFSPLIQEQVQDSPLSVLRCHEPMGPKSTLRLMRTLGPSPASLVQSSWSLLAMALVMGPLLGGLHQNGVTLFCENAPTIWDQHRLKGTFKPSVFTRKA

SEQ ID NO: 201404 - protein, 147 aa, Glycine max
  Coding DNA Sequence Number=SeqID_84626
MGKDWGPGAAGAGYTGKRSRSTAPDPYGWPPAVLLNERPVNRRMDELCGHNWHPIELADTRDQSQKSQCSIRLFWVHWVSWRRDPYKLWEIKIMIAGKDVAEEKHHSDLCQGGHASAHDPHPPSHHASCKVLSRRAQQLAYGLLIKS

SEQ ID NO: 201405 - protein, 134 aa, Glycine max
  Coding DNA Sequence Number=SeqID_84627
MEPFRIKLSQGYRNLPFGGVRKGQNRWAKAFVSKGENERSRHQHLFEENVRKTKKSLRILKMRVRELFTHGEAKKAFGTKAARPGELLLHSEVTLLAQGSKDKDTNFVQEIQPFDQATGENQVKARKHEDIEVM

SEQ ID NO: 201406 - protein, 67 aa, Glycine max
  Coding DNA Sequence Number=SeqID_84628
  Subcellular localization annotation: CTP_CleavageSite=44; ConfidenceScore=5.49e-01
MKVRPCSPLKARACSPLKTRVCNPLKARTCNPLKARTCNPLNVRACSPMKARKSYPSRTLDRRLQED

SEQ ID NO: 201407 - protein, 53 aa, Glycine max
  Coding DNA Sequence Number=SeqID_84629
MVKAKDKGERPWESSTVHRQTLISSVYSQGTLTQLKGGKSVKNWNIKYNKEYM

SEQ ID NO: 201408 - protein, 78 aa, Glycine max
  Coding DNA Sequence Number=SeqID_84630
MDHAHKTPSRPGEVQQGPRVSSSGYGPVSVLPGTCSPEQGIAPTRHPVDPEESNKALGFPALIMSLSQFYGEPIAPNK

SEQ ID NO: 201409 - protein, 163 aa, Glycine max
  Coding DNA Sequence Number=SeqID_84631
  Gene Ontology: Mol. function=chitin binding; Cellular component =extracellular region; Biological process=chitin metabolic process
  Homolog annotation: Hit_ID=UPI00006A17C9; Match level="QueryCoverage =97%, HitCoverage=100%, E-value=5e-22, Identity=34%"; Hit description= UPI00006A17C9 related cluster
SSPSEDYTPSPFRGLHVLTFRGLHALAFRRLHVLTFRGLHALAIRGLHIFTIRGLHILAFRGLHALVFKGLHALTFRGLHVLSFKGLHALAFRGLHVLTFRGLHVLPFRGLHALAFVGLHTLTFDGLHLLAFRGLHALAFRGLHLLAFRGCTSSPSWGSTSAP

SEQ ID NO: 201410 - protein, 152 aa, Glycine max
  Coding DNA Sequence Number=SeqID_84632
MKNIPDLGVVFAFEEGISTSHVDKSGALAPTYPPSKRKSDLRGPFKTLDLKMIHFYMVRQTENSPLQPICRKKGEEVAAQLAQRVRSTSKWSIKGCMPSNNSPRMKLGYDKAYAGCPTLPQCSCTVPLIAPVYGSEVPIVVFRHDLVAGNLL

SEQ ID NO: 201411 - protein, 83 aa, Glycine max
  Coding DNA Sequence Number=SeqID_84633
  Homolog annotation: Hit_ID=Q1SDS1; Match level="QueryCoverage=77%, HitCoverage=12%, E-value=3e-08, Identity=44%"; Hit description=IMP dehydrogenase/GMP reductase
MCAEKGKVYWENLLAGMVGASVNWFPRWKEGGAEVVSSCEGFPNVPLMGTRGCINSNPVLAIRQLGYPMRGAPLEESITPFIP

SEQ ID NO: 201412 - protein, 78 aa, Glycine max
  Coding DNA Sequence Number=SeqID_84634
MLKREGSEKLNRVLDLLVLVRRRCRCESNSVFWCDDSVVWCEVVDNEVQIVSCDEEDTVWFEFKQRRQRGCIVQRRRR

SEQ ID NO: 201413 - protein, 96 aa, Glycine max
  Coding DNA Sequence Number=SeqID_84635
  Homolog annotation: Hit_ID=Q42777; Match level="QueryCoverage=46%, HitCoverage=6%, E-value=8e-13, Identity=82%"; Hit description =Methylcrotonoyl-CoA carboxylase subunit alpha, mitochondrial precursor
MKIWEGIFTFTVDRIQKLSSVDDGGSVQVTDPRWWRSASDGLVGGCHMERVPVGVALNGDVFNKIYPMQQEECELRVCMVRSGMGPGICSSPMQQI

SEQ ID NO: 201414 - protein, 611 aa, Glycine max
  Coding DNA Sequence Number=SeqID_84636
  Gene Ontology: Mol. function=RNA-directed DNA polymerase activity; Cellular component=chromatin; Biological process=chromatin assembly or disassembly
  Pfam annotation: Domain name=RnaseH; Domain location=213-332; Score= -17.0; E_value=0.0022; Accession=PF00075.14; Description=RNase H
  Pfam annotation: Domain name=rve; Domain location=468-610; Score =69.8; E_value=8.8e-18; Accession=PF00665.16; Description=Integrase core domain
  Pfam annotation: Domain name=zf-H2C2; Domain location=409-450; Score =8.0; E_value=0.032; Accession=PF09337.1; Description=His(2)-Cys(2) zinc finger
  Pfam module annotation: Pfam domain module=RnaseH::rve::zf-H2C2; Domain location=213-332::468-610::409-450
MALGGFFSKIALKSGYHQIRVHEQDIHKTAFRTHNGHYEYLVMPFGLMNAPATFQATMNDIFKPFLRQFVLVFFDDILVYSKNEQDHLNHVKLVLEVLVKHCFVANKKKCSFGCSQVDYLGHIISAAGVSVDPSKVKCIMEWPEPKTVKGVRGFLGLTSYYRKFVKDYGKIARPLTDLIKKDNFLWNESAREAFQKLKTVMTTSPVLALPNFDVAFEVECDAAGRGIGAVLMQNRQSIAYFSKALSENNLAKSVYEKELMALVLSIQHWRHYLLGKEFVVYTDHKSLKHFLQQKISSPDQQCWLAKLLGYQFEVKYKPGLENKAADALSRCYDDCELAVMAYSPVWIGRQQLLKDVENDVSVQELLKKVVENPDKYPGFVIHQGVLLYQDRLVIGKNSSMIPQLLKECHETPMGGHSRFLRTYKRVAENLYWIGMQKTVRDYVRACDVCQRQKYVATTPGGLLQPLPIPNAIWEDLSIDFITGLPKSRGYEAILVVVDRLSKYSHFILLKHPYTAKTIAEIFVKEVIRLHGIPMSIVSDRDPLFISHFWREIFKLQGTSLKMSSSYHPETDGQTEVINRCLESYLRCFVAEQPKTWSYWVSWAEYCTYYLP

SEQ ID NO: 201415 - protein, 627 aa, Glycine max
  Coding DNA Sequence Number=SeqID_84637
  Gene Ontology: Mol. function=RNA-directed DNA polymerase activity; Cellular component=chromatin; Biological process=chromatin assembly or disassembly
  Homolog annotation: Hit_ID=Q1RVR4; Match level="QueryCoverage=49%, HitCoverage=88%, E-value=3e-85, Identity=52%"; Hit description =Peptidase aspartic, active site; Aldehyde dehydrogenase
  Pfam annotation: Domain name=RVP_2; Domain location=397-511; Score= -21.8; E_value=5e-05; Accession=PF08284.2; Description=Retroviral aspartyl protease
  Pfam module annotation: Pfam domain module=RVP_2::Retrotrans_gag; Domain location=397-511::108-198
MGDRIEALETQMGNVTTTLQELALQMSQHAQQMQQQSLVLTELSKQIGQKGATQEGEASVGDSSQNESRLAGKKVKLPLFEGEDPVAWITRAEIYFDVQNTPEEMRVKLSRLSMEGSTIHWFNLLMETEDDLSWEKLKKALIARYGGRRLENPFEELSTLRQTGSVEEFVEAFELLSSQVGRLPEEQYLGYFMSGLKAPIRRRVRTLNPANRMQMMRIAKDVEEELREEDDDENRASMKKNVGRSEYGPGSKFWTGSNLAQKEITRFSKSGWTNPSRKTVSIGSTSNTTSSLSSTGRKHEGDRRGGTNDRWRGISSEEMEERRAKGLCFKCGGKYHPTQHKCPERSLRVLILGDGESLNDDGEIVAMEGEESEEEEMTEAECKLIGVLGKMGESQTMKIEGKLEHVNVGVLIDSGASHSFISPELVTALGLKVTPTTVKRIKLGDGHKVLSEGVCRRVRLVLGSNEFEIDALVLGLGGLDVVLGVSWLSTLGKVVMDWKDLTMQFWHNGEMMTLKGQGGRQLVQGCLHTYLEGKDRAMSPVELWSLEEKLLDSNVKIQGNIGDLLTTFPEVFTEQLSLPPIRSQVHQINLIPNYGPVNMRPYKYPHHQKEEIEKQVAELLQAGVIRP

SEQ ID NO: 201416 - protein, 102 aa, Glycine max
  Coding DNA Sequence Number=SeqID_84638
MNDELQAKVNELKGEKNELRDENNRLKEEKEKLEQQKLEACRHLIARFYLHYSPDKLSFFLPASFYIGRKRTVVEHVTNYIGRKTTIVEYVINEVVPTTSPM

SEQ ID NO: 201417 - protein, 97 aa, Glycine max
  Coding DNA Sequence Number=SeqID_84639
MEERIEGLFSTESLRWILRILLRLKRSSRCGGSATSNNGLWWPPVVVGGGGGGARAWISLSKLISLSGSPLLALCATFGAEHNSSQVGICVKHDNSC

SEQ ID NO: 201418 - protein, 123 aa, Glycine max
  Coding DNA Sequence Number=SeqID_84640
  Gene Ontology: Mol. function=siderophore-iron transporter activity; Cellular component=outer membrane; Biological process=siderophore transport
  Homolog annotation: Hit_ID=Q6D988; Match level="QueryCoverage=90%, HitCoverage=16%, E-value=2e-27, Identity=52%"; Hit description =Putative ferric siderophore TonB-dependent receptor
  Subcellular localization annotation: CTP_CleavageSite=27; ConfidenceScore=5.18e-01
MRRTPFNPGMKPTLLAMLVSAGCLPVMAATTNTSNAPQGANEQPTLTVTATPQSEFKPGGNDLVPAFLDGQIAHGGRLGMLGEQNAMDVPFNVIGYTAKMIQDQQAQTIADVVRNDAGVQNVK

SEQ ID NO: 201419 - protein, 436 aa, Glycine max
  Coding DNA Sequence Number=SeqID_84641
  Gene Ontology: Mol. function=transferase activity; Cellular component= chloroplast; Biological process=fatty acid biosynthetic process
  Homolog annotation: Hit_ID=Q6CYL6; Match level="QueryCoverage=93%, HitCoverage=99%, E-value=0.0, Identity=81%"; Hit description =Putative beta-ketoacyl-ACP synthase
  Pfam annotation: Domain name=Ketoacyl-synt_C; Domain location=280 -390; Score=139.4; E_value=1e-38; Accession=PF02801.12; Description =Beta-ketoacyl synthase, C-terminal do
  Pfam annotation: Domain name=ketoacyl-synt; Domain location=28-272; Score=157.1; E_value=4.6e-44; Accession=PF00109.16; Description=Beta- ketoacyl synthase, N-terminal domain
  Pfam module annotation: Pfam domain module=Ketoacyl-synt_C::ketoacyl -synt; Domain location=280-390::28-272
MKRMGAADEVAGLASYLMSDIAGYVTRQRVVVTGMGGVTAFGESWSAVAQRIKQGQNAVRKMPEWQVYDGLHTLLGAPIDDFTLPPHYTRKRIRAMGRVSLLATRATELALEQAGLIDHPVLTSGETGIAYGSSTGSTGPVSEFATMLTEKHTNNITGTTYVQMMPHTTAVNAGLFFGLRGRVIPTSSACTSGSQAIGYAWEAIRHGYQTVMVAGGAEELCPSEAAVFDTLFATSQRNDAPHTSPAPFDQQRDGLVIGEGAGTLILESLAHAQARGATIYAELVGFHTNCDAAHITQPQRETMQICIQRALDSAGVTAAQIGYINAHGTATDRGDIAESQATAAIFGNRTPISSLKSYFGHTLGACGALEAWMSIEMMREGWFAPTLNLTQPAAECGELDYITGAPRQLQTDYVQSNNFAFGGINTSLVFKRWRDA

SEQ ID NO: 201420 - protein, 920 aa, Glycine max
  Coding DNA Sequence Number=SeqID_84642
  Gene Ontology: Mol. function=ionotropic glutamate receptor activity; Cellular component=integral to membrane; Biological process=ion transport
  Homolog annotation: Hit_ID=Q84W41; Match level="QueryCoverage=92%, HitCoverage=91%, E-value=0.0, Identity=55%"; Hit description =Glutamate receptor 3.6 precursor
  Pfam annotation: Domain name=ANF_receptor; Domain location=47-410; Score=288.9; E_value=9.3e-84; Accession=PF01094.18; Description =Receptor family ligand binding region
  Pfam annotation: Domain name=Lig_chan; Domain location=606-866; Score= 284.9; E_value=1.5e-82; Accession=PF00060.17; Description=Ligand -gated ion channel
  Pfam annotation: Domain name=SBP_bac_3; Domain location=510-829; Score=-42.9; E_value=3.1e-05; Accession=PF00497.10; Description =Bacterial extracellular solute-binding proteins, family 3
  Pfam module annotation: Pfam domain module=ANF_receptor::Lig _chan::SBP_bac_3; Domain location=47-410::606-866::510-829
MILAWLLVLMALSNGFFSNGDGMHNSTIPDFVNIGALFSFNTSVGRSIKIAIKAAIEDINSDPTILGKTKLNLSLQEDSKYRGFLSISEVLQVMARRTVAIIGPHSSVTAHVITHIANELQVPLLSFSALDPTLSSLQFPFFIRTCHSDLYQMTAIADIVNYHDWKDVIAVYLDDDNGRNGIGALGDKLAERRCRISYKAPLSPDASMEEISNVLVQVALAESRVIVVHANTQFGPKLFSVAKNLGMMGTGYVWIATAFLSALLDINSPLSSDSLDDIQGVLTPRMYTPDSQLQRRFASRWKNLTSGNTANAHLGLSFLPIYAYDTVYVLAHALDAFFKQGNQITFSTDSKLSSIHGDNLNLEALKIFNEGNLLRSNIYEVNMTGVSGPFKYTSDRNLVNPAYEIINVIGTGTRRIGYWSNYSGLSVVPPETLYSKPANLSRENQKLFAPIWPGNTGERPRGWVFPNNGRLLKIGVPKGVSYKEFVSQIEGTDTFEGFCIDVFLAAVSLLSYAVPYKFVPYGEGKNNPSMTELVRLITTGVSIMDNFFVEFESFMEFDGAVGDIAITTERTRMVDFTQPYIESGLVVVAPVRKEESNALAFLAPFTPKMWCVTAIFFILVGAVVWILEHRVNDEFRGPPKKQVVTVLWFSFSTMFFSHRENTVSALGRFVLIIWLFVVLIINSSYTASLTSILTVQQLYSPIKGIESLVIGKEPIGYTQGSFARNYLVHEIGINESRLVPLTTTEEAAKALRKGPENGGVAAYIDERAYTDIFLSSRCDLTVVGQEFTRNGWGFAFPRDSPLAVDLSTAILQMIDNGDLQRIHDKWLLSSACLSQGAKLEVERLQLKSFWGLYVICGLACLLALLTKKKRPLRAGPREEKWRGSHTEAVKEAHPSALIRDMLHAEVNVLAKYDQYFYMIF

SEQ ID NO: 201421 - protein, 315 aa, Glycine max
  Coding DNA Sequence Number=SeqID_84643
  Gene Ontology: Mol. function=endoribonuclease activity, producing 5' -phosphomonoesters; Cellular component=endoplasmic reticulum; Biological process=protein amino acid phosphorylation
  Homolog annotation: Hit_ID=Q1SZQ5; Match level="QueryCoverage=91%, HitCoverage=31%, E-value=1e-149, Identity=88%"; Hit description =Protein kinase; PUG; Quinonprotein alcohol dehydrogenase-like
  Pfam annotation: Domain name=Pkinase; Domain location=5-179; Score =11.6; E_value=3e-09; Accession=PF00069.15; Description=Protein kinase domain
  Pfam annotation: Domain name=Pkinase_Tyr; Domain location=11-179; Score=-149.8; E_value=0.0028; Accession=PF07714.7; Description =Protein tyrosine kinase
  Pfam annotation: Domain name=Ribonuc_2-5A; Domain location=184-313; Score=246.7; E_value=5e-71; Accession=PF06479.2; Description =Ribonuclease 2-5A
  Pfam module annotation: Pfam domain module=Pkinase::Pkinase _Tyr::Ribonuc_2-5A; Domain location=5-179::11-179::184-313
MENPVGCERHKYGIWSVLTFTFILKHRDVVSGLVHLHELGIIHRDLKPQNVLIIKEKSLCAKLSDMGISKRLLEDMSSLGHTVTGCGSSGWQAPEQLVQGRQTRAVDLFSLGCVLFFCMTAGRHPFGERLERDVNIVKNQKDLFLVEFIPEADDLISCLLNPNPDLRLTAIEVLHHPLFWSSEMRLSFLRDVSDRVELEDREIDSDLLKALESIAPLALGAKWDEKLDPDFITNIGRYRRYKYDSVRDLLRVMRNKLNHYRELPQEIQELIGPVPEGFNDYFASRFPRLLIEVYKVIYKSCKDDECFQRYFRNIN

SEQ ID NO: 201422 - protein, 56 aa, Glycine max
  Coding DNA Sequence Number=SeqID_84644
MSGVGGGCPCPRGNSECSIEDLNGDTVGNLNQNAAKPPRDHSVMRHCISSSWSAET

SEQ ID NO: 201423 - protein, 315 aa, Glycine max
  Coding DNA Sequence Number=SeqID_84645
  Gene Ontology: Mol. function=protein serine/threonine phosphatase activity; Cellular component=protein serine/threonine phosphatase complex; Biological process=protein amino acid dephosphorylation
  Homolog annotation: Hit_ID=Q9SD02; Match level="QueryCoverage=97%, HitCoverage=84%, E-value=1e-114, Identity=69%"; Hit description =Protein phosphatase 2C-like protein
  Pfam annotation: Domain name=PP2C; Domain location=20-274; Score =282.3; E_value=9.3e-82; Accession=PF00481.12; Description=Protein phosphatase 2C
MNIVGLKSSTEEKSNFSLVMRSGSCSDKGPKQYMEDEFICADILSECVDLGEDLPSPAAFYGVFDGHGGVDAASFARKNILKFIVEDAHFPCGIKKAVKCAFVKADLAFRDASALDSSSGTTALIALMLGSSMLIANAGDSRAVLGKRGRAIELSKDHKPNCTSERLRIEKLGGVIYDGYLYGQLSVARALGDWHIKGSKGSKSPLSSEPELEEIVLTEEDEFLIMGCDGLWDVMSSQCAVTMVRRELMQHNDPTTCAKVLVAEALQRNTCDNLTVVVVCFSKDPPSKIEIPRSYRRRSISAEGLDLLKGVLNGR

SEQ ID NO: 201424 - protein, 309 aa, Glycine max
  Coding DNA Sequence Number=SeqID_84646
  Gene Ontology: Mol. function=calcium ion binding; Cellular component =mitochondrion; Biological process=embryonic development ending in seed dormancy
  Homolog annotation: Hit_ID=Q84VG6; Match level="QueryCoverage=99%, HitCoverage=89%, E-value=2e-85, Identity=34%"; Hit description =Pentatricopeptide repeat-containing protein
  Pfam annotation: Domain name=PPR; Domain location=127-161; Score =41.1; E_value=3.9e-09; Accession=PF01535.11; Description=PPR repeat
  Pfam annotation: Domain name=PPR; Domain location=219-253; Score =30.5; E_value=6e-06; Accession=PF01535.11; Description=PPR repeat
  Pfam annotation: Domain name=PPR; Domain location=254-288; Score =28.9; E_value=1.8e-05; Accession=PF01535.11; Description=PPR repeat
  Pfam annotation: Domain name=PPR; Domain location=57-91; Score=36.3; E_value=1.1e-07; Accession=PF01535.11; Description=PPR repeat
  Pfam annotation: Domain name=PPR; Domain location=92-126; Score=9.6; E_value=0.54; Accession=PF01535.11; Description=PPR repeat
  Pfam module annotation: Pfam domain module=PPR::PPR::PPR::PPR::PPR; Domain location=127-161::219-253::254-288::57-91::92-126
MAREFHRKSMMASGLIKSRGVAPNTVVYNTLLHALCRNGKFGRARNLMNEMKDPNDVTFNILISGYYKEGNSVQALVLLEKSFSMGFVPDVVSVTKVLEILSNAGHATEAAEVLERVESMGGLLDVVAYNTLIKGFCGAGKVMVGLHFLKQMESKGCLPNVDTYNVLISEGRIEDGFSTLELMEESKEGSRGHISPYNSIIYGLVCDQMIDEGGIPSILVYNCLVHGFSQQGSVREAVELMNEMIANNRFPIPSTFNGVISGFYRQGKVESALKLVGDITARGRVPNTETYSPLIDVLCRNGDLQKAMQ

SEQ ID NO: 201425 - protein, 151 aa, Glycine max
  Coding DNA Sequence Number=SeqID_84647
MTGRLLAGSLAFECRIMHYFIICILLPRSSNLTHPFVKVKRSFSICSNVVSSFGYRKERDGSWVKKDAPVQAAEDRSPSPQPQRDDSSSLMHNILDRLDGLHTFVGERFDSLDTCIDAMDARFAGMDTRITKLEEDVSFVRQCFDLPPPSS

SEQ ID NO: 201426 - protein, 695 aa, Glycine max
  Coding DNA Sequence Number=SeqID_84648
  Gene Ontology: Mol. function=N-acetyltransferase activity; Biological process=metabolic process
  Homolog annotation: Hit_ID=Q6D1C9; Match level="QueryCoverage=62%, HitCoverage=49%, E-value=0.0, Identity=82%"; Hit description =Putative acyl-CoA synthetase
MNGFIQHALLAKPNQRRHRQLIVAGLTAEVIAGTAQGETEQAGLDFDLRAFRPIAAIEALYGAGGEQMLLDVIDQGIGQHLVGDQLVAIVTVFLMLMQINVVDAGATVDHGIVDHKALQVQYAQRFSGIDRHAVNRHRLLGMLAGHGTVPVGVGIGGGGADAAALCAVPVDQHADFQLGPPLLGLIQRVEDLAPGVVMLQIQGHQIDALGSVGDGVQQRGAKIGRRVQRTNISNRLGEFGQLCKWWIRSALRRRSLRVGGLQRQRQIDDAVLKLHLNAKAQPLRQRDHAAVIRHGDAAQTGQAMGARIGDHFLQQLAAQAQAFQVGTHQHGEFGVGVVRIGQRAGHADDLVCAHRHKGHFSIVVDLRHVGQIVMGKLVDLAEVAIIEVFLGHPVDEMLQRRLVFRQDRAEQALAAVFQRDGFFQLMRIRANRQPRLRIAAERRELHRNVQQGEFAAGGQHRVNIQPGDLRAVEDQVGDLHQQAAQPGDIQRPQRAAAADLAAFHRLQHQITRQRHVQRRQRDRHLIFLAPFHAAFAQHDQRAENRILLHRDAQLLGAGAVGHALHQQAVNARLRVGALYAVEDRLRRALHFGRGAQVEHDALNFRFVRDIRRTQLQRHRVADLFGDVYRFGAVFGDPGRQGAQVIGLQNGLHLVGIQLGGAFGQRLMDKAVGVGGVGGEADRQRWRLFQLLLVAA

SEQ ID NO: 201427 - protein, 105 aa, Glycine max
  Coding DNA Sequence Number=SeqID_84649
MRNHGSRGLVQETVFGGKLGSEGPLHVSQAVGFPLCRNLSFGGTATQGLTGASSMGGKCAESPPMFIRGKCRKNQKGTLRRWTINDLFGVVDKSGTFAPTYPQLS

SEQ ID NO: 201428 - protein, 186 aa, Glycine max
  Coding DNA Sequence Number=SeqID_84650
  Gene Ontology: Mol. function=DNA binding; Biological process=DNA integration
  Homolog annotation: Hit_ID=Q1SS72; Match level="QueryCoverage=96%, HitCoverage=12%, E-value=6e-49, Identity=47%"; Hit description =Integrase, catalytic region
MNESTPNIESYLYLHPSENPTVALVSPVLDSSNYHSWSRSMVTALSTKNKVEFINGNAPEPLRTDRTYSVWSRCNNMVVSWIVHSVSVAIRQSILWMNKAEEIWNDLKSRYAQGDLLRISDLQQEASSMKQGTLSVTEYFTKLRIIWDEIENFRPDPTCSCTIKCTCSVLTIIAQQKLEDRAMQFL

SEQ ID NO: 201429 - protein, 108 aa, Glycine max
  Coding DNA Sequence Number=SeqID_84651
  Gene Ontology: Mol. function=magnesium ion binding; Cellular component=chloroplast; Biological process=metabolic process
  Homolog annotation: Hit_ID=Q6Q3H3; Match level="QueryCoverage=83%, HitCoverage=16%, E-value=2e-18, Identity=53%"; Hit description =Terpene synthase
  Pfam annotation: Domain name=Terpene_synth; Domain location=2-106; Score=-32.6; E_value=4.3e-05; Accession=PF01397.11; Description =Terpene synthase, N-terminal domain
MDIAFHQLGLYRELNPPDQTGKFNERLANDIQGMLSLYEAAQLRFHGEEILEEVHDFTLTQLTKSPTTQLSHFLAAQVKHSLGQSLRKGMPRLETRYYMSFYQEDPLT

SEQ ID NO: 201430 - protein, 157 aa, Glycine max
  Coding DNA Sequence Number=SeqID_84652
  Gene Ontology: Mol. function=magnesium ion binding; Cellular component=chloroplast; Biological process=metabolic process
  Homolog annotation: Hit_ID=Q64K29; Match level="QueryCoverage=98%, HitCoverage=27%, E-value=1e-42, Identity=53%"; Hit description=(-) -germacrene D synthase
MEEYMQVATMSCGFAMLTIVSFLGMEDTTEEVLIWATSDPKIVAAASIISRLMDDIVGSEYEQERGHVVSSLDCYMKQHNTSRQDTIEELLKLVESAWKDINAACLNPTQVPMKFLMRVVNLARMMDVLYKDEDSYTNAGGIMKDYIKILLVNKIFD

SEQ ID NO: 201431 - protein, 83 aa, Glycine max
  Coding DNA Sequence Number=SeqID_84653
  Pfam annotation: Domain name=zf-GRF; Domain location=15-60; Score =46.0; E_value=1.3e-10; Accession=PF06839.3; Description=GRF zinc finger
MSPNSSTRGNATSNRLCYCCGRATIRITRTARNNERLFYVCPLPQQDADRCNFFSWIDEDIDVGATEIGRIEPIPDFGLRLRL

SEQ ID NO: 201432 - protein, 117 aa, Glycine max
  Coding DNA Sequence Number=SeqID_84654
  Gene Ontology: Mol. function=transmembrane receptor activity; Cellular component=membrane; Biological process=defense response
  Homolog annotation: Hit_ID=Q1SGR7; Match level="QueryCoverage=87%, HitCoverage=8%, E-value=7e-30, Identity=63%"; Hit description=TIR; Disease resistance protein; AAA ATPase
  Pfam annotation: Domain name=TIR; Domain location=21-117; Score=30.8; E_value=6.6e-08; Accession=PF01582.10; Description=TIR domain
MASNTIIQCSPSTHTKRKYDVFVSFHGEDSHNNSTSFLFEALRKKGIDAFRDDAGLNKGESIAPKLLQAIEGSRLFIVVFSKYYASSTWCLRELTHICNCIEISPRLPIFYDVGPSE

SEQ ID NO: 201433 - protein, 70 aa, Glycine max
  Coding DNA Sequence Number=SeqID_84655
MWYHVSEKSRQVPRRRLVRVTLFCENAPIMWNRHMLKGALKPSVFTPKAYTLKSPLGPLPPDSCPTEKTF

SEQ ID NO: 201434 - protein, 78 aa, Glycine max
  Coding DNA Sequence Number=SeqID_84656
  Subcellular localization annotation: CTP_CleavageSite=55; ConfidenceScore=5.55e-01
MTIILCVKTPPVSPRATSILLPRRPNALRSRSGTPLSGPCTNILGPKAQGCYLIRVVLLRTQSHAREMNRSTNPSGWR

SEQ ID NO: 201435 - protein, 441 aa, Glycine max
  Coding DNA Sequence Number=SeqID_84657
  Gene Ontology: Mol. function=pantothenate kinase activity; Cellular component=cytosol; Biological process=coenzyme A biosynthetic process
  Homolog annotation: Hit_ID=Q8L5Y9; Match level="QueryCoverage=94%, HitCoverage=47%, E-value=0.0, Identity=78%"; Hit description =Pantothenate kinase 2
  Pfam annotation: Domain name=Fumble; Domain location=47-395; Score =669.3; E_value=2.9e-198; Accession=PF03630.5; Description=Fumble
MAHTGSNSSMHRSSSRPQLDLSKAEIQGNFEEKYPTILLPNQSHDISHLALDIGGSLIKLVYFSRHQDQSTYDKRVKNVKNRLGFPPNGNRRSYPILGGRLHFVKFETSKINECLDFISSKQLHSAGGGESRYSDARTDSNAIIKATGGGAHKFADLFKERLGLSLDKEDEMSCLVAGANFLLKAIRHEAFTHMEGQKEFVQIDTNDLFPYLLVNIGSGVSMIKVDGDGKYERVSGTNVGGGTYWGLGRLLTKCESFDELLELSQKGDNSNTDMLVGDIYGGMDYSKIGLSASTIASSFGKATSEKKGLEDYRPEDISLSLLRMISYNIAQIAYLNALRFGLKRIFFGGFFIRGHAYTMDAISFAIHFWSNGAAQAMFLRHEGFLGALGAFMSYEKHGLDDLMVHQLVERFPMGAPYTGGKIHGPPLRDLNEKARSDYSVN

SEQ ID NO: 201436 - protein, 60 aa, Glycine max
  Coding DNA Sequence Number=SeqID_84658
MVVTVVILVAVVVTTSGDSCVVVTMTKVILVVVTILMMEVVVTTKKCIIVKYGEFIFCLN

SEQ ID NO: 201437 - protein, 309 aa, Glycine max
  Coding DNA Sequence Number=SeqID_84659
  Gene Ontology: Mol. function=serine-type endopeptidase activity; Cellular component=nucleus; Biological process=proteolysis
  Homolog annotation: Hit_ID=Q9LFE2; Match level="QueryCoverage=99%, HitCoverage=73%, E-value=1e-104, Identity=38%"; Hit description=WD40- repeat protein
  Pfam annotation: Domain name=WD40; Domain location=134-174; Score =16.9; E_value=0.072; Accession=PF00400.22; Description=WD domain, G -beta repeat
  Pfam annotation: Domain name=WD40; Domain location=185-223; Score =19.1; E_value=0.016; Accession=PF00400.22; Description=WD domain, G -beta repeat
  Pfam annotation: Domain name=WD40; Domain location=247-306; Score =3.8; E_value=13; Accession=PF00400.22; Description=WD domain, G-beta repeat
  Pfam annotation: Domain name=WD40; Domain location=50-88; Score=23.1; E_value=0.00097; Accession=PF00400.22; Description=WD domain, G-beta repeat
  Pfam annotation: Domain name=WD40; Domain location=92-130; Score =51.1; E_value=3.7e-12; Accession=PF00400.22; Description=WD domain, G-beta repeat
  Pfam module annotation: Pfam domain module=WD40::WD40::WD40::WD40::WD4 0; Domain location=134-174::185-223::247-306::50-88::92-130
MEPLRLKTNYRCVPALQQFYTGGPFVVSSDSSFIACACGESIKIVDSATAAIRSTLDADSESFTALALSPDDRLLFSSGHSRQIRVWDLSTLKCVRSWKGHEGPVMCMTCHPSGGLLATGGADRKVLVWDVDGGYCTHYFKGHGGVVSCVMFHSDPEKQLLFSGSDDGGDHATVRVWDISKTKKKNCIATLDNHSSAVTSLALSEDGWTLLSAGRDKAGSISLHLTICFTLPFQMNIVVTLWDLHGYSGKKTVITNEAVEAVCVIGAGSPFASSLDLYQQNAKIHDGSEIFYFITVGERGIVRIWNSKG

SEQ ID NO: 201438 - protein, 272 aa, Glycine max
  Coding DNA Sequence Number=SeqID_84660
  Gene Ontology: Mol. function=serine-type endopeptidase activity; Cellular component=nucleus; Biological process=proteolysis
  Homolog annotation: Hit_ID=Q9LFE2; Match level="QueryCoverage=92%, HitCoverage=67%, E-value=1e-100, Identity=35%"; Hit description=WD40- repeat protein
  Pfam annotation: Domain name=WD40; Domain location=116-154; Score =34.9; E_value=2.9e-07; Accession=PF00400.22; Description=WD domain, G-beta repeat
  Pfam annotation: Domain name=WD40; Domain location=158-196; Score =41.3; E_value=3.2e-09; Accession=PF00400.22; Description=WD domain, G-beta repeat
  Pfam annotation: Domain name=WD40; Domain location=18-59; Score=39.1; E_value=1.6e-08; Accession=PF00400.22; Description=WD domain, G-beta repeat
  Pfam annotation: Domain name=WD40; Domain location=200-238; Score =37.7; E_value=4e-08; Accession=PF00400.22; Description=WD domain, G -beta repeat
  Pfam annotation: Domain name=WD40; Domain location=63-102; Score =38.6; E_value=2.1e-08; Accession=PF00400.22; Description=WD domain, G-beta repeat
  Pfam module annotation: Pfam domain module=WD40::WD40::WD40::WD40::WD4 0; Domain location=116-154::158-196::18-59::200-238::63-102
MYKPTGALQIRVYDLSSMSCSYVLSGHTEIVLCLDSCVSSSGKPLIVTGSKDNSVRLWEPESANCIGVGIGHMGAVGAIAFSKRKRDFFVSGSSDHTLKVWSMDGLLDNMTVPINLKAKAVVAAHDKDINSVAVAPNDSLVCSGSQDRTACVWRLPDLVSVVVFKGHKRGIWSVEFSPVDQCVVTASGDKTIRIWAISDGSCLKTFEGHTSSVLRALFVTRGTQIVSCGADGLVKLWTVKTNECVATYDHHEDKVPVDPLIYLFSDDFSFNS

SEQ ID NO: 201439 - protein, 175 aa, Glycine max
  Coding DNA Sequence Number=SeqID_84661
  Gene Ontology: Mol. function=transporter activity; Cellular component= integral to membrane; Biological process=transport
  Homolog annotation: Hit_ID=P93389; Match level="QueryCoverage=81%, HitCoverage=35%, E-value=5e-51, Identity=68%"; Hit description =Phosphate/phosphoenolpyruvate translocator
  Pfam annotation: Domain name=DUF6; Domain location=35-166; Score=8.0; E_value=0.023; Accession=PF00892.11; Description=Integral membrane protein DUF6
  Pfam annotation: Domain name=TPT; Domain location=35-166; Score =148.0; E_value=2.5e-41; Accession=PF03151.7; Description=Triose -phosphate Transporter family
  Pfam module annotation: Pfam domain module=DUF6::TPT; Domain location= 35-166::35-166
MWLVTRIPSKGERREEMQTSERNICGHLSSNKWHFLFCKKVMVNKEESMDNITLFSIITVMSFLLSVPVTLLMEGVKFTPAYLQSAGLNVNEVYIRSLLAALCFHAYQQVSYMILQKVSPVTHSVGNCVKRVVVIVSSVIFFQTPVSPINALGTAIALAGVFLYSRVKRLKPKTT

SEQ ID NO: 201440 - protein, 489 aa, Glycine max
  Coding DNA Sequence Number=SeqID_84662
  Gene Ontology: Mol. function=DNA binding; Cellular component=nucleus; Biological process=regulation of transcription, DNA-dependent
  Homolog annotation: Hit_ID=Q9S7L2; Match level="QueryCoverage=78%, HitCoverage=96%, E-value=6e-86, Identity=46%"; Hit description =Transcription factor MYB98
  Pfam annotation: Domain name=Myb_DNA-binding; Domain location=206 -252; Score=56.1; E_value=1.1e-13; Accession=PF00249.21; Description =Myb-like DNA-binding domain
  Pfam annotation: Domain name=Myb_DNA-binding; Domain location=258 -303; Score=60.7; E_value=4.7e-15; Accession=PF00249.21; Description =Myb-like DNA-binding domain
  Pfam module annotation: Pfam domain module=Myb_DNA-binding::Myb_DNA -binding; Domain location=206-252::258-303
MSPSSVSVTPLMDNIETNLTENYASESKPMHLQENYLKPSMEDQLPFGTPSTQGFLQDSHHIDHLQFHVNGSSSSNPIFGVQTPNFDPFDHNVTCESAPPDFEAYECKLFAESNGSGHAHLMDNFQYVGYSLNLPRTNQLDLMVANQSYVPFNALETKPLNFVVPDEVSCISPPNYYKRVGLNKNLRESPSTRITFKARKKSNIVKGQWTSDEDRLLIQLVEQYGLRKWSHIAQALPGRIGKQCRERWHNHLRPDIKKDIWTEEEDKILIQAHAEIGNKWAEIAKKLPGRTENSIKNHWNATKRRQYSKRKCRSKYPRGSLLQEYIKSLNLDKNPPIDYRKKSDKNANAKTNNNGKAAAQPQCADQFCPNGQIVPRYDFNEVPDFSLDDNLFEEGCSIDSLLDDMQSASTVDHEKDFDGKIMQCAPTMDGKQSHHQVGIQCVHVVDEHHHDHETEMVAHTMGNEVKKEFDLVEMMSHMNGSHYSTHSPR

SEQ ID NO: 201441 - protein, 627 aa, Glycine max
  Coding DNA Sequence Number=SeqID_84663
  Gene Ontology: Mol. function=inorganic anion exchanger activity; Cellular component=integral to membrane; Biological process=anion transport
  Homolog annotation: Hit_ID=Q7X9F3; Match level="QueryCoverage=98%, HitCoverage=86%, E-value=0.0, Identity=76%"; Hit description=Boron transporter
  Pfam annotation: Domain name=HCO3_cotransp; Domain location=7-550; Score=-97.5; E_value=7.8e-13; Accession=PF00955.11; Description=HCO3- transporter family
MEETFVPLRGIKNDLKGRLMCYKQDWTSGIRAGIRILAPTTYIFFASAIPVISFGEQLERNTDGTLTAVQTLASTALCGIIHSVLGGQPLLILGVAEPTVLMYTFLYDFAKDRKDLGHKLFLPWTGWVCVWTAVLLFLLAILGACSIINRFTRLAGELFGLLIAMLFMQQAIRGLVEEFGVLQSQREGTNQIALQSSWLFGNGMFALVLSFGLLFTALRSRKARSWRYGAGWLRGFVADYGVPLMILVWTAVSYIPTNKVPRGIPRRLFSPNPWSPGAYSNWTEMLNVPLIYIIGAFIPATMIAVLYYFDHSVASQLAQQKEFNLRKPSSYHYDLLLLGFLTILCGLIGIPPSNGVIPQSPMHTKSLATLKHQLLRNKLVSAARKSMQKNMNLCQLYRNMQEAYDQMQTPLARQIPPALGLKELKESTIQLASSHGYIDSPVDEAVFDVDKDVDDLLPVEVKEQRLSNLLQALMVAACVAAMPLLKKIPTSVLWGYFAFMAIESLPGNQFWERILYLFTAPSRRYKVMEEHHAAFIETVPFKTVAMFTLFQTAYLLLCFGLTWIPIAGVLFPLLIMLLIPVRQYFLPKFFKGAHLQELDAAAYEETPAISFNLSFDVGFRKSDNNSQ

SEQ ID NO: 201442 - protein, 191 aa, Glycine max
  Coding DNA Sequence Number=SeqID_84664
MAPEELEQLTQQIRDQLEESIIEKVTRQLMLSFSQMQSQFQSQIQSQGLALPPEPKVGPSIARVSTKGSCVDPSATDPDMGDSDKCGLYIKENPSRLVALGRVYEGSTMVHNIPLLHGSEAGSPAKPADRPDHEVDDPLYFDDIDHPTTFFEASPGYGGLSQPTLWREGDTRLTGASSKGGKCAESPPTFI

SEQ ID NO: 201443 - protein, 94 aa, Glycine max
  Coding DNA Sequence Number=SeqID_84665
MDNPISAICPLFYLRNKEVSEQNISINRGHDDNRECGGNDGSNNDSVNSVDNNNGYNNNNNDDDNNNNDSCSDSDLGDIGRSVNDPKNVGMDLI

SEQ ID NO: 201444 - protein, 227 aa, Glycine max
  Coding DNA Sequence Number=SeqID_84666
  Gene Ontology: Mol. function=hydrolase activity, acting on ester bonds; Cellular component=cytoplasm; Biological process=lipid metabolic process
  Homolog annotation: Hit_ID=Q9FM04; Match level="QueryCoverage=96%, HitCoverage=98%, E-value=1e-83, Identity=63%"; Hit description =Similarity to isoamyl acetate-hydrolyzing esterase
  Pfam annotation: Domain name=Lipase_GDSL; Domain location=6-185; Score=146.6; E_value=6.6e-41; Accession=PF00657.12; Description=GDSL- like LipaseAcylhydrolase
MMRSKIVLFGDSITEQSIRENGWGVPLANAYSRRADVLVRGYGGYNTRWAMFLLGHLFPLDSTKPPTATTIFFGANDAALLGRTSERQHVPIEEFKENLRKFVRHLKDCSPTMVIVLITPPPLSEEGRLAYARSVYGENATKIPERTNEVTGQYANACVEVAKEMGVWDGLHLTTEGNAVVYEEVINVFNEAGLSADNMPMDFPHHSKIDSKHPERAFQQNVCDIPL

SEQ ID NO: 201445 - protein, 349 aa, Glycine max
  Coding DNA Sequence Number=SeqID_84667
  Gene Ontology: Mol. function=2-C-methyl-D-erythritol 2,4 -cyclodiphosphate synthase activity; Biological process=terpenoid biosynthetic process
  Homolog annotation: Hit_ID=Q681X6; Match level="QueryCoverage=90%, HitCoverage=97%, E-value=6e-63, Identity=38%"; Hit description=MRNA, complete cds, clone: RAFL21-92-C23
MRFMTGSPKGTWQPIMTADTTTQSYWLNWRVLVCAILVLFSAIISSLIILKYEVSRKKATRNGNKEGEKETSSTLYEDEIWRPCLKGINPVWLLGFRVFAFAVLLVLLILIATEDGGSIFYFYTQWTFAAVTIYFGLGSLLSMHGCYQHLKKASGGKVGNVDGYAEQGIYDAPTPPQNSNPSNHEKGLGAPQEHLVRQTAGTWGYIFQILFQMIGGAVMLTDCVFWFIIVPFLTIKDYNINLLIISMHTINAVFLLGDTALNSLRFPWFRIGYFCMWTITYVIFQWIVHAIVKLWWPYPFLDLSSPYAPLCYFSMALLHIPCYGIFALIMKLKHSVLSTRYPDSYLCDT

SEQ ID NO: 201446 - protein, 387 aa, Glycine max
  Coding DNA Sequence Number=SeqID_84668
  Gene Ontology: Mol. function=protein serine/threonine kinase activity; Cellular component=mitochondrion; Biological process =protein amino acid phosphorylation
  Homolog annotation: Hit_ID=Q9FNE1; Match level="QueryCoverage=90%, HitCoverage=56%, E-value=8e-64, Identity=39%"; Hit description =Receptor-like serine/threonine kinase
  Pfam annotation: Domain name=DUF26; Domain location=168-221; Score =44.8; E_value=2.9e-10; Accession=PF01657.8; Description=Domain of unknown function DUF26
  Pfam annotation: Domain name=DUF26; Domain location=79-132; Score =69.5; E_value=1.1e-17; Accession=PF01657.8; Description=Domain of unknown function DUF26
  Pfam module annotation: Pfam domain module=DUF26::DUF26; Domain location=168-221::79-132
MTQLFNLISTWLILTSSSLLIPHAASYDFGIHETGLTCGASESPGSSASKFMAIMDTVSFQVKERGWGAQTLLGSGPPMYALGQCRRDLRPTECYTCFTQARQVLSRCVPKTAGRIYLDGCFLRYDNYSFFRESVDPHARHQRLPVVAGASERRGRTGGSSGGERDEGRGGVRCWGTLDKGTCERCLNAAGTRVQECVPNAQGRSLFTGCFLRYSTRKFYNDVALHGIKDSTNSRGIQHTIVGLLLVVLAAFICRKRIASSRRNKISDSCGASPGFAYVTGFSFRYDLLEKATNYFDPANKLGEGGAGSVFKGTLPSGGTVAVKRLFFNARQWTEGFFNELNLINEIQHKNVVKLLGCSIDGPESLLVYEFVPRGNLDQVLFGEFFT

SEQ ID NO: 201447 - protein, 138 aa, Glycine max
  Coding DNA Sequence Number=SeqID_84669
  Subcellular localization annotation: CTP_CleavageSite=22; ConfidenceScore=5.30e-01
MIHTTARSETQLSINHFNDFVVQMKRRRRRALIGKRRRKPTLPNPVPPPLPPSHAMPRVAIMEKRPTEKHIVIKKQTHEVNNFITDPFRSVFEGGLCLFAANWATNWRENSSKLVIGPSLKPLNQSRAIPVRVLGHHQ

SEQ ID NO: 201448 - protein, 268 aa, Glycine max
  Coding DNA Sequence Number=SeqID_84670
  Homolog annotation: Hit_ID=Q00TI9; Match level="QueryCoverage=55%, HitCoverage=65%, E-value=4e-08, Identity=31%"; Hit description=[S] KOG4608 Uncharacterized conserved protein
  Pfam annotation: Domain name=Tim17; Domain location=17-160; Score= -0.6; E_value=0.0067; Accession=PF02466.9; Description=Tim17Tim22Tim23 family
MEAPDNSEATVPYNSPKLAGTVNWGTATVVGVFAGMLYGGSKEAAASVSKDAEVMLKLGSTEDKREQYRLMRDAMEKRFIRVTRGSIVGGVRLGIFTAAFYCLQNLLAEKRGVHDVFNVVGAGSATASAFGLIRSLRWRARNMALGSVLGAAFCFPLGWIHLKLVEMANEGNPAAHPHSDQRQVKSGVSAAIERLEGNLIRVNLSRQSKPGILEKLKSMEELIGLLNLLSMEERCRLIASSLAHSSLVMTSENITEEIRVRGITGSSF

SEQ ID NO: 201449 - protein, 61 aa, Glycine max
  Coding DNA Sequence Number=SeqID_84671
MAMKRWRGRRRRGRGEGEEGEEGARAEGRDGGVTGLVSDGDACDDLEVEDAGSEGEDEVEG

SEQ ID NO: 201450 - protein, 182 aa, Glycine max
  Coding DNA Sequence Number=SeqID_84672
  Gene Ontology: Mol. function=protein serine/threonine kinase activity; Cellular component=mitochondrion; Biological process =protein amino acid phosphorylation
  Homolog annotation: Hit_ID=Q9FNE1; Match level="QueryCoverage=63%, HitCoverage=18%, E-value=2e-29, Identity=51%"; Hit description =Receptor-like serine/threonine kinase
MAPEYVINGQLTEKADIYAFGVLVIEIVSGKKNSDYIPESTSVLHSVWKNYNANIITSSVDPTLHGKFTAEEASNALQAGLLCTQSSDTLRPSMSEVVQMLTKKDYVIPSPNQQPFLNSIARILSSNGHASARSSFHSTTSSLIPNDDVTVLENSFSPYSRFNPTGSPDSNIQILGYLSQGR

SEQ ID NO: 201451 - protein, 130 aa, Glycine max
  Coding DNA Sequence Number=SeqID_84673
MEDAGIVTTRHPVDPEEPNRALGFPALATGLCQSYRAPVPPACSCHRDIGEYAHLSTDFRCHLLFVGITLARHSVDPEKSNRVLGFPALITGLCQFYGVPVTPSKVIRPPTNRAFIKKYCAPRQAEGETP

SEQ ID NO: 201452 - protein, 117 aa, Glycine max
  Coding DNA Sequence Number=SeqID_84674
  Gene Ontology: Mol. function=RNA-directed DNA polymerase activity; Biological process=RNA-dependent DNA replication
MAGEAHGQSFTQLDRRNVEAYVDDMVVKSTLENMHGADLQEIFDMINRYRLKLNSRRNARLTFKQEKFLNFMLSQRGIEANLDKCFAIVVESKQHKGSTIIVNRSDCFLIWLSFKIW

SEQ ID NO: 201453 - protein, 192 aa, Glycine max
  Coding DNA Sequence Number=SeqID_84675
  Gene Ontology: Mol. function=nucleotide binding
  Homolog annotation: Hit_ID=Q1T390; Match level="QueryCoverage=77%, HitCoverage=21%, E-value=1e-20, Identity=40%"; Hit description=ATP -binding region, ATPase-like
MTCSRRFRNGRYKTTAQKGGEWTLHMEICGEAIQGTKMSSIEIVDLCNSDDDEVENVGSEPAKKLIEIKKETCQVTENIIQVASEGNRSSSALSTCHSYSTRQMEEMVAPLYVDVDDTTGLSLPPFCRNFWRAGYHHDNNGLSSKLNFPNTGNYLHVHPFFLHSNATSHKWVFGAIAELIDNAVDEVILFGA

SEQ ID NO: 201454 - protein, 84 aa, Glycine max
  Coding DNA Sequence Number=SeqID_84676
MKGKAPMTEISSVEVEKGSKVDREKELRTIQYLQQIGETFVFGGINRIYNMVGKVYEVGSGLIGASEDLQPVCVCFLTLRALSG

SEQ ID NO: 201455 - protein, 171 aa, Glycine max
  Coding DNA Sequence Number=SeqID_84677
  Homolog annotation: Hit_ID=Q00M75; Match level="QueryCoverage=19%, HitCoverage=5%, E-value=3e-10, Identity=94%"; Hit description=PPR -repeat containing protein
MRASPGAAVKLCLGDLLVMGSNPETASLHMQGKIGCYNDNHKVRVILRLKVTMIPICMSKLKALTLSNVICNTVIIKRVLGLEMNHFEEWEVGECGGRVGGRRGWRFVAWRRVQGEGADGGGEWCGGGCEWGRVTQRRVRANWQRNANPMSTLESREEMDRGHIKPKKVEK

SEQ ID NO: 201456 - protein, 144 aa, Glycine max
  Coding DNA Sequence Number=SeqID_84678
MFNHHGQKLTSTNRRTQNLSSMRTFHKHFVNQEQPRLNHPWQKLKQYLTTLDKCKNWAVLDMERTLRSTKLKVIKFNIKPEIIVRYASSSAITTHDRGRRCTAAGLTAEKAKKIEGFCCGVKQQLKIVVPAKYEVGNRQCDKAR

SEQ ID NO: 201457 - protein, 46 aa, Glycine max
  Coding DNA Sequence Number=SeqID_84679
MTLTGLHMILPSESDLTYQGMKQMVRWIASRNIVLKDIGTQCSDRI

SEQ ID NO: 201458 - protein, 244 aa, Glycine max
  Coding DNA Sequence Number=SeqID_84680
  Gene Ontology: Mol. function=ATP binding
  Homolog annotation: Hit_ID=Q1T390; Match level="QueryCoverage=71%, HitCoverage=25%, E-value=3e-42, Identity=50%"; Hit description=ATP -binding region, ATPase-like
MRRVFHLGSTGFYVEFIRPWMLTIATSFCSVMLPSLRIESNLCKGLVCLGQQPFWKVVNYTNTRGRGVVGILQADYLEPTHNKQDFERTSLFQKLELRLKQMTWEYWDYHCHLIGYCKRSTGDPGAPLNKRKTHGSIDLHKMKRQAMQENVTVAGCDQNVLTTASPTDQTVDQRIINLMEVQKKLLKECLKYEKAEEELNLKVTQLRRKTQEAKHEYDTLMAEVKSLGLYLWEENGSVAVPLVF

SEQ ID NO: 201459 - protein, 938 aa, Glycine max
  Coding DNA Sequence Number=SeqID_84681
  Gene Ontology: Mol. function=protein binding; Cellular component =integral to membrane; Biological process=protein amino acid phosphorylation
  Homolog annotation: Hit_ID=Q9SN91; Match level="QueryCoverage=90%, HitCoverage=69%, E-value=0.0, Identity=44%"; Hit description=Leucine rich repeat-like protein
  Pfam annotation: Domain name=LRRNT_2; Domain location=4-43; Score =42.5; E_value=1.5e-09; Accession=PF08263.3; Description=Leucine rich repeat N-terminal domain
  Pfam annotation: Domain name=LRR_1; Domain location=120-142; Score =16.0; E_value=0.14; Accession=PF00560.23; Description=Leucine Rich Repeat
  Pfam annotation: Domain name=LRR_1; Domain location=144-166; Score =9.9; E_value=4.1; Accession=PF00560.23; Description=Leucine Rich Repeat
  Pfam annotation: Domain name=LRR_1; Domain location=168-190; Score =6.7; E_value=16; Accession=PF00560.23; Description=Leucine Rich Repeat
  Pfam annotation: Domain name=LRR_1; Domain location=192-214; Score =6.0; E_value=22; Accession=PF00560.23; Description=Leucine Rich Repeat
  Pfam annotation: Domain name=LRR_1; Domain location=216-238; Score =18.2; E_value=0.029; Accession=PF00560.23; Description=Leucine Rich Repeat
  Pfam annotation: Domain name=LRR_1; Domain location=240-262; Score =12.3; E_value=1.4; Accession=PF00560.23; Description=Leucine Rich Repeat
  Pfam annotation: Domain name=LRR_1; Domain location=264-287; Score =9.9; E_value=4.1; Accession=PF00560.23; Description=Leucine Rich Repeat
  Pfam annotation: Domain name=LRR_1; Domain location=288-307; Score =15.2; E_value=0.23; Accession=PF00560.23; Description=Leucine Rich Repeat
  Pfam annotation: Domain name=LRR_1; Domain location=313-335; Score =10.4; E_value=3.2; Accession=PF00560.23; Description=Leucine Rich Repeat
  Pfam annotation: Domain name=LRR_1; Domain location=337-359; Score =15.7; E_value=0.17; Accession=PF00560.23; Description=Leucine Rich Repeat
  Pfam annotation: Domain name=LRR_1; Domain location=361-383; Score =13.3; E_value=0.88; Accession=PF00560.23; Description=Leucine Rich Repeat
  Pfam annotation: Domain name=LRR_1; Domain location=385-407; Score =9.7; E_value=4.4; Accession=PF00560.23; Description=Leucine Rich Repeat
  Pfam annotation: Domain name=LRR_1; Domain location=409-431; Score =10.6; E_value=3; Accession=PF00560.23; Description=Leucine Rich Repeat
  Pfam annotation: Domain name=LRR_1; Domain location=433-455; Score =12.8; E_value=1.2; Accession=PF00560.23; Description=Leucine Rich Repeat
  Pfam annotation: Domain name=LRR_1; Domain location=457-479; Score =10.3; E_value=3.4; Accession=PF00560.23; Description=Leucine Rich Repeat
  Pfam annotation: Domain name=LRR_1; Domain location=48-70; Score=8.5; E_value=7.4; Accession=PF00560.23; Description=Leucine Rich Repeat
  Pfam annotation: Domain name=LRR_1; Domain location=481-503; Score =13.3; E_value=0.9; Accession=PF00560.23; Description=Leucine Rich Repeat
  Pfam annotation: Domain name=LRR_1; Domain location=505-527; Score =13.8; E_value=0.62; Accession=PF00560.23; Description=Leucine Rich Repeat
  Pfam annotation: Domain name=LRR_1; Domain location=529-550; Score =8.4; E_value=7.7; Accession=PF00560.23; Description=Leucine Rich Repeat
  Pfam annotation: Domain name=LRR_1; Domain location=552-574; Score =15.5; E_value=0.19; Accession=PF00560.23; Description=Leucine Rich Repeat
  Pfam annotation: Domain name=LRR_1; Domain location=576-598; Score =11.5; E_value=2; Accession=PF00560.23; Description=Leucine Rich Repeat
  Pfam annotation: Domain name=LRR_1; Domain location=600-622; Score =15.2; E_value=0.24; Accession=PF00560.23; Description=Leucine Rich Repeat
  Pfam annotation: Domain name=LRR_1; Domain location=624-646; Score =9.6; E_value=4.5; Accession=PF00560.23; Description=Leucine Rich Repeat
  Pfam annotation: Domain name=LRR_1; Domain location=648-670; Score =13.7; E_value=0.66; Accession=PF00560.23; Description=Leucine Rich Repeat
  Pfam annotation: Domain name=LRR_1; Domain location=672-694; Score =15.7; E_value=0.17; Accession=PF00560.23; Description=Leucine Rich Repeat
  Pfam annotation: Domain name=LRR_1; Domain location=696-718; Score =12.1; E_value=1.5; Accession=PF00560.23; Description=Leucine Rich Repeat
  Pfam annotation: Domain name=LRR_1; Domain location=72-94; Score =20.7; E_value=0.0053; Accession=PF00560.23; Description=Leucine Rich Repeat
  Pfam annotation: Domain name=LRR_1; Domain location=720-742; Score =14.4; E_value=0.41; Accession=PF00560.23; Description=Leucine Rich Repeat
  Pfam annotation: Domain name=LRR_1; Domain location=745-767; Score =1.7; E_value=1.3e+02; Accession=PF00560.23; Description=Leucine Rich Repeat
  Pfam annotation: Domain name=LRR_1; Domain location=769-791; Score =17.8; E_value=0.038; Accession=PF00560.23; Description=Leucine Rich Repeat
  Pfam annotation: Domain name=LRR_1; Domain location=793-815; Score =19.2; E_value=0.015; Accession=PF00560.23; Description=Leucine Rich Repeat
  Pfam annotation: Domain name=LRR_1; Domain location=96-118; Score =15.6; E_value=0.18; Accession=PF00560.23; Description=Leucine Rich Repeat
  Pfam module annotation: Pfam domain module=LRRNT_2::LRR_1::LRR_1::LRR_ 1::LRR_1::LRR_1::LRR_1::LRR_1::LRR_1::LRR_1::LRR_1::LRR_1::LRR_1::LRR_ 1::LRR_1::LRR_1::LRR_1::LRR_1::LRR_1::LRR_1::LRR_1::LRR_1::LRR_1::LRR_ 1::LRR_1::...
  Pfam module annotation: Pfam domain module=LRR_1::LRR_1::LRR_1::LRR _1::LRR_1::LRR_1::LRR_1::LRR_1; Domain location=4-43::120-142::144 -166::168-190::192-214::216-238::240-262::264-287::288-307::313 -335::337-359::361-383::...
  Pfam module annotation: Domain location=385-407::409-431::433 -455::457-479::48-70::481-503::505-527::529-550::552-574::576 -598::600-622::624-646::648-670::672-694::696-718::72-94::720 -742::745-767::769-791::793-815::96-118
MANNATDSYLLLKVKSELVDPLGAFSNWFPTTQFCNWNGITCAVDQEHVIGLNLSGSGISGSISVELGNFTSLQTLDLSSNSLSGSIPSELGQLQNLRILQLYSNDLSGNIPSEIGNLRKLQVLRIGDNMLTGEIPPSVANMSELKVLALGYCHLNGSIPFGIGKLKHLISLDVQMNSINGHIPEEIEGCEELQNFAASNNMLEGDLPSSMGSLKSLKILNLANNSLSGSIPTALSHLSNLTYLNLLGNKLHGEIPSELNSLIQMQKLDLSKNNLSGSIPLLNVKLQSLETLVLSDNALTGSIPSNFCLRGSKLQQLFLARNMLSGKFPLELLNCSSIQQLDLSDNSFEGKLPSILDKLQNLTDLVLNNNSFVGSLPPEIGNISSLENLFLFGNFFKGKIPLEIGRLQRLSSIYLYDNQMSGLIPRELTNCTSLKEIDFFGNHFTGPIPETIGKLKDLVVLHLRQNDLSGPIPPSMGYCKSLQILALADNMLSGSIPPTFSYLSELTKITLYNNSFEGPIPHSLSSLKSLKIINFSHNKFSGSFFPLTCSNSLTLLDLTNNSFSGPIPSTLANSRNLGRLRLGQNYLTGTIPSEFGQLTELNFLDLSFNNLTGEVPPQLSNSKKMEHILMNNNRLSGEISDWLGSLQELGELDLSYNNFSGKVPSELGNCSKLLKLSLHHNNLSGEIPQEIGNLTSLNVLNLQRNGFSGLIPPTIQQCTKLYELRLSENLLTGVIPVELGGLAELQVILDLSKNLFTGEIPPSLGNLMKLERLNLSFNQLEGKVPSSLGKLTSLHVLNLSNNHLEGKIPSTFSGFPLSTFLNNSGLCGPPLRSCSESMVQGKIQLSNTQVAIIIVAIVFTSTVICLVMLYIMLRIWCNWRKVTISSAEGGGTVGHKTRNGEYWNMNSFGFIPSPDKQNSATTTSFYNLKMETMENTNM

SEQ ID NO: 201460 - protein, 70 aa, Glycine max
  Coding DNA Sequence Number=SeqID_84682
  Homolog annotation: Hit_ID=Q1T390; Match level="QueryCoverage=61%, HitCoverage=6%, E-value=2e-10, Identity=72%"; Hit description=ATP -binding region, ATPase-like
MKQSPCLFSLFFLYRCLEYEKAEEELNLKVTQLRSKIQKPKHEYDTLLAEVKSLGLWEENDNVADVPLAI

SEQ ID NO: 201461 - protein, 93 aa, Glycine max
  Coding DNA Sequence Number=SeqID_84683
MEQELQELHGYSIGQVKPIVTIGIVILSCLIIREAIEEKYSFTKCRVRESLLFAEGSSSCLGLNGLVEEEKSQLHNRKLLLVRTIGGKLELKN

SEQ ID NO: 201462 - protein, 110 aa, Glycine max
  Coding DNA Sequence Number=SeqID_84684
MVNMTHSSSALGLSKIINLHEIELDSSKSQGTVQSWKRECTGYSWKIRRLGETLEKQLQKGAKRGEGEGDLWELEAMGFGSERKRRVRWRMRKRKKKELKDVTVELPYHP

SEQ ID NO: 201463 - protein, 536 aa, Glycine max
  Coding DNA Sequence Number=SeqID_84685
  Gene Ontology: Mol. function=hydrolase activity; Cellular component =membrane; Biological process=response to chemical stimulus
  Homolog annotation: Hit_ID=UPI000034F0B7; Match level="QueryCoverage =82%, HitCoverage=58%, E-value=5e-73, Identity=36%"; Hit description =hydrolase
  Pfam annotation: Domain name=GDA1_CD39; Domain location=43-494; Score= 67.8; E_value=3.6e-17; Accession=PF01150.8; Description=GDA1CD39 (nucleoside phosphatase) family
MEVPKSPSKYKRIAKHKWLIKFALLILMMLLLFLGFYLESDTRGKLNASSYYTVVVDCGSTGTRVNVYEWMVGVKGISKGNLPSLLHSYPDNTTRSSSLWKNSCQYHCMQTEPGLHSFVNDSLGVRKALEPLIVWAEHLVPREMHRKTPVFVLATAGLRRLPGLEAEWVLGEVEAVVKDHNFMFSKSWIRVLSGREEAYYGWVALNYKMGSFYSYLDSPTLGLVDLGGSSLQVVVETDGAGDDVHMMRSKLSSMEHQIMAFSLPAFGLNEAFDRTVLMLRNNQSEERTELRHPCLVSTFLQNYTCHSCSGLASIYQKNRSQHQEGELHSLRLTGEPDWEQCKELAIAAAMNLSDSKLSQTVSKNCQASSFSGIGKGTGILNLTAVAHPIKFHALSGFFFVYNKLKLSPRTNLTMVWESGKQLCSNLWSGLSNVSDNPKYAGQFCFRVAYMASLIEYGLCLGDVEMVFGPGDISWTLGAALIEGKFLCQVKLPMPSRRASAPGSSLPSYTHPEDSDMEYGLYLHYRIEAELPSFQAL

SEQ ID NO: 201464 - protein, 376 aa, Glycine max
  Coding DNA Sequence Number=SeqID_84686
  Gene Ontology: Mol. function=protein binding; Cellular component=CD95 death-inducing signaling complex; Biological process=proteasomal ubiquitin-dependent protein catabolic process
  Homolog annotation: Hit_ID=Q2L3D7; Match level="QueryCoverage=95%, HitCoverage=93%, E-value=3e-77, Identity=41%"; Hit description=ETEA -like (Expressed in T-cells and eosinophils in atopic dermatitis) protein
  Pfam annotation: Domain name=UBX; Domain location=289-370; Score =89.4; E_value=1.1e-23; Accession=PF00789.11; Description=UBX domain
MPSTVRDHGIVRRMASLPRSIMEFIGRGRRRNQHTNFPLQPQDHHHDPQPHGQVVVQDEWSFLESFEQQFGTKHPFFYACRFMEAIKLAEHDHKFLFMYLHSPDHPFANVFCKETLCSEPVIQFLDVNFVCWGGLVDRGEGVQMVATLSPATFPCCAVIAPTPGESIAVLQQLEGPLSPAELAGILQRTLEEQGVAFGSDRAKQEEKIRADRRLREEQDAAYLAALQIDKEKDKPNSLPPRERLQKPGEAHNNRNYGKLLNNSINVTKQNSKVNESNKEKRDKGVASKGSESQPTQILIRFPNGERREHTFLYTDRIQSIFSYIDSLGLPWIGNYRLISNFPRRAYGVDQMRMTLKEAGLYPKASVFLEPLGTRVP

SEQ ID NO: 201465 - protein, 216 aa, Glycine max
  Coding DNA Sequence Number=SeqID_84687
MQTDEETEQKIKEHKDTTSEDACQTQGSSLVSLEKTQIGASLVVAPKAHQTQGLPLGSLTPKCSSNPRFVLGESPFSKDSLNPWPALGESCFSKGFSNPWPALGESHSPKAHQTQGLSLLNLASPKAHQTQVLSLVSLASPKACQTQGSSLVSLASPKTHQTQGLPLALQIKGSPLVSLDASVQACQAQGPPMVSLAKTQDEHIPGLKLIKPNVHP

SEQ ID NO: 201466 - protein, 460 aa, Glycine max
  Coding DNA Sequence Number=SeqID_84688
  Gene Ontology: Mol. function=ubiquitin thiolesterase activity; Cellular component=intracellular; Biological process=ubiquitin -dependent protein catabolic process
  Homolog annotation: Hit_ID=Q93X76; Match level="QueryCoverage=95%, HitCoverage=94%, E-value=1e-170, Identity=64%"; Hit description =Putative carboxyl-terminal proteinase
  Pfam annotation: Domain name=DUF239; Domain location=242-419; Score =336.9; E_value=3.5e-98; Accession=PF03080.5; Description=Arabidopsis proteins of unknown function
MKGYSVSWTKQHQKELFFAAHHTTRQHQCIQANHDATEETSSQQQNQYSLKLALSSTSQNTMLHAFVALLLLVTSIGTAFSHPTIASNSSSTLPAALSHFHANNNTLRPSAVLQKLRRIRAHLNKSNKPASPDGDLIDCVLSHQQPAFDHPQLKGQRPLDPPERPKGHTHTNGETVIESFQLWTDSGEACPEGTVPIRRTTEQDFLRASSVRRFGRKPRNVRRDSTGTGHEHAVVSVNGDQYYGAKASINVWTPSVTDPYEFSLSQIWVSPELYGDNYPRFFTYWTTDAYQATGCYNLLCSGFVQTNNRIAIGAAISPRSIYNGRQFDIGLMVWKDPKHGHWWLEFGSGLLVGYWPAYLFSHLRNHASMVQFGGEIVNSRSRGYHTGTQMGSGHFSGEGFRKAAYFRNLQVVDWDNNLLPLSNIHQLADHSNCYDIRMGSNSVWGTYFYYGGPGRNVRCP

SEQ ID NO: 201467 - protein, 965 aa, Glycine max
  Coding DNA Sequence Number=SeqID_84689
  Gene Ontology: Mol. function=protein serine/threonine kinase activity; Cellular component=integral to membrane; Biological process=protein amino acid phosphorylation
  Homolog annotation: Hit_ID=Q5VQM7; Match level="QueryCoverage=95%, HitCoverage=83%, E-value=0.0, Identity=51%"; Hit description =Putative receptor-like protein kinase INRPK1
  Pfam annotation: Domain name=LRRNT_2; Domain location=28-68; Score =50.5; E_value=5.5e-12; Accession=PF08263.3; Description=Leucine rich repeat N-terminal domain
  Pfam annotation: Domain name=LRR_1; Domain location=120-142; Score =16.8; E_value=0.08; Accession=PF00560.23; Description=Leucine Rich Repeat
  Pfam annotation: Domain name=LRR_1; Domain location=144-166; Score =15.6; E_value=0.18; Accession=PF00560.23; Description=Leucine Rich Repeat
  Pfam annotation: Domain name=LRR_1; Domain location=168-190; Score =9.9; E_value=4; Accession=PF00560.23; Description=Leucine Rich Repeat
  Pfam annotation: Domain name=LRR_1; Domain location=192-215; Score =10.7; E_value=2.8; Accession=PF00560.23; Description=Leucine Rich Repeat
  Pfam annotation: Domain name=LRR_1; Domain location=217-239; Score =9.6; E_value=4.6; Accession=PF00560.23; Description=Leucine Rich Repeat
  Pfam annotation: Domain name=LRR_1; Domain location=241-263; Score =5.4; E_value=28; Accession=PF00560.23; Description=Leucine Rich Repeat
  Pfam annotation: Domain name=LRR_1; Domain location=265-287; Score =15.2; E_value=0.23; Accession=PF00560.23; Description=Leucine Rich Repeat
  Pfam annotation: Domain name=LRR_1; Domain location=289-311; Score =12.8; E_value=1.1; Accession=PF00560.23; Description=Leucine Rich Repeat
  Pfam annotation: Domain name=LRR_1; Domain location=313-335; Score =9.8; E_value=4.2; Accession=PF00560.23; Description=Leucine Rich Repeat
  Pfam annotation: Domain name=LRR_1; Domain location=337-359; Score =14.2; E_value=0.47; Accession=PF00560.23; Description=Leucine Rich Repeat
  Pfam annotation: Domain name=LRR_1; Domain location=361-383; Score =16.9; E_value=0.075; Accession=PF00560.23; Description=Leucine Rich Repeat
  Pfam annotation: Domain name=LRR_1; Domain location=385-407; Score =15.5; E_value=0.19; Accession=PF00560.23; Description=Leucine Rich Repeat
  Pfam annotation: Domain name=LRR_1; Domain location=409-431; Score =16.3; E_value=0.11; Accession=PF00560.23; Description=Leucine Rich Repeat
  Pfam annotation: Domain name=LRR_1; Domain location=433-455; Score =8.8; E_value=6.6; Accession=PF00560.23; Description=Leucine Rich Repeat
  Pfam annotation: Domain name=LRR_1; Domain location=457-479; Score =10.1; E_value=3.7; Accession=PF00560.23; Description=Leucine Rich Repeat
  Pfam annotation: Domain name=LRR_1; Domain location=481-503; Score =15.4; E_value=0.2; Accession=PF00560.23; Description=Leucine Rich Repeat
  Pfam annotation: Domain name=LRR_1; Domain location=505-527; Score =11.3; E_value=2.2; Accession=PF00560.23; Description=Leucine Rich Repeat
  Pfam annotation: Domain name=LRR_1; Domain location=529-551; Score =14.1; E_value=0.52; Accession=PF00560.23; Description=Leucine Rich Repeat
  Pfam annotation: Domain name=LRR_1; Domain location=553-575; Score =10.2; E_value=3.5; Accession=PF00560.23; Description=Leucine Rich Repeat
  Pfam annotation: Domain name=LRR_1; Domain location=577-599; Score =17.2; E_value=0.059; Accession=PF00560.23; Description=Leucine Rich Repeat
  Pfam annotation: Domain name=LRR_1; Domain location=626-647; Score =3.8; E_value=57; Accession=PF00560.23; Description=Leucine Rich Repeat
  Pfam annotation: Domain name=LRR_1; Domain location=649-670; Score =11.4; E_value=2.1; Accession=PF00560.23; Description=Leucine Rich Repeat
  Pfam annotation: Domain name=LRR_1; Domain location=72-94; Score=1.9; E_value=1.3e+02; Accession=PF00560.23; Description=Leucine Rich Repeat
  Pfam annotation: Domain name=LRR_1; Domain location=96-118; Score =14.4; E_value=0.41; Accession=PF00560.23; Description=Leucine Rich Repeat
  Pfam annotation: Domain name=Pkinase; Domain location=778-965; Score =19.0; E_value=1.1e-09; Accession=PF00069.15; Description=Protein kinase domain
  Pfam annotation: Domain name=Pkinase_Tyr; Domain location=778-965; Score=-53.6; E_value=3.5e-09; Accession=PF07714.7; Description =Protein tyrosine kinase
  Pfam module annotation: Pfam domain module=LRRNT_2::LRR_1::LRR_1::LRR_ 1::LRR_1::LRR_1::LRR_1::LRR_1::LRR_1::LRR_1::LRR_1::LRR_1::LRR_1::LRR_ 1::LRR_1::LRR_1::LRR_1::LRR_1::LRR_1::LRR_1::LRR_1::LRR_1::LRR_1::LRR_ 1::LRR_1::...
  Pfam module annotation: Pfam domain module=Pkinase::Pkinase_Tyr; Domain location=28-68::120-142::144-166::168-190::192-215::217 -239::241-263::265-287::289-311::313-335::337-359::361-383::385 -407::409-431::433-455::...
  Pfam module annotation: Domain location=457-479::481-503::505 -527::529-551::553-575::577-599::626-647::649-670::72-94::96-118::778- 965::778-965
MPVNPWTLFFLCISLLLLPFHSFIAAAVNQQGEGLLSWKRTLNGSLEVLSNWDPVQDTPCSWYGVSCNFKKEVVQLDLRYVDLLGRLPTNFTSLLSLTSLILTGTNLTGSIPKEIGELVELSYLDLSDNALSGEIPSELCYLPKLEELHLNSNDLVGSIPVAIGNLMKLQKLILYDNQLGGEVPGTVGNLKSLQVLRAGGNKNLEGPLPQEIGNCSSLVMLGLAETSLSGSLPPSLGFLKNLETIAIYTSLLSGEIPPELGDCTELQNIYLYENSLTGSIPSKLGNLKKLENLLLWQNNLVGTIPPEIGNCDMLSVIDVSMNSLTGSIPKTFGNLTSLQELQLSVNQISGEIPGELGKCQQLTHVELDNNLITGTIPSELGNLANLTLLFLWHNKLQGNIPSSLPNCQNLEAIDLSQNGLTGPIPKGIFQLKNLNKLLLLSNNLSGKIPSEIGNCSSLIRFRANDNNITGNIPSQIGNLNNLNFLDLGNNRISGVLPEEISGCRNLAFLDVHSNFIAGNLPESLSRLNSLQFLDVSDNMIEGTLNPTLGELAALSKLVLAKNRISGSIPSQLGSCSKLQLLDLSSNNISGEIPGSIGNIPALEIALNLSLNQLSSEIPQEFSGLTKLGILDISHNVLRGNLQYLVGLQNLVVLNISYNKFSGRVPDTPFFAKLPLSVLAGNPALCFSGNECSGDGGGGGRSGRRARVARVAMVVLLCTACVLLMAALYVVVAAKRRGDRESDVEVVDGKDSDVDMAPPWQVTLYQKLDLSISDVAKCLSAGNVIGHGRSGVVYRVDLPAATGLAIAVKKFRLSEKFSAAAFSSEIATLARIRHRNIVRLLGWGANRRTKLLFYDYLQNGNLDTLLHEGCTGLIDWETRLRIALGVAEGVAYLHHDCVPAILHRDVKAQNILLGDRYEPCLADFGFARFVQEDHASFSVNPQFAGSYGYIAPGRVRVDIGIFSHEF

SEQ ID NO: 201468 - protein, 248 aa, Glycine max
  Coding DNA Sequence Number=SeqID_84690
  Pfam annotation: Domain name=zf-CCHC; Domain location=136-153; Score =10.2; E_value=0.021; Accession=PF00098.13; Description=Zinc knuckle
MCRCHRNLGNLRSDSSRSAKVDVSLSELNALSECHPLCEASKRLADRRNLEGNLSRRHALSMSSTRSVSHLSPSRLSASLSMSESSLTRAKRDVELLEKHLKERHSMYKFQKVSIELGNPKEETKGNFKRIAQKIYTCFECEKQDHIKVGCPTFLKKQQGGEKMSFKKKRAYIALDNNDESSSRDSIEEEEANLCLMAEFDKDETKINVSDSSSKSNTNYDNLLEAFKELNEEAQRLNFVNKNSKRLS

SEQ ID NO: 201469 - protein, 143 aa, Glycine max
  Coding DNA Sequence Number=SeqID_84691
  Gene Ontology: Mol. function=protein-tyrosine kinase activity; Cellular component=integral to membrane; Biological process=protein amino acid phosphorylation
  Homolog annotation: Hit_ID=Q8L3Y5; Match level="QueryCoverage=90%, HitCoverage=15%, E-value=5e-47, Identity=71%"; Hit description =Receptor-like kinase RHG1
  Pfam annotation: Domain name=LRRNT_2; Domain location=16-58; Score =30.4; E_value=6.1e-06; Accession=PF08263.3; Description=Leucine rich repeat N-terminal domain
  Pfam annotation: Domain name=LRR_1; Domain location=109-131; Score =11.9; E_value=1.7; Accession=PF00560.23; Description=Leucine Rich Repeat
  Pfam annotation: Domain name=LRR_1; Domain location=85-107; Score =11.1; E_value=2.4; Accession=PF00560.23; Description=Leucine Rich Repeat
  Pfam module annotation: Pfam domain module=LRRNT_2::LRR_1::LRR_1; Domain location=16-58::109-131::85-107
MVPVVSEERWDGVVVTQSNFLALQAFKQELVDPKGFLRSWNDSGYGACSGAWVGIKCAQGQFIVIQLPWKGLKGHITKRICQLRGLIKLSLHDNQIGGSIPSALGLLLNLRGVHLFNNKFTGTIPPSLGSFPLLQSLDLNNNL

SEQ ID NO: 201470 - protein, 44 aa, Glycine max
  Coding DNA Sequence Number=SeqID_84692
MASTTKTYIVIVSTKTSKNCFVPMEWLQGNQRSSFKDNSSDLRM

SEQ ID NO: 201471 - protein, 153 aa, Glycine max
  Coding DNA Sequence Number=SeqID_84693
  Subcellular localization annotation: CTP_CleavageSite=52; ConfidenceScore=5.69e-01
MTTPPNSPHPPPPPTDATSQSLSSLKRTRKATQLRSLVTRPAGAERLVVHVNPATKKADGPHKKKLKTYLGIITRDKVDVTYENWKQVPTAQKHLIWQDIQIVGEWWRQFKSDLTSKWTLATDKDNVDDTICKKYDISKEKWAQFCHSCKDPS

SEQ ID NO: 201472 - protein, 223 aa, Glycine max
  Coding DNA Sequence Number=SeqID_84694
  Pfam annotation: Domain name=Transposase_23; Domain location=37-107; Score=4.0; E_value=0.00042; Accession=PF03017.5; Description =TNP1ENSPM transposase
MQSQGLALPPEPEVVPSSARVSTKESCVDPLGNDPDTGDLDKCGLYIEEHPPRLVALGRVYEGSTIVHNIPLLHDQVKVSVEDVRDADAPIPVPTEEVNLVGNALNTFLAWSTHLVKRFSEHDATVFGVFNEDFPLYIKHEDLSKIAHGDQCLNIFVIQLWILAHRQMVVILPKENLVVWFCSLHNRPNFVIYFNDARPLELERLKAFRIQWAKYYLKVRNET

SEQ ID NO: 201473 - protein, 140 aa, Glycine max
  Coding DNA Sequence Number=SeqID_84695
  Gene Ontology: Mol. function=structural molecule activity; Cellular component=extracellular region; Biological process=keratinization
  Homolog annotation: Hit_ID=UPI0000612705; Match level="QueryCoverage =97%, HitCoverage=92%, E-value=4e-19, Identity=31%"; Hit description =UPI0000612705 related cluster
MTGPLDESISCFLIRVDPWVLVPIAFIRGLHAQAFRGLHILALRGLHVLAFRGLHTLAFRGLHALAFRGLHVLPYRGLHALTLRGLHVLTFRGLHVLAFRGLHVLPFRGLHALAFRGLHALAFRGLHALAFRGLHVLAFR

SEQ ID NO: 201474 - protein, 120 aa, Glycine max
  Coding DNA Sequence Number=SeqID_84696
  Gene Ontology: Mol. function=transferase activity
  Subcellular localization annotation: CTP_CleavageSite=20; ConfidenceScore=5.14e-01
THLLLEAASPLSLPSPFRCPSSSKKQRKPLMKKILGLQAPMELTSIPKEEVCTIAIRILAYGSPADSVDKYVQIGETTVVECLERFVSGICTIFGNEYLRRPNNKDTKRILQMGATRGFP

SEQ ID NO: 201475 - protein, 166 aa, Glycine max
  Coding DNA Sequence Number=SeqID_84697
  Gene Ontology: Mol. function=RNA-directed DNA polymerase activity; Cellular component=chromatin; Biological process=chromatin assembly or disassembly
  Pfam annotation: Domain name=rve; Domain location=35-163; Score=6.4; E_value=0.0017; Accession=PF00665.16; Description=Integrase core domain
  Pfam annotation: Domain name=zf-H2C2; Domain location=1-34; Score =17.6; E_value=0.0017; Accession=PF09337.1; Description=His(2)-Cys(2) zinc finger
  Pfam module annotation: Pfam domain module=rve::zf-H2C2; Domain location=35-163::1-34
MGVTKTLARIGENFTWSGMKHNVSQFVAACVDCQCTKYVNRKQGGLLCPLPIPSHPWKDISLDQFSKGIHLGILQTHFTAYTVALFFMDIMDKIHGMPYSLISDQYPLFICHLWQELFKLSGTKLRMSSAYHPQTDGQTEVLNRVVEQYLRTFVRHQPASWGKLLM

SEQ ID NO: 201476 - protein, 159 aa, Glycine max
  Coding DNA Sequence Number=SeqID_84698
MGETHEISHRNLADFEPHLGYATKGKAVGGVPLQNTLESPQFRPQPQPLHSATGKIPLAMEKMGKLDHLEERLRAIEEGRYYAFANIKELFLVPNMVIPPKFKVPEFDKYIGTACPKNHLKMYCQKMGVYAKDEKLLMHFFQENLIGAAITWYTNLEPS

SEQ ID NO: 201477 - protein, 80 aa, Glycine max
  Coding DNA Sequence Number=SeqID_84699
MKNSPLKISLRHKCTKISLPVPLHPLGMSVSVFNGLNFSGWSEQVQFHLGVSDFDLALQVEKPAAITDASSNEEKTHYKA

SEQ ID NO: 201478 - protein, 256 aa, Glycine max
  Coding DNA Sequence Number=SeqID_84700
MSEIKEVQEQMKVDMEAMKEKMTTMMEAMMSMRKMMEVNMATVIAVSTATEVDPTHSFGLNQVQSKNSFPPYGLPPNYTPPNVAHAPDENVDNSAPILIESQQPQSGQAQVPQPMGETHEVPRGHTLADSEPCLGYATERQAFGGIPLPNTLGGTQYRPQPQPLHFAVERLPLAMVEKGKFDHIEERLRAIEGGGDYAFADMAELCLVPDVIIPPKFKVADFDKYKGTTYPKNHLKMYCRKMGAYAKDEKSLMHFF

SEQ ID NO: 201479 - protein, 147 aa, Glycine max
  Coding DNA Sequence Number=SeqID_84701
  Gene Ontology: Mol. function=nucleic acid binding
  Pfam annotation: Domain name=RRM_1; Domain location=26-96; Score =23.9; E_value=0.00059; Accession=PF00076.12; Description=RNA recognition motif. (a.k.a. RRM, R
MGGEGNGKQQSYARTNWRDHHNISSFYFTRFPEEATEAELWQHFKKVGDVREVFISRKRNRSGRRYGFARFKGVDDVKQLERRLDNIVLGETHMKGDNQKLELRQPPDNRYKKGEGRIGHRSFQRHWDSSTELLRMSLHGEIQEGTT

SEQ ID NO: 201480 - protein, 61 aa, Glycine max
  Coding DNA Sequence Number=SeqID_84702
MVMFLRMMMLNALNLPQALPFQELPWIKSPHHTIGLSYGLSERSKLVLDRAPPNLTQTFLK

SEQ ID NO: 201481 - protein, 195 aa, Glycine max
  Coding DNA Sequence Number=SeqID_84703
  Gene Ontology: Mol. function=oxidoreductase activity; Cellular component=intracellular; Biological process=metabolic process
  Homolog annotation: Hit_ID=Q9D7B1; Match level="QueryCoverage=98%, HitCoverage=35%, E-value=5e-57, Identity=59%"; Hit description=tRNA -dihydrouridine synthase 2-like
  Pfam annotation: Domain name=Dus; Domain location=8-195; Score= -121.7; E_value=0.037; Accession=PF01207.8; Description =Dihydrouridine synthase (Dus)
MEYRNKLVLAPMVRVGTLPFRLLAAQYGADITYCEEIIDHKMLKCERRINELIGSTDFVEKGTNNVVFRTCDEEKDRVVFQIGTSDAVRALTTAQLVFSHWDQLCHVENNTTQCNDVAAVDINMGCPKSFSVSGGMGAALLSKPELIHDILTTLKRNLNTPVTCKIRLLKSPHDTVELARRIEKTGVSALAVHGR

SEQ ID NO: 201482 - protein, 309 aa, Glycine max
  Coding DNA Sequence Number=SeqID_84704
  Gene Ontology: Mol. function=sequence-specific DNA binding; Cellular component=nucleus; Biological process=regulation of transcription, DNA-dependent
  Homolog annotation: Hit_ID=Q5UL95; Match level="QueryCoverage=75%, HitCoverage=58%, E-value=5e-71, Identity=65%"; Hit description =Homeobox transcription factor KN3
  Pfam annotation: Domain name=KNOX1; Domain location=124-168; Score =89.0; E_value=1.5e-23; Accession=PF03790.4; Description=KNOX1 domain
  Pfam annotation: Domain name=KNOX2; Domain location=175-226; Score =114.2; E_value=3.6e-31; Accession=PF03791.4; Description=KNOX2 domain
  Pfam module annotation: Pfam domain module=KNOX1::KNOX2; Domain location=124-168::175-226
MEEYTSNNHLSENTGPSPSTPRPNFLYSSASGGNHNHQHQHHSHHHHHHHQFPINTFHLQSGGSDHCFQSDQVSPHPSVKSEASTSQLHAPIFHYPLMRGNLHNTMHHPQQQGGSPTSSTGEVEAIKAKIIAHPQYSNVLEAYMDCQKIGAPPEVVARMAAAKQEFEARQRSSVGSRETSKDPELDQFMEAYYDMLVKYREELTRPIQEAMDFMRRIETQLNMLCNGPVRIFSDSTMCNTCRGHKILNRVLQFLKFVNSSVLCTEPGNFDRKFYLPTDRRREGTQRVEMIFHQAQNPNQYPIYKIYFCL

SEQ ID NO: 201483 - protein, 56 aa, Glycine max
  Coding DNA Sequence Number=SeqID_84705
MEKYFGNAYRGDPGVPHSDPDRFVNIWVGSAAFAVLTYFNPYMWQLSNQFNIIFVA

SEQ ID NO: 201484 - protein, 94 aa, Glycine max
  Coding DNA Sequence Number=SeqID_84706
  Gene Ontology: Mol. function=heat shock protein binding; Biological process=protein folding
  Homolog annotation: Hit_ID=Q1SZB3; Match level="QueryCoverage=98%, HitCoverage=19%, E-value=8e-24, Identity=62%"; Hit description=Heat shock protein DnaJ, N-terminal
MELKPGDSAAKKELSQLLQAQSALETTHSLYDLGNFSKSLEYIDKVVLVFSSACNKAKLLIVKVLIVDKEYESAIVESGFLLKEDENNLEAFML

SEQ ID NO: 201485 - protein, 126 aa, Glycine max
  Coding DNA Sequence Number=SeqID_84707
  Gene Ontology: Mol. function=protein serine/threonine kinase activity; Cellular component=membrane; Biological process=protein amino acid phosphorylation
  Homolog annotation: Hit_ID=Q1S7H1; Match level="QueryCoverage=83%, HitCoverage=12%, E-value=4e-36, Identity=70%"; Hit description =Protein kinase; EGF-like, subtype 2; S-locus glycoprotein; Curculin- like ...
  Homolog annotation: Hit description=(Mannose-binding) lectin; N/apple PAN; Type I EGF
  Pfam annotation: Domain name=Pkinase_Tyr; Domain location=30-126; Score=-166.9; E_value=0.031; Accession=PF07714.7; Description =Protein tyrosine kinase
MVENNEENVKKDLELPLVDLATIVKATDGFSINNKLGEGGFGVVYMGTLDDGHEIAVKRLSQSSGQGYNEFKNEVILIAKIQNQNLVKFLGRCIEGEEKMVIYECMPNKSLKSFIFGYDFFTSYAI

SEQ ID NO: 201486 - protein, 144 aa, Glycine max
  Coding DNA Sequence Number=SeqID_84708
  Homolog annotation: Hit_ID=Q8H7Q9; Match level="QueryCoverage=68%, HitCoverage=7%, E-value=2e-09, Identity=36%"; Hit description =Putative kinesin-related protein
MLQDEIFILKRSLYESEFEFRRLKASYQMLSLECDELKAKNVSYNRRISTTEKVTSELEDCKCSKIELEEKNLRLQWNLTIKEASCHNNAQLKYEVAQIKDWHLRILEGVMLERSIPEKTKSTTCSLLASQETPFHEQMEAEKL

SEQ ID NO: 201487 - protein, 135 aa, Glycine max
  Coding DNA Sequence Number=SeqID_84709
GPTHIWFGDEDGPGCGQPHFSSDQLDRPVQHFQAQGPAALAPELQRRHLRLLFHPSLLLSLLPRDRAIHLHPPQHPWTCMAYRQQDAWPGDQPSIDRGEEPSGATATEDHAVDEDLMADLAGADWGPWANLGGGN

SEQ ID NO: 201488 - protein, 49 aa, Glycine max
  Coding DNA Sequence Number=SeqID_84710
MQSEWVLRQNAYYEYAATVLPLDLVSENGKEEPTSYSGYMGWNHGTEKR

SEQ ID NO: 201489 - protein, 129 aa, Glycine max
  Coding DNA Sequence Number=SeqID_84711
  Homolog annotation: Hit_ID=Q8S8L5; Match level="QueryCoverage=51%, HitCoverage=55%, E-value=7e-12, Identity=53%"; Hit description =Expressed protein
  Pfam annotation: Domain name=Auxin_inducible; Domain location=10-106; Score=55.3; E_value=2e-13; Accession=PF02519.5; Description=Auxin responsive protein
MTLRTFVGKIERGVSHFVHRRPSLNYLSEATTTSVVPDDVREGYFAVLATKGGESKRFVVGLHYLTDPGFLGLLDQAEEEFGFRQKGALAIPCQPQELQKILDGCRMRKMECRKVFYWVGGFKQQLKRC

SEQ ID NO: 201490 - protein, 256 aa, Glycine max
  Coding DNA Sequence Number=SeqID_84712
  Gene Ontology: Mol. function=hydrolase activity; Cellular component =cytosol; Biological process=metabolic process
  Homolog annotation: Hit_ID=Q8GT55; Match level="QueryCoverage=99%, HitCoverage=93%, E-value=1e-135, Identity=95%"; Hit description =Putative phosphatase
  Pfam annotation: Domain name=Hydrolase; Domain location=1-203; Score =19.2; E_value=0.0012; Accession=PF00702.16; Description=haloacid dehalogenase-like hydrolase
LDDTLYPSSTGIDKCVKKNIQLFLIQKCGFSESKALTQRVELFKTYGSTLAGLRAQGLDITAEDYHGLNFSFFSLRPSFVHGRLPYDSIDTDHQLRNLLLSIKQRKIVFTNSDRIHAMRALDRLGVKDCFEQIICFETINPNLPYSTRPDEFPILLKPSLDAFKIALDAANVDPRRTLFLDDSVRNIAAGKEMGLHTVLVGKTMKSKGADYAVESVHNLAQVIPEIWANEMDGGDPTMTRSKSELEAVLACALVGA

SEQ ID NO: 201491 - protein, 154 aa, Glycine max
  Coding DNA Sequence Number=SeqID_84713
  Homolog annotation: Hit_ID=Q8S8L5; Match level="QueryCoverage=44%, HitCoverage=57%, E-value=2e-12, Identity=52%"; Hit description =Expressed protein
  Pfam annotation: Domain name=Auxin_inducible; Domain location=24-125; Score=55.6; E_value=1.7e-13; Accession=PF02519.5; Description=Auxin responsive protein
MKKIEELHNNRRDSMQMKILKSFIAKVHDGLAVVFAPIKRSFTLTSNDDSATTEVPGDVLEGHFVVLANKGEETKRFIVELHYLDDPAFLGLLERAREEYGFRQKGVLVIPCHPQELEKILEQPRDHESVGGDGGKLTDSIQDISECSVISCSS

SEQ ID NO: 201492 - protein, 215 aa, Glycine max
  Coding DNA Sequence Number=SeqID_84714
  Gene Ontology: Mol. function=DNA binding; Cellular component =mitochondrion; Biological process=DNA integration
  Pfam annotation: Domain name=Auxin_inducible; Domain location=123 -211; Score=41.1; E_value=1.5e-09; Accession=PF02519.5; Description =Auxin responsive protein
  Pfam module annotation: Pfam domain module=Auxin_inducible::RVT_2; Domain location=123-211::1-102
SRVWYGRIDQYFTNHGFKRSKSESTLYIKTQGNNLKMMKEFKEDMMKTFKMIELGLMNYFLNIEVRQQKEGILISKKKYIEALLKKFKMYGCKSITIALTTNEKLQKDDGALEADASHYRSLIGSLLYLIATRLDIIYRATTAGQDDVMKGYFAVLAIKGEETKRFIIGLDYLNDPAFLVLLNEAQEEYGFRQQGVLALSCRPQELQKILDAPKA

SEQ ID NO: 201493 - protein, 104 aa, Glycine max
  Coding DNA Sequence Number=SeqID_84715
MAARLGKLRLSPEVTGLSRRADSFTLKSFGGPGESEASLGKLGSRKLNEKTLLPLLFGIFCVLDQNIERSFVLCGNWCQTTQFEHLHHVSHQMIEIAIKIPLLS

SEQ ID NO: 201494 - protein, 62 aa, Glycine max
  Coding DNA Sequence Number=SeqID_84716
  Homolog annotation: Hit_ID=Q6H7M7; Match level="QueryCoverage=73%, HitCoverage=8%, E-value=4e-07, Identity=55%"; Hit description =Putative outer envelope membrane protein OEP75
MTRTIIHGNADGNGSLTIGHITCGIEFSLPMRPKWSGTTGVVFQCFHSGTINTTCKLMIFLV

SEQ ID NO: 201495 - protein, 675 aa, Glycine max
  Coding DNA Sequence Number=SeqID_84717
  Gene Ontology: Mol. function=formate dehydrogenase activity; Cellular component=formate dehydrogenase complex; Biological process=formate metabolic process
  Homolog annotation: Hit_ID=Q8P7E7; Match level="QueryCoverage=99%, HitCoverage=67%, E-value=0.0, Identity=69%"; Hit description=Formate dehydrogenase related protein
  Pfam annotation: Domain name=Molybdopterin; Domain location=3-430; Score=348.9; E_value=8.5e-102; Accession=PF00384.12; Description =Molybdopterin oxidoreductase
  Pfam annotation: Domain name=Molydop_binding; Domain location=514 -620; Score=108.7; E_value=1.7e-29; Accession=PF01568.11; Description= Molydopterin dinucleotide binding domain
  Pfam module annotation: Pfam domain module=Molybdopterin::Molydop _binding; Domain location=3-430::514-620
PNRLTTPLIRENGQFRPASWDEALQRVADGLRAVARQHGGNAIGFIGSSKASNEEAYLTQKIARLIFGTNNVDNSSRYCQNPATEGLFRTVGYGGDAGTLRDLQQTDLIITVGSNLAENHPVFASHIKQSHKHRGQKLLVVDPRRHEMAERADCYLRIRPGTDMVWASAMARYMFDHGYADEAFLRTRVNQVAEYRASLAPFTLEMASEVTGLSVAQLTEAAEMIGNAGSACLLWAMGITQHSHGADTSTALSNLLLVTGNYGRPGTGGYPMRGHNNVQGASDFGCLSNVYPGYEKVTDAQVREKWARAWGVAPEALSDEAGLDNFMMVEDAHKQRVRAMYIIGEETAFSDADSTKVHEAFSRLDFMVVQDIFMSRTAQFADVVLPGCPSLEKEGTFVNTERRIQHFSPAFAPLGDSRPDWQILTEVAARLGHHWHYPNPGAIMAEAAGIAALFAGVSYENLVGWQSQLWPVNADGSSTPLLYTEAFAFPDGKARLYPLTWQPPMEAPDAQYDLLLNNGRMLEHFQSTNQTGQGGRIKSLSPNWFVEISPQLAQERQLQQGDWVELRSRRGSVEVPVVVTERMAGNVLFIPIHHGKPGVNGLTAEHHDPDVNTPAYKEIAVTMRKLAHAPQPHPIPLHNFRHGQRTPLDHLPVEQKWQQPEYRLPPEHVSHPEKS

SEQ ID NO: 201496 - protein, 137 aa, Glycine max
  Coding DNA Sequence Number=SeqID_84718
  Gene Ontology: Biological process=auxin mediated signaling pathway
  Homolog annotation: Hit_ID=Q8S8L5; Match level="QueryCoverage=53%, HitCoverage=61%, E-value=2e-12, Identity=50%"; Hit description =Expressed protein
  Pfam annotation: Domain name=Auxin_inducible; Domain location=33-133; Score=43.0; E_value=9.7e-10; Accession=PF02519.5; Description=Auxin responsive protein
  Subcellular localization annotation: CTP_CleavageSite=61; ConfidenceScore=5.71e-01
MQYTGTRHSLFGKTLPRVKTVCVFSINSKNLNTRTPSSKTSNTYSIRTRRPAAFSYFSEDRATTAAPDDVKEGYFAVHAIKGEETKRFIVGLDYLNDPAFLGLLDQAQEEFGFRQKGALVLPCCPQELQKILNGPKA

SEQ ID NO: 201497 - protein, 82 aa, Glycine max
  Coding DNA Sequence Number=SeqID_84719
MRISIKSTVCGGGDDEHIGGCGPNRILRLIKWLPRHCGTEVEESEDDAVVEVVQWLDCMAVSGFAMWVELWCFDVGDLCGIF

SEQ ID NO: 201498 - protein, 132 aa, Glycine max
  Coding DNA Sequence Number=SeqID_84720
  Gene Ontology: Mol. function=structural constituent of ribosome; Cellular component=intracellular; Biological process=translation
MGMMMRYALRVFVSGKHMTANVVEGNNGRVVAGALSVEHALRGAFEWGRGCDARAAASVREVLAMRLKTEAPELGGGGGVHFDAEREIQKKTVDNGDKVSWFSSPVIATIQVKKKDFQGIYLFKKKRVSWAF

SEQ ID NO: 201499 - protein, 160 aa, Glycine max
  Coding DNA Sequence Number=SeqID_84721
  Gene Ontology: Mol. function=oxidoreductase activity, acting on single donors with incorporation of molecular oxygen, incorporation of two atoms of oxygen; Cellular component=cytoplasm; Biological process=fatty acid biosynthetic process
  Homolog annotation: Hit_ID=Q7X9G5; Match level="QueryCoverage=99%, HitCoverage=17%, E-value=3e-55, Identity=62%"; Hit description =Lipoxygenase
  Pfam annotation: Domain name=PLAT; Domain location=40-155; Score =124.3; E_value=3.4e-34; Accession=PF01477.13; Description=PLATLH2 domain
MERSKRVKGRVVLMKKGVLDFHDIKANVLDRVHELLGKGVSLQLISATTPDPEVEEYTMDPITGLRGKLGKVAHLERWVSTITSLTSATDTEFTVTFEWDESMGVPGAFIIRNNHHSQFYLKTVTIEDIPGHGPVNFVCNSWIYPAHRYAHDRVFFANKA

SEQ ID NO: 201500 - protein, 67 aa, Glycine max
  Coding DNA Sequence Number=SeqID_84722
MGVVKNCKAKALGCCGMTMAIMVRATIVVNSPWPSSECLHCLEGKSTYYHGRTTYHDYAECTIVVVK

SEQ ID NO: 201501 - protein, 164 aa, Glycine max
  Coding DNA Sequence Number=SeqID_84723
MTLLQETNVFLCCLLGFCQSSSQRTIKDLVQLEEDYGVKASGPKSEDRVFAMNDQRLWKNAKNRSSILPPEYKRGSSRPKKLRKREPDEDLNPTKLKGKKQLSTNVKENEGTAIQLVNEGNAEHDTIVESTIVVNDNIVVVIQLQQVENGPAIKAQHPEATRNI

SEQ ID NO: 201502 - protein, 276 aa, Glycine max
  Coding DNA Sequence Number=SeqID_84724
  Gene Ontology: Mol. function=porin activity; Cellular component =integral to membrane
  Homolog annotation: Hit_ID=Q6YWF9; Match level="QueryCoverage=96%, HitCoverage=12%, E-value=2e-15, Identity=45%"; Hit description =Nucleoporin-like protein
MGTGSTLASKEVPIVGSDAVRWIDLSVPSSSNIAAVDDGGAAPLTTDDRASCFVIGDPPTYLIWRIHKAQPHSLELLELAASKEFPRVGLRFTFPDALCPFAFICKNEISGASRVPYLLYVLTVSGVAYLLKIRNVSVYASVSVFPVDELLEVNVRGYIPNHAATITAVTATVGGLVVGTSDGSVFCFQLGVLDSSAPGFMHELRDDAGISRLWGLISRGKMVGTVQELAILELHEKKFVFVLHLDGTLRIWDLASHSRVFSNNMGTMAMAGHHKH

SEQ ID NO: 201503 - protein, 200 aa, Glycine max
  Coding DNA Sequence Number=SeqID_84725
  Pfam annotation: Domain name=GRP; Domain location=35-100; Score= -28.6; E_value=0.064; Accession=PF07172.2; Description=Glycine rich protein family
MVVVSVATAVEISVVIALPVAVAVVVAMQMVVVVAVIVIVVVAMALLVAMVVVVAVVEMSVAMVAASGGDDKVGIGGSGSDGSDSGCGGGISGGGIGGGDDSDIDGSDGGGSGSSKKYNCQMEYVSMRSIGIGYLDPYLIWMRGTLADAWTILFCNIVNVFKCANVRAAVAVGNSGSSTLVTCELCASACPPYAYSIKFN

SEQ ID NO: 201504 - protein, 112 aa, Glycine max
  Coding DNA Sequence Number=SeqID_84726
  Gene Ontology: Mol. function=nucleic acid binding; Cellular component= intracellular
  Homolog annotation: Hit_ID=Q9SJL4; Match level="QueryCoverage=96%, HitCoverage=98%, E-value=4e-43, Identity=65%"; Hit description =Expressed protein
MGGKCPHRNVKKRRYSHKTARRTKFELKGDDMVYAQLNKPDEERAPLPLDEDLPGMGHRYFSNVAVRDEHFKTKRHKKRIKQMMGPAPHTQLDADVAAGMGMPDNGPKLMSM

SEQ ID NO: 201505 - protein, 117 aa, Glycine max
  Coding DNA Sequence Number=SeqID_84727
MDPPLMTLEAFIQQVAWPGVQPSTDGGQASIQVVEYESQQRDEWLACLKEIMGLREHKGFSHVMSLIWGRVGGKDCLKKVKQHTIRHPQKACKPKFLSKKEEEEEEGQKINRYYKCC

SEQ ID NO: 201506 - protein, 600 aa, Glycine max
  Coding DNA Sequence Number=SeqID_84728
  Gene Ontology: Mol. function=porin activity; Cellular component =integral to membrane; Biological process=mRNA export from nucleus
  Homolog annotation: Hit_ID=Q6YWF9; Match level="QueryCoverage=97%, HitCoverage=39%, E-value=1e-145, Identity=46%"; Hit description =Nucleoporin-like protein
MKSSSGNGASEALQSLSDDLGIPYLGFSGCTSIAAWKLQYYQWAMQLFERYSISEGACQFALAALEQVDEALYMKDDKCTNNSVNESVTTIKGRLWANVFIFALDLGRFYDAYCAIISNPDEESKYICLRRFIIVLYEQGAIKILCSDKLPLIGLVEKVEQELVWKADRSDISVKPNLYKLLYAFQLHRHNWRQAASYMYMYSARLRTEAALKDCVGSSLMLQERLNALSAAVNALHLVHPAYAWIDSLAEGSSIVNEHYPSKKAKRTPDEHSAADNDAEPQGWQSSIDIEKLENEFVLTSAEYMLSLVNIKWTFSGKHGALSDLADLLVQNSLYDMAFTILFRFFKGSGLKRELERVLSAISLKCCLDKVESTWVEEHSHLLNSSKHEMVVHGSPVTVSSTPQTDRNSRWATLKLYLEKYKELHGRLPIIVAETLLRSDPKIELPLWLVQLFKEGQKERSWGMTGRESNPASLFQLYVSYDRYAEATYLLLECIDSFASMFVSINVEIQAILPCLILCTTKGAISLQQRPADIIRRKRPLAVWFPYTTIERLLYQLEELIRMGHMVDHCDKLKKMLHGSLQNHLKMLKVDSDDAVSVSS

SEQ ID NO: 201507 - protein, 502 aa, Glycine max
  Coding DNA Sequence Number=SeqID_84729
  Gene Ontology: Mol. function=ATPase activity, coupled to transmembrane movement of substances; Cellular component=integral to membrane; Biological process=auxin mediated signaling pathway
  Homolog annotation: Hit_ID=Q9ZR72; Match level="QueryCoverage=96%, HitCoverage=88%, E-value=0.0, Identity=62%"; Hit description =Multidrug resistance protein 1
  Pfam annotation: Domain name=ABC_membrane; Domain location=1-189; Score=5.3; E_value=0.00074; Accession=PF00664.13; Description=ABC transporter transmembrane region
  Pfam annotation: Domain name=ABC_tran; Domain location=264-448; Score= 244.0; E_value=3.2e-70; Accession=PF00005.17; Description=ABC transporter
  Pfam annotation: Domain name=SMC_N; Domain location=257-452; Score= -131.3; E_value=0.054; Accession=PF02463.9; Description=RecFRecNSMC N terminal domain
  Pfam module annotation: Pfam domain module=ABC_membrane::ABC _tran::SMC_N; Domain location=1-189::264-448::257-452
MAWFDQEENESARIAARLSLDANNVRSAIGDRISVIVQNTALMLVACTAGFVLQWRLALVLVAVFPVVVAATVLQKMFMTGFSGDLEAAHAKATQLAGEAIANVRTVAAFNSEKKIVGLFTSNLETPLRRCFWKGQISGSGYGIAQFALYASYALGLWYASWLVKHGISDFSNTIRVFMVLMVSANGAAETLTLAPDFIKGGHAMRSAFDLLDRRTEIEPDDPDATPVPDSLRGEVELKHVDFSYPTRPDMSVFRNLSLRARAGKTLALVGPSGCGKSSVIALIQRFYDPTSGQVMIDGKDIRKYNLKSLRRHIAVVPQEPCLFATTIYENIAYGHDSASDAEIIEAATLANAHKFISSLPDGYKTFVGERGVQLSGGQKQRIAIARAFVRKAELMLLDEATSALDAESERSVQEALERACSGKTTIIVAHRLSTIRNANLIAVIDDGKVAEQGSHSQLLKNHPDGIYARMIQLQKFTNNQVIGMASGSSSSARAQDDEREG

SEQ ID NO: 201508 - protein, 217 aa, Glycine max
  Coding DNA Sequence Number=SeqID_84730
  Subcellular localization annotation: CTP_CleavageSite=19; ConfidenceScore=5.37e-01
AVHVSSTFEFGAVFHDCLSADPQGNPPFSPFFRSSMNCVFVHVSSTFEFGAVFHDCLSADPQGNPPFSPFFRSSMNVVASFIPMNCVFIHVSSTFEFGAVFHDCLSADPQGNPPFSPFFRSPMNVIAKRCSCVLHFSSLGVVLHDCLRCGPSRQSSISPPFGTSGDWGICSSVVFRIGSFTRYVREKEGVETRVVITERAGRTKSVSYLCFPLISDE

SEQ ID NO: 201509 - protein, 120 aa, Glycine max
  Coding DNA Sequence Number=SeqID_84731
  Subcellular localization annotation: CTP_CleavageSite=71; ConfidenceScore=5.68e-01
SALGESHFSKGSSNSRFALGELSFSKGSSNPRPALGESRFSKGSSNPRSTLGEYRFYKGLSKSRSTLGESRFSKGSSNPRPKDTTELQMEPMNGPWKSKKKIFNFFTNKLWPILPFRGSY

SEQ ID NO: 201510 - protein, 96 aa, Glycine max
  Coding DNA Sequence Number=SeqID_84732
METTKSTKGALQIVEIQVGELAEAVTQFMFRREKYFVEVEAQEKSPVKEHESREKDEEKAQQQWEKYSTVEKQQENILQINNFPHQLIIKLNGKGT

SEQ ID NO: 201511 - protein, 108 aa, Glycine max
  Coding DNA Sequence Number=SeqID_84733
  Gene Ontology: Mol. function=nucleic acid binding
  Homolog annotation: Hit_ID=Q68VB5; Match level="QueryCoverage=60%, HitCoverage=33%, E-value=8e-13, Identity=49%"; Hit description=ALY protein
MVLEELGAAKIESGTKLYLFNLDHGVADDDIKIGRSKGTTEVVFVRHSNALAAIKKYNNMSDGKLLQIEFVGTYACSATPVVTPLCQTNLMGRPNDVHLRCEILILIV

SEQ ID NO: 201512 - protein, 558 aa, Glycine max
  Coding DNA Sequence Number=SeqID_84734
  Gene Ontology: Mol. function=nucleic acid binding
  Homolog annotation: Hit_ID=Q1S3K9; Match level="QueryCoverage=86%, HitCoverage=73%, E-value=1e-141, Identity=55%"; Hit description=IQ calmodulin-binding region
MMHEGSVELETVLSLRSPTADMENDDLFGKSGSTKTTRDTCGDWLEKNFYSPMLETQNQWNQAALRLQKVYKSFRTRRQLADCAVLAEQRWWKALDFAELKRSSISFFDIEKPETAISRWSRASKRAAKVGKGLSKDMKARKLALQHWLEAIDPRHRYGHNLQFYYVKWLRCDSYQPFFYWLDIGDGKEVQSDRCTRTKLQQQCIKYLGPVERKFYEVVIENGRLLYKISGKPVETTEDAKWIFVLSTSKTLYVGQKNKGTFQHSSFLAGGATLSAGRLVAEDGVLKTFSTPKAVWPHSGHYLPTKENFEELMSFLKENNVDLTDVKKNPVEEEDLAKINQDLFRDNPSEAVEPPKIETESSSPLAEDQPDLRNEDSNADSNHQQPLSRLSVRLGSKIAKLEIPKRVTVYDIFGELANGPRTKFYSPTAVSECGYETAEESFINEAEFMVSKSNMFVEDQDEEEENTIPKETILKRIDSHKGRKSYQLANHLSTKWTTGAGPRIGCMRDYPLELQNLILEQQNLSPRTRTTAPSPRIPPLSRFSPHVAFPPPLDAPIA

SEQ ID NO: 201513 - protein, 712 aa, Glycine max
  Coding DNA Sequence Number=SeqID_84735
  Gene Ontology: Mol. function=ATPase activity, coupled to transmembrane movement of substances; Cellular component=integral to membrane; Biological process=auxin mediated signaling pathway
  Homolog annotation: Hit_ID=Q9ZR72; Match level="QueryCoverage=90%, HitCoverage=97%, E-value=0.0, Identity=57%"; Hit description =Multidrug resistance protein 1
  Pfam annotation: Domain name=ABC_membrane; Domain location=95-372; Score=145.4; E_value=1.5e-40; Accession=PF00664.13; Description=ABC transporter transmembrane region
  Pfam annotation: Domain name=ABC_tran; Domain location=447-631; Score= 233.1; E_value=6e-67; Accession=PF00005.17; Description=ABC transporter
  Pfam annotation: Domain name=SMC_N; Domain location=417-635; Score= -124.0; E_value=0.016; Accession=PF02463.9; Description=RecFRecNSMC N terminal domain
  Pfam module annotation: Pfam domain module=ABC_membrane::ABC _tran::SMC_N; Domain location=95-372::447-631::417-635
NSEEIKTLEQWRWSEMQGIELVSSSATVSNSHESNPALEKKREERVIMEEVSSVAKKEEGVPNGVGGEKKKDGSVASVGFGELFRFSDGLDYILMAIGTVGAFVHGCSLPLFLRFFADLVNSFGSNANDLDKMTQEVVKYAFYFLVVGAAIWASSWAEISCWMWTGERQSTRMRIRYLEAALDQDIQFFDTEVRTSDVVFAINTDAVMVQDAISEKLGNFIHYMATFVSGFVVGFTAVWQLALVTLAVVPIIAVIGGIHTTTLAKLSSKSQEALSQAGNIVEQTVVQIRVVLAFVGETRALQGYSSALRIAQKIGYRTGFAKGMGLGATYFVVFCCYALLLWYGGYLVRHHYTNGGLAIATMFSVMIGGLALGQSAPSMAAFTKARVAAAKIFRVIDHKPVIDRRSESGLELESVTGLVELRNVDFSYPSRPEFMILHNFSLNVPAGKTIALVGSSGSGKSTVVSLIERFYDPSSGQVLLDGHDVKSLKPRWLRQQIGLVSQEPALFATTIRENILLGRPDANQVEIEEAARVANAHSFIIKLPEGYETQVGERGLQLSGGQKQRIAIARAMLKNPAILLLDEATSALDSESEKLVQDALDRFMIGRTTLVIAHRLSTICKADLVAVLQQGSVTEIGTHDELFAKGENGVYAKLIRMQEMAHETSMNNARKSSARPSSARNSVSSPIIARNSSYGRSPYPRRLSDFSTSDFS

SEQ ID NO: 201514 - protein, 116 aa, Glycine max
  Coding DNA Sequence Number=SeqID_84736
MAASIKLRRSRKRMSDVASATSGLGSPCWCIVLAIRNKPCSYLRQKATPNKFWVVRGVLAPCACILALILFCIRAPIYRAMAESTRAKTNLDHLEDVVAKLTTNQLSLSAKINELV

SEQ ID NO: 201515 - protein, 371 aa, Glycine max
  Coding DNA Sequence Number=SeqID_84737
  Gene Ontology: Mol. function=ATPase activity, coupled to transmembrane movement of substances; Cellular component=integral to membrane; Biological process=transport
  Homolog annotation: Hit_ID=Q9ZR72; Match level="QueryCoverage=81%, HitCoverage=74%, E-value=1e-133, Identity=53%"; Hit description =Multidrug resistance protein 1
  Pfam annotation: Domain name=ABC_membrane; Domain location=96-371; Score=140.6; E_value=4.2e-39; Accession=PF00664.13; Description=ABC transporter transmembrane region
MAQNSEEIKTVEQWRWSEMQGLELMSSSAPVSNSHESNPTLEEERVMEEASSVEKKEGVPNGTRDGGGEKKKGETVASVWFGELFRFADGLDYILMAIGTVGAFVHGCSLPLFLRFFADLVNSFGSNANDLDKMTQEVVKYAFYFLVVGAAIWASSWAEISCWMWTGERQSTRMRIRYLEAALDQDIQFFDTEVRTSDVVFAINTDAVMVQDAISEKLGNFIHYMATFVSGFVVGFTAVWQLALVTLAVVPIIAVIGGIHTTTLAKLSSKSQEALSQAGNIVEQTVVQIRVVLAFVGETRALQGYSSALRIAQKIGYRIGFAKGMGLGATYFVVFCCYALLLWYGGYLVRHHYTNGGLAITTMFSVMIGGL

SEQ ID NO: 201516 - protein, 251 aa, Glycine max
  Coding DNA Sequence Number=SeqID_84738
  Gene Ontology: Mol. function=RNA-directed DNA polymerase activity; Cellular component=chromatin; Biological process=chromatin assembly or disassembly
  Homolog annotation: Hit_ID=Q1T2D5; Match level="QueryCoverage=98%, HitCoverage=31%, E-value=9e-48, Identity=44%"; Hit description=Chromo
MQEEDVYKIAFRTHEEHYEFHVMPFGLCNAPSSFQALMNTTFRPQLRKFIIIFFDDILIYNKTFEAHVHHMECVFQLLQEGQFFRKLSKCAFAQRQIEYLGHTVSGSSVKPVPEKILAIQQWPPPTSLQTLRGFLGLTGFYRCFIRGYAMTTTPLVHLLTKDTFEWSTAAQDAFQALKTTVSTAPATKYETQRSTGLLVPLSISHRSWEDMSLDFIMGLPPFRGHTMLLVVVDRFSKGIHLGLLPAQFSAY

SEQ ID NO: 201517 - protein, 136 aa, Glycine max
  Coding DNA Sequence Number=SeqID_84739
  Gene Ontology: Mol. function=chromatin binding; Cellular component =chromatin; Biological process=chromatin assembly or disassembly
  Homolog annotation: Hit_ID=Q1SAV4; Match level="QueryCoverage=71%, HitCoverage=24%, E-value=6e-10, Identity=43%"; Hit description =Integrase, catalytic region
MRAYADGPYVGRTGPLTHPYSLLKPFFQDVDNQPMPLSLLPTALDNQHVITPLAILSSCQEGQDPDRRLQVLVQWKSLHVDDTSREDWTTLKDTYHLEDKVIFDEAGSDRPSGSQAAQTKRPKRRITATRRFQDYV

SEQ ID NO: 201518 - protein, 116 aa, Glycine max
  Coding DNA Sequence Number=SeqID_84740
  Gene Ontology: Mol. function=chromatin binding; Cellular component =chromatin; Biological process=chromatin assembly or disassembly
  Homolog annotation: Hit_ID=Q1SAV4; Match level="QueryCoverage=82%, HitCoverage=24%, E-value=7e-25, Identity=59%"; Hit description =Integrase, catalytic region
MEDWVNARLCWQQKLIGHWSYALDNLEGSLITPSKLVMRCSRDGRLSMRLQFDHYIIPYLKGHLSAVLICIVFHLVLRLKQLLSYARKQCFPGSQQCKSIYDMKFLMMPKINASQV

SEQ ID NO: 201519 - protein, 288 aa, Glycine max
  Coding DNA Sequence Number=SeqID_84741
  Gene Ontology: Mol. function=nucleic acid binding
  Homolog annotation: Hit_ID=Q1S3P4; Match level="QueryCoverage=99%, HitCoverage=75%, E-value=3e-95, Identity=62%"; Hit description=Zinc finger, CCCH-type
  Pfam annotation: Domain name=zf-CCCH; Domain location=170-196; Score =28.5; E_value=2.3e-05; Accession=PF00642.15; Description=Zinc finger C-x8-C-x5-C-x3-H type (and similar)
  Pfam annotation: Domain name=zf-CCCH; Domain location=261-287; Score =48.9; E_value=1.7e-11; Accession=PF00642.15; Description=Zinc finger C-x8-C-x5-C-x3-H type (and similar)
  Pfam annotation: Domain name=zf-CCCH; Domain location=91-116; Score =31.6; E_value=2.8e-06; Accession=PF00642.15; Description=Zinc finger C-x8-C-x5-C-x3-H type (and similar)
  Pfam module annotation: Pfam domain module=zf-CCCH::zf-CCCH::zf-CCCH; Domain location=170-196::261-287::91-116
MDYARDGNVVQIITGGGGGGESWSGDQADWATEDEYRFWNNNNKNGGDSETTPSNSNYEGRSSEPTSKKSRNSSQEGSSSNRSKAIGKMFFKTKLCCKFRAGTCPYITNCNFAHSIEELRRPPPNWQEIVAAHEEEKAVMTEPPQQPREEFQIPTVGSSTFSGEMMQRSYKGRHCKKFYTEEGCPYGDSCTFLHDEQSKNRESVAISLGPGGYAGGGGGGCGSGSGGGGGGGGGGVGGGGSGGNGGVNAAGNGPNSKPSNWKTRICNKWEMTGYCPFGNKCHFAHGAT

SEQ ID NO: 201520 - protein, 75 aa, Glycine max
  Coding DNA Sequence Number=SeqID_84742
MASSSSSSSSIQIKSGPIEGDVLWMQPKHVSEHVWNGEPDRKLHIRRAVPIYQGLPVDGAPLIGQTNLDWAELCE

SEQ ID NO: 201521 - protein, 124 aa, Glycine max
  Coding DNA Sequence Number=SeqID_84743
MMERLGFFETWIGWMRTCLSMGAPQMNLFIKRVKARPVTIVCDLSLLFVTCHRRVLLTIIAAELLHELGFITTARLSIPLEFDISARYVMQWALDRRLQEDWARDVREGPKVLMSLRVDFGPMG

SEQ ID NO: 201522 - protein, 97 aa, Glycine max
  Coding DNA Sequence Number=SeqID_84744
MKFCHTYFAKKDLRWWILRNSLTRMILSSWQNNLNRWSVVLHEKTIGVNVEDDDSHIDTYVSPLSTQMSPNIVGAEEADDVHANRNDHDEGELINIA

SEQ ID NO: 201523 - protein, 131 aa, Glycine max
  Coding DNA Sequence Number=SeqID_84745
MELQRWRRQQFGEGSVRFSVFAVEVVPLEAPRDDPLSAVVEVPSGVHNREKRRRGLEKVESRKNNGPVTESSSPCGPSVFIEHLSCRSSSRSRCIFPLWLKWIHPIYVASAFMTNPSIKDDMNTYLPDTSI

SEQ ID NO: 201524 - protein, 305 aa, Glycine max
  Coding DNA Sequence Number=SeqID_84746
  Gene Ontology: Mol. function=DNA binding; Cellular component=nucleus; Biological process=regulation of transcription
  Homolog annotation: Hit_ID=Q09GS2; Match level="QueryCoverage=63%, HitCoverage=82%, E-value=5e-75, Identity=70%"; Hit description =Transcription factor MYBJ7
  Pfam annotation: Domain name=Myb_DNA-binding; Domain location=14-62; Score=49.7; E_value=9.6e-12; Accession=PF00249.21; Description=Myb -like DNA-binding domain
  Pfam annotation: Domain name=Myb_DNA-binding; Domain location=68-113; Score=40.1; E_value=7.4e-09; Accession=PF00249.21; Description=Myb -like DNA-binding domain
  Pfam module annotation: Pfam domain module=Myb_DNA-binding::Myb_DNA -binding; Domain location=14-62::68-113
MGRAPCCDKANVKKGPWSPEEDEKLREYIEKNGTGGNWIALPQKAGLKRCGKSCRLRWLNYLRPNLKHGEFSEDEDRIICTLYASIGSRWSIIASQLPGRTDNDIKNYWNTKLKKKMMGMNPSALKKPHQVNLSPMLQNSTPSSSFKNNHNSYFQPHLPFTGSESISYSSLPSDNYSTFESLQNYQVSSVFMETSCSSSSDGSCNNNQINHVKEAELGYVGDGTFGDQIIGRLSYLNSGVEDQDTLKLVPSNAGRVSGVTDEETRLWGESPLEYGLEEIKQLISNSSCNNFMLDDSKTGEMVMYY

SEQ ID NO: 201525 - protein, 109 aa, Glycine max
  Coding DNA Sequence Number=SeqID_84747
MHEEDAGTPRGRRSTNTKKKNHQHEEEEVGRRRRTTNTKKKKLEGKEEEEVENDATEYKNARCSKQLPLCIIAKKRRTLNKSPVHNYPTWPNDEDMRVHITKPHKRKAT

SEQ ID NO: 201526 - protein, 241 aa, Glycine max
  Coding DNA Sequence Number=SeqID_84748
  Gene Ontology: Mol. function=chitin binding; Cellular component =extracellular region; Biological process=chitin metabolic process
  Homolog annotation: Hit_ID=UPI0000612705; Match level="QueryCoverage =96%, HitCoverage=92%, E-value=8e-16, Identity=28%"; Hit description =UPI0000612705 related cluster
MSSPSEGYTPSPSEGCMPSSPEGYMTSPLEGYTSLPLEGYMPSPSEDCTSSPSEDHTSSPSEGYMPSLSEDYIGLHIVAIRGLHVLTFKRQHILSFRGLNILAFRGLHALTFRGLHTLAFSELHTSPSEDYMSSPLEGYAPSLSEDYMSSPSEGCTPLPSEGSTPSPLEDYTSSPSEEYTPSPSEDYTSSPSEDYTSSPSEDYTSSPSKWLHALAFRGLHVLAFRGLHALTFRGLHVLPFK

SEQ ID NO: 201527 - protein, 175 aa, Glycine max
  Coding DNA Sequence Number=SeqID_84749
MVCTNQADMTGRLLVGSLAFECHIMHYLIVRILLPRSSNLAQAHLVRYRMHKALRSNAPLPYPHLITLFLQHFNVPLDSEPFVKVKRSFSIGANVVSSFGYLKERDGSWRDDFSSLMHNILERFDGLQTYVGERFDSLERQVDTRFEEMNSRIAKVEEDVTIIRDCLDLPPPPSV

SEQ ID NO: 201528 - protein, 335 aa, Glycine max
  Coding DNA Sequence Number=SeqID_84750
  Gene Ontology: Mol. function=translation elongation factor activity; Cellular component=plastid chromosome; Biological process =translational initiation
  Homolog annotation: Hit_ID=O80572; Match level="QueryCoverage=81%, HitCoverage=72%, E-value=2e-26, Identity=23%"; Hit description =Expressed protein
  Pfam annotation: Domain name=mTERF; Domain location=13-323; Score =128.3; E_value=2.2e-35; Accession=PF02536.5; Description=mTERF
MEITSSHSSGSMMWFFKDKGFDDNSVQGMFRKCRRLEGVHQERASENWDYLRSIGIEERKLPSIVSKCPKILALDLYGKIVPTVECLRTLGTKPNEVASAIAKFPHILSNSVEEKLCPLLAFFQTLGIPEKQIGKMILLNPRLISYSIETKLTEIVNFLVNLGLSKDGMIGKVIVRDPYIMGYSVDKRLRPTSDFLKSIGLSEADLQAVAVNFPGILSRDVNKLLVPNYAYLKKRGFEERQIVALVVGFPPILIKSIQNSLEPRIKFLVDVMGRQVDEVIDYPCFFRHGLKRRIEPRYKLLKERSLNCSLSEMLDCNRKKFFMKFGLLEGHALSN

SEQ ID NO: 201529 - protein, 192 aa, Glycine max
  Coding DNA Sequence Number=SeqID_84751
  Gene Ontology: Mol. function=metal ion binding; Cellular component =intracellular; Biological process=metabolic process
  Homolog annotation: Hit_ID=Q1SV87; Match level="QueryCoverage=100%, HitCoverage=62%, E-value=2e-21, Identity=30%"; Hit description =Pentatricopeptide repeat
MHHPPNPTILQQRTSRQQRNEGILIRLNKTPSHLRKNPHRTTSATRTHKPINHRVIRNRIPHRTFIKHPAGITGIPENKVHLQKRVDNKNIGLKPTFENVGMDLKAESGKRKLGAGLEEEGKGEEREGSDDEVEEEEIRVWDLGEEKMGVVKSVAVGGGEERDEWCHEEWVVVAPCDHHLGVDLKRLVNGSA

SEQ ID NO: 201530 - protein, 442 aa, Glycine max
  Coding DNA Sequence Number=SeqID_84752
  Gene Ontology: Mol. function=binding; Cellular component =intracellular; Biological process=metal ion transport
  Homolog annotation: Hit_ID=Q1SV65; Match level="QueryCoverage=98%, HitCoverage=66%, E-value=1e-93, Identity=31%"; Hit description =Asp/Glu racemase; Tetratricopeptide-like helical
  Pfam annotation: Domain name=PPR; Domain location=111-145; Score =52.9; E_value=1e-12; Accession=PF01535.11; Description=PPR repeat
  Pfam annotation: Domain name=PPR; Domain location=216-250; Score =45.8; E_value=1.5e-10; Accession=PF01535.11; Description=PPR repeat
  Pfam annotation: Domain name=PPR; Domain location=251-284; Score =18.0; E_value=0.034; Accession=PF01535.11; Description=PPR repeat
  Pfam annotation: Domain name=PPR; Domain location=287-321; Score=8.1; E_value=0.81; Accession=PF01535.11; Description=PPR repeat
  Pfam module annotation: Pfam domain module=PPR::PPR::PPR::PPR; Domain location=111-145::216-250::251-284::287-321
MRGGFVEPDEYTFVALLSACSLLEDRGIGRVVHGLVYRKLGCFGENELLVNALVDMYAKCGCLEVAERVVRNGNGKSGVAAWTSLVSAYALRGEVEVARRLFDQMGERDVVSWTAMISGYCHAGCFQEALELFVELEDLGMEPDEVVVVAALSACARLGALELGRRIHHKYDRDSWQCGHNRGFTCAVVDMYAKCGSIEAALDVFLKTSDDMKTTFLYNSIMSGLAHHGRGEHAMALFEEMRLVGLEPDEVTYVALLCACGHSGLVDHGKRLFESMLSEYGVNPQMEHYGCMVDLLGRAGHLNEAYLLIQNMPFKANAVIWRALLSACKVDGDVELARLASQELLAMENDHGARYVMLSNMLTLMDKHDEAASVRRAIDNVGIQKPPGWSHVEMNGTLHKFLAGDKSHPEAKATEFMLRDIDMGLKSIGHSISVSKMVFDVD

SEQ ID NO: 201531 - protein, 481 aa, Glycine max
  Coding DNA Sequence Number=SeqID_84753
NDLANIVRRRGHKQIQELLTRSSLNADVDILSAETSLDERLDAANGFEDPLTGQNETVDCLVNDVKSSTEFLLGSSSGSLYVDSSSSLGEGTNIAEEASANLFVEDGLSKVEDHAEVLNDVTEGNFYPTELIIVDNDYDSSREGLHPNFGSQSSIMPTEISGELPIQTVSSGNSESEDSLVGKMDGEITLSLTESHSNTSFNDSNIDTEDKEFSHLEPLVGLPLEQKDLGALEGLDDSKDDIAEDVATTSEVSVRENLSDDNRLNSIVHSADSSSTNLDTLANLSLREKVANFIQNGDLDPVEGTHLPEDNNVMAHGNSLTSNQVVPSGALDLDQSLWDDHLPHEDLTTDFNKDLDTEAPKVQNESEINHLKFMLKELELSRLKEQIEKEKLALSVLQTKAEAEISKARKLISEKDAELHVAEESLSGLKEVQIEFCGDGDVVEVAGSFNGWHHRIEMDLQQSTSAIDLDGSRLYRLNMFN

SEQ ID NO: 201532 - protein, 344 aa, Glycine max
  Coding DNA Sequence Number=SeqID_84754
  Gene Ontology: Mol. function=hydrolase activity, hydrolyzing O -glycosyl compounds; Cellular component=cell wall; Biological process= carbohydrate metabolic process
  Homolog annotation: Hit_ID=Q9SJL9; Match level="QueryCoverage=98%, HitCoverage=93%, E-value=5e-80, Identity=84%"; Hit description =Probable xyloglucan endotransglucosylase/hydrolase protein 32 precursor
  Pfam annotation: Domain name=Glyco_hydro_16; Domain location=26-272; Score=239.5; E_value=7.2e-69; Accession=PF00722.11; Description =Glycosyl hydrolases family 16
  Pfam annotation: Domain name=XET_C; Domain location=295-342; Score =86.0; E_value=1.1e-22; Accession=PF06955.3; Description=Xyloglucan endo-transglycosylase (XET)
  Pfam module annotation: Pfam domain module=Glyco_hydro_16::XET_C; Domain location=26-272::295-342
  Subcellular localization annotation: CTP_CleavageSite=85; ConfidenceScore=5.18e-01
MASSSNAYWPPSPGYRPSSKFRPVNFYRGFRNLWGPQHQSIDQNALTIWLDSSSGSGFKSNRPFRSGYFGASIKLHPGYTAGVITAFYLSNNEAHPGFHDEVDIEFLGTTFGKPYTLQTNVYIRGSGDGTIIGREMKFHLWFDPTQNFHHYAILWSPKEIIKSREDRVGNISFSTEADRRENSVFPEIEDKGKEALGDRVNHIKSRSPEQHTKYENRTVRSVGFLVDDIPIRRYPRKSAETFPLRPMWLYGSIWDASSWATEDGKYKADYRYQPFVAKYTNFRAGGCSAYTSRRCRPVSASPYRSGGLTRRQYWAMRWVQKYHMVYNYCQDHKRDHKLTPECWG

SEQ ID NO: 201533 - protein, 63 aa, Glycine max
  Coding DNA Sequence Number=SeqID_84755
MELPFEVEAVPTNDLAFRSGISHPVIIYNMAKPCEDMEEKVEADVEPVPADPVKPGSVDVKQD

SEQ ID NO: 201534 - protein, 395 aa, Glycine max
  Coding DNA Sequence Number=SeqID_84756
  Gene Ontology: Mol. function=DNA binding; Cellular component=nucleus; Biological process=regulation of transcription
  Homolog annotation: Hit_ID=Q8W3M8; Match level="QueryCoverage=69%, HitCoverage=81%, E-value=3e-66, Identity=52%"; Hit description=6b -interacting protein 1
MDSIAGAPPHADVTPPPPRQSPFPGREDCWSEEATFTLIEAWGQRHLELNRGNLRQRHWQEVADAVNARHGHVSTKARRTDVQCKNRIDTLKKKYKIEKARVSDSGDSATTWPFFRRLDFLIGDNFPAKKPSPPATAGITRRSTPPAKSPPWAVIPVGPRSGTKKRPAAAKPASASPDSVANSYFRRNFSVFAAAAAAAAAAAADSENSNGSKWSSGSEKGTMKKKRTRGDWEFGYREMAEALEKFGEIYERVEGAKQRQMVELEKQRMQFAKDLETQRMKLFMETQVHLQKINRSKRSSASEIKTSICLLYKNFWLRTSVKKSCKPILVYFFCFSEGEGSWYLRALLCSHDRRKSVMNAKMIQNDDELPTLFPPVSLYHAALHKNLPRQPLTNS

SEQ ID NO: 201535 - protein, 355 aa, Glycine max
  Coding DNA Sequence Number=SeqID_84757
  Gene Ontology: Mol. function=voltage-gated potassium channel activity; Cellular component=membrane; Biological process=potassium ion transport
  Homolog annotation: Hit_ID=Q1RYP3; Match level="QueryCoverage=99%, HitCoverage=49%, E-value=1e-157, Identity=77%"; Hit description =Cyclic nucleotide-binding; Ion transport protein
MVSDRSKSVRFQDEAETNKLMYNKESHLPMVSFDEVSDKQKGGKDAIGKSSDGRELSRVFSEDYDAAEILVLDPRGHRVNTWNKIFLAACLLSLFVDPLFFYLPVAKKDKCIDMSTGLEVFLTIIRSLIDAFYIIQIYFRFQTAYIAPSSRVSGRGELIIDSSKIASKYMRRDFWLDVMAAQPLPQVLIWAVIPYLKGSQMIASRHVLRLVSIFQYLLRLYLIYPLSSEIVKANGVMMEKAWAGAAYNLMLYMLASHVLGSSWYLLSIERQNECWKKACTLQYPHCQYRYLDCQSMGDPDRIVWLRSSNLSRLCDQNSDFFQFGIFVDALNLEVTASQFFNKYCYCLWWGLRNLR

SEQ ID NO: 201536 - protein, 123 aa, Glycine max
  Coding DNA Sequence Number=SeqID_84758
  Gene Ontology: Mol. function=voltage-gated potassium channel activity; Cellular component=membrane; Biological process=potassium ion transport
  Homolog annotation: Hit_ID=Q1RYP3; Match level="QueryCoverage=97%, HitCoverage=18%, E-value=1e-46, Identity=71%"; Hit description =Cyclic nucleotide-binding; Ion transport protein
DLKFVAAQFRRLHSKQLRHTFRFHSHQWRTWAACFIQAAWFRYKRTKETSELKKKENLMMAFVLGTGSEHFSAPLQSPKGTMYAAKLASSPRKGRSLRYGPELDILGSLRKPLEPDFTDDDDS

SEQ ID NO: 201537 - protein, 287 aa, Glycine max
  Coding DNA Sequence Number=SeqID_84759
  Homolog annotation: Hit_ID=Q6ER39; Match level="QueryCoverage=14%, HitCoverage=5%, E-value=2e-08, Identity=74%"; Hit description=CTR1 -like kinase kinase kinase-like
MTRHLQVNKFNKSIAISAEKEENLQFHRRFEASSNVSGLSLRNVMLRSNSNLSLSHSEPNIATAFGRRSRRKVIAEQRTASSSPEHPSFRARGRSMLSGDRTTFRDFTDDQATSRSSYRSDGTSSSEARRIRRRSISITPEIGDDIMPRSELVVFLYLYFHIHIIQSREVEPCGGGFLQLKQYRISALGEGCLVNMTRRPLNGGSLLHWAALFLVVFGLACIVWASLYFSLKGEAGSKAILEKLLIELLMKLIGGASSFNEMRTLKKLDQTLPTLLGYALFAVVWCI

SEQ ID NO: 201538 - protein, 226 aa, Glycine max
  Coding DNA Sequence Number=SeqID_84760
  Gene Ontology: Mol. function=protein serine/threonine kinase activity; Cellular component=membrane; Biological process=protein amino acid phosphorylation
  Homolog annotation: Hit_ID=Q6ER39; Match level="QueryCoverage=97%, HitCoverage=36%, E-value=8e-49, Identity=60%"; Hit description=CTR1 -like kinase kinase kinase-like
MEETREDAGPAEQGPSNVLWWPSDFVEKFGSVSLGSQDETLSNKESPRHVVEDVLSSLKASQTLWQTGMLSEPIPNGFYSVIPVSDFYKRPNVESPAKAALDETSHMFENRGVQMLGQIKHGSCRPRAILFKVLADTVGLESRLMVGLPNDGAIECQDSYKHMSVIVVLNSLEMLVDLMRFPGQLLPRSTKSVFMTHISAGESDSAENDSCDSPLEPNSPLFGVSE

SEQ ID NO: 201539 - protein, 72 aa, Glycine max
  Coding DNA Sequence Number=SeqID_84761
MIREIEGVANSPAADPSIRVRIWGEGEGVSHVQCERDLGTSPRQPASKRVGSPTSTTSYASKLLCSPLAYSL

SEQ ID NO: 201540 - protein, 91 aa, Glycine max
  Coding DNA Sequence Number=SeqID_84762
MCLEIGKWVFHEEGLKIDLGKSIFDRWRKRACNAINESEDGDKVLEEIVEVTIWVMERVDEGTGVIGHYPLMFSYSIINAHCSTALEHHLK

SEQ ID NO: 201541 - protein, 153 aa, Glycine max
  Coding DNA Sequence Number=SeqID_84763
MVFLAILGFRFSGSHRHLLFEQGEVWKVCDFVRVSITIIVRRWNANTFAGPQKSTEQRVIDTSSKKLNDVEDDDIVVIDGVEARVEVVAEGEVKAVVEGEIMAEGQVDQQTLVEVQVEVEVQVGEQGLVKVQVEPVGETNVQAQMEAEVHVHE

SEQ ID NO: 201542 - protein, 303 aa, Glycine max
  Coding DNA Sequence Number=SeqID_84764
  Gene Ontology: Mol. function=chitin binding; Cellular component =extracellular region; Biological process=chitin metabolic process
  Homolog annotation: Hit_ID=UPI00006A17C9; Match level="QueryCoverage =98%, HitCoverage=100%, E-value=4e-36, Identity=30%"; Hit description= UPI00006A17C9 related cluster
MPSPSEGCTPSPSEDNTSSPSEDNISSPLEESTFLPSEDFPSSLSKDSMSSPLEGYTSSPSEGCTPSPLEGLHALTFRGLHVLAIRGLRALTFRGLDVPTFRGLNILAFRGLHSLSFRGLHVLSFRGLHVLTFRGLHAVTFHGQHFLTFRGLHVLTFRGLHVLAFTGLHVLAFGGLHTLAIRGLHVLTFRGLHDLTLLHALAFRGLHTLNFRGLHAFAFKGQHVLTFRGLHVLAFRGLHALAFRGLHVLAIGGLHALTFRVLHVLSLRGLHILAFRGLHLLPFRGIHVRTFRGLHVLAFRGLQ

SEQ ID NO: 201543 - protein, 86 aa, Glycine max
  Coding DNA Sequence Number=SeqID_84765
MEKKGVVCYLPYYMHTLKIWRTIGSMCRKCYIKRLHKQFILSQRALRGRARATLTGALSKGGKMRGVATNVYLWKTSEKPKETGQK

SEQ ID NO: 201544 - protein, 241 aa, Glycine max
  Coding DNA Sequence Number=SeqID_84766
  Gene Ontology: Mol. function=protein transporter activity; Cellular component=integral to membrane; Biological process=protein secretion
  Homolog annotation: Hit_ID=P46482; Match level="QueryCoverage=76%, HitCoverage=59%, E-value=1e-66, Identity=69%"; Hit description=p -hydroxybenzoic acid efflux pump subunit aaeA
  Pfam annotation: Domain name=DUF1656; Domain location=3-63; Score =60.0; E_value=7.9e-15; Accession=PF07869.3; Description=Protein of unknown function (DUF1656)
MSVLPVFVVFGLSFPPIFIELLVSLALFWLVKRVLTPSGIYDLVWHPALFNTALYCLKALIRKIARYAITLLLVIIAVIIIFRAWVFYTESPWTRDAKFSADVVAISPDVTGLITDVPVHDNQLVKKGDTLFIVDRPRYQKALDEAQADVEYYQALVSEKRREAARRNQLGTSAMSREAIEQSNSDLQTSEHQLAKAVATRDLAVIDLDRTTIKAPSDGWVTNLNVYQGEFITRGSVAVAL

SEQ ID NO: 201545 - protein, 57 aa, Glycine max
  Coding DNA Sequence Number=SeqID_84767
NFKQLKIWNFNFLLKGEKLKFSSYSLLLRETSYEIMEHRSGAKAVFNYVYEKSGNLF

SEQ ID NO: 201546 - protein, 546 aa, Glycine max
  Coding DNA Sequence Number=SeqID_84768
  Gene Ontology: Mol. function=protein binding; Cellular component =membrane; Biological process=defense response
  Homolog annotation: Hit_ID=Q6SQJ2; Match level="QueryCoverage=97%, HitCoverage=43%, E-value=0.0, Identity=90%"; Hit description=NBS-LRR type disease resistance protein RPG1-B
  Pfam annotation: Domain name=NACHT; Domain location=209-361; Score= -28.0; E_value=0.0087; Accession=PF05729.3; Description=NACHT domain
  Pfam annotation: Domain name=NB-ARC; Domain location=168-472; Score =333.7; E_value=3.1e-97; Accession=PF00931.13; Description=NB-ARC domain
  Pfam module annotation: Pfam domain module=NACHT::NB-ARC; Domain location=209-361::168-472
MAVELIAGALLSSFLQVAFEKLASPQVLDFFHGKKLDETLLRKLKIKLQSIDALADDAERKQFADPRVRNWLLEVKDMVFDAEDLLDEIQHESSKWELEAESESQTCTSCTCKVPNFFKSSPASFFNREIKSRMEKILDSLEFLSSQKDDLGLKNASGVGVGSELGSAVPQISQSTSSVVESDIYGRDEDKKMIFDWLTSDNGNPNQPWILSIVGMGGMGKTTLAQHVFNDPRIQEARFDVKAWVCVSDDFDAFRVTRTILEAITKSTDDSRDLEMVHGRLKEKLTGKRFLLVLDDVWNENRLKWEAVLKHLVFGAQGSRIIATTRSKEVASTMRSREHLLEQLQEDHCWKLFAKHAFQDDNIQPNPDCKEIGTKIVEKCKGLPLALKTMGSLLHDKSSVTEWKSILQSEIWEFSTERSDIVPALALSYHHLPSHLKRCFAYCALFPKDYLFDKECLIQLWMAEKFLQCSQQDKSPEEVGEQYFNDLLSRCFFQQSSNTKRTQFVMHDLLNDLARFICGDICFRLDGDQTKERCLTLWVILNISIP

SEQ ID NO: 201547 - protein, 247 aa, Glycine max
  Coding DNA Sequence Number=SeqID_84769
  Gene Ontology: Mol. function=tyrosine decarboxylase activity; Cellular component=cytoplasm; Biological process=metabolic process
  Homolog annotation: Hit_ID=Q8RUN2; Match level="QueryCoverage=91%, HitCoverage=92%, E-value=2e-93, Identity=78%"; Hit description =Expressed protein
  Pfam annotation: Domain name=Lysine_decarbox; Domain location=57-218; Score=216.8; E_value=4.9e-62; Accession=PF03641.4; Description=Lysine decarboxylase family
METHAEIRVSKFKRVCVFCGSSPGKKRSYQDAAIELGNELVSRNIDLVYGGGSIGLMGLVSQAVHDGGRHVIGRITKSEPIMLVSVSFSIDTICHVIVSCRVIPKTLMPRELTGETVGEVKAVADMHQRKAEMAKHSDAFIALPGGYGTLEELLEVITWAQLGIHDKPVGLVNVDGYFNSLLSFIDKAVEEGFISPNARHIIVSAPTSKELVKKLEDYVPCHESVASKLSWQIEQQLTYPEEYDISR

SEQ ID NO: 201548 - protein, 121 aa, Glycine max
  Coding DNA Sequence Number=SeqID_84770
  Gene Ontology: Mol. function=heat shock protein binding; Cellular component=integral to membrane; Biological process=protein folding
  Homolog annotation: Hit_ID=P93499; Match level="QueryCoverage=55%, HitCoverage=42%, E-value=5e-24, Identity=80%"; Hit description=DnaJ -like protein
ASIVVSALVRIGKSRIGGVDLYEFVSGRVFFINGHHVEVADSNRSSVHGLDFLVRGANGNAEDIEEQASAVAMAVVKATISRNLMRHNEKAMALPEKLMAGKDAEKDMKEIIFATCYIGSL

SEQ ID NO: 201549 - protein, 453 aa, Glycine max
  Coding DNA Sequence Number=SeqID_84771
  Gene Ontology: Mol. function=signal transducer activity; Cellular component=membrane; Biological process=response to light stimulus
  Homolog annotation: Hit_ID=Q1SGZ1; Match level="QueryCoverage=100%, HitCoverage=73%, E-value=0.0, Identity=71%"; Hit description =BTB/POZ; NPH3
  Pfam annotation: Domain name=BTB; Domain location=23-122; Score=12.8; E_value=0.00028; Accession=PF00651.21; Description=BTBPOZ domain
  Pfam annotation: Domain name=NPH3; Domain location=212-453; Score =257.3; E_value=3.2e-74; Accession=PF03000.5; Description=NPH3 family
  Pfam module annotation: Pfam domain module=BTB::NPH3; Domain location= 23-122::212-453
MAFMRLGSKSDAFHREGQTWNCTTGLPSDVTVKVGETSFFLHKFPLLSRSGLLKKLIADFTNEDGSNCVLQLDDVPGGDKTFELVTKFCYGVKIEVTASNVVSLRCAAEHLQMNENYGEGNLIARTEAFLNEVFSNWSDTIKALQTCEEVKSCAEELHIVSRCIDSLAIKACSNPNMSNRHVEGQDCSKYSAQDPALWNGISSENKSPHPGDDWWYEDLSSLILPLYKRVILSIEAKGMKPENVVGSLIYYIRRFIPMMNRQASFNDKNSVNQGTTTNSSISEADQRALLEEIMGLLPNKKGVTPSKYLLRLLCAATILHASPSCIENLEKRIGSQLDQAELVDLLIPNMGYSVETLYDIDCIQRIIDHFMSIYQAATASTSPCIIEEGSLIAGTDALAPMTIVANLIDAYLAEVAVDVNLKLPKFQALASAIPDYARPLDDALYHAIDVYLK

SEQ ID NO: 201550 - protein, 525 aa, Glycine max
  Coding DNA Sequence Number=SeqID_84772
  Gene Ontology: Mol. function=diaminopimelate decarboxylase activity; Cellular component=cytosol; Biological process=lysine biosynthetic process via diaminopimelate
  Homolog annotation: Hit_ID=Q9LUL0; Match level="QueryCoverage=99%, HitCoverage=91%, E-value=0.0, Identity=72%"; Hit description =Similarity to diaminopimelate decarboxylase
  Pfam annotation: Domain name=Orn_Arg_deC_N; Domain location=102-389; Score=137.3; E_value=4.1e-38; Accession=PF02784.7; Description =Pyridoxal-dependent decarboxylase, pyridoxal binding domain
  Pfam annotation: Domain name=Orn_DAP_Arg_deC; Domain location=392 -500; Score=122.6; E_value=1.1e-33; Accession=PF00278.12; Description= Pyridoxal-dependent decarboxylase, C-terminal sheet domain
  Pfam module annotation: Pfam domain module=Orn_Arg_deC_N::Orn_DAP_Arg_ deC; Domain location=102-389::392-500
  Subcellular localization annotation: CTP_CleavageSite=45; ConfidenceScore=5.30e-01
MAASHILYNPPPLSKTFINHPLNQNPSPQNLILPLKATIKPRVLRAVHSQKITANSSLHNSDTRTRFQHCFTKSEDGLLYCEGLKVHEIMDSVERRPFYLYSKPQITRNVEAYKDALEGLRSIIGYAIKANNNLKILEHLRQLGCGAVLVSGNELRLALRAGFDPTRCIFNGNGKVLDDLVLAAKEGVFVNIDSEFDLENIIAAAKIAQKRVNVLLRINPDVDPQVHPYVATGNKNSKFGIRNEKLQWFLDAVKEHPNELKLVGAHCHLGSTITKVDIFRDAAIIMVNYIDQIRAQGFEVDYLNIGGGLGIDYQHSGAVLPTPRDLIDTEHLHSIFGQFRHVLPILSLNAFHKQDAVYFSLIIQFMVRELVLSRGLNLIIEPGRSLVANTCCLVNRVTGVKTNGSKNFIVIDGSMAELIRPSLYDAYQHIELVSPAPANAEIANFDVVGPVCESADFLGKDRQLPTPAKGTGLVVHDAGAYCMSMASTYNLKMRPPEYWVEEDGSVSKIRHGETFEDHIRFFEGL

SEQ ID NO: 201551 - protein, 82 aa, Glycine max
  Coding DNA Sequence Number=SeqID_84773
MIWRAMLDRMPTRDNLLHRGINLVNTNCPICHQQGESFNHIIWKSNTSCKCTLRQIYMQIMGLTSSFTWLKYIVYTYGYTCI

SEQ ID NO: 201552 - protein, 158 aa, Glycine max
  Coding DNA Sequence Number=SeqID_84774
MTRELKEECRASILSYPIPIHGNHIETALTDAGVAQVNVKASNFSWRACTVVKSGMIPLCASVSVYCRPSSPTPLAVAGNHCRHRRPPPHLFPMIPRFGSSISACPKPEGFEVRNLNTCTHVPLLHACIPCARLQSPELRHNTWVLVAGPSCYFSALR

SEQ ID NO: 201553 - protein, 501 aa, Glycine max
  Coding DNA Sequence Number=SeqID_84775
  Gene Ontology: Mol. function=protein dimerization activity; Cellular component=nucleus; Biological process=regulation of transcription, DNA-dependent
  Homolog annotation: Hit_ID=Q8S976; Match level="QueryCoverage=96%, HitCoverage=69%, E-value=1e-172, Identity=63%"; Hit description =Auxin response factor 10
  Pfam annotation: Domain name=Auxin_resp; Domain location=282-365; Score=163.8; E_value=4.5e-46; Accession=PF06507.4; Description=Auxin response factor
  Pfam annotation: Domain name=B3; Domain location=112-217; Score =110.4; E_value=5.4e-30; Accession=PF02362.12; Description=B3 DNA binding domain
  Pfam module annotation: Pfam domain module=Auxin_resp::B3; Domain location=282-365::112-217
MDTKEKLKEVERCLDPQLWHACAGGMVQMPTVNTKVYYFPQGHAEHACGPVNFKTCPKVPPFVPCRVVAVKYMADPETDEVYAKLKLVPLNANDVDYDHDVIGAETRDKPASFAKTLTQSDANNGGGFSVPRYCAETIFPRLDYSADPPVQNILAKDVHGETWKFRHIYRGTPRRHLLTTGWSTFVNHKKLVAGDSIVFLRAENGDLCVGIRRAKKGIGGGLETSSGWNPAGGNFPMPYSGFSPFLREDDNRILRNGNSNGLNPSVSMMGKGKVRPEAIIEAANLAANKKPFEVVYYPRASTPEFCVKASLVEAAMQTRWYSGIRFKMAFETEDSSRISWFMGTISSVQVADPLNWPNSPWRLLQVTWDEPDLLQNVRRVSPWLVELVSNMPAIHFSPFSPPRKKLRLPQHPDFPLDGQIPLPTLPNNLLGPNNTNQFGCLLESTPAGMQGARHAHYGLSLSDLHLSKLQSGLSSAGFPPLDHAATPMKVSNNKTLPKPSI

SEQ ID NO: 201554 - protein, 140 aa, Glycine max
  Coding DNA Sequence Number=SeqID_84776
  Gene Ontology: Mol. function=protein dimerization activity; Cellular component=nucleus; Biological process=regulation of transcription, DNA-dependent
  Homolog annotation: Hit_ID=Q0GPG6; Match level="QueryCoverage=65%, HitCoverage=19%, E-value=2e-42, Identity=93%"; Hit description=BZIP transcription factor bZIP99
MNEEQKMYKLAKYMERKSRDLNEGTYPVYNSLKVNSQTISPGSVHISSLGQLPISLEKSPLTNQTEPPHRLRLQKVQSSNPGTILVGNTDNWEESTMADASPRTDISTDGDTDDKNHPVMFLYLLCCFLPSCSIDAISSP

SEQ ID NO: 201555 - protein, 215 aa, Glycine max
  Coding DNA Sequence Number=SeqID_84777
  Gene Ontology: Cellular component=mitochondrion
  Homolog annotation: Hit_ID=Q1S0T2; Match level="QueryCoverage=97%, HitCoverage=96%, E-value=1e-21, Identity=69%"; Hit description =Complex 1 LYR protein
  Pfam annotation: Domain name=Complex1_LYR; Domain location=20-86; Score=14.8; E_value=0.022; Accession=PF05347.5; Description=Complex 1 protein (LYR family)
MANAALRNVKVLPNSANMEEARHRVFEFFRTACRSLPSVMEIYNLYDVVSVSELRSSVASQIRNNIHVTDPKLTLPGGIRLFIVVVCEWISGYLLSMLSMVDSGIWQKAQVLPYKHAIAAYDTAIVGHFLHIGIHQYGGGSYSFEFIHVMMETCEKVIDMLLFKGMEELKNVVDHSKQRHHIIGQYVVGRQVQDSATKDPDTSTFLKNFYNTNYF

SEQ ID NO: 201556 - protein, 112 aa, Glycine max
  Coding DNA Sequence Number=SeqID_84778
MAHQENQVTGKISEDLDDEKRLYECVRKYEIIVKQFDELMAIMSNGNAVAKTKWRKVGSPNAAIKEGMQGRRGNASGGRAAASSIQTNNNEIVVQTVTRFLHELRNNPTDSE

SEQ ID NO: 201557 - protein, 181 aa, Glycine max
  Coding DNA Sequence Number=SeqID_84779
MLVVGLGSQQRYTEEKSEEQTSHDRGIMGARRRRSILATLAFLMLMGIALYFRLWAIHYNLSSDDTQLLRLQFDIANREAMDESAEWRLRYDEEVDRTNKCLQQLQLFRESSQKGEDASGINHELTILQKVCIICLFFTTLFKCYNDLLTYQENAVLLERLETLKRELEEERLKCSSRYMN

SEQ ID NO: 201558 - protein, 71 aa, Glycine max
  Coding DNA Sequence Number=SeqID_84780
MAIRKCLEATGHVCCGCALQQSCKFGNQSVWKCKDANNLDSVTVMKVITPYALESVNPQLVVPDEVKKSVN

SEQ ID NO: 201559 - protein, 51 aa, Glycine max
  Coding DNA Sequence Number=SeqID_84781
MAFVIFIQALYPKKTLSLMRNSALRRGLCREKENLQQWSARPDYVHKFSLL

SEQ ID NO: 201560 - protein, 278 aa, Glycine max
  Coding DNA Sequence Number=SeqID_84782
  Gene Ontology: Mol. function=oxidoreductase activity; Cellular component=cytosol; Biological process=electron transport
  Homolog annotation: Hit_ID=Q6DAB8; Match level="QueryCoverage=65%, HitCoverage=94%, E-value=5e-79, Identity=74%"; Hit description =Putative modulator of drug activity B
  Pfam annotation: Domain name=ABM; Domain location=186-257; Score =52.3; E_value=1.6e-12; Accession=PF03992.6; Description=Antibiotic biosynthesis monooxygenase
  Pfam annotation: Domain name=Flavodoxin_2; Domain location=2-199; Score=213.3; E_value=5.6e-61; Accession=PF02525.7; Description =Flavodoxin-like fold
  Pfam module annotation: Pfam domain module=ABM::Flavodoxin_2; Domain location=186-257::2-199
MSKILIIDGGKTFAHSKGELNHTLTEVAASQLRDLGHEVQVTVADSDYNVADEVQKYLDSDVVIYQMPGWWMGEPWTVKKYIDEVFTLGHGALYASDGRSRSDASKKYGSGGLIQGKKYMLSLTWNAPLEAFTDPDQFFEGVGVDGLYLHFHKANQFLGMESLPTFICNDVIKQPDVPRDIAQICVKPGRRQEVLEAINKLIPVVLEEEGCHQYDALVDHQAQVPWKQNSPDSIFMLEQWESLRHLEQHQQMPHMDAHRATIKDDVVDVKILVLEPTA

SEQ ID NO: 201561 - protein, 462 aa, Glycine max
  Coding DNA Sequence Number=SeqID_84783
  Gene Ontology: Mol. function=calcium ion binding; Cellular component =extracellular region; Biological process=pathogenesis
  Homolog annotation: Hit_ID=Q6F8M1; Match level="QueryCoverage=83%, HitCoverage=50%, E-value=3e-29, Identity=27%"; Hit description =Putative hemagglutinin/hemolysin-related protein
LAEGSHDIELIAKDPSTGKESPTSDPINVIIDITPPDQPQPPTIVDNEGDNTGPVEPGKPIDDNRPGFGGEGGTPGDKVEVIIDDGKGNPVVIGTGIVGEDGKWEVKPENPIDDGNYQVIIEITDPAGNESQPSDPIDLIIDTKKPGSMEGSYILEDNVGPIQGEIENGTVTDDKQPTLKGTSPDLSQVIIYIDDREPVVVDVKDGKWSYELPELGEGNHKVEVQPVSQSGVKGDKEAAINFDVDTTKPEPVEGGDKANFEGVFADKTGTEIPVRPDTNDDTLIFRGKGSEDGTIVMIWGDEARTQLIGSTVVENGVWRYESDKLAEGDYAFNVTVRDAAGNELVIDHTVKTNVDVTPPPPPEINSIFAAGATDVEGLMSMSLNDIMTQGQDSLFIDNGKSQLVVNAKQGEALTLEDILPAGEDASSWQQATGTVTVGGTEYNVYSNGDAELLVQNLHNEQH

SEQ ID NO: 201562 - protein, 319 aa, Glycine max
  Coding DNA Sequence Number=SeqID_84784
  Gene Ontology: Mol. function=fructose-bisphosphate aldolase activity; Cellular component=integral to membrane; Biological process=metabolic process
  Homolog annotation: Hit_ID=Q6DAB7; Match level="QueryCoverage=89%, HitCoverage=99%, E-value=1e-141, Identity=88%"; Hit description =Fructose-bisphosphate aldolase
  Pfam annotation: Domain name=F_bP_aldolase; Domain location=1-283; Score=255.5; E_value=1.1e-73; Accession=PF01116.10; Description =Fructose-bisphosphate aldolase class-II
MLISMKEMLAPTREHRFAIGAFNVADSCFIRAVVEEAEATNTPAIISIHPSELEFVTDEFFGYVRERTLKSRVPFTIHLDHGASIAQVLRAIQCGFTSVMIDGSLLPYEENVALTKEVVKLAHAVGVSVEGELGTIGDTGTTVEGGVSKVIYTEPAQAEDFVQRTGVDTLAVAIGTAHGIYPKDMKPELQMHILKDISQRVDIPLVLHGGSANPDAEIAEAVTLGVGKINISSDMKFAYFARLREILARESWWDPNVIYPDAIAAAKAVIRYKMNLFGGLGKAGMSVAHAVAARFIANDYFTTPSHCLAICAYSPVAVL

SEQ ID NO: 201563 - protein, 279 aa, Glycine max
  Coding DNA Sequence Number=SeqID_84785
  Gene Ontology: Mol. function=fructose-bisphosphate aldolase activity; Cellular component=integral to membrane; Biological process=metabolic process
  Homolog annotation: Hit_ID=Q6DAB6; Match level="QueryCoverage=99%, HitCoverage=98%, E-value=3e-99, Identity=67%"; Hit description =Probable sugar-bisphosphate aldolase
  Pfam annotation: Domain name=F_bP_aldolase; Domain location=1-279; Score=164.2; E_value=3.4e-46; Accession=PF01116.10; Description =Fructose-bisphosphate aldolase class-II
MNDLIQAAFQHKYAVLAINCFNLETARAAIQAAEQQRAPLILNVYQGHSAHFPPTVAAPLVQALAAQAAVPVALALDHGKAFPLIGQAFRAGFTGLMIDASAEPLADNIRQTAAVVKMAHTAGVCVEGELGHIADAPTYELADAAVKMTRVEDVLPFIEQTGIDLLAISVGTAHGLYPPGVKPKIDFERLQQLHAVTTRPLALHGGSGTPAEDIRRVSACGVAKINVGAAVFDAGKHAVQQALRQHPQAELADVLALMESACREVVIEYLSWSGSANRY

SEQ ID NO: 201564 - protein, 1019 aa, Glycine max
  Coding DNA Sequence Number=SeqID_84786
  Homolog annotation: Hit_ID=Q7CGI0; Match level="QueryCoverage=41%, HitCoverage=89%, E-value=0.0, Identity=72%"; Hit description =Suppressor of ftsI
  Pfam annotation: Domain name=Acyltransferase; Domain location=335 -463; Score=160.3; E_value=5e-45; Accession=PF01553.11; Description =Acyltransferase
  Pfam annotation: Domain name=Cu-oxidase; Domain location=765-892; Score=-11.0; E_value=0.0015; Accession=PF00394.12; Description =Multicopper oxidase
  Pfam annotation: Domain name=Cu-oxidase_2; Domain location=918-1019; Score=7.7; E_value=0.00011; Accession=PF07731.4; Description =Multicopper oxidase
  Pfam annotation: Domain name=Cu-oxidase_3; Domain location=635-753; Score=107.5; E_value=3.8e-29; Accession=PF07732.5; Description =Multicopper oxidase
  Pfam annotation: Domain name=DNA_gyraseA_C; Domain location=143-190; Score=27.8; E_value=3.9e-05; Accession=PF03989.3; Description=DNA gyrase C-terminal domain, beta-propeller
  Pfam annotation: Domain name=DNA_gyraseA_C; Domain location=192-246; Score=36.8; E_value=7.7e-08; Accession=PF03989.3; Description=DNA gyrase C-terminal domain, beta-propeller
  Pfam module annotation: Pfam domain module=Acyltransferase::Cu -oxidase::Cu-oxidase_2::Cu-oxidase_3::DNA_gyraseA_C::DNA_gyraseA_C; Domain location=335-463::765-892::918-1019::635-753::143-190::192-246
AILASDRKMSNLLKKELLADSQTYGDDRRSPLHEREEAKALSENELVSAEPVTIVLSQMGWVRSAKGHDIDPAGLSYKAGDSYRAAARGKSNQPVAFIDSTGRSYTLDPTSLPSARGQGEPLTGKLTPPPGAVIEQVLMEADDQKLLMASDAGYGFICTFADLVSRNRAGKALLTLPENAKVMSPLAVHSGDDMLLAITQAGRMLMFPVADLPQMSKGKGNKIISIPSADAAAGVDKLQWLLILPPGSSITIYVGKRKLIMRDEDLQKVRAERGRRGSVSRGLQRIDSVEVNAPARPKSDANSEDIWCLFSPRNPRHVATFGHMFGRLSTVFGVKVELRKPADAESYGNAIYIANHQNNYDMITAANIVQPTTVTVGKKSLLWIPFFGQLYWLTGNLLIDRDNRAKAHGTIGELVAQFKKKKISFWMFPEGTRSRGRGLLPFKTGAFHAAVAAGVPIIPVVVSNTHGKIKLNRWDNGLVIVEMLPPVDTTQFETTSVRKLATHCRELMSAKLEELNAEVAEREKNGAPGPAICRMRIHAHRAPPLAGCAFMRTGSRMRIDLTRTHSRAFRALHNTIKNNNMDTASSRHAQKLSAGMALASSVMPYAARAAAPLGDVPLPVPPLIESRRGQPLFLTLQRSHWSFNGNSNKVPVWGINGLYLGPTVRVYSGDDVKLIYSNRLNEPVAMTVSGLQVPGALMGGAPRMMSAGVDWAPVLPIRQGAATLWYHANTPNRMAPHVYNGLAGMWLIEDDISKALPLPKHYGVDDFPLIIQDKRLDNFATPVYNPPSDGGFLGDTLLVNGVQNPYVEVSRGWVRLRLLNAANARRFDLSFSDNRPFTVIASDQGFLPAPVAVQTLSLAPGERREVLVDMSQGDEVSITAGTAAGIMDRLRGLFEPSSILTNTLVLTLRPTGLLPLVTDNLPMRLLADQILDGVAVRTREFRLGDGTPGINGVLWDMNRIDTTVQQGTFERWIIHADRPQSLHIQGVMFLIKSVNGAQSMGEDRGWKDTVWVDGDVELL

SEQ ID NO: 201565 - protein, 777 aa, Glycine max
  Coding DNA Sequence Number=SeqID_84787
  Gene Ontology: Mol. function=calcium ion binding; Cellular component =extracellular region; Biological process=pathogenesis
  Homolog annotation: Hit_ID=Q8XQP2; Match level="QueryCoverage=67%, HitCoverage=86%, E-value=2e-58, Identity=32%"; Hit description =Probable hemagglutinin/hemolysin-related protein
MELFNYEEVKYLERDTNTPTFFGYANSEIGKGGTMLITVGKETFSVDIDPANGYWSWTPATPLEDGYYNMSFQSVDKAGNVSTPSLRTLIVDTTPPAAPTLLNMYDDQGDITGSFDSGKMTDDRRPTLTGIAEKGVIVYLKEGNTVIGSAKADENTGIWKIEPEIDLTDGQHDLTLVASETFAGKVREGEVSDEFIIIIGKDGEVPVDPGGVAKIIDAVDNVGSVTGSLKSDGITDDTTPELRGSAPAGSVVRIQYRNAQGEWVDGGNAVMKGTSWSWTPNPALGEGNWQFRANAGDEWSNEFKLNIDLTPASETTIAYAWDNYGHATGMLGNSARTDDRTPTLHGRAEANSIVYIEYGKAGAPWIPGYSVQVGADGNWEFTIPIELDNGNWEFRAKSGNSGAFTPKFKLNVIDNNLAPTIDFALDNVGKTQGKLTSGSVTDDTTPELQGHAEANSTVYIEYYAGNNSKVIASVTANIYGEWTFSPPKLNYGNWTFNAYTNDKAQSSFEIKVRETDLISHREDFSNGTYIIQQGTSVTLASGIKVYNQYGNASQRNEFLVGPDLGTGNPSNSKQTAVHFYIDKSNYFKFDAQAQQATHNMIRFYNEKDELIGSIEISKWGGMKPYEFIAPQGQLISKVSAFNSFYDDGTGNSRYDTIFLDNFEWGIKDNVVKSTDISVNEISTLDADAFSALENITAEEVFSKGTKDFFIDDGKTQLMINGNQGDTMRLEDILPEGSEQEGWTQQTGTVTIAGNQYHVFSHGDAELLVQDGVTVNLV

SEQ ID NO: 201566 - protein, 409 aa, Glycine max
  Coding DNA Sequence Number=SeqID_84788
  Gene Ontology: Mol. function=protein transporter activity; Cellular component=integral to membrane; Biological process=protein transport
  Homolog annotation: Hit_ID=Q6DA97; Match level="QueryCoverage=59%, HitCoverage=79%, E-value=2e-93, Identity=73%"; Hit description =Biopolymer transport protein
  Pfam annotation: Domain name=MotA_ExbB; Domain location=238-376; Score=175.4; E_value=1.4e-49; Accession=PF01618.7; Description =MotATolQExbB proton channel family
DGIGDCGRTARIEHAAGAAFQFGHRILEGKMGEGAAPAIKQFTAGASGGGALFVRDGVKNQVTPAQSRKEAGCGFCYAAEKQSAINCAATTRAGCSSAPVAQFRKAHQTVAARFIAQSCLLLHPRDRSGAIYRATVPAAQFHKPHPTVAARFIAQPSRRRSVVASDLMQTDLSVWGMYQHADIVVKIVMIGLLLASVVTWAIFFGKYAELSGAKRRLKREQLALGEARSLNDAYRAAENFKANSHSAVLLADTRNEVELSAGSEDLDGIKERTSFRLERRVAGFSRHAGRGNGFLATIGSVAPFIGLFGTVWGIMNSFIGIAKTQTTNLAVVAPGIAEALLATAIGLVAAIPAVVIYNVFARMIASYKASLGDVAAQVLLLQSRDLDLGNVDTAKEVNRPAAAQKLRVG

SEQ ID NO: 201567 - protein, 474 aa, Glycine max
  Coding DNA Sequence Number=SeqID_84789
  Gene Ontology: Mol. function=calcium ion binding; Cellular component =extracellular region; Biological process=pathogenesis
  Homolog annotation: Hit_ID=Q8XQP2; Match level="QueryCoverage=70%, HitCoverage=84%, E-value=4e-35, Identity=33%"; Hit description =Probable hemagglutinin/hemolysin-related protein
ETFAGKVREGKVSDEFNITIGKDGDVPSDPGGVAKIIEAIDNAGSLTGSLKSGGITDDTTPELRGSAPEGSVVRIQYRNDKGEWIDGGNAVMNGTSWSWTPNPALGAGNWEFRANAGSGWTDEFKLDIDLAPAAKTEITHAYDDFGPFTGTLGNGAITDDRTPNLHGRAESNSLVYIHYRNVLGTWELLDSVTAGADGRWEYETDRLSPGTYEFQAGRTATRDANGKPFGLQIVAPGSVAPEIAMAWDDVGKITGEVKSGGLTNDTQPELRGSAEANAVVQVEYSRDGKTWHSGSTVADANGRWSFTPKDELEYGNWDFRAKTTNGNSYSADYALRVVEHEEMVKSYDFESIIPGDMTKDFIYGDLNFKFNNQEKRLARVYATEYTGDGAREVLRFFSSEIEISYVELHLQSARNVFGIDNIITKRYANDDITHGNHGFEAFNSYEAAYKFPLGKADNLGSGLIFKPVKGTEAE

SEQ ID NO: 201568 - protein, 404 aa, Glycine max
  Coding DNA Sequence Number=SeqID_84790
  Gene Ontology: Mol. function=alcohol dehydrogenase activity; Cellular component=membrane; Biological process=electron transport
  Homolog annotation: Hit_ID=Q4J0Y1; Match level="QueryCoverage=94%, HitCoverage=87%, E-value=3e-97, Identity=46%"; Hit description =Cytochrome c, class I precursor
  Pfam annotation: Domain name=Cytochrom_C; Domain location=296-384; Score=37.4; E_value=5.1e-08; Accession=PF00034.11; Description =Cytochrome c
MKTRLSLCAAALLLTSFVSHAQPEYDQYARGSYIATLADCTACHTADPQQPFAGGVRLQTPFGTLVGANITPDRETGIGNWRYEDFRRAMTEGIGHGGKRLYGAMPFTAYTKMSDKDLQDLWAWMQTLQPIHHPVETNQLPFPFNIRTSLMVWNWINFDRGAFQPDASQSAEWNRGAYLVQGAGHCGTCHTPKNLLGGDKNGAFLRGEVVEGWMAPDITANPHSGLGKWSQQDIVSYLRTGVNRFDIASGPMADAVRHSTQHWRDEDLQAVAVYLKSGESRDEQVPAALAATDDRMKLGAQIYAAKCSACHSPGGRGEKNIFPQLADNPLLNQEDATSLIRVVAAGSRGVDTDARPTAPAMPAFAGTLGDEEIAAVVSYIRNSWGNAAAPVSADDVKKVKQKLE

SEQ ID NO: 201569 - protein, 81 aa, Glycine max
  Coding DNA Sequence Number=SeqID_84791
MATTSYSLNEASFDLGIDNDSQDLSLHMVEELVDLSLHIVEESFHKDEETDTGVVVSSHDDEVKAKIIELSNGNEDEKKLN

SEQ ID NO: 201570 - protein, 132 aa, Glycine max
  Coding DNA Sequence Number=SeqID_84792
  Gene Ontology: Mol. function=protein kinase activity; Biological process=protein amino acid phosphorylation
  Homolog annotation: Hit_ID=Q9M7J5; Match level="QueryCoverage=66%, HitCoverage=23%, E-value=5e-10, Identity=41%"; Hit description =Protein serine/threonine kinase
MIGTNALTGGENRDKPHSKVAVQLLDRDVALVEEAAVDGAEASLADEEGTAEGARGRFQVGEGEKTEIVGAALRQEMVQVHRVRELRRLGVEVGATVVTVRVHQAQRTSPRHVQGGATAPPPTESSFSPFEK

SEQ ID NO: 201571 - protein, 79 aa, Glycine max
  Coding DNA Sequence Number=SeqID_84793
  Subcellular localization annotation: CTP_CleavageSite=44; ConfidenceScore=5.16e-01
MAIASDSFMHMPMLRTSNYNSFPQKPMTMTINKTEQAGTRGIAVLQAKSSDNQGKGKGTQTNRVGNEEVKKSMEIKEYW

SEQ ID NO: 201572 - protein, 153 aa, Glycine max
  Coding DNA Sequence Number=SeqID_84794
MTDLGFDEPLEKGDSPRANLGFDKPLEKVVMTLNEPSQLGPSFPARGSFLASLRTRHARSLGLKARNKNLLVNGSPTSTGIMAYVSYSITTSKNFTIPGAFGSGPSMSIPYMEKSQGELKLWRLLGGVRGMYTNTWHRLHLLVKSRLSALSVG

SEQ ID NO: 201573 - protein, 555 aa, Glycine max
  Coding DNA Sequence Number=SeqID_84795
MTSRRVASLLSPPSLDRCCPILRVVTSTGARAAVDREVIPIGSSSLEETRHIASDSESSFSERLVVSGRATRGTSCLHRGGGAQPFVASLDGEPNPVTIILPRVRHSHSVRSPSSPLVVIGYEWVRDDVFKYHFSITFVTSVAALERQLGFGSPPELFQCAPLEHLNVALSQLDANSWAMMRAFEVFYPFSTFGLSCWYFFFQMKLIGKIGWVSLNSVSKKLFEFDSNVFRHFKDHFFKVQATDTVVDRLAPMFNRDGEPCFSFYWQSHATRFKSFDEDLLTLVERVDKAILEQLPASLDDRAILSLPSANDPLIALDGKLRPASGVVPLSTVDPPVGGRGQPTARVGPNDDKVFEVSPNASSSVFAKRVYPRPHWPSKLLFFFYSSFCACLGGFCFPSRCSYDASSLAPLIMAPPSTIVTPLLSIGVTIMSAQKMWPPSFVAPPVPPLSPVVLTPASPSSSSSRPMSPLITSTLLVIEALSKVASLEVEVAQWMAIVRTVWRVECPKKERNDLAVKVESTIAKKDKLAKVVFDLEAQLKEAKSRLEDFELRASK

SEQ ID NO: 201574 - protein, 483 aa, Glycine max
  Coding DNA Sequence Number=SeqID_84796
  Gene Ontology: Mol. function=DNA-directed DNA polymerase activity; Cellular component=delta DNA polymerase complex; Biological process =DNA synthesis during DNA repair
  Homolog annotation: Hit_ID=Q9EQ28; Match level="QueryCoverage=91%, HitCoverage=93%, E-value=6e-16, Identity=22%"; Hit description=DNA polymerase subunit delta 3
MAQTQTLSFIHEIESLVSDKLQVVSYKWLSRNYMVSSDEAKRLLQEFVQKHEGGLEVVYALSGWLKSNHPSYHVRLVTGPKLAEAQQEFDGDCSVQIYSVQASIPKDPAVLWNAEFIQAEELFKQPSSVDNCLRDNRFCGISNSFVQRNVDGPTVVFAAPQSKSVGEGPTKSDIVQQPPKNISRDSIDKVDTKPQSVVKEVKSESNGIGNTGVHDNMNKPTADKEKAPPLPTGKKKVQADKSGSVNGGSLASLWGRASAKPKPCSSSAENNNKISNPLVSTEAGQTAACEAEECDSGNDDNQDVSLRRSSNRKRRVVFDFSDEDEDDVEENKSGVKEERATEQKAHLPLRENVSAISRCTNTGKSSSEKLQSGAPEVHLNKDSVNNAPPCSPKRRKVMKTRIDERGREVTEVVWDGEETEEKKPDKVTTKKSDSNASTKAINSAPATKKPPANSNAISGKGGKKAGNSKDPKQGNILSFFKRV

SEQ ID NO: 201575 - protein, 195 aa, Glycine max
  Coding DNA Sequence Number=SeqID_84797
  Homolog annotation: Hit_ID=Q6EUK9; Match level="QueryCoverage=86%, HitCoverage=39%, E-value=8e-20, Identity=32%"; Hit description =Putative NHL repeat-containing protein
MLQQQQPSENQFKGLASNEKHMPILESSKEEPGWPSFGQLIIDLSKLSLEALASAFIPSHFRPGNSKRGLKPLNDRLVMPEDDVRPPLVNRQNAQGHTPLTENRMASQQAPIIKTTRVCRILWSSEIPPYTKSKSQKERPRHRQREKSGEVVMGAVGAEAKPVETRVVDHNNKKFDHYRMRTKYASEETFRFNSQ

SEQ ID NO: 201576 - protein, 68 aa, Glycine max
  Coding DNA Sequence Number=SeqID_84798
  Gene Ontology: Biological process=protein modification process
  Homolog annotation: Hit_ID=Q9FK69; Match level="QueryCoverage=86%, HitCoverage=61%, E-value=7e-22, Identity=83%"; Hit description =Arabidopsis thaliana genomic DNA, chromosome 5, P1 clone:MRA19
MFSCLPLEIWDALRAAAEADLTLAQVIVDSAGVIVQSSDLTVCYDERGAKYELPKYVLSEPTNLIRDS

SEQ ID NO: 201577 - protein, 140 aa, Glycine max
  Coding DNA Sequence Number=SeqID_84799
MEGSIPFSALDGRCFGKPEEEIPAPKLMEKGKAHFKEVPISVDEYSEWCKSRRGFLMVTVLGKVGFRVSKLKSGRRKGPTKSLMYHLISTKFFLCQMRIAIMLCLKGHRWWRIITSRYNVGGHSLWPMLKCSLVFSFVGP

SEQ ID NO: 201578 - protein, 81 aa, Glycine max
  Coding DNA Sequence Number=SeqID_84800
MGISSNILAIAGTTVDVVPLEEVGEVVVTGLVIKETNILNELSPYFESFFLLLLQLLHAFRLSSNTMHFPSFNSLGAAPSS

SEQ ID NO: 201579 - protein, 59 aa, Glycine max
  Coding DNA Sequence Number=SeqID_84801
  Homolog annotation: Hit_ID=Q9LH69; Match level="QueryCoverage=91%, HitCoverage=10%, E-value=4e-15, Identity=73%"; Hit description =Arabidopsis thaliana genomic DNA, chromosome 3, BAC clone: T21E2
MGPLIKHLSSLIKWTRSTSKTPHSDGNALQFENGYVVETVVEGNKIGVVPYRIRVSGGR

SEQ ID NO: 201580 - protein, 106 aa, Glycine max
  Coding DNA Sequence Number=SeqID_84802
  Subcellular localization annotation: CTP_CleavageSite=92; ConfidenceScore=5.07e-01
MKVKQIAGSNGASFLQRATTNGASLITASLTCYHCVPAIALCSYAATLGPSTRQFDWRQCPSRRACWQLQRHVGKSKGAGWNGGTNTTWHVLAESANGGGAMHGDT

SEQ ID NO: 201581 - protein, 260 aa, Glycine max
  Coding DNA Sequence Number=SeqID_84803
MTSKICGKETLTSKYPRLFLLSEKKNGVLVDMGGGLKGSGMHIQCFFAMEIKNTIQRDSIFVENASGQNPNKRELAKEKTDTARQQLFWPLLLSTFGNCTTSLPQLHFFAGSMFSVFQGNSIIFNNGSKNYKKVMELDKLFQASWQAWKSITADQFIARGFLMQGITMFRRNGSRRKCILLRVAWLKSAYGAVCDQDDIFMQAWNIKEECGNQCMVVNFSALFVEVLMNPCYTLFLFANMQRNKVADYLVYLLGSLELQE

SEQ ID NO: 201582 - protein, 189 aa, Glycine max
  Coding DNA Sequence Number=SeqID_84804
  Gene Ontology: Mol. function=protein serine/threonine kinase activity; Cellular component=integral to membrane; Biological process=protein amino acid phosphorylation
  Homolog annotation: Hit_ID=Q948R7; Match level="QueryCoverage=94%, HitCoverage=22%, E-value=3e-41, Identity=44%"; Hit description=CR4
  Pfam annotation: Domain name=Pkinase; Domain location=2-188; Score= -75.8; E_value=0.00048; Accession=PF00069.15; Description=Protein kinase domain
  Pfam annotation: Domain name=Pkinase_Tyr; Domain location=1-179; Score=-82.5; E_value=2.1e-07; Accession=PF07714.7; Description =Protein tyrosine kinase
  Pfam module annotation: Pfam domain module=Pkinase::Pkinase_Tyr; Domain location=2-188::1-179
MGERLLVYEYMPHGTLYDHLHGGLSPLNWSLRLKTAMQAAKGLEYLHKELVPPIVHKDLKSSNILLDSEWGARISDFGLLASSDKDLNGDLESDVYNFGIVLLEILSGRKAYDRDYTPPNVVEWAVPLIKQGKGAAIIDRYVALPRNVEPLLKLADIAELAVRENPSERPPMSDIASWLEQIVKDGLFL

SEQ ID NO: 201583 - protein, 526 aa, Glycine max
  Coding DNA Sequence Number=SeqID_84805
  Gene Ontology: Mol. function=protein serine/threonine kinase activity; Cellular component=integral to membrane; Biological process=protein amino acid phosphorylation
  Homolog annotation: Hit_ID=Q948R7; Match level="QueryCoverage=96%, HitCoverage=56%, E-value=6e-47, Identity=29%"; Hit description=CR4
  Pfam annotation: Domain name=TNFR_c6; Domain location=338-371; Score =17.3; E_value=0.012; Accession=PF00020.9; Description=TNFRNGFR cysteine-rich region
  Subcellular localization annotation: CTP_CleavageSite=65; ConfidenceScore=5.38e-01
MQIISHSSFFLLLLFLFLCSNANGGKQDVICWGSNATSPSLSTVSNALPAMSALSGGEGFLCGILANTSQAFCWSAVTRPSADLILVPPAYRNTAYSQVAAGKSHVCAIRGSYYADRDSGTVDCWEITKTANKTLTAKQSDKFIDQLISNLEVKRVVSGEGFTCGEVNDGGLICWGPTSENLGNISNVSDTFAVLAAGRSAVCGVFNVSGELKCWGDPVSFSDPPLDSVRLVSLSAGANHFCGVRMDNHEVECWGDLNSSVIPKGNGFMAIASSDFTTCGIREDDLLLDCWLVNASKPDFDPPLELSSPGLCRASECGVDEFAFNVSVLNELALTSVCVREDLRICSPCGSNCSKGFFLSSECSRNADRVCTACSLCQNSSCFGVCGLHSSSGQHLHLHWHHLRKWVVIVGCPVLGFLVILLCGCLFMVRKRTKKQSKSCIGKPDQEEDHVNVALNSTLSVNSCPGAPQVFRLSELKDATNGFKEFNELGRGSYGFVYKAALADGRVVAVKRANAATIIHTQQPRF

SEQ ID NO: 201584 - protein, 82 aa, Glycine max
  Coding DNA Sequence Number=SeqID_84806
MAYEESCMLCFAHQAKLKAKEKEWGTGFSIGLRISFHLMQLDAIAISIKYSNSLNCASVMSPSNSEAVEGVLQDHYGSVVFA

SEQ ID NO: 201585 - protein, 426 aa, Glycine max
  Coding DNA Sequence Number=SeqID_84807
  Gene Ontology: Mol. function=peroxidase activity; Biological process =protein folding
  Homolog annotation: Hit_ID=Q338Y6; Match level="QueryCoverage=80%, HitCoverage=83%, E-value=4e-74, Identity=40%"; Hit description =Expressed protein
  Pfam annotation: Domain name=DUF641; Domain location=68-200; Score =222.9; E_value=7e-64; Accession=PF04859.3; Description=Plant protein of unknown function (DUF641)
MESVKPSAVTPRKKLARNFAKVLHVKALIGIASVDGLKNVISDANLKDEGNIGKSKATLNWSESFNEDDDEDLQEREANEALLAKLFASISTVKAAYAELQYAQSPFDPDGIEAADQLLVSELKNLSELKQCYLKKQFDPSPKTAILEAESKELQGVIKTYEIMGKKLESQVRLKDSEIIFLREKLEEANRQNKAIEKRLNQSGQLSGLDNLHITGLSPSHFITVLRHTVRSIRNFVRLIVDEMRYAGWDVDATVDAIEQNVVYMAEDHKCFAIEAFVCREMFDAFHIPNFALSSESLLDKNRRQQWFFGKFNEMKSMKAKYYLAEKPRSSFAKFCRVKYSRLVHPKMESSFFGNQSHRNLVNAGGFPDTEFFASFAEMAKRVWLLHCLAFSYEPQASIFQVGKGCRFSDVYMEMSSVPLTAPNQG

SEQ ID NO: 201586 - protein, 76 aa, Glycine max
  Coding DNA Sequence Number=SeqID_84808
  Gene Ontology: Biological process=response to biotic stimulus
  Homolog annotation: Hit_ID=P16273; Match level="QueryCoverage=79%, HitCoverage=26%, E-value=8e-16, Identity=62%"; Hit description =Pathogen-related protein
MAKDKYRSFLHDEPDNIQWRHGGPPTYEAVNKLFEERRTKEWPEGSLEEIVQNAIKSWEIWSFHTRPAYACFDDLI

SEQ ID NO: 201587 - protein, 254 aa, Glycine max
  Coding DNA Sequence Number=SeqID_84809
  Gene Ontology: Mol. function=transcription factor binding; Cellular component=intracellular; Biological process=regulation of transcription, DNA-dependent
  Homolog annotation: Hit_ID=Q8LJR6; Match level="QueryCoverage=99%, HitCoverage=100%, E-value=1e-109, Identity=83%"; Hit description=GTP- binding protein
  Pfam annotation: Domain name=MMR_HSR1; Domain location=14-166; Score =4.7; E_value=0.00037; Accession=PF01926.13; Description=GTPase of unknown function
  Pfam annotation: Domain name=Miro; Domain location=15-166; Score =66.1; E_value=1.1e-16; Accession=PF08477.3; Description=Miro-like protein
  Pfam annotation: Domain name=Ras; Domain location=15-213; Score =283.4; E_value=4.3e-82; Accession=PF00071.12; Description=Ras family
  Pfam module annotation: Pfam domain module=MMR_HSR1::Miro::Ras; Domain location=14-166::15-166::15-213
MAGYRADDDYDYLFKVVLIGDSGVGKSNLLSRFTKNEFNLESKSTIGVEFATRTLNVDSKVIKAQIWDTAGQERLVNEVSVVVVVADLVLWSRWGFVFLRSGVEVGPATRRYRAITSAYYRGAVGALLVYDVTRHATFENVDRWLKELRNHTDANIVVMLVGNKSDLRHLVAVSTEDGKSYAEKESLYFMETSALEATNVENAFAEVLTQIYRIVSKKAVEGAENGTASVPAKGEKIDLKNDVSALKRVGCCSS

SEQ ID NO: 201588 - protein, 78 aa, Glycine max
  Coding DNA Sequence Number=SeqID_84810
MARLNSVLLTTLLVLVCYSSVLDARKILKIETQELLSLKGTPPSIEANGYHHKNGSGRLVAHLSNEEVVSNPSPGEGH

SEQ ID NO: 201589 - protein, 415 aa, Glycine max
  Coding DNA Sequence Number=SeqID_84811
  Gene Ontology: Mol. function=transferase activity; Cellular component= nucleus; Biological process=biosynthetic process
  Homolog annotation: Hit_ID=UPI0000E48E72; Match level="QueryCoverage =96%, HitCoverage=99%, E-value=1e-101, Identity=47%"; Hit description= PREDICTED: similar to Alg2 protein
  Pfam annotation: Domain name=Glycos_transf_1; Domain location=204 -388; Score=173.1; E_value=7.1e-49; Accession=PF00534.10; Description= Glycosyl transferases group 1
MAKGATSKLNIAIIHPDLGIGGAERLIVDAAVELASQGHKVHVFTAHHDKNRCFEETVAGEPLYMNVCTFPVTVHGSFLPRHIFYRLHALCAYLRCLFVAFCVLFMWHSFDVILADQVSVVIPILKLKRSTKVVFYCHFPDLLLAQHSTFIRRMYRKPIDLAEEITTGMADLILVNSKFTASTFANTFKYLDAKGIRPAVLYPAVNVDQFNEPSSFKLNFLSINRFERKKNIQLAISAFAMLNSPEGVLKHKDITNASLTIAGGFDKRLKENVEYLEELKDLAEKEGVSNKIRFITSCSTAERNELLSECLCVLYTPKDEHFGIVPLEAMAAYKPVIACNSGGPVESIKNGVTGFLCDPTPQEFSLAMAKLINDPQEAERMGREARRHVAESFSTKSFGQHLNRYLVDIHRGKED

SEQ ID NO: 201590 - protein, 133 aa, Glycine max
  Coding DNA Sequence Number=SeqID_84812
  Gene Ontology: Mol. function=DNA binding; Biological process=DNA integration
  Homolog annotation: Hit_ID=Q1SFL1; Match level="QueryCoverage=60%, HitCoverage=6%, E-value=4e-13, Identity=49%"; Hit description =Integrase, catalytic region; Peptidase aspartic, catalytic
  Subcellular localization annotation: CTP_CleavageSite=55; ConfidenceScore=5.13e-01
MAKPCFAKTHFPSSSRGKRSLIKKKTPFGCKYFILNARGQLAKFDSKVDKGIFLRYSNTSKAYRVFNSRTLVVEESIHVKCNDGLTFYKKLSNLEDDFADMHTGLFVTPKKMKSNSLMKFFLRLENHLINNLG

SEQ ID NO: 201591 - protein, 99 aa, Glycine max
  Coding DNA Sequence Number=SeqID_84813
MTLEILSKSPCHNDCASVIDWVVTTMLFFGAQGSFIRCSIFSHAEYLSTCIKACDKVFRRILDTGEWKTTLVFMGETFLGIRHGQIFDNDGDSKTMDDL

SEQ ID NO: 201592 - protein, 163 aa, Glycine max
  Coding DNA Sequence Number=SeqID_84814
MDAFDFANVCRKVIFNTRNASITPPTNPLHPPCLTPKDVIPPANKNKKKMGQKENEEEAQPPKRLQQQTLHHFSHSLPSSLKALPMAKVFEEHKVGFDMTIRQVHHKFKILEATKFDILKDVHQGVLMSINGIPKKTPCSSQPPTPPIDTLLANVDFGEDEGI

SEQ ID NO: 201593 - protein, 82 aa, Glycine max
  Coding DNA Sequence Number=SeqID_84815
MPLRDSITSVYVPGVVEYLGPSKVSCIVPKSNYQQQESLESNCPQTPPSKDYMQRGPSPPWAMGGQVAAFYHEEGKQRKQNR

SEQ ID NO: 201594 - protein, 388 aa, Glycine max
  Coding DNA Sequence Number=SeqID_84816
  Gene Ontology: Mol. function=zinc ion binding; Biological process =ubiquitin cycle
  Homolog annotation: Hit_ID=Q2HV40; Match level="QueryCoverage=89%, HitCoverage=90%, E-value=1e-97, Identity=57%"; Hit description=Zinc finger, RING-type
  Pfam annotation: Domain name=zf-C3HC4; Domain location=332-370; Score= 21.2; E_value=0.001; Accession=PF00097.15; Description=Zinc finger, C3HC4 type (RING finger)
MGNIGSSGSNSRRRHGGGGGSGRRIHPPPPQVMPPPEVTANQFVYPPAATPYHNYPGYYPAPTTMPAPLPAPYDHHHRTAVDPMWGRYPVAAPPAPAPYVEHQKAVTIKNDVNIKKETLRIEPDDENPGRFLVSFTFDATVSGSVWCRVNDGNYVSDARFWGGCCCDPVLDLIALPNLLILILISKGVCKAAREGCTLTPMKENVLPPVTVNFQQGLGQKFKQPAGTGIDFSTFEESELLKVGDMDVYPVAIKADASSSDHDESKSNETPSSGSSNSQITQAVFEKEKGEFQVKVVKQILWVNGMRYELQEIYGIGNSVESDVDGNDPGKECVICLSEPRDTTVLPCRHMCMCSGCAKVLRFQTNRCPICRQPVERLLEIKVGPEPEE

SEQ ID NO: 201595 - protein, 103 aa, Glycine max
  Coding DNA Sequence Number=SeqID_84817
MPIIAIVGTLTCGPFAGPYFRRAKICSKYALDVVSSFEAYYRARVWLGPARIEKRGESLRRNSQVQRSIYEVQSLDKKEDFEPLGNSNWCMDESKSRQQEFWT

SEQ ID NO: 201596 - protein, 478 aa, Glycine max
  Coding DNA Sequence Number=SeqID_84818
  Gene Ontology: Mol. function=methyltransferase activity; Biological process=metabolic process
  Pfam annotation: Domain name=Methyltransf_11; Domain location=120 -203; Score=10.0; E_value=0.0057; Accession=PF08241.2; Description =Methyltransferase domain
  Subcellular localization annotation: CTP_CleavageSite=22; ConfidenceScore=5.07e-01
MDSKSFKFYALSGSIARRVFFRALLLSSAVSLVALIRFLPTVDLGSLTPKTYFDCVDDDSDSLSENATLTAGSYLFQSRILNTFWGSFDSMNCKNDTSLASTVITILTGKRLLNFGARSLCVGEGSNVIVSSMQRLGFSSVVGLHKHPFLSLHKKKTVCHFEYDDSTFDFVFSKDVVDQVSVPAALLVLEVERILKPGGIGALLVGSSSSSSVPSLLRSSNLVHVGYVNELNLVVFKKRSENASTSSPFYNHVLPEDCASVEFTKPLVKLMEPLVVERVGHDVKYEKKNVSYLPKFVDVSNKKRLVYIDIGVRELVNANVNVTNWFPPSYPIDQKAFSVYFVHYNASVLSYVKLPRVTFVYHPGLAGKIAHKNGVDGEMEPFFGEEEFDFLVWFKETVQHADFVVLKMHAGEVEMKFLADIFESGAICSVDELFLSCSESGDGKRETMSSREHCMDTYKGLRSNGVYVHQWWDAKLHQ

SEQ ID NO: 201597 - protein, 127 aa, Glycine max
  Coding DNA Sequence Number=SeqID_84819
MDPDRESINANERKKEKPNLVCLWILHVEQPTEKKASQREGEGNSVSVTPLSVFCRVAVLCALEANRCGVLIELGMLLYLVVGRVDLLLSHHETRLGKIRKDRKSIFTDYQVKMEKDQDKIVYRSDT

SEQ ID NO: 201598 - protein, 305 aa, Glycine max
  Coding DNA Sequence Number=SeqID_84820
  Gene Ontology: Mol. function=protein binding
  Homolog annotation: Hit_ID=Q60EC4; Match level="QueryCoverage=78%, HitCoverage=65%, E-value=1e-10, Identity=26%"; Hit description =Unknow protein
  Pfam annotation: Domain name=F-box; Domain location=18-66; Score =20.5; E_value=0.0061; Accession=PF00646.23; Description=F-box domain
MTDESQRANLTLVMDVEAEIDRLPIDLLAHIFVLFTSFTDLAQASGVCKKWKQGVKESLARRHNLSFAGWKMDDDSTARLVYHAYNLTKLDIFPLMVFLEHQRELSVLILRALEMDCEFEFINFDCIEELSCYKLINCHDVKNVDLRCTTFIVFCICRPRSRWGCQITDAGLLRISFAKCISNLTSISLWGLTGITDEGVVQLISRTRSLQHLNVGGTFITDESLFVIARSCPKLETIVLWSCRHVTESGLFALVDQCLKLKSMNVWGTRVPEECLNNLLICKSSSSDKSLKLDCMYRMAFKVLK

SEQ ID NO: 201599 - protein, 122 aa, Glycine max
  Coding DNA Sequence Number=SeqID_84821
  Gene Ontology: Mol. function=protein binding; Biological process =regulation of transcription
  Homolog annotation: Hit_ID=Q2HSA0; Match level="QueryCoverage=88%, HitCoverage=28%, E-value=3e-31, Identity=60%"; Hit description =Tubby; Di-trans-poly-cis-decaprenylcistransferase; Cyclin-like F- box
  Pfam annotation: Domain name=F-box; Domain location=44-99; Score =27.8; E_value=3.9e-05; Accession=PF00646.23; Description=F-box domain
MSLRKVFRSRKFSKSFKEVLPAEGAAVEGGVAGTVEEAANGNNNGWSSMLPEILGEIVRRVDAAEEQWPNRQNVVACACVCKRWRDITREVVRVPSHTGKITFPSCLKQGSAVIWELCLCNI

SEQ ID NO: 201600 - protein, 473 aa, Glycine max
  Coding DNA Sequence Number=SeqID_84822
  Gene Ontology: Mol. function=DNA binding; Cellular component=nucleus; Biological process=regulation of transcription, DNA-dependent
  Homolog annotation: Hit_ID=Q76I95; Match level="QueryCoverage=91%, HitCoverage=59%, E-value=1e-100, Identity=42%"; Hit description =PHCLF2
MQANKVEGSSPTAKDVLLVIDSLKKQVAAERVVYVKKRIEENRQKLVGVTNHLCTMSTERRNCSITDTNRSLDLLTKRQKDAIDMHNGVHASNGDVESNGYHDDNHGSTAVLLGSNVAVKNAVRPIKLPEVKKLPPYTTWIFLDSMTVKEFGLTDIVLESLAQCFSRNTSEIKAKYETLSIHDNAGGCSKAGDSEENSQSGNFFLEKDLEAALDSFDNLFCRRCLVFDCRLHGCSQDLVFPAEKQPTWNPPDTENAPCGPNCFRSSERFAKTSSAQADEEKSSGGALSRKKSSAKRRIKCSQSESASSNAKNISESSDSENGPGRDAVSASRSAPPKTKPVGKGGIGKRNSKRVAERVLVCMQKRQKKTMVSDSDSISEALDRSSNDMVTDPHAMSSEDNMRKEEFVDDNVCKPEITDNKSWKALEKGLLEKGMEIFGRNSMQEYDHWSKCLYEVKLVFSQFHGEWMGIILKL

SEQ ID NO: 201601 - protein, 409 aa, Glycine max
  Coding DNA Sequence Number=SeqID_84823
  Gene Ontology: Mol. function=phospholipase C activity; Cellular component=membrane; Biological process=intracellular signaling cascade
  Homolog annotation: Hit_ID=Q93XX5; Match level="QueryCoverage=90%, HitCoverage=92%, E-value=1e-143, Identity=63%"; Hit description=PI -PLC X-domain containing protein At5g67130 precursor
  Subcellular localization annotation: CTP_CleavageSite=72; ConfidenceScore=5.19e-01
MLMCSRFLDYRTKCRASTPTIFASFFFSLFLTSSAACFNGNCQVLEACTAATDCGPGLYCGNCPALGRTRPVCTRGQATIVTSLVTSKNVNGLPFNKYSWIMTHNSFSIVDAPPLPGGVQRLTFYNQEDTVTNQLRLDDEGNQQPAINTLREVEAFLTQNPTEIVTIVIEDYVRTPKGLTNLFTNAGLDKYWFPVSDMPKKGEDWPTVTEMVQANHRLLVFTSDASKEAEEGIAYQWSYMVENESGDPGVQGGSCPHRKESKLLNSRSASLFLQNYFPTDPVEADSCKEHSAPLADMVNTCYKAAGNVLPNFIAVNFYMRSDGGGVFDIVDKINGHSLCGCNTVSACQEGAPFGSCKNIAVPDTTPVTNTTGSFTGYVQFSRSASPVHSPNCWLFLAFYLRLITILLQL

SEQ ID NO: 201602 - protein, 335 aa, Glycine max
  Coding DNA Sequence Number=SeqID_84824
  Gene Ontology: Mol. function=DNA binding; Cellular component=nucleus; Biological process=regulation of transcription, DNA-dependent
  Homolog annotation: Hit_ID=Q5VN06; Match level="QueryCoverage=97%, HitCoverage=33%, E-value=1e-150, Identity=77%"; Hit description =Putative Polycomb protein EZ1
  Pfam annotation: Domain name=CXC; Domain location=103-140; Score=6.6; E_value=0.0041; Accession=PF03638.5; Description=TesminTSO1-like CXC domain
  Pfam annotation: Domain name=SET; Domain location=160-308; Score =148.5; E_value=1.7e-41; Accession=PF00856.18; Description=SET domain
  Pfam module annotation: Pfam domain module=CXC::SET; Domain location =103-140::160-308
  Subcellular localization annotation: CTP_CleavageSite=8; ConfidenceScore=5.08e-01
MSGPPGDVANSLMDCYSKGTNEVRRRSRFLRRRGRVRRLKYTWKSAAYHSIRKRITERKDQPCRQYNPCGCQSACGKQCPCLQNGTCCEKYCGCPKSCKNRFRGCHCAKSQCRSRQCPCFAADRECDPDVCRNCWVSCGDGTLGIPSQRGDNYECRNMKLLLKQQQRVLLGRSDISGWGAFLKNSVGKHEYLGEYTGELISHREADKRGKIYDRENSSFLFNLNDQASFYDFVSFVGDKFFVTYTHFVLDAYRKGDKLKFANHSPDPNCYAKVIMVAGDHRVGIFAKERICAGEELFYDYRYEPDRAPAWARKPEASGSKKEDGAPSSGRAKKLA

SEQ ID NO: 201603 - protein, 76 aa, Glycine max
  Coding DNA Sequence Number=SeqID_84825
MKMEESSFLSVKKRWCKVEKRSYKECVGEKSPCIPSECVGLRETYFNCKRGQASVYFFNLIMHVNGLPPNYLAANF

SEQ ID NO: 201604 - protein, 503 aa, Glycine max
  Coding DNA Sequence Number=SeqID_84826
  Gene Ontology: Mol. function=zinc ion binding
  Homolog annotation: Hit_ID=Q6H6V3; Match level="QueryCoverage=89%, HitCoverage=93%, E-value=2e-84, Identity=40%"; Hit description=Zinc finger (C3HC4-type RING finger) protein-like
  Pfam annotation: Domain name=zf-C3HC4; Domain location=261-308; Score= 56.4; E_value=9.1e-14; Accession=PF00097.15; Description=Zinc finger, C3HC4 type (RING finger)
MATEAAGSSKDNNNQGHVTTENRADIPKQKGPAPSEITEELPREQHGARQNLILDIPAISQEEAREDYVRINMPLTPPPRRVIFSPCPSPVFPRSKESPGPSSSKSKSNIKTFLPKLSLKFRNTSSEIEKAAFLALEGSTVAPKKPFLSRTLSLVTPRGKKTSSLPVTPIAHSNPGSVHGGNLVYAETVEKELNLPIHRSRSVPVLNKEGNSPVRGMFRIVPTTLRLDEKIASATPMTSPIHDTVKNEDGGEDIPEEEAVCRICFVELGEGADTFKLECSCKGELSLAHRECVVKWFTIKGNRTCDVCKQEVQNLPVTLLRVQNGQAHNMLGADASQYRVWQDAPILVVINMLAYFCFLEQLLVSNMGSGAIAMSLPFSCILGLLASMTATTMVRRNHVWIYATVQFCLVVLAGHLFFSLVHMQAVLAILLATFTGFGVVMCGASILMEILKWRGRSLAQSNQQQGSQEAIPPPDQSSTVAHQPQIGSEQTESNLGESPAQRS

SEQ ID NO: 201605 - protein, 218 aa, Glycine max
  Coding DNA Sequence Number=SeqID_84827
  Gene Ontology: Mol. function=molecular_function; Cellular component =nucleus; Biological process=negative regulation of transcription by carbon catabolites
  Homolog annotation: Hit_ID=Q1SZB7; Match level="QueryCoverage=84%, HitCoverage=34%, E-value=1e-87, Identity=82%"; Hit description=WD40 -like
  Pfam annotation: Domain name=WD40; Domain location=145-181; Score =12.8; E_value=1.2; Accession=PF00400.22; Description=WD domain, G -beta repeat
  Pfam annotation: Domain name=WD40; Domain location=44-95; Score=22.0; E_value=0.0021; Accession=PF00400.22; Description=WD domain, G-beta repeat
  Pfam module annotation: Pfam domain module=WD40::WD40; Domain location=145-181::44-95
MDLWINLLFPQFLSYSSSRASKITVLDFAVTVDDLVQVWSMEDRKVVAWGEGHNSWVSGVAFDSYWSSPNSNDNEETVRYRFGSVGQDTQLLLWDLEMDEIVVPLRRPSGGSPTYSAGSQSSQWDSVVPLGTLQPAPSMLDVLKISPLVTHRVHTEPLSGLIFTQESVLTACREGHIKIWIRPAAAESQSSNAETLLSTSLKEKPSILSKVGNSSHRQ

SEQ ID NO: 201606 - protein, 265 aa, Glycine max
  Coding DNA Sequence Number=SeqID_84828
  Gene Ontology: Mol. function=ribonuclease H activity
  Homolog annotation: Hit_ID=Q84R37; Match level="QueryCoverage=69%, HitCoverage=77%, E-value=8e-44, Identity=47%"; Hit description =Putative ABA-responsive protein
  Pfam annotation: Domain name=GRAM; Domain location=145-224; Score =34.6; E_value=3.6e-07; Accession=PF02893.10; Description=GRAM domain
MTDESLIPIDPINIYPTMQALPSCAYSFPISLFPPPSNFVPSSVKLSWFSKQENDELSHRDYCYIFPAPVSPAESKLMVSGPNPMDKIYGAINHYGKKVEEATKQAETMVGNIRNHVRVSSRPADAAIARLIQGTKVLTSGGPDKLFQQTFGVFPGEKLLQPCACYISTNSGPLIGTLYISTKRLAFCSDSPLCHHPFSLQQHECVYYKVIVLLDQLSKVSSVTNGLNPSEKRMQVITTDGYEFHFMGFFSYDKALKAVNEALKH

SEQ ID NO: 201607 - protein, 945 aa, Glycine max
  Coding DNA Sequence Number=SeqID_84829
  Gene Ontology: Mol. function=DNA-directed RNA polymerase activity; Cellular component=cytoplasm; Biological process=intracellular protein transport
  Homolog annotation: Hit_ID=Q1STD0; Match level="QueryCoverage=96%, HitCoverage=83%, E-value=1e-113, Identity=32%"; Hit description =Prefoldin
  Pfam annotation: Domain name=DUF869; Domain location=64-851; Score =357.1; E_value=2.8e-104; Accession=PF05911.2; Description=Plant protein of unknown function (DUF869)
MDHKSWLWGNKATQKTNLATDKTNLTSKENGEVQAPLTDKEKLEKDLKRLNDKLAFTLSECNAKDEQIKKQTKIVQEAVADSFEGWEKAEAEILSMKQHLDESIQKQLVYKERVAQLDGALKECMQQLRFVREEQELRIHDAVMKASKEFEEAYIVLEEQLSETSKGLAKSGVENSRLNKSIIAKENLIEDLKRQLAHAEADHNALMIRLESIEKDNASLKYEAQVLEKELAIRNEEREFNCRAADASHKLHLQSVKKIANLESECQRLRILVRKRLPSQACLAKMKNEVEMLEQDSLEMRRKNLNSTSVVVESSLDSSPETTIRRITALTDQLCGVEEENKTLKESLNRKANEIQFSRVMLARTASKLMRLESEIESRGHVTLEQPKSNPALQDISLSSTSDIGSEDKVSCADSWASALISQLEHFRSVKQKESMSCKSVGPSDISLMDDFLEMEKLAVVSVEKAPKISCASLEENNEIDGLPEARPNGISSEVISKEIIPVSDHLSEFSTSNQESCSIDILNGDIPGWLLDVVKVILEQKCVTHKNLDDIREDIRLALSYLNNADQCGFDSSKGHPFDGSKPLHFSQHTSWKPLNNSVVDPCGEVNDAEILSIKGTKQKPQRDLSQSIGKIIELIEGISMPAEDYDNSDSLYKRDGNIRTHKNQGMPTGYMVRVFQWKTSELSNVLQQFLHVCYDLLNDKADHEKFATELTTALDWIMNHCFSLQDVSSMRDAIKKQFDWDETQSENEAETGMFADTYKLHLPIEQLSCLPVLTNSDCHDVPTEEMQYVDKEEIKNIEDKVISSESEKEALEGRLQSAINQLQESEKTIGSLRLELQTLKELNRILEEQVQNHAFINVDLDTQLTETELKEANHKVLALEVELENKNQYCEELETRCVELQLQLESMTKKWSDNDVNQRDEPLQTIPDWSMMSKLLHQLIDCF

SEQ ID NO: 201608 - protein, 305 aa, Glycine max
  Coding DNA Sequence Number=SeqID_84830
  Homolog annotation: Hit_ID=Q94JY0; Match level="QueryCoverage=99%, HitCoverage=91%, E-value=1e-124, Identity=70%"; Hit description =Cyclin delta-3
  Subcellular localization annotation: CTP_CleavageSite=56; ConfidenceScore=5.02e-01
HVSFVKDVAATQPPQHLSQLLSILKTRGESIISPGARQGLIPLAIPLSKNSSGNVTALLRWPTAPPEMEMPVVEVRKYGVWLLAKSVDQFIQRLLVEEDTKNGRERNEEVFYASGDAGEKFYRKGDFTESGISNLDVYLLKKVGLFPDIIERKVARHFEEGDLVSALVTGEFYTKKEHFPGFARPFVFNSEVLLRVGRKVEAKDAARGALKSPWWTLGCKYQDVANIAQWDDEQIEYVKEKVTEEGRQEDLKKGKAPAQVVLDEAAFLLDLASIEGEWDEYLERIAKCYEEAGLHDVAKFILYRD

SEQ ID NO: 201609 - protein, 81 aa, Glycine max
  Coding DNA Sequence Number=SeqID_84831
MKNVIGSLDDNNGIGSIGVGCGANNDDIGGVDGFGGGNKDGGSGGGIGDDEDCDGDDNNNGGSGISGGGYNSAVAMMIIMI

SEQ ID NO: 201610 - protein, 80 aa, Glycine max
  Coding DNA Sequence Number=SeqID_84832
  Homolog annotation: Hit_ID=Q2QMU6; Match level="QueryCoverage=54%, HitCoverage=1%, E-value=2e-08, Identity=61%"; Hit description =Kinesin motor domain containing protein, expressed
MKTLKTTVDGHSEAKDLDCNDFAVINRVRPLNSMERCTQGYNRCLKQEGSQSITWIGELENQFDGSLLVGLLWRLDLELQ

SEQ ID NO: 201611 - protein, 453 aa, Glycine max
  Coding DNA Sequence Number=SeqID_84833
  Gene Ontology: Mol. function=methyltransferase activity; Cellular component=nucleus; Biological process=fatty acid biosynthetic process
  Homolog annotation: Hit_ID=Q1T1A3; Match level="QueryCoverage=99%, HitCoverage=91%, E-value=1e-146, Identity=63%"; Hit description=SAM dependent carboxyl methyltransferase
  Pfam annotation: Domain name=Methyltransf_7; Domain location=36-359; Score=563.3; E_value=2.4e-166; Accession=PF03492.6; Description=SAM dependent carboxyl methyltransferase
MEVAQVLHMNGGVGDASYANNSLVQQKVICLTKPIREEAIRSLYCSTHPRSLAIADLGCSSGPNTLFVVSEFIKIVEKLCRELNHKSPEYKVFLNDLPGNDFNNIFKSLDSFKEKLCDEMESGIGPCYFSGVPGSFYGRVFPYQSLHFVHSSYSLQWLSKVPEGVDNNKGNVYIGSTSPKNVVRAYYEQFQRDFSLFLKCRAEELVEGGRMVLTFLGRRSDDPSSKDGCYIWELLATALSDMVLQGIIREEQLDTFNIPQYTPSPSEVKLEVLKEGSFAINRLEVSEVNWNALDEWNALDFESERSESLSDGGYNVAQCMRAVAEPMLISHFGEAIIEEVPEGIDNNKGNIYIGSTSPSNVPRAYYEQFQKDFSLWEEEAGIHLARVVTGCYMATALNDMVLRDNLPLIEVSEVNWNAHDEWNALEFGSEILGNGGYMQCDTVHESCGRIYAG

SEQ ID NO: 201612 - protein, 320 aa, Glycine max
  Coding DNA Sequence Number=SeqID_84834
  Gene Ontology: Mol. function=methyltransferase activity; Cellular component=nucleus; Biological process=fatty acid biosynthetic process
  Homolog annotation: Hit_ID=Q1T1A3; Match level="QueryCoverage=57%, HitCoverage=61%, E-value=9e-62, Identity=56%"; Hit description=SAM dependent carboxyl methyltransferase
  Pfam annotation: Domain name=Methyltransf_7; Domain location=147-320; Score=72.7; E_value=9.7e-20; Accession=PF03492.6; Description=SAM dependent carboxyl methyltransferase
MRLDHRRLVLLVGVPGHDLWRLPLADSEGTLRGDDVRISKMASPPLVKSAQARWISFPDGTFDFDFADDNTLEEEEAVKLEVLKEGSFAINCLEGCVAESMLVSHFGEAIIDELFSPYQETLADPMSNEKTKFASEQKAICLSKPIREEAITGLYCNTVPRSLAIADLGCSYGPNTLSVVSEFIKTVEKLCRKLNHKSPEYKVFLNDLPGNDFNNIFMSLDNFKEKLCDEIETGVGPCYFFGVPGSFYSRVFPNQSLNFVHSSYSLQWLSKCRAEELVEGGRMVLTILGRRSDAENPAIKEGGYIIWELMATALNDMVMQ

SEQ ID NO: 201613 - protein, 694 aa, Glycine max
  Coding DNA Sequence Number=SeqID_84835
  Gene Ontology: Mol. function=nucleoside-triphosphatase activity; Cellular component=membrane
  Homolog annotation: Hit_ID=Q9FJZ7; Match level="QueryCoverage=98%, HitCoverage=99%, E-value=0.0, Identity=56%"; Hit description =Arabidopsis thaliana genomic DNA, chromosome 5, TAC clone:K1F13
  Pfam annotation: Domain name=UPF0261; Domain location=10-430; Score =505.1; E_value=8.2e-149; Accession=PF06792.2; Description =Uncharacterised protein family (UPF026
MAHHHNNSTTLRVFCVGTLDTKLHELLFLSESLRSNLNRFSSSKVEVVVVDVSAGTNAPESLQDLAFVSRNDVVSSYNSGSGEALSLPEDRGKAVAVMTQALEQFLKKSHEDQSLVGVIGVGGSGGTSLLSSPFASLPIGIPKVIVSTVASGQTEPYVGTSDLVLFPSVVDVAGINRVSRLILSNAAAAFAGMVVGRVQSLQESSRAEDKPTVGITMFGVTTPCVNAVRDRLHEEGYETLVFHATGVGGRAMENLVREGFIQGVFDITTTEVADYIVGGVMACESSRFDAIIESKVPLVLSVGALDMVNFGAKDTIPLKFQQRNIYEHNKQVSLMRTTVDENRKFADFIANKLKNSSSKICVCLPEKGVSALDAPGKPFYDPEATSTLLRELQNLIPTNDDRQVKVYPHHINDLEFSNALVDAFLEINEKTSKGSTHQQVASPESVEQFHEDNVSNASSFGTILYTPNEFPEARTETLEKTQLILQQLLHQIHKGIPIIGAGAGTGRFRMAGRGSLAGLLPFADANAVVLDMANEVLPVVKKVPVLADKILKKREWDIGGLEVEMIQKAHKMGLLTTPYAFNQYEAIEMAKVGADIIVAHMGLTTTGSIGAKTAVSLEESVVRVQAIADAAHRINPGVIVLCHGGPISGPKEAEFILKRTKGVHGFYGASSMERLPVEQAITNTVKEYKSISFH

SEQ ID NO: 201614 - protein, 80 aa, Glycine max
  Coding DNA Sequence Number=SeqID_84836
  Subcellular localization annotation: CTP_CleavageSite=33; ConfidenceScore=5.07e-01
MPITKCLCYSRTIANRCFVFACRQNLTTTTLGRATSVVVCLRYNNDSLKSHIVFGKEGSKEEREEEKRWWYLACDKGGFP

SEQ ID NO: 201615 - protein, 57 aa, Glycine max
  Coding DNA Sequence Number=SeqID_84837
MKQGASIYHEDLNSMRYGLKVFKETLRMSNVLLWFPRVALEDCTIEGGLSSLAFLAS

SEQ ID NO: 201616 - protein, 495 aa, Glycine max
  Coding DNA Sequence Number=SeqID_84838
  Gene Ontology: Mol. function=nucleoside-triphosphatase activity; Cellular component=membrane; Biological process=cell division
  Homolog annotation: Hit_ID=Q9FN75; Match level="QueryCoverage=87%, HitCoverage=89%, E-value=1e-113, Identity=47%"; Hit description=AAA -type ATPase-like protein
  Pfam annotation: Domain name=AAA; Domain location=229-423; Score=2.5; E_value=0.00014; Accession=PF00004.19; Description=ATPase family associated with various cellular activities (AAA)
MAMASPSSIFSPYASMTAYIMLLRSITNDLIPQPIRCYLTNTFRYFFKARCNALALIIEEYSSGIARNHVYDAAEVYLSTKITPENERLNISKSPKEKKLSIRLEKGEEPVDWFNGVKVNWKLICSESEKSNSPTRAEKKYFELSFEKKHKEMVLGTYLPFILEKEKEMKDEERVLKMHTLNTSYGYGGFKWDSINLDHPSTFETLALEAEQKSAIMEDLSRFVGGGSTGKSSLIAAMANYLKFDIYDLQLDNLVTDSDLRKLLLATENRSILVIEDIDCSTVDLPGPRHGDGRKQPDVQYLDWLYMDSLLIIWMLKLSLCGLLNFIDGLWSSCGDERIIILTTNHKERLDPALLRPGRMDMHIHMSYCSYHGFKVLASNYLDIAPDHHLFGKIEGLIEDMEITPAQVAEELMKSEDADTALEGFLKLLKRKKMEGDVCENDGSHKTELRQSKRSKVGCKQKRPVCISKRKNGVGTQRMTREDVHCNQLSTFGTI

SEQ ID NO: 201617 - protein, 566 aa, Glycine max
  Coding DNA Sequence Number=SeqID_84839
  Gene Ontology: Mol. function=transporter activity; Cellular component= intracellular; Biological process=transport
  Homolog annotation: Hit_ID=Q94FN3; Match level="QueryCoverage=68%, HitCoverage=70%, E-value=0.0, Identity=82%"; Hit description =Phosphatidylinositol transfer-like protein II
  Pfam annotation: Domain name=CRAL_TRIO; Domain location=298-484; Score=151.2; E_value=2.7e-42; Accession=PF00650.10; Description =CRALTRIO domain
  Pfam annotation: Domain name=CRAL_TRIO_N; Domain location=212-281; Score=54.9; E_value=2.6e-13; Accession=PF03765.5; Description =CRALTRIO, N-terminus
  Pfam module annotation: Pfam domain module=CRAL_TRIO::CRAL_TRIO_N; Domain location=298-484::212-281
MGDWLCCIGTGHGDAVSLESGAGNGVGLGCMGAEHGGGVGMESGGGGVLEEWYPVWIPWKLGFRRSEVELQQVWSWRPQDGPHKRRKVQRLPLKDVREGAESMEGGVGMVRTICRVVVPNKHSKRLQKWLLVGGCVEKMSCEEVIWTDMTAMEGSHWSSMTAPICYELKNNSAIPNIRALEKSDRVGSLKKMLRNSLTRSRRRSSSKVMSVEIEDIRDAEESKAVDEFRQALVLDELLPEKHDDYHMLLRFLKARKFELEKSKQMWSDMLQWRKEFGADTISEDFEFKELEEVLQYYPHGHHGVDKDGRPVYIERIGQVDATKLMQVTTMDRYIKYHVKEFERTFDVKFAACSISAKKHIDQSTTILDVQGVGLKSFNKHARELITRLQKIDGDNYPETLNRMFIINAGSGFRMLWNTVKSFLDPKTTSKIHVLGNKYQSKLLEIIDESELPEFLGGTCTCADQGGCMHSDKGPWKDADIMKMVQNGDHKCSRKCEVPVMEEKTASEEHETSKLEANLTAQLSSVFAGVPASKAYNYEDFVPEADKTAWNKKMDENEKFALSKGRM

SEQ ID NO: 201618 - protein, 159 aa, Glycine max
  Coding DNA Sequence Number=SeqID_84840
  Homolog annotation: Hit_ID=Q8LSJ9; Match level="QueryCoverage=71%, HitCoverage=18%, E-value=5e-20, Identity=42%"; Hit description=X1
  Pfam annotation: Domain name=XS; Domain location=12-80; Score=-30.7; E_value=0.004; Accession=PF03468.5; Description=XS domain
MVLSGGGTCLGEAGVFVFIQVLLKVEEVKRVVQEAITEIEESAYELDHHAKKDWFVDSGQKSGLYAWVARADDYKVNNIYGEQLQKMGDLKTIPERMEEEARKQDILVSSLTSIIEVKNQHLKEIEVRCHETTNKMNLAMNEKDKLIQTYNEGIYFIEP

SEQ ID NO: 201619 - protein, 267 aa, Glycine max
  Coding DNA Sequence Number=SeqID_84841
  Gene Ontology: Mol. function=ferric iron binding; Biological process =aromatic compound metabolic process
  Homolog annotation: Hit_ID=Q7F761; Match level="QueryCoverage=98%, HitCoverage=46%, E-value=4e-52, Identity=43%"; Hit description =Putative transcription factor
  Pfam annotation: Domain name=XH; Domain location=131-264; Score =219.1; E_value=1e-62; Accession=PF03469.5; Description=XH domain
MAALEQKKADENVMKLAKINRCVKQKEQLHAKIIQLQKQLDKKQELELEIQQLKGTLNVLKHMEDDEDAEVLKKVDTLQKDLRDKEQSLEDLVDALNQALIVKERESNDKLQEARKALVDGMKELSSHGNIRLKRMGELDTIPFHDAMKKRYNEEEAEERASELCSLWEEYLKNPDCHPFKVTMVEGKEKAIVRDDDEMLNELKNDLGEGAYKAVVQALSEVNEHNPSGRYLTSVVWNYKEGRRASLKEVQFLLNHWKVLKRKRGMV

SEQ ID NO: 201620 - protein, 523 aa, Glycine max
  Coding DNA Sequence Number=SeqID_84842
  Gene Ontology: Mol. function=nucleic acid binding; Cellular component= intracellular; Biological process=regulation of transcription
  Homolog annotation: Hit_ID=Q1SZA5; Match level="QueryCoverage=98%, HitCoverage=98%, E-value=2e-92, Identity=46%"; Hit description=Zinc finger, C2H2-type
  Pfam annotation: Domain name=RS4NT; Domain location=124-161; Score =15.5; E_value=0.029; Accession=PF08071.2; Description=RS4NT (NUC023) domain
  Pfam annotation: Domain name=zf-C2H2; Domain location=139-161; Score =22.0; E_value=0.0022; Accession=PF00096.16; Description=Zinc finger, C2H2 type
  Pfam annotation: Domain name=zf-C2H2; Domain location=166-187; Score =16.3; E_value=0.11; Accession=PF00096.16; Description=Zinc finger, C2H2 type
  Pfam annotation: Domain name=zf-C2H2; Domain location=63-85; Score =25.6; E_value=0.00018; Accession=PF00096.16; Description=Zinc finger, C2H2 type
  Pfam module annotation: Pfam domain module=RS4NT::zf-C2H2::zf -C2H2::zf-C2H2; Domain location=124-161::139-161::166-187::63-85
  Subcellular localization annotation: CTP_CleavageSite=58; ConfidenceScore=5.27e-01
MMPGDPFSLSTSIGGFTQDKQNTNPNPKPNPPPKKKRNLPGTPDPDAEVIALSPKTLMATNRFICEICNKGFQRDQNLQLHRRGHNLPWKLRQRSNKEVRKKVYICPEQTCVHHDPARALGDLTGIKKHFSRKHGEKKWKCEKCSKKYAVQSDWKAHTKTCGTREYKCDCGTLFSRKDSFITHRAFCDALAEESARLTSVTTTNLNFKSEEGGNNVMNSQQHGLGGHGLIGAQSLQNVSGIPQFGSHGFRLDFNGMEQQIRPSLSLWLNQGNHQMNSNNNNINSNNNSASDAGPNYMSSSGLPEIVQMAHANALMGCSSSMVSNFGGVHAGSNSSSANLSLGKRGEACGSTVVDLASIYNNSEGQNKNSKPASPMSATALLQKAAQMGSTRSTNPSIFSGSFGVINSPSSQTTSLNNNNNGGAAMMLASNTSTAAANANDFSSLRHSSNSFDQLVMQTNAQLQSEPVKLKLHSNGMENNLTRDFLGVSGGGGGGGGPQFLPQELGKFASMGSPMGLSQFTSNQ

SEQ ID NO: 201621 - protein, 49 aa, Glycine max
  Coding DNA Sequence Number=SeqID_84843
MASSQFLIMTTMAVFLAVVSAAHAADAPAPSPTSPASVISPSFAAEIEA

SEQ ID NO: 201622 - protein, 126 aa, Glycine max
  Coding DNA Sequence Number=SeqID_84844
MNGVRAWMRRNREWLEGGKRKAVRLLIYDEFHCKFSIEICCGNFLCSLRFFRGAEDFPVLKERVQEMENESIIQSNNNTNTMSSVREKNGGDGSLLLRANSDSARQATTSDLVLQWGNRKRLRCMK

SEQ ID NO: 201623 - protein, 455 aa, Glycine max
  Coding DNA Sequence Number=SeqID_84845
MDKDQEWFIAMFETIDKWTSDERTRESIVKIKCREVMVQLIEEYPIQTKGRCYYTDHEIPDDELSVFIMENEDISLSGSEWSREEETNHRESFQEAISDDADMTLGQIAQNCSKRSKGKVRMDEEEGTMPRPEKKKKRVELEEGKVMEVEVGKDKEVLEGFVGKTNREGDAGSRESHIDVKDDREGHILSRQKGNINLIDVGLTKEMKSQHVNVQQKWADRTTNSINRGAKGNKCIKQGIANEKIDQTRRYESIGGGHGYGDKSIMTQKIQGVEDTNMVVTGGKNNEVEEKVKQRVQWAIIQEFKRLNLMDKWCLVEDSNSVRRLGDSRRHYHIAIGGIEMKEFNNFIEDMEVDDLPLVGLKYTWFRSNGVAKGRLDKCLISSSWDDQWLGRSIQVEGWGACMLKEKLKRLRGRLKEWNTHSFENLHDRKEIIEEKLSSFDKKDEEGTLCEGCSD

SEQ ID NO: 201624 - protein, 515 aa, Glycine max
  Coding DNA Sequence Number=SeqID_84846
  Gene Ontology: Mol. function=DNA binding; Cellular component=proton -transporting two-sector ATPase complex; Biological process=DNA integration
  Pfam annotation: Domain name=rve; Domain location=240-408; Score =42.1; E_value=1.9e-09; Accession=PF00665.16; Description=Integrase core domain
MTSNGLNLFQFPRLTKWNYDNRCHRMKALVGSQDVWEVVEKGYTKPENEDSLPQTEKETLLKMKKDQQALTFIYQGLDEGMFEMVSNTSTSKEAWEILKTSLEGVDKVKKVHLQTLREEFESLQMKESESILDFGNRVIMVVNQMKHYGENMEDVQVVEKVIHSLTAKFDFVEKKSHGSGQGRGDHDKCDNNERSNQPTRNYERGRGRDNFGRTNERRANLGGEKEEDKEPTLLLAHNREENGDKNLWYIDNGASNHMCGYKEKFVELEEKEKENVSSDDSSKGYEVLMKDNCLWLKDQNSNLIAKALVKKESGYVIKALRSNRGGEFTSKEFNEFCENNGILHPLTVPRTPQQNGVAERKNRTILNTTRCMLKAKSMPKEFWAKAVSFFGSIANAHVPDQGRYKLDDRSVKHAIIGYVASSKGYKLYNSSNGKIVVSRDIEFDEEETWNREKKEGTYVFLSYFEENDEEVAAPNEFSTPPPSPTHSIHEASSSAGSSKAMEEKRRRRDIKKNDI

SEQ ID NO: 201625 - protein, 253 aa, Glycine max
  Coding DNA Sequence Number=SeqID_84847
  Homolog annotation: Hit_ID=Q9LTP9; Match level="QueryCoverage=67%, HitCoverage=64%, E-value=5e-40, Identity=51%"; Hit description =Arabidopsis thaliana genomic DNA, chromosome 3, P1 clone: MQC12
MEDGDNILDAIYEEDTLDDDVDMVDVEEGELVEPDSQNVLGQSSAGDINEPNQEPLSKNQKRRANKKKNKKKRKGSGSNAMDINRFVLDTCRRLKEKKSYMVYTAVGCLGVSALSDLVNEVDAIQTCGGQKTADGRRFRTGGGILWSILKVREPKVYKEIIKKAKEFEKQFRQPNVMQRPVPKKEDSSQGVPVSFSGRDLGNVSDSNILASQMQNQHQPATLEEKPVSAHDRLRIPVSYDDDLLGENPINDAT

SEQ ID NO: 201626 - protein, 296 aa, Glycine max
  Coding DNA Sequence Number=SeqID_84848
  Gene Ontology: Mol. function=protein serine/threonine kinase activity; Cellular component=chromosome, pericentric region; Biological process=protein amino acid phosphorylation
  Homolog annotation: Hit_ID=Q1S0R7; Match level="QueryCoverage=88%, HitCoverage=97%, E-value=1e-133, Identity=85%"; Hit description =Protein kinase
  Pfam annotation: Domain name=Pkinase; Domain location=21-272; Score =307.7; E_value=2.2e-89; Accession=PF00069.15; Description=Protein kinase domain
  Pfam annotation: Domain name=Pkinase_Tyr; Domain location=21-270; Score=84.1; E_value=4.3e-22; Accession=PF07714.7; Description =Protein tyrosine kinase
  Pfam annotation: Domain name=RIO1; Domain location=34-183; Score= -90.9; E_value=0.028; Accession=PF01163.12; Description=RIO1 family
  Pfam module annotation: Pfam domain module=Pkinase::Pkinase _Tyr::RIO1; Domain location=21-272::21-270::34-183
MASQNPAEEENSKRHWSLEDFEIGKPLGRGKFGRVYVAREVKSKFVVALKVIFKEQIDKYRVHHQLRREMEIQTSLRHANILRLYGWFHDADRVFLILEYAHKGELYKELRKKGHLTEKQAATYILSLTKALAYCHEKHVIHRDIKPENLLLDHEGRLKIADFGWSVQSRSKRHTMCGTLDYLAPEMVENKAHDYAVDNWTLGILCYEFLYGAPPFEAESQSDTFKRIMKVDLSFPSTPSVSIEAKNLISRLLVKDSSRRLSLQKIMEHPWIIKNADFVVFKCLINLNDTLPLLRG

SEQ ID NO: 201627 - protein, 97 aa, Glycine max
  Coding DNA Sequence Number=SeqID_84849
  Gene Ontology: Mol. function=oxidoreductase activity, acting on NADH or NADPH; Cellular component=mitochondrion; Biological process =mitochondrial electron transport, NADH to ubiquinone
  Homolog annotation: Hit_ID=Q42577; Match level="QueryCoverage=74%, HitCoverage=33%, E-value=4e-28, Identity=78%"; Hit description=NADH -ubiquinone oxidoreductase 20 kDa subunit, mitochondrial precursor
  Pfam annotation: Domain name=Oxidored_q6; Domain location=1-58; Score= 47.2; E_value=5.5e-11; Accession=PF01058.12; Description=NADH ubiquinone oxidoreductase, 20 Kd
MPEPRWVVSMGSCANGGGYYHYSYSVVRGCDRIVPVDIYVPGCPPTAEALLYGLLQLQKKINRRKDFLHWWTKFLLYLIPSAPPFLNLLTVRPSKRN

SEQ ID NO: 201628 - protein, 150 aa, Glycine max
  Coding DNA Sequence Number=SeqID_84850
  Gene Ontology: Mol. function=oxidoreductase activity, acting on NADH or NADPH; Cellular component=mitochondrion; Biological process =mitochondrial electron transport, NADH to ubiquinone
  Homolog annotation: Hit_ID=Q9SP38; Match level="QueryCoverage=55%, HitCoverage=39%, E-value=5e-39, Identity=92%"; Hit description=NADH ubiquinone oxidoreductase PSST subunit
MEYYYLSTHKQSKSVHRVKRNKNREVKNPRKGKEGILAKSGSHLVGESAGDDHAIRLARAGPENDAEAVEIVAGGAGVHHFDGAAGEAEGHGPDGAAAGPVHQIVHLRDHELRRLRNAGGRGSGRRRWRGIWCRRGCGWGCVQRWERCVE

SEQ ID NO: 201629 - protein, 301 aa, Glycine max
  Coding DNA Sequence Number=SeqID_84851
  Gene Ontology: Mol. function=RNA binding; Cellular component=nucleus; Biological process=regulation of translation
  Homolog annotation: Hit_ID=Q9T0G5; Match level="QueryCoverage=55%, HitCoverage=22%, E-value=5e-41, Identity=53%"; Hit description =Putative DNA-directed RNA polymerase
  Pfam annotation: Domain name=KH_1; Domain location=177-243; Score =86.4; E_value=8.7e-23; Accession=PF00013.19; Description=KH domain
  Pfam annotation: Domain name=KH_1; Domain location=85-150; Score =71.8; E_value=2.2e-18; Accession=PF00013.19; Description=KH domain
  Pfam annotation: Domain name=KH_2; Domain location=177-229; Score =11.1; E_value=0.0057; Accession=PF07650.7; Description=KH domain
  Pfam annotation: Domain name=KH_2; Domain location=85-128; Score=3.7; E_value=0.044; Accession=PF07650.7; Description=KH domain
  Pfam module annotation: Pfam domain module=KH_1::KH_1::KH_2::KH_2; Domain location=177-243::85-150::177-229::85-128
MAEEAQYSSGPDSAPLKRKYEDQPSGIELAKQRAQEVAARLLNAAPPPPLDAKRPKPDTGFDSLDLKPLYSASPPPVSYGHQGSSKKIDIPNGRVGVIIGKGGETIKYLQLQSGAKIQITRDIDADPNSSTRTVELMGTPEAISSAEKLINEVLAEAESGGSGIVTRRFTGQAGSDEFVMKIPNNKVGLIIGKGGETIKNMQASTGARIQVIPLHLPPGDTSTERTLKIDGTPEQIESAKQLVYQVISGEGYSVYWTIGDTNMNSFVGVPSACPGMVLNLSFDIYYHGQHINLKFAHCEAL

SEQ ID NO: 201630 - protein, 163 aa, Glycine max
  Coding DNA Sequence Number=SeqID_84852
  Gene Ontology: Mol. function=transporter activity; Cellular component= intracellular; Biological process=transport
  Homolog annotation: Hit_ID=Q94FN3; Match level="QueryCoverage=99%, HitCoverage=28%, E-value=2e-56, Identity=73%"; Hit description =Phosphatidylinositol transfer-like protein II
  Subcellular localization annotation: CTP_CleavageSite=80; ConfidenceScore=5.01e-01
MAVGAVDAYAMVDSFNIHEKMNSQIFTGVMAFVMGIVTMVRMTKNMPKKLTDANFYSNFGSEYKGQATNSEEMTTMPNISAKEFMTVMKRMAELEDKMVKMNNQTICMPPEKEEMLNAAITRADALEQELLATKKALEDSLSKQEELSAYIEKKKKKKKLFAW

SEQ ID NO: 201631 - protein, 65 aa, Glycine max
  Coding DNA Sequence Number=SeqID_84853
MADRCGVNLKQTSTAYVLSEAIGYIHFLHQQIQTLSIPYMKSAQSKPSRMVQLNLTPRRRVNFRK

SEQ ID NO: 201632 - protein, 118 aa, Glycine max
  Coding DNA Sequence Number=SeqID_84854
MEFARFHLQHQLQEESTMCITSTIPPPDSTPSFITNQSWIPSNMYNGYDRGFLTDQCFTNSRELQLKHAMTDSLRISTRQAFGFHNGKSLITQHPVSDNNNLFPARIFKGGMINTSMK

SEQ ID NO: 201633 - protein, 93 aa, Glycine max
  Coding DNA Sequence Number=SeqID_84855
  Gene Ontology: Mol. function=RNA-directed DNA polymerase activity; Biological process=RNA-dependent DNA replication
MKGDVPSWEEGMVDGLLVTNEVMDEAEKRKNYLVVDVDFEKSCGLVSSPVSILINGSPTKEFRRQRGLRHGDSITPFLFLLVSKDLSDLIRHA

SEQ ID NO: 201634 - protein, 592 aa, Glycine max
  Coding DNA Sequence Number=SeqID_84856
  Homolog annotation: Hit_ID=Q9LW36; Match level="QueryCoverage=93%, HitCoverage=94%, E-value=2e-90, Identity=37%"; Hit description =Arabidopsis thaliana genomic DNA, chromosome 3, P1 clone: MDJ14
MANVQWRFQIFSEEANQRASIRMCSDSEQQGWRYTWEAQSHIPTLRLTLFPNDKTLNPSLQCKDLAVDLHSSHSFLTLTASFLSLRVPLPAVLVDGDSPVAFRPLSDHIEVKLLLLLPVDHPILSALDLSQTPPPDPLDSQSDVKILSSAGEVDFYCRTCAFKLTRIPLRNFVEMPSVNWREVADNWFGACCCSFGGISEKMAGGMSRCGEQECSTVTEVSRDDGVVKGMRNCELNDERTSTCSDYGEVTHAFDSNSRLVHPEDEKLSVNLRCEVAKSKPGCGDFPDSCPDLNHAEDVTQTPSCCAHLTSNVGHGDSEHNLCGTAGKKGMPTETVEILGNQKSFLNGYLEDVFMARLSNLSKDIDWREFTCPQCTSLLGAYPCREGQTPVDGGVRFFKCYISTCVQVGGSGDMFRKSIKSQKLKYWWTKLLPMAVLLHASGSPSACSTYRLQIIKYTMGKMFANQLMECANDESSFRFVIRDLTTKSPVLQIILLNPDTWSCSGNCSSLEDKDPIAKLKLQPIIKVLFSDCHNATESQSRLIEEWATKNSAEDIFMLTRQTQELVGLFISAKDLYPPCCASLQGLILSSLQL

SEQ ID NO: 201635 - protein, 91 aa, Glycine max
  Coding DNA Sequence Number=SeqID_84857
MGRTAQVNIICGKCLNGQCKGRPGCICNVTNESNCRVLVDLAIPCDKPGPPVFQGFTVGFHPRSWELVSRLYHFHLYVFVCLKDICILHST

SEQ ID NO: 201636 - protein, 66 aa, Glycine max
  Coding DNA Sequence Number=SeqID_84858
MAYKAGEKVLKKKKDEIWEQNVRVVPLLIYFNLVISLVVVGLNHHPRGCNLGNPKEAAIKAELDCN

SEQ ID NO: 201637 - protein, 74 aa, Glycine max
  Coding DNA Sequence Number=SeqID_84859
  Gene Ontology: Mol. function=oxidoreductase activity; Biological process=hydrogen peroxide catabolic process
  Homolog annotation: Hit_ID=O23237; Match level="QueryCoverage=73%, HitCoverage=16%, E-value=8e-16, Identity=74%"; Hit description =Peroxidase 49 precursor
TGGPSWLVSLGRRDSRDASISGSNNNIPASNCTFQILQTKFEQQGLNITDLVALSVKAISSPSSHIANACIEGV

SEQ ID NO: 201638 - protein, 88 aa, Glycine max
  Coding DNA Sequence Number=SeqID_84860
MVMQWCNIGGRKKKCRGGKEVKLFKVGKPNEVDRASMGVEVVEWGAGLHVKAKRGAGDDVREGVQRRSITYRKKKKNTLVNVEEALKK

SEQ ID NO: 201639 - protein, 223 aa, Glycine max
  Coding DNA Sequence Number=SeqID_84861
  Gene Ontology: Mol. function=molecular_function; Cellular component =cytosol; Biological process=cell differentiation
  Homolog annotation: Hit_ID=Q6Z8B1; Match level="QueryCoverage=97%, HitCoverage=63%, E-value=3e-82, Identity=67%"; Hit description =Putative pollen specific protein
  Pfam annotation: Domain name=Ndr; Domain location=18-223; Score =160.1; E_value=5.6e-45; Accession=PF03096.5; Description=Ndr family
MADSVSVDMEAISPPPEEHIIRTRHGRVSVAVYGDQDKPALITYPDLALNYVSCFQGLLFCPEACSLLLHNFCIYHISPPGHELGAAAIDPDDPILSADDLADQIAEVLNYFGLWYKVLEILEQNKRKGKMKYRHRVLGLVLVSPLCKAPSWTEWLYNKVMSNLLYFYGMCGVVKEILLKRYFSKEVRGSDYLSESDVVQACQRSLDERQSLNVWRFLEAING

SEQ ID NO: 201640 - protein, 231 aa, Glycine max
  Coding DNA Sequence Number=SeqID_84862
  Gene Ontology: Mol. function=RNA-directed DNA polymerase activity; Biological process=RNA-dependent DNA replication
  Homolog annotation: Hit_ID=Q1SWC8; Match level="QueryCoverage=96%, HitCoverage=19%, E-value=2e-21, Identity=31%"; Hit description=RNA -directed DNA polymerase
MSLTNIQDNDIPIQKFSSTEVYTVKSTYHPLMERMICNKHLKVQGNWNMLWNLQLPPKIKPFLWRSLRCYLPMRTRLQTKGVHYSSYRLKVFGKQQDSGIRLANTWELLNQLLNLTFTLLEKLPMELKRKFAITLWCIWKRRSEKVWESKTTLPNISISHAMQYLYEWTNACTTTTNSVLNNSKVLASYLTWIKPHHGFVKLDIDAHSTIFKDQNLFEAGLVLRDNQGCFL

SEQ ID NO: 201641 - protein, 127 aa, Glycine max
  Coding DNA Sequence Number=SeqID_84863
MPVTRREQKEKLEEGKDPSVVIAKNIGDTREKCCEVKWYPLNWKKSGQEKKDNAGSWNEKSGPKLSYMDIDGSLIPSKNVKLPNDIDVHILLNILDFKCNLLLDLFMRNLSRMGKQQDGLYTFSSLI

SEQ ID NO: 201642 - protein, 150 aa, Glycine max
  Coding DNA Sequence Number=SeqID_84864
FDEFKDELMRRKWDEELTSFAKGSIDVAIVKEFYANVYDLEDNSPKQVRVRGHLIKFDEATLNTFLRTPVIIEEGETLSAYSRFALLRPDPQELATKLCILGRGFELNADGQPLKILRKNMITLAQTWSVLSYANLVPTSHTSDITMDRA

SEQ ID NO: 201643 - protein, 110 aa, Glycine max
  Coding DNA Sequence Number=SeqID_84865
  Homolog annotation: Hit_ID=Q9FYN1; Match level="QueryCoverage=70%, HitCoverage=71%, E-value=8e-08, Identity=41%"; Hit description =Arabidopsis thaliana genomic DNA, chromosome 5, P1 clone:MOK16
MELRSTFTTCFLLLILILALPCFSKGESEELHTEIYEIDYRGPETHSSGVPPPHHHFHIGKQHSTHHSQKGSVRGTKALGLRDGTYDENKASLFYFFNVSLYRRVFNYSS

SEQ ID NO: 201644 - protein, 300 aa, Glycine max
  Coding DNA Sequence Number=SeqID_84866
  Subcellular localization annotation: CTP_CleavageSite=63; ConfidenceScore=5.75e-01
MKPPTKPISSPGRTEKFPPPLMRFLRNNAASRSRGRSRTTTTMFLRKKNTNIETQEPSSPKVTCMGQVRVKRSATKRVDSDAKRVPSAGAGAPTKCRCCSWVPHALFFHRFRKPGFSFPFQCKQVRPNWGFLKRKKTDSKVTETSSPKTELNFRGRHNPSYDDSEHEDRVNPPAFVSNTSTTPPRNALLLTRCRSAPGRRFLNKETEVVENRVNREHSENNRDPKLEAKLRFFKELEESLRERIMESEKQREESDSVHPLVLTRCKSEPARTAQKLDPELNVLSEKTTLGFARAWFSHVL

SEQ ID NO: 201645 - protein, 389 aa, Glycine max
  Coding DNA Sequence Number=SeqID_84867
MWHLLLLVAVAGSTGFATKRFLTHHRNTGEGENVNLHDPNELDFSGSESISQTHHSDGVFTFSSSKSESLTQRDGPKSRRSRASKNGVRAPKVEARSEKRSGGTRLHFRLKKGEITKNVAAKAPVRSSKDDCLFGWGFCFGIMYMMSAGKAEINKLNKTMDETAKLVQELKSELNRRKSSHALQILDSVGNGVKNSCKISGRNEVMLKNTNIELRDVDVKICSPCVNDCGECGSSALTEEPEPQVLEMDQLEAELEFELQKLSGCATDGPCNEKIKPNLDELEAPNEGYHGTDDWNLNYSNSHGVSASELHQKLSHLLIKQQENQIAELESELHQAQSNLHEKEAELQALKDCVKCLTELSLSTVSGMIISILVTHFSCSQTPFMFVIG

SEQ ID NO: 201646 - protein, 83 aa, Glycine max
  Coding DNA Sequence Number=SeqID_84868
  Gene Ontology: Mol. function=RNA-directed DNA polymerase activity; Biological process=RNA-dependent DNA replication
MSHLSHAVEESGNGKWSELTRGRVLQLIKLHKLKLSLSQVALSSLSDMPPFLPFDQVRSTPEVGRCTRLQLSVQAQKVIKGVQ

SEQ ID NO: 201647 - protein, 66 aa, Glycine max
  Coding DNA Sequence Number=SeqID_84869
MEYGGGEKQSYKRMNYLIETTVLMLVLNAEVELQRTAAVTNPSDNDGVEETTVTGLRGEGERGFCF

SEQ ID NO: 201648 - protein, 74 aa, Glycine max
  Coding DNA Sequence Number=SeqID_84870
MDKPYVSDLGYSHFPTSNQMSTLGRDIGVGRVTLPMAVLSDFESEEEEDLYLMEENPKENLDVTSRGCFSRGFA

SEQ ID NO: 201649 - protein, 78 aa, Glycine max
  Coding DNA Sequence Number=SeqID_84871
  Subcellular localization annotation: CTP_CleavageSite=35; ConfidenceScore=5.01e-01
MGRWLSPCHKDLKNVGRMRMTPQRLSLLDCPSRFSVDSLSTVPNYSRPWRFPLPHKHSSPKCDPDFHNMSSSMTGIPS

SEQ ID NO: 201650 - protein, 104 aa, Glycine max; identical to SEQ ID NO: 140397
  Coding DNA Sequence Number=SeqID_84872

SEQ ID NO: 201651 - protein, 300 aa, Glycine max
  Coding DNA Sequence Number=SeqID_84873
  Gene Ontology: Mol. function=phosphatidylglycerol-prolipoprotein diacylglyceryl transferase activity; Cellular component=integral to membrane; Biological process=lipoprotein biosynthetic process
  Homolog annotation: Hit_ID=Q8PP47; Match level="QueryCoverage=82%, HitCoverage=83%, E-value=1e-104, Identity=75%"; Hit description =Prolipoprotein diacylglyceryl transferase
MDDRAQVQFLGGDQREAVGQVEKHLPAEHAAGTGAGAVALLGAVLEHVREQVQLRLQYRRAARHHQQHQAEGDQRQAEDLAAGQPVEGHVDTVVGHAHELHREAEQSVQQREQATHQVTVARLGRHGPQHHEHHQAFQERFIQLRRMTRELVQRTGRELRLQGRVVQLVQRRRQAGREHHAPRAVGVLAPQLGADEVADAAEAQAQRHQRRHEIHGVEEVQRVLARPPPAGTEYAEQAAVEAHAAIPDLEQQQRVVQEIAQRVEQHVADASAQHHAEHGVEQQVGEAVGIDARQATGGDA

SEQ ID NO: 201652 - protein, 42 aa, Glycine max
  Coding DNA Sequence Number=SeqID_84874
MHLATNISKEVWGTEIEDMMTMGTGTTTMVTMETMTTMRGEI

SEQ ID NO: 201653 - protein, 106 aa, Glycine max
  Coding DNA Sequence Number=SeqID_84875
MRRFKETEDCFIVGFDPSAAAVPLLVDSSANDVSVIAEKGQIYVKHLLAILCLLLTTTKTSFYIGGKPASTTGPTPSLFQVSLYVDNNDIGQLAPVFVMEKNNVSG

SEQ ID NO: 201654 - protein, 110 aa, Glycine max
  Coding DNA Sequence Number=SeqID_84876
MGVQIAILKLGFQSWIASGGSNLARLGELGGNLLPFFPINRLKGAVLRVPDPPENPSRGAFVTLSRCFRKQIHEGFPPLFTVLHPFFVLQRAKINSQSQARLRKITKKGF

SEQ ID NO: 201655 - protein, 148 aa, Glycine max
  Coding DNA Sequence Number=SeqID_84877
MHTGASFHPAATRRRVWIVRTNIWMTLLLSNLLPSDHHSDLPLPKDRACKTPSGPEEVQQGPRVLALITGLCRFYGVTTTPISPYRSVSWDCAHKTPSGPEEAQQGPGVLALITGLCRFYGVPVAPNKVIRPPINQAFIKKYCAPRQA

SEQ ID NO: 201656 - protein, 101 aa, Glycine max
  Coding DNA Sequence Number=SeqID_84878
  Gene Ontology: Mol. function=protein kinase activity; Biological process=protein amino acid phosphorylation
  Homolog annotation: Hit_ID=Q1SN45; Match level="QueryCoverage=99%, HitCoverage=5%, E-value=8e-16, Identity=40%"; Hit description=AAA ATPase
  Pfam annotation: Domain name=DUF889; Domain location=1-101; Score= -91.4; E_value=2.7e-05; Accession=PF05970.5; Description=Eukaryotic protein of unknown function (DUF889)
MRLQGNAQLIDDQETTKFAKWILDIGDGVIGNQNDGYATIEIPEYLLITEYNDPIDAIVKSTFPDLYQHHSNHEFFKSRAILASTNETVEEVNDYILSLIP

SEQ ID NO: 201657 - protein, 52 aa, Glycine max
  Coding DNA Sequence Number=SeqID_84879
  Homolog annotation: Hit_ID=Q9SD67; Match level="QueryCoverage=83%, HitCoverage=5%, E-value=7e-12, Identity=77%"; Hit description=FtsH metalloprotease-like protein
MTRPCLKGIEEKTAKLKGSEKALVARHEASHAVVGTAVANLLAGQPHVEICG

SEQ ID NO: 201658 - protein, 146 aa, Glycine max
  Coding DNA Sequence Number=SeqID_84880
  Gene Ontology: Mol. function=peptidase activity; Biological process =proteolysis
  Homolog annotation: Hit_ID=Q116U1; Match level="QueryCoverage=53%, HitCoverage=83%, E-value=2e-20, Identity=59%"; Hit description=ATP -dependent Clp protease adaptor protein ClpS
  Pfam annotation: Domain name=ClpS; Domain location=63-139; Score =126.8; E_value=6.1e-35; Accession=PF02617.7; Description=ATP -dependent Clp protease adaptor protein C
MVVLATGPGIGGGVLEKPVIEKVTPGLKASLKRVKVSCGSTKMSKTKERIFDSGFSKMCRKSRKSAPPYRVILHNDNFNKREYVVQVLMKVIPGMTLDNAVNIMQEAHYNGLSVVIICDQADAEDHCMQLRGNGLLSSIEPANGGC

SEQ ID NO: 201659 - protein, 126 aa, Glycine max
  Coding DNA Sequence Number=SeqID_84881
MLENNLFSGVAHEDPMPHLRKFTKLTNMVRQNRVPIETSLDAACRGNLMLKTPIDAIRIIKDMCSNPYNNSRDRRIMKRNINKVEKDDSQIELGKHMQALTLKIKTLMRAQAQVPITTPLFPTYDR

SEQ ID NO: 201660 - protein, 253 aa, Glycine max
  Coding DNA Sequence Number=SeqID_84882
  Gene Ontology: Mol. function=RNA-directed DNA polymerase activity; Biological process=RNA-dependent DNA replication
MPNVVMTRSKRILEDSEEKEGYFPKAVDDVFIEMDQALKKVEVPTDENLVPKKDGNEKQEILTSHQVSLPFPHRVKNDQRDVQFRKILEVMSKVHINLPIVEKLGITDLEPTNISLNLDDYSIVYLRGVIKDVLVKANKDVPIILGQPFLSTCDLLVKLNREVEEILMFLHSQHGPKPPSYERDKRETFGWSIHVMKGLGPTLYTHKINTKDGSLPKWSSQRKLIPNMMEVVKGEDVKPIVKMKTYDEGFQQV

SEQ ID NO: 201661 - protein, 104 aa, Glycine max
  Coding DNA Sequence Number=SeqID_84883
MEKGTIKQLHHNFRTGGLAAHDQSKTRNPIQDRHIYTNKVGMMVTIHPHSVVHASQLLKALKISVSEKATTVVKSTMMVVESFTKALRYCGLNMTLIVDLDPHS

SEQ ID NO: 201662 - protein, 67 aa, Glycine max
  Coding DNA Sequence Number=SeqID_84884
MDYSIQSYDSHHCFHFTMTTLFDSFDVNVRLPSIAFFPVTMHQTSVKLPHYATLRLKLVATMRSGME

SEQ ID NO: 201663 - protein, 58 aa, Glycine max
  Coding DNA Sequence Number=SeqID_84885
MVGYLIEQSAQGSERLSVTDRESEKRERQELRHKRDRESVAQFSQAPLLLKHNCLLGY

SEQ ID NO: 201664 - protein, 406 aa, Glycine max
  Coding DNA Sequence Number=SeqID_84886
  Gene Ontology: Mol. function=phosphoinositide phospholipase C activity; Biological process=intracellular signaling cascade
  Homolog annotation: Hit_ID=Q9SK32; Match level="QueryCoverage=31%, HitCoverage=25%, E-value=1e-14, Identity=39%"; Hit description =Expressed protein
MAHAQPEPIDGSFLHLQDNHISDQETITLQDVALQLGLKIGRLPITGAITGDVRVACQALLGDTSPDKYIKGKMTYLTWLRQNFQQLPIDVDDVVIAQHAKAHIMMLIGECLMLDTLGARVHFMYLLLLSNLIEATHYSWGATVLASLFRALDWVVKPLQIEISGWRPVEVTLFYENAPTMWDRHRLKRALKPGVFTPKAYTLKSPSGPLPLDSARLARLWTTKHALVDFDLAHAFLAQRMDWSGVLSGITLHSTQMHSSSFFQILPRAQSRSVALSGWLAKPEDWLNERMKISSSHTCLINLKLRGNGVSLLVIDYRHMEFRIPVTGPEYPMSEPPPHLLEGKIGESERAKASPDGESEMIIKGGDGGTTSISQTSGPMVADGGAGVDDEGMSYALALFLDAICN

SEQ ID NO: 201665 - protein, 72 aa, Glycine max
  Coding DNA Sequence Number=SeqID_84887
MVHCLRTWRHYEPGSAPAEASRELELERKKKELADETVRRDEMIKSASRLATRIKNAVERKKERTGAILEDC

SEQ ID NO: 201666 - protein, 73 aa, Glycine max
  Coding DNA Sequence Number=SeqID_84888
MAFVFGCLAFKLRLRSTPLLSLSSLPFIYIDTPFFSHSLGQRLERGARQGRALSGLKNKKDAPSLISYLRKGR

SEQ ID NO: 201667 - protein, 93 aa, Glycine max
  Coding DNA Sequence Number=SeqID_84889
MVTDDSNDYDEGSPILYTIVDSSTVLQKQDLTWLKETLPTDLQMQTNYSTNMLLCNLFVIKARDGYDRGSSILSLSCKQGAGGDADIAKFAWD

SEQ ID NO: 201668 - protein, 57 aa, Glycine max
  Coding DNA Sequence Number=SeqID_84890
MKMNQYIRDIGNFVQKEKESLLRPRKGCKRSLEIVHTMALLKKDRRIMKRGINQVGT

SEQ ID NO: 201669 - protein, 70 aa, Glycine max
  Coding DNA Sequence Number=SeqID_84891
  Subcellular localization annotation: CTP_CleavageSite=26; ConfidenceScore=5.14e-01
MRTIKGKGRRCLPPSSPRQARLLPPKATVFWMANGAKFVYACLSPNLRNLNGKGRIIRLCVFTTRLAAPE

SEQ ID NO: 201670 - protein, 122 aa, Glycine max
  Coding DNA Sequence Number=SeqID_84892
  Homolog annotation: Hit_ID=Q9LTU4; Match level="QueryCoverage=74%, HitCoverage=6%, E-value=1e-12, Identity=38%"; Hit description =Helicase-like protein
MMFAFTSAGIKFDKTISHSRGPPTIRIQEKDGRRYNVPSVPEVAALIAGYTMIESKRLSYVRNNQKKLRVDKFCSLQQSSDAGNTEGLGQGKRIILPSTFVGSPRYMDQLYFDGIVIVYAVT

SEQ ID NO: 201671 - protein, 105 aa, Glycine max
  Coding DNA Sequence Number=SeqID_84893
MGPVLSDPQRPLVGGCEKKSIGHPEAKHCPPPPHVLSRGGYEYLEQKLMAEKTKKILEEAAQSGSTVGVIDPPSPIRRHMKWKMARTKKIGQMTSETAKEITEKI

SEQ ID NO: 201672 - protein, 260 aa, Glycine max
  Coding DNA Sequence Number=SeqID_84894
  Gene Ontology: Mol. function=nucleic acid binding; Biological process= RNA-dependent DNA replication
MSQNFTDCATMLSFDFRHVTELHGLPNDGCQVPRSGQMRVTSQQTDGPRTKLGPLIQDQVQDYPLSMLRCHEACILLSQTAPNPKEEVDVESIRSGQPIIEEKATPPQEKEALIEEIQEANKAGENDVLTPPQAIDQMQKHAKYLKGIFSNKGKLVDLATIGLNKKCFAIFLRKFPPKLSDPRSFSIPCTIGNLGIDSALCDLGANINLMSYSIDKKLALQQPQPTNIYLLLAEQERERYRKRGSKGSFQGVLWTLACPG

SEQ ID NO: 201673 - protein, 313 aa, Glycine max
  Coding DNA Sequence Number=SeqID_84895
  Gene Ontology: Mol. function=chitin binding; Cellular component =extracellular region; Biological process=chitin metabolic process
  Homolog annotation: Hit_ID=UPI00006A17C9; Match level="QueryCoverage =97%, HitCoverage=100%, E-value=2e-39, Identity=30%"; Hit description= UPI00006A17C9 related cluster
MSSTSEDYMSSTSEDYTFSPLEDYMSLPYEGYTASPFQDYTPSPSEDYTSSPSEDYTSSPSEGCTFSPFIGVHALPFIGLHVLTFKGLHVIAFRGVHVLAFRGLQALAFIGLHTPALKGLHVLPFRGQHDLPFRGLHALALTGLHVLTFTGLHNLAFRRLDALAFRGVHILPLRGLHALAFVGLHTLTFKGVHVLNIRGLYIVAIRGLHVLAFRGLHVLHFRGLHAHTFKRYLHRTTRPWLRKASRPHLQRTTHARLQRTTRLCLRRTTRPHLQRTTHPRFLSDTCPRLQRTTRLTFQGSARPCLQWATRPCL

SEQ ID NO: 201674 - protein, 78 aa, Glycine max
  Coding DNA Sequence Number=SeqID_84896
  Gene Ontology: Mol. function=DNA binding; Biological process=DNA integration
MIDEALTDDDWIIAMEEELHQFTKNDVWALAPRLENKSIIGTRWVFKNKLDKQDEVYAKQPHDFEDHILPNHTFKLKN

SEQ ID NO: 201675 - protein, 123 aa, Glycine max
  Coding DNA Sequence Number=SeqID_84897
  Homolog annotation: Hit_ID=Q1SFQ3; Match level="QueryCoverage=28%, HitCoverage=6%, E-value=1e-10, Identity=82%"; Hit description=Zinc finger, RING-type; Protein kinase PKN/PRK1, effector
  Pfam annotation: Domain name=zf-C3HC4; Domain location=43-77; Score =19.1; E_value=0.0017; Accession=PF00097.15; Description=Zinc finger, C3HC4 type (RING finger)
MLAVRMLKSFNKTKLTSHRVTLLQSPKLKYIDLCTWHVTLLSKLIQKEVVITKCYHLFCYSCIQKVAGSRHRKCPQCETWFSPGCREEAGVLLKKIWCMDTYIGGSIVCLVPTVEIRNIGSDQ

SEQ ID NO: 201676 - protein, 173 aa, Glycine max
  Coding DNA Sequence Number=SeqID_84898
MWNMFPHQARFWEDGWLADGIPLMAKYPRLYLNSNQKNQYIQQLGSSSGGTWEWCLQWRRLLFEAEIPMGSSFLEEIQGLNINEQQQDRTGEKVKGITGSETGKRERGVSEGSFVPVKKLREGGFSGRKFLGFYFGSQTQPVFEPNRNSQISVVPQRATIFHGDPAGSGEDTI

SEQ ID NO: 201677 - protein, 173 aa, Glycine max
  Coding DNA Sequence Number=SeqID_84899
MPYKSHARIPYFQCGNQDPYLRRHLFHGRFLHSHECYSQEYNMGIISFPVLAIPILSLCSQEVSVISDLWPFSGNPVTVLYRLNLYLYSARGMTQPETMQLRGLIGDVSVLVQFDKCASHNFIAQELVQKLRLKVPPTTRYGVQLGGGFHKQSQRYCKDLKLNLANYELSANF

SEQ ID NO: 201678 - protein, 160 aa, Glycine max
  Coding DNA Sequence Number=SeqID_84900
MAFGTMAAHPGELMLHPEVIAISESKDRATMTHAGLFGKLGEYVMDLTRMAKKEAIVKKNRGLALKTSIQSSDESEDGNAEGSNAENLNLLVKRFNKFLKKKKNYGNITFHLRRISRKEEANFRLMAIIEAESEGSGMEKEEREETPLQGEDESRRSSPP

SEQ ID NO: 201679 - protein, 121 aa, Glycine max
  Coding DNA Sequence Number=SeqID_84901
MSGEFEMSMMGELNYFLSLQVKQMNHGTFLHQTNYCKELLKKFDMDKIKEAATPMATNCYLSVDEKMKLIDQTKILGQHYPLMQSYPLRALDRRLQEDWARDAREGPRVLMSLRVDFGSMG

SEQ ID NO: 201680 - protein, 140 aa, Glycine max
  Coding DNA Sequence Number=SeqID_84902
  Homolog annotation: Hit_ID=Q1SDG1; Match level="QueryCoverage=63%, HitCoverage=7%, E-value=8e-07, Identity=34%"; Hit description =Integrase, catalytic region; Zinc finger, CCHC-type
MVFVLLYMVEVLKDLRTIGLELISRAIIIGSAKGASINRQPLFRSMNYSFGKVRMKIFMESIKKGIWSVVVNGYTIPAHVVDNKTIEKPYESWLQEEIRKGEYDSKAMNIIHSSLYSDEFFRVSICIAPKRDVGFNPSHT

SEQ ID NO: 201681 - protein, 129 aa, Glycine max
  Coding DNA Sequence Number=SeqID_84903
  Gene Ontology: Mol. function=nucleic acid binding
MDYLTPTLGDPNTILLPKLLDGPIFDFKYGFLQMLENLRKFIKFTNTVRQNRYLRTTSLHGTNATSTFLRKYFSPMKTNQYIKDIGNFMQREQESIPEAWERLQEMIRSCPHHGFSQQRPVHIFYGGVC

SEQ ID NO: 201682 - protein, 485 aa, Glycine max
  Coding DNA Sequence Number=SeqID_84904
  Homolog annotation: Hit_ID=Q6D8K0; Match level="QueryCoverage=46%, HitCoverage=62%, E-value=1e-105, Identity=83%"; Hit description =Membrane-bound lytic murein transglycosylase C precursor
  Pfam annotation: Domain name=Iron_traffic; Domain location=179-266; Score=191.4; E_value=2.1e-54; Accession=PF04362.5; Description =Bacterial Fe(2+) trafficking
  Pfam annotation: Domain name=SLT; Domain location=427-484; Score= -6.5; E_value=0.0095; Accession=PF01464.10; Description =Transglycosylase SLT domain
  Pfam module annotation: Pfam domain module=Iron_traffic::SLT; Domain location=179-266::427-484
VEKRLWQISEDVTPAEGVSQFNQAMMDLGALVRTRFRSKCDICPLNSGCAAYAQGNWADYPGKKPKVTLPERSGWFLMLQHGDEVFLEQRPPVGLWGGLFCFPQFTSEQALTDWLAARGIHAKPQQLTAFRHTFSHFHLDIVPMWLAWPSSGSLMDEAGAAPSPAASTANQFDRRGRVMSRTIFCTYLQRDAEGQDFQLYPGELGKRIYNEISKEAWQQWMSKQTMLINEKKLNMMNPEDRKVLEKEMVNFLFEGKDVHIEEWVKDTNGFDILMGQFAANIENIWGINEVLIAGPKDYVKYSDNYYTRSHINFDSGSITIETISGTDPMASLRQAIITTLLIGDDPGNVDLYSDANDIQISKEPLLYGQVLDNTGQPIRWQGRAGNFADYLIQNKLQKRTSGLHVIWSVTIPMVPNHLDKRAHKYLPLVRKAAEQYGVDASLILAIMQTESSFNPYAVSNADALGLMQVVQHTAGVDVFRMKGQM

SEQ ID NO: 201683 - protein, 122 aa, Glycine max
  Coding DNA Sequence Number=SeqID_84905
MINANYPQESLHPISNGNLRIDFHKRFCKYNFEERTCRSDGTEWRSLKWLELQQERSEQKSPETTVPVELTEASGETVVSGNCVSEERNWKEAVVFLFLEMECWLEEGCSMAAIVREQRIHT

SEQ ID NO: 201684 - protein, 499 aa, Glycine max
  Coding DNA Sequence Number=SeqID_84906
  Gene Ontology: Mol. function=hydrolase activity, hydrolyzing O -glycosyl compounds; Cellular component=cellulose and pectin -containing cell wall; Biological process=carbohydrate metabolic process
  Homolog annotation: Hit_ID=Q1RTS8; Match level="QueryCoverage=94%, HitCoverage=94%, E-value=0.0, Identity=67%"; Hit description =Glycoside hydrolase, family 1
  Pfam annotation: Domain name=Glyco_hydro_1; Domain location=41-486; Score=614.4; E_value=9.8e-182; Accession=PF00232.9; Description =Glycosyl hydrolase family 1
MAFKGYFLLGLVTLVLVKSSKVTCEEESVNTVSPIIDISLNRKSFPEGFIFGAGSSSYQFEGAAKEGGRGPSVWDTFTHNYPGKIMDRSNGDMAIDSYHNYKKDVGMMKDMNLDSYRFSISWSRILPKGKLSGGINQEGINYYNNLINELLANGIQPLVTLFHWDLPQALEDEYGGFLSPRIVKDFRDYAELCFREFGDRVKYWVTLNEPWSYSQNGYANGRMAPGRCSAWMNLNCTGGDSSTEPYLVTHHQLLAHAAAVRVYKTKYQASQNGVIGITLVANWFLPLRDTKSDQKATERAIDFMYGWFMDPLTSGDYPNSMRSLVRTRLPKFTAEQSKLLIGSFDFIGLNYYSTTYASDAPDLSEARPSYLTDSLVTPAYERDGKPIGIKIASDWLYVYPRGIRDLLLYTKEKYNNPLIYITENGINEYNEPTLSLEESLIDTFRIDYHYRHLFYLQSAIRLYITFWDDLRGLQKWFEEIPKAFSAMVQEFSQERKKTL

SEQ ID NO: 201685 - protein, 544 aa, Glycine max
  Coding DNA Sequence Number=SeqID_84907
  Gene Ontology: Mol. function=hydrolase activity, hydrolyzing O -glycosyl compounds; Cellular component=cellulose and pectin -containing cell wall; Biological process=carbohydrate metabolic process
  Homolog annotation: Hit_ID=Q1RTS8; Match level="QueryCoverage=94%, HitCoverage=99%, E-value=0.0, Identity=65%"; Hit description =Glycoside hydrolase, family 1
  Pfam annotation: Domain name=Glyco_hydro_1; Domain location=60-538; Score=762.5; E_value=2.5e-226; Accession=PF00232.9; Description =Glycosyl hydrolase family 1
MKGFAERTSKQSTKKNISHNMAFKGYFLLGLIALVIVRSSKVICEEAANTVSPIIDISLSRKSFPEGFIFGAGSSSYQFEGAAKEGGRGPSVWDTFTHNYPGKIMDRSNGDVAIDSYHNYKKDVGMMKDMNLDSYRFSISWSRILPKGKRSGGINQEGINYYNNLINELVANGIQPLVTLFHWDLPQALEDEYGGFLSPRIVNDFRDYAELCFREFGDRVKYWVTLNEPWSYSQNGYANGRMAPGRCSAWMNLNCTGGDSSTEPYLVTHHQLLAHAATARVYKTKYQASQNGVIGITLVANWFLPLRDTKSDQKATERAIDFMYGWFMDPLTSGDYPKSMRSLVRTRLPKFTVEQSKLLIGSFDFIGLNYYSTTYASDAPQLSNARPSYLTDSLVTPAYERDGKPIGIKIASDWLYVYPRGISDLLLYTKEKYNNPLIYITENGINEYDEPTLSLEESLIDTFRIDYHYRHLFYLQSAIRNGANVKGYYVWSLIDNFEWSSGYTSRFGMIFVDYKNDLKRYQKLSALWFKDFLKKETKLYGSNK

SEQ ID NO: 201686 - protein, 523 aa, Glycine max
  Coding DNA Sequence Number=SeqID_84908
  Gene Ontology: Mol. function=hydrolase activity, hydrolyzing O -glycosyl compounds; Cellular component=cellulose and pectin -containing cell wall; Biological process=carbohydrate metabolic process
  Homolog annotation: Hit_ID=Q1RYZ6; Match level="QueryCoverage=96%, HitCoverage=99%, E-value=0.0, Identity=66%"; Hit description =Glycoside hydrolase, family 1
  Pfam annotation: Domain name=Glyco_hydro_1; Domain location=39-517; Score=766.8; E_value=1.3e-227; Accession=PF00232.9; Description =Glycosyl hydrolase family 1
MAFKGYFLIGLIAIVVVTSKVTCELEAETVSPIIDISLNRNSFPEGFIFGAGSSSYQFEGAAMEGGREPSVWDTFTHNYPAKIKDRSNGDVAIDSYHHYKEDVGMMKDMNLDSYRFSISWSRILPKGKLSGGINQEGINYYNNLINELLANGIQPLVTLFHWDLPQALEDEYGGFLSPLIVKDFRDYAEICFKEFGDRVKYWVTLNEPWSYSQHGYANGGMAPGRCSAWLNSNCTGGDSATEPYLVTHHQLLAHAAVVRVYKTKYQVSQKGSIGITLVANWFIPLRDTKSDQKAAERAIDFMYGWFMDPLTTGDYPKSMRSLVRTRLPKFTTEQSKLLIGSFDFIGLNYYSTTYASDAPQLSNARPNYITDSLVSPAFERDGKPIGIKIASEWIYVYPRGIRDLLLYTKEKYNNPLIYITENGINEYDEPTQSLEESLMDIYRIDYHYRHLFYLLSAIRNGSNVKGYYVWSLFDNFEWSSGFTSRFGMIYVDYKNDLKRYKKFSALWFENFLKKETKLYGSSK

SEQ ID NO: 201687 - protein, 224 aa, Glycine max
  Coding DNA Sequence Number=SeqID_84909
  Homolog annotation: Hit_ID=Q8S8B4; Match level="QueryCoverage=43%, HitCoverage=7%, E-value=3e-09, Identity=37%"; Hit description =Putative chromosome associated protein
MIKLATLQSEGSDYSTIKLKCERTLTTLHCGNHTKATKAMKQLRQFKIILIKSFGASVEHHYEKTIFLTELAHTLLLFKLGYFFFMHLFINYASLLIGFLPNTPAQFGLAVDFWKLLVEAKEQKLLDEIDRLKEELQHCDENMNSIVPSLAKVERRNIVSCKSILFTTFHSQENISYEFKLLRYRSLWGKENELTAEIDKLRAEVEKAEKSLDHAIPGVSNPSF

SEQ ID NO: 201688 - protein, 191 aa, Glycine max
  Coding DNA Sequence Number=SeqID_84910
  Gene Ontology: Mol. function=hydrolase activity, hydrolyzing O -glycosyl compounds; Cellular component=cellulose and pectin -containing cell wall; Biological process=carbohydrate metabolic process
  Homolog annotation: Hit_ID=Q1RTS0; Match level="QueryCoverage=99%, HitCoverage=42%, E-value=6e-66, Identity=66%"; Hit description =Glycoside hydrolase, family 1
  Pfam annotation: Domain name=Glyco_hydro_1; Domain location=1-178; Score=-269.8; E_value=3.7e-05; Accession=PF00232.9; Description =Glycosyl hydrolase family 1
MDPLTSGDYPNSMRSLVRTRLPKFTAEQSKLLIGSFDFIGLNYYSTTYASDAPDLSEARPSYLTDSLVTPAYERDGKPIGIKIASDWLYVYPRGIRDLLLYTKEKYNNPLIYITENGINEYNEPTLSLEESLIDTFRIDYHYRHLFYLQSAIRLYITFWDDLRGLQKWFEEIPKAFSAMVQEFSQERKKTL

SEQ ID NO: 201689 - protein, 119 aa, Glycine max
  Coding DNA Sequence Number=SeqID_84911
  Gene Ontology: Mol. function=hydrolase activity, hydrolyzing O -glycosyl compounds; Biological process=carbohydrate metabolic process
  Homolog annotation: Hit_ID=P26204; Match level="QueryCoverage=58%, HitCoverage=12%, E-value=7e-11, Identity=63%"; Hit description=Non -cyanogenic beta-glucosidase precursor
ITITRSNTNALIHEVSYLNRSSFPLGFIFGTASSAYQKLRYIILRCSMKVLQVKVEKDRVYGILSLINTQNSEVVDRVGGEIIEMEVKERILRDSIVDGIMSLIVSNKETRETSNCSSD

SEQ ID NO: 201690 - protein, 730 aa, Glycine max
  Coding DNA Sequence Number=SeqID_84912
  Gene Ontology: Mol. function=oxidoreductase activity, acting on single donors with incorporation of molecular oxygen, incorporation of two atoms of oxygen; Cellular component=chloroplast; Biological process=fatty acid biosynthetic process
  Homolog annotation: Hit_ID=Q45HK6; Match level="QueryCoverage=98%, HitCoverage=80%, E-value=0.0, Identity=68%"; Hit description =Lipoxygenase LOX2
  Pfam annotation: Domain name=Lipoxygenase; Domain location=41-714; Score=1236.1; E_value=0; Accession=PF00305.9; Description =Lipoxygenase
MSLKQSTSMASLRVLLISLCLLGSLQVDNPTKRCYLPRETPSGLRRLREEELSHLRGNGEGERKSFERIYDYDIYNDIGDPDKSLELQRPPLGGKERPYPRRCRTGRPHSEADPLSEKRSRNFYVPRDECFSEVKQLTFSTKTLHSVLLILLPTLGKIIKEKELAFSYFHDIDSLFSHGLDLPPEETEKGFLGKIMPRLVKSISGDRTHVLRFETPETMSRDRFFWFRDEEFARQTVAGLNPYSIRLVTEWPLRSKLDPEIYGPPESAITSEIINKEIGGIMSVEKAIEKKKLFMLDYHDILLPYVNKVRKLKGKTLYGSRTLFFLNSEGTLRPLAIELTRPPSSSNNTGQWKQVFTPSWHSTSVWLWRFAKAHVLAHDSGYHQLVSHWLRTHCVTEPYVIATNRQLSELHPIYKLLHPHFRYTMEINAIAREALINADGTIESSFAPGKYSIEISSAAYALEWRFDKQALPADLVSRGMAVKDPFSPHGLKLTIQDYPFANDGLLLWDAIKLWVTDYVNHYYPEPSLVESDEELQAWWTEIRTLGHADKKDEPWWPRLKTPKDLIGILNTIIWVTSGHHAAVNFGQYVYGGYFPNRPTIVRTKMPSEDPTEEEWKKFIANPERALLKCFPSQLQATRVMAVLDILSTHSPDEEYIGEKMEPSWGEDPVIKDAFERFRERLKKLETLIDERNENTKLKNRNGAGIVPYELLKPFSKPGVTGMGVPCSISI

SEQ ID NO: 201691 - protein, 485 aa, Glycine max
  Coding DNA Sequence Number=SeqID_84913
  Gene Ontology: Mol. function=hydrolase activity, hydrolyzing O -glycosyl compounds; Cellular component=cellulose and pectin -containing cell wall; Biological process=carbohydrate metabolic process
  Homolog annotation: Hit_ID=Q1RYZ6; Match level="QueryCoverage=97%, HitCoverage=98%, E-value=0.0, Identity=66%"; Hit description =Glycoside hydrolase, family 1
  Pfam annotation: Domain name=Glyco_hydro_1; Domain location=33-484; Score=680.8; E_value=1.1e-201; Accession=PF00232.9; Description =Glycosyl hydrolase family 1
  Subcellular localization annotation: CTP_CleavageSite=46; ConfidenceScore=5.11e-01
MAFKGYLYILIGVFTLVISSSVNITQAVAPSLNRTSFPPGFIFGTASSAYQYEGAANEGGRGPSTWDAYSHKYPEKISDRSNGDVAVDQYHRYKEDVGIMKYMNTDAYRFSISWSRILPKGKISAGINQEGIKYYNNLINELLANDLLPFVTLFHWDLPQALQDDYGGFLSPHIINDFQDYAKLCFKEFGDRVKHWITFNEPWSYSMGSEPYLSSHYQLLAHAAAVKIYKTNYQASQNGLIGITLNCHWFIPFSNDTLDHQAALRALDFMFGWFMQPLTTGNYPETMQSLLGSRLPNFTEEQSKLLIGSFDFVGLNYYTTNYAAHIFQTINNTSNTSYFQDTHINFTTERNGTPIGPRAASSWLYVYPRGLRELLLYIKMKYNNPVIYITENGMDESNDPTLSLEEALMDTCRIDYFYRHLYYILIAIKDGVKVQGYFAWSLLDNFEWSAGYTLRFGINFVDYKDNLKRHQKLSAHWFRNFLQKY

SEQ ID NO: 201692 - protein, 64 aa, Glycine max
  Coding DNA Sequence Number=SeqID_84914
MRVIKIEPISSNSMPVIYVPVVGADLMLSTGPFFWLFFGSRIVGLLEGVRMLNGSVLKVSYFGL

SEQ ID NO: 201693 - protein, 127 aa, Glycine max
  Coding DNA Sequence Number=SeqID_84915
MPISPYRCISWDHAHKALSGPEEVQQGPGVSSSGYGPLIALTRRPVDPKKSNRALGFPALVTGLCSPTGCPFPPARSRHHDIGIAPARHPMDPKKSNRVLELPSSNYGPLSVLRSACRPQQGHQAPY

SEQ ID NO: 201694 - protein, 99 aa, Glycine max
  Coding DNA Sequence Number=SeqID_84916
GENPYPRKKKWEEGKFPIKEWEKAKKKRRKVPNQRVRESKKEKKENSQIKEWEKEKEKKENPRSKIGREKNKYAERSWDQTISEQICHQVNKKRKETTT

SEQ ID NO: 201695 - protein, 251 aa, Glycine max
  Coding DNA Sequence Number=SeqID_84917
  Gene Ontology: Mol. function=chitin binding; Cellular component =extracellular region; Biological process=chitin metabolic process
  Homolog annotation: Hit_ID=UPI000044A8F0; Match level="QueryCoverage =80%, HitCoverage=97%, E-value=6e-14, Identity=23%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
  Subcellular localization annotation: CTP_CleavageSite=9; ConfidenceScore=5.49e-01
MFQQKAVPSGGSNPARLGDNHLPLFPYKFSPNSTLTFRGLHVLTFRGLHALTFRGLHFLAIRGLHVLAFRGLHLLAFTFRGLYVLAIRGLHALTFRGLHVLALRTTRPHLQRATRPRLQRTTHPRLEDYTSSPSADYTGLHVLTFRGLLVLVFRGLLALTFRGLHVLAIIGLHALTFRGLHVLAIRGRDALTFRERHALAFRGLHALAFRRQYVLAFRGLHALPFRELHALAFRGLCVLIFSVLHIHTLRD

SEQ ID NO: 201696 - protein, 184 aa, Glycine max
  Coding DNA Sequence Number=SeqID_84918
  Homolog annotation: Hit_ID=Q1S3X6; Match level="QueryCoverage=78%, HitCoverage=78%, E-value=1e-58, Identity=73%"; Hit description =Ribulose bisphosphate carboxylase, large chain
  Pfam annotation: Domain name=DUF640; Domain location=19-151; Score =304.3; E_value=2.3e-88; Accession=PF04852.3; Description=Protein of unknown function (DUF640)
MSSKGKEVAEGSSTTRPSHGGDDDHHHNQQQQLPLSRYESQKRRDWNTFGQYLRNQRPPVALSQCSSNHVLEFLRYLDQFGKTKVHSQGCLFFGQTEPPGPCTCPLRQAWGSLDALIGRLRAAYEENGGLPETNPFASGAIRVYLREVRDSQSKARGIPYKKKKKKRNVIKPNGDTSSSNLPMQ

SEQ ID NO: 201697 - protein, 82 aa, Glycine max
  Coding DNA Sequence Number=SeqID_84919
MTCSQDADLRGLAAPLPTTATILTGGVADCSAVRAEKTVVGGRKRVCGLWLALQNGFTEVELQVDFESVVKNLSGNKQGCAA

SEQ ID NO: 201698 - protein, 110 aa, Glycine max
  Coding DNA Sequence Number=SeqID_84920
  Gene Ontology: Mol. function=transferase activity, transferring glycosyl groups; Cellular component=endoplasmic reticulum
  Homolog annotation: Hit_ID=Q1T1R8; Match level="QueryCoverage=60%, HitCoverage=11%, E-value=8e-29, Identity=83%"; Hit description=Alg9 -like mannosyltransferase
MALSAVRQRRSEPSDPSPSEPYTKLDKPEKAEEKDEGLGWVFPFVALGLLRYMSATSNIIHDCDEVFNYWEPLHFLLYKTGFQTWEYSLGKMGQGRREKVLIFIIWGVFE

SEQ ID NO: 201699 - protein, 119 aa, Glycine max
  Coding DNA Sequence Number=SeqID_84921
MVFVILTHEVRRHAGYRMVIRTFRQPGANELIDAQRLTSSSALFVILTHGVRGSVWLSAPFVNQQRLTSSSAPFSHPGTASRVAGRDTLWFLLSSSEGIQARRRMGFFFDGRGRSSSMM

SEQ ID NO: 201700 - protein, 118 aa, Glycine max
  Coding DNA Sequence Number=SeqID_84922
MSPIAPPSDVTCVVIRHHTPVCEAHVPPLDLACGVFFQHALLQKPSRRSSPPVVTWFGYCLATVWLFQQLFGIVLMTIKFASSFVVTFTNVQLIRCEKLARTTNYNTWAVVVQLWFQG

SEQ ID NO: 201701 - protein, 264 aa, Glycine max
  Coding DNA Sequence Number=SeqID_84923
  Gene Ontology: Mol. function=protein domain specific binding; Cellular component=nucleus; Biological process=intracellular signaling cascade
  Homolog annotation: Hit_ID=Q96299; Match level="QueryCoverage=98%, HitCoverage=82%, E-value=3e-90, Identity=66%"; Hit description=14-3 -3-like protein GF14 mu
  Pfam annotation: Domain name=14-3-3; Domain location=1-261; Score =375.2; E_value=9.8e-110; Accession=PF00244.10; Description=14-3-3 protein
MVDAMKKVAKLDVELSVEERNLFSVGYKNVVGSRRASWRILSSIEQKEESKGNELHVKRIRDYRNKVELELSNICSDIMIVLDEHLIPSTNIAESTVFYYKMKGDYYRYLAEFKAGNEKKEVADQSLKAYEVFAGGLGLMLINCLEKAFLRVSMSVMCTREYSSLNFCDKAFSSATASTTAESELQPTHPIRLGLALNFSVFYYEIMNSPERACHLAKQAFDDAVSDLDTLNEDSYKDSTLIMQLLRDNLTLWTSDIPEEGGKI

SEQ ID NO: 201702 - protein, 78 aa, Glycine max
  Coding DNA Sequence Number=SeqID_84924
MHPLCSSGAYIHLFVQREQGRVHPLWIFACKGFYKAWLSARIKPLSEVCRSKKLQLSLSQILVGLAKMMHLKYKGACA

SEQ ID NO: 201703 - protein, 204 aa, Glycine max
  Coding DNA Sequence Number=SeqID_84925
MVYATFLDICLMPNSIYLFRTSKTVNLGELLVAFAKRNTPRLSARKTLEEDELYRFAKRTASDLELCMSRVSRDRKVQVLESFERFCCVKTYRDQSLKQEPASWCGQRGIHYHYNKNWGHVEADYHIKARELSQSVNVAQVITSTSDITIFAIEYNELFQLLAANEPASPVTSVAQSGNPITSFSQSSSIGLGVLDSDAFDYMT

SEQ ID NO: 201704 - protein, 80 aa, Glycine max
  Coding DNA Sequence Number=SeqID_84926
LESITWAFGIIKISRFIIMKLASTTMNLLSERAALSEFIKIHCRYAFPEELAKLTYHTKRVHLVRMNTHPPIEILVAKRG

SEQ ID NO: 201705 - protein, 598 aa, Glycine max
  Coding DNA Sequence Number=SeqID_84927
  Gene Ontology: Mol. function=binding; Cellular component=thylakoid; Biological process=photosynthesis
  Homolog annotation: Hit_ID=Q5QNE5; Match level="QueryCoverage=96%, HitCoverage=86%, E-value=1e-178, Identity=55%"; Hit description =Tetratricopeptide repeat protein-like
  Pfam annotation: Domain name=TPR_1; Domain location=126-159; Score =29.6; E_value=1.1e-05; Accession=PF00515.18; Description =Tetratricopeptide repeat
  Pfam annotation: Domain name=TPR_1; Domain location=160-193; Score =14.1; E_value=0.11; Accession=PF00515.18; Description=Tetratricopepti de repeat
  Pfam annotation: Domain name=TPR_1; Domain location=318-351; Score =24.1; E_value=0.00049; Accession=PF00515.18; Description =Tetratricopeptide repeat
  Pfam annotation: Domain name=TPR_1; Domain location=364-397; Score =9.9; E_value=0.36; Accession=PF00515.18; Description=Tetratricopeptid e repeat
  Pfam annotation: Domain name=TPR_1; Domain location=398-431; Score =31.6; E_value=2.8e-06; Accession=PF00515.18; Description =Tetratricopeptide repeat
  Pfam annotation: Domain name=TPR_1; Domain location=432-465; Score =14.5; E_value=0.1; Accession=PF00515.18; Description=Tetratricopeptid e repeat
  Pfam annotation: Domain name=TPR_2; Domain location=126-159; Score =29.7; E_value=1e-05; Accession=PF07719.7; Description=Tetratricopepti de repeat
  Pfam annotation: Domain name=TPR_2; Domain location=160-193; Score =19.5; E_value=0.012; Accession=PF07719.7; Description=Tetratricopepti de repeat
  Pfam annotation: Domain name=TPR_2; Domain location=318-351; Score =28.5; E_value=2.3e-05; Accession=PF07719.7; Description =Tetratricopeptide repeat
  Pfam annotation: Domain name=TPR_2; Domain location=364-397; Score =21.7; E_value=0.0027; Accession=PF07719.7; Description =Tetratricopeptide repeat
  Pfam annotation: Domain name=TPR_2; Domain location=398-431; Score =21.2; E_value=0.0037; Accession=PF07719.7; Description =Tetratricopeptide repeat
  Pfam annotation: Domain name=TPR_2; Domain location=432-465; Score =17.9; E_value=0.037; Accession=PF07719.7; Description=Tetratricopepti de repeat
  Pfam annotation: Domain name=TPR_4; Domain location=160-185; Score =7.7; E_value=4.5; Accession=PF07721.5; Description=Tetratricopeptide repeat
  Pfam annotation: Domain name=TPR_4; Domain location=318-343; Score =10.3; E_value=2.2; Accession=PF07721.5; Description=Tetratricopeptide repeat
  Pfam annotation: Domain name=Thioredoxin; Domain location=495-595; Score=17.3; E_value=6.5e-06; Accession=PF00085.10; Description =Thioredoxin
  Pfam module annotation: Pfam domain module=TPR_1::TPR_1::TPR_1::TPR _1::TPR_1::TPR_1::TPR_2::TPR_2::TPR_2::TPR_2::TPR_2::TPR_2::TPR _4::TPR_4::Thioredoxin; Domain location=126-159::160-193::318 -351::364-397::398-431::...
  Pfam module annotation: Domain location=432-465::126-159::160 -193::318-351::364-397::398-431::432-465::160-185::318-343::495-595
  Subcellular localization annotation: CTP_CleavageSite=64; ConfidenceScore=5.35e-01
SNNNNSGELSGSSENSPTARKPGHRRSDSGSALVPLIYSGQTATSPAMNVLPTGNICPSGKILKAGMMANRSSRTSRSDVLGSGMGNYGHGSIMRGGGKVEPASSRGGGGGNETVKKGGHVQSVDPEELKRLGNECYKRGNFADALSLYDRAIAMSPASAAYRSNRAAALTGLGRLGESVRECEVAVRLDPNYGRAHQRLASLFLRLGQVENARKHLCYPGMQPEPSEMQRLQVVEKHISKCGDVRRVGEWKSVLREVDAAVAAGADSSPQLFMCRAEAFLKLHQIDDAESILLSIPKSELQINSSSQARFFGMLSEAYSYFVRAQIEMALGRFENAVTAAEKACQIDSRNVEVAVLLNNVRMVARARVRGNDLFKSERYTEACSAYGEGLRLDPSNSVLYCNRAACWFKLGQWEQSIEDSNQALHIQPNYTKALLRRAASNSKLERWEEAVKDYEILRRELPNDNEVAESLFHAQVALKKSRGEEVYNLKFGGEVEEVSGLEQFRAAISLPGVSVVHFEVASNLQCKQIWPFVNTLCGRYPSINFLKVDIQQSPTVATAENVRIVPTFKIYKNGSRVKEIVCPSRDMLEHSVRHYSF

SEQ ID NO: 201706 - protein, 214 aa, Glycine max
  Coding DNA Sequence Number=SeqID_84928
MRFTLVDLDKVAYKDKPFITIEQAIQGRTSCVSIKMMIVLDICETPSFSTCMPSTIEEHEVDDLDKPKVVFHVNPATGRASSPHKKKFHSYLGIVARDKINILYSNWKDVLEALKNLIWDDIVGTFDIPEVFNTKKKFISSVATLWRNFMSSMTTNYMTHGCFVPHGHQDILTIAIGRPEHSSHVCAMGVSMTISQYFGHASHGSNNSTSIIPQ

SEQ ID NO: 201707 - protein, 69 aa, Glycine max
  Coding DNA Sequence Number=SeqID_84929
  Homolog annotation: Hit_ID=Q0KIN0; Match level="QueryCoverage=68%, HitCoverage=2%, E-value=8e-08, Identity=56%"; Hit description =Integrase core domain containing protein
MDEIGKCKNGKNCFCQNCCPFNLISTSKLTRTLDFSVLFVNNFILVQDRHIGQTIGAGHKSGGLYQLMP

SEQ ID NO: 201708 - protein, 130 aa, Glycine max
  Coding DNA Sequence Number=SeqID_84930
MERVTLWYSGQRGLKNLGELASSDYPTSGALIRHGDQCTLFPYAVITPNCHPHDSVRRSKPRRIGGRGVQDSPLLMQSYPARALGRRLQVDWARDPREGPRVLMSLRLSSSFFRNLLKEASQGGELSYER

SEQ ID NO: 201709 - protein, 69 aa, Glycine max
  Coding DNA Sequence Number=SeqID_84931
MEDEFSEATIPEPFTAGEEAGDTQMTQVATATSERSLEATSEPPASAVDLPSPQHATDPSTPVLEIPKD

SEQ ID NO: 201710 - protein, 57 aa, Glycine max
  Coding DNA Sequence Number=SeqID_84932
MEDTTVRDFMRIDAHYKERIKIKSEVVSMVGVSAMSYTGMLGVLPIVIHMLCKTMKA

SEQ ID NO: 201711 - protein, 85 aa, Glycine max
  Coding DNA Sequence Number=SeqID_84933
MVKVLIEEVRDADAQVLFPTLEVQCVGQVHSTFIAWLRHLVKPVSHEDSHRRPKKHVESIRESNPIGDPLAYMIKNLLDLYMKPF

SEQ ID NO: 201712 - protein, 229 aa, Glycine max
  Coding DNA Sequence Number=SeqID_84934
MRLNQHEENDKKKKGICFKASSSTQEGSDKEDTIEIDEDDDLSLFVKRFNKFLRKRIEKSEKKVFNEKKAKKAYITWDANDMDSSEDSENEVVNLSIMAKSYESDEEYIEEIKDLKNSCKFSIGKNNLDIILGKQKCVFDKAGLGYKSDKQQKFYKNFFAFTQKYSSPFLTCFYCGKKGHGICRNLLFGGRVTRGLTGESSKKGKCAESPPMFIRGKRRENRKGVVYEL

SEQ ID NO: 201713 - protein, 161 aa, Glycine max
  Coding DNA Sequence Number=SeqID_84935
ICAPGYGGHGFLSTVLGLPPDIGGRPTVRAHPERKAITHQLCIPGQDFTRAAAKRRVWIMRTNMTTFTWIWMTLLFSNILPGDHNANLPLQMYRLGSRPQDAQWARRSPTGPWGFQLWLWASVVLQGARFTPADGSVGLCRHHDIGIAPARHPVDPKKSNR

SEQ ID NO: 201714 - protein, 57 aa, Glycine max
  Coding DNA Sequence Number=SeqID_84936
MGVKYVKAVKRRLHVTKQWSPDEIRRIPEHKGRVVPVWFRLCKRSFTKRVENLKWVA

SEQ ID NO: 201715 - protein, 135 aa, Glycine max
  Coding DNA Sequence Number=SeqID_84937
  Subcellular localization annotation: CTP_CleavageSite=49; ConfidenceScore=5.40e-01
MKALSAPAALSLFIATVKILDFQMNALSGPYRTKRMASKNRKAPSTPTQARYDRSRFTSKEAWERYTDIVVPRKLLPERNVVVYYIEFDEFKEELERRHWDEKLTDFADSSIDIAIVKELRKAFEDPREGIRAKC

SEQ ID NO: 201716 - protein, 200 aa, Glycine max
  Coding DNA Sequence Number=SeqID_84938
  Gene Ontology: Mol. function=transferase activity, transferring glycosyl groups; Cellular component=membrane; Biological process =protein amino acid glycosylation
  Homolog annotation: Hit_ID=Q8L6H1; Match level="QueryCoverage=47%, HitCoverage=43%, E-value=3e-29, Identity=79%"; Hit description=Beta 1,3-glycosyltransferase-like protein III
  Subcellular localization annotation: CTP_CleavageSite=89; ConfidenceScore=5.45e-01
MEENINITVNNRCLFAKAQTRPSLSLSLSFTVHVPTLNHLSTTPTTTFTTSLHPFNLFCFSSPKSRDEMNEKTDVADVASTAMSRPMVSLEEATGLAFRFVIDQRCLHFRRKWHNMMISFFWILKRSTFVAEKNLVIYYRLAFFKAAYALFEADFCVKADDDIYLRPDRLSLLLAKELSHPQTYIGCMKKGPVFTDPKLK

SEQ ID NO: 201717 - protein, 45 aa, Glycine max
  Coding DNA Sequence Number=SeqID_84939
MGLKGYFEIHIKERCILQITMVRVCKIGLEAYSPNLKAIQWLMNP

SEQ ID NO: 201718 - protein, 495 aa, Glycine max
  Coding DNA Sequence Number=SeqID_84940
  Gene Ontology: Mol. function=nucleoside-triphosphatase activity; Cellular component=integral to membrane; Biological process=transport
  Homolog annotation: Hit_ID=Q9MAH4; Match level="QueryCoverage=91%, HitCoverage=76%, E-value=1e-116, Identity=51%"; Hit description =Probable white-brown complex homolog protein 10
  Pfam annotation: Domain name=ABC2_membrane; Domain location=306-491; Score=81.7; E_value=2.4e-21; Accession=PF01061.14; Description=ABC-2 type transporter
  Pfam annotation: Domain name=ABC_tran; Domain location=35-224; Score =147.9; E_value=2.7e-41; Accession=PF00005.17; Description=ABC transporter
  Pfam module annotation: Pfam domain module=ABC2_membrane::ABC_tran; Domain location=306-491::35-224
LCSQLDECRSLCFGSNPGRGAKFILKDVNCEARPGELTAIAGPSGAGKTTLLEILAGRIPSFKVSGQVLVNHRPMDVNQFRRTSGYVTQDDALFPSLTVKETLMYSAMLRLPGGRKVAAIRVEELVKELGLDHIADSRIGGGSDHGISGGERRRVSIGVDLVHDPAVILIDEPTSGLDSASALSVVSLLRLVAFNQGKTIILTIHQPGFRILELFDGLILLSDGFVMHNGSLNLLEARLKLAGHHIPDHVNVLEFALDVMECLVIHTSESVDNQFLLKENQDHKMRMQYSKVAKEKALMYSNSPTEEISILGQRFCCNIFRTKQLFVTRVIQALVAGFILGSIFFNVGSQRSHVALQTRSGFFAFSLTFLLSSTTEGLPIFLEERRTFMRETSRGAYRVSSYVLANTLVFLPFLLLVGLLYSTPVYWLVGLRKDIDGFLYFSLLVWLVLLMSNSLVACFSALVPNFILGTSVIAGSERFTKMDQFGCNVELHSGL

SEQ ID NO: 201719 - protein, 443 aa, Glycine max
  Coding DNA Sequence Number=SeqID_84941
  Gene Ontology: Mol. function=peptidase activity; Cellular component =nucleus; Biological process=response to oxidative stress
  Homolog annotation: Hit_ID=Q8LGH3; Match level="QueryCoverage=89%, HitCoverage=88%, E-value=1e-135, Identity=55%"; Hit description=4 -methyl-5(B-hydroxyethyl)-thiazole monophosphate biosynthesis protein, putative
  Pfam annotation: Domain name=DJ-1_PfpI; Domain location=288-426; Score=148.3; E_value=2.1e-41; Accession=PF01965.14; Description=DJ -1PfpI family
  Pfam annotation: Domain name=DJ-1_PfpI; Domain location=74-214; Score= 134.5; E_value=3e-37; Accession=PF01965.14; Description=DJ-1PfpI family
  Pfam module annotation: Pfam domain module=DJ-1_PfpI::DJ-1_PfpI; Domain location=288-426::74-214
  Subcellular localization annotation: CTP_CleavageSite=42; ConfidenceScore=5.74e-01
MALRHLRFFPHTLPLTLTPTPNPNNSNRFSFFTPSLSSTTLMATAHKVLVPIADGTEPMEAVITIDVLRRSGADVTVASASDNLAVQALHGVKIIADAPVRDVAATSFDLVALPGGLQGVENLRDCKVLEGLVKKHVEDGRLYAAVCAAPAVVLGPWGLLNGKKATCYPALMEKLAAYAAATSESRVQVDGRVVTSRAPGTTMEFAITLIEQLIGKEKADEVAGFGNWECMSELVMHSNHDDEHTFKEFNPVQWTSDNPPKILVPIANGSEEMEAVIIIDILRRAKAKVVVASVEDKLEIVASRKVKLEADMLLDEAAKLSYDLIVLPGGLGGAQTFANSETLVSLLKKQRESNIYYGAICASPALVLEPHGLLKGKKATAFPVMCNKLSDQSEVENRVVVDGNLITSRGPGTSIEFALAIVEKLFGRKLALELAKAVVFARP

SEQ ID NO: 201720 - protein, 225 aa, Glycine max
  Coding DNA Sequence Number=SeqID_84942
  Gene Ontology: Mol. function=DNA binding; Biological process=DNA integration
  Homolog annotation: Hit_ID=Q1RSZ9; Match level="QueryCoverage=99%, HitCoverage=23%, E-value=4e-30, Identity=56%"; Hit description =Polynucleotidyl transferase, Ribonuclease H fold
MENVQYGTWAKLFKIYACSHKVLHHIVPPEKGREKMPKIDEEKKLWSTLDVAAYNGVVTLIRQSYHLPPFYQARSMLTLEEVGLAKKAAISGGAAMVACDTNDSHSLSKNSHQNWNTHDDKRVKTTTMVAIAVASRAMMVATAIVASSSSPASSNRGTNSGLLDNSNGHGCLGLFHLAHTPHPTAHPLPHIGLGQIFRKPNSTRQASLGQNHYRPTWRQQHLHPL

SEQ ID NO: 201721 - protein, 94 aa, Glycine max
  Coding DNA Sequence Number=SeqID_84943
MANVTISNCQEMYLSTNYMFNEKSDYLTKRKMTPQRVDKAIHLIQCDPNEQLQLNMSYLQLRIASTVDQNGCIWLTPFVTNWTTTLESLSNNSF

SEQ ID NO: 201722 - protein, 140 aa, Glycine max
  Coding DNA Sequence Number=SeqID_84944
  Gene Ontology: Mol. function=voltage-gated potassium channel activity; Cellular component=voltage-gated potassium channel complex; Biological process=potassium ion transport
  Homolog annotation: Hit_ID=Q2HUH9; Match level="QueryCoverage=93%, HitCoverage=32%, E-value=2e-28, Identity=51%"; Hit description =BTB/POZ
MNEPGGSGQSSRFGDSFVDVEGLLLFMLCSKSGDLAMADMRFLKDDPWVYLKEKNPSLVSYGEVRNIVVHCYRGQVFVAKEEHWRFGQVWNKGKIVGVVLKGFIEGILWIRERIQREGLFVSREDVEGIEVWERLANLVR

SEQ ID NO: 201723 - protein, 159 aa, Glycine max
  Coding DNA Sequence Number=SeqID_84945
  Gene Ontology: Mol. function=nucleic acid binding; Biological process= DNA integration
  Homolog annotation: Hit_ID=Q1SKA8; Match level="QueryCoverage=95%, HitCoverage=58%, E-value=4e-10, Identity=28%"; Hit description=Zinc finger, CCHC-type
  Pfam annotation: Domain name=zf-CCHC; Domain location=87-104; Score =14.6; E_value=0.0039; Accession=PF00098.13; Description=Zinc knuckle
MSLATLFGKLQEHEMELQHLNQNEETDKKKRSIALKASSSMQEENEEDESDFSLFVKKFQKFVKKRRIERRQNFNNGRKSQEDSQILRYYKCNQLGHIKANFPSNEEWPKKSDKKRYEERRTKKAYIAWDDNDSSDGSEKEINLLTKDYESDENISQEN

SEQ ID NO: 201724 - protein, 49 aa, Glycine max
  Coding DNA Sequence Number=SeqID_84946
MVLDGWVQAMMALNAIKVNHQLGGGNRSGQTLKNLSLAYDEFLRPESSL

SEQ ID NO: 201725 - protein, 154 aa, Glycine max
  Coding DNA Sequence Number=SeqID_84947
  Homolog annotation: Hit_ID=Q1T1B9; Match level="QueryCoverage=38%, HitCoverage=26%, E-value=1e-23, Identity=86%"; Hit description =Mitochondrial carrier protein
  Pfam annotation: Domain name=Mito_carr; Domain location=43-104; Score= 1.5; E_value=0.0026; Accession=PF00153.17; Description=Mitochondrial carrier protein
MWILTNAEILGSLKAQCPLLLRIINGFGVDKLTSVANCNRRESFALVTLRMSYFECPTYMLRFILQGLRGLYAGFLPGVLGSTISWSLYFFFYDRAKQRYARNREGKLSPGLHLASAAEAGAIWFHGHHGGMAWQIFCQPPWGKCEGMPAMAAP

SEQ ID NO: 201726 - protein, 151 aa, Glycine max
  Coding DNA Sequence Number=SeqID_84948
  Gene Ontology: Mol. function=transporter activity; Cellular component= mitochondrial inner membrane; Biological process=transport
  Homolog annotation: Hit_ID=Q8LFJ3; Match level="QueryCoverage=80%, HitCoverage=38%, E-value=2e-42, Identity=71%"; Hit description =Contains similarity to peroxisomal membrane carrier protein
  Pfam annotation: Domain name=Mito_carr; Domain location=5-62; Score =10.5; E_value=0.00038; Accession=PF00153.17; Description =Mitochondrial carrier protein
MREEGFSALYKGIVPDAFRTIMREEGFSALYRGIVPGLFLVSHGAIQFTAYEELRKVIVDFKSKGSTVDNQNPDKLLNSVDYAVLGATSKLAAVLLTYPFQVIRARLQQRPSGDGVPRYMDTLHVVKETARYILKPILDLVYIFILANKQR

SEQ ID NO: 201727 - protein, 170 aa, Glycine max
  Coding DNA Sequence Number=SeqID_84949
MRWNSNGLNRNEETDEKKRSISLKASSSMQEANEEEDSDDEEDFSLFVKKFQKFVKKRRIERRQNFNNGRKSQEDSQVLRSNCPSNEEGPEKSDKKRYDERRTKKAYIAWDDNDSSDGSEKEINLLTKDYESDENISQEEPSKKRKGSSSRSQRHSETQETPIPSSIPSA

SEQ ID NO: 201728 - protein, 91 aa, Glycine max
  Coding DNA Sequence Number=SeqID_84950
MEETLCWVICAFFGKLDREIETVRARFSYMQKLHCALSCNVICLYVSRFSVKFSLSRRIPRELKIQKQNYLLITPFGKSKMTYTMVIQACH

SEQ ID NO: 201729 - protein, 69 aa, Glycine max
  Coding DNA Sequence Number=SeqID_84951
MATVKKTGWRSRNQWFYFFYEKVRERNKKHLRSRGDVAPCGACRPCIFFINGVLFFLKINGSGIEMEER

SEQ ID NO: 201730 - protein, 78 aa, Glycine max
  Coding DNA Sequence Number=SeqID_84952
  Subcellular localization annotation: CTP_CleavageSite=65; ConfidenceScore=5.54e-01
MTPHLLTATATSFFTLCLVLHPPTMAGTLPSTVPTLALSPQCCTTTFLFLPLSIAIEGFGARWILVEIGSYSKTNVLE

SEQ ID NO: 201731 - protein, 62 aa, Glycine max
  Coding DNA Sequence Number=SeqID_84953
  Subcellular localization annotation: CTP_CleavageSite=53; ConfidenceScore=5.57e-01
MVPRKLSAKRSSRTPRLKELVPLLSSTSIVSRALSTSSVSRPSRRPQPAPGIPASVGGGPGV

SEQ ID NO: 201732 - protein, 214 aa, Glycine max
  Coding DNA Sequence Number=SeqID_84954
  Gene Ontology: Mol. function=methyltransferase activity; Cellular component=cellulose and pectin-containing cell wall
  Homolog annotation: Hit_ID=Q9FMJ2; Match level="QueryCoverage=98%, HitCoverage=27%, E-value=1e-78, Identity=62%"; Hit description =Ankyrin-like protein
  Pfam annotation: Domain name=DUF248; Domain location=1-207; Score= -18.1; E_value=1.1e-24; Accession=PF03141.7; Description=Putative methyltransferase
YVPLQACMHKLPTDKDERGTRWPEPWPRRLEKAPYWLNNLQGGKQASHDFATDNERWKNVVDELSNVGVSWSNVRNIMDMRATYGGFAAALKDLPVWVFNVVNTDAPDTLAVIYERGLIGIYHDWCESFSTYPRTYDLLHADHLFSILKNRCNLVPVVTEIDRIVRPGGNLIVRDESSVIGEVEALLKSLHWEITSTNLEGLLCGKKGMWRPSS

SEQ ID NO: 201733 - protein, 115 aa, Glycine max
  Coding DNA Sequence Number=SeqID_84955
  Gene Ontology: Mol. function=transporter activity; Cellular component= periplasmic space; Biological process=transport
  Homolog annotation: Hit_ID=Q6D1E4; Match level="QueryCoverage=98%, HitCoverage=34%, E-value=1e-51, Identity=82%"; Hit description =Glycine betaine-binding periplasmic protein
MVPGRDVVWLQVPFSSLPGEQKNVDTKLPNGANYGFPVNTMRIAANKQWAEANPAAAKLFAIMKLPIADINAQNLRMHEGQASEADIQNHVNGWIKAHQATFDGWVKTAAEAAKP

SEQ ID NO: 201734 - protein, 105 aa, Glycine max
  Coding DNA Sequence Number=SeqID_84956
  Gene Ontology: Mol. function=transcription factor activity; Biological process=regulation of transcription, DNA-dependent
  Homolog annotation: Hit_ID=Q2XFW2; Match level="QueryCoverage=89%, HitCoverage=32%, E-value=4e-17, Identity=47%"; Hit description =Putative LysR-family transcriptional regulator
ALAEVPLVDFYSGTGARRQTDRAFQAAGIRRHVSFEIDHIEWLENLVRRGLAAGIVPISTAQRLSTLVSIPIEDGPRRQVYCIWPQPLSNAAARFLQFSGIDMAG

SEQ ID NO: 201735 - protein, 140 aa, Glycine max
  Coding DNA Sequence Number=SeqID_84957
  Gene Ontology: Mol. function=DNA binding; Biological process=DNA integration
  Homolog annotation: Hit_ID=Q1T192; Match level="QueryCoverage=63%, HitCoverage=18%, E-value=2e-10, Identity=46%"; Hit description =Polynucleotidyl transferase, Ribonuclease H fold
MAIGQGVPKLWRLLGGVLRMSTNSWHRLHLLVKSWVLTLSVGQQYLACTTLVAREHPQHLSNGVVNPLLNSSPSRIHPVRFLLFSCHDLLGVNGQSLECHLDDGFEMPDLFSASHLGEQVCSSVALPGYVDVALAPMYPQ

SEQ ID NO: 201736 - protein, 428 aa, Glycine max
  Coding DNA Sequence Number=SeqID_84958
  Subcellular localization annotation: CTP_CleavageSite=43; ConfidenceScore=5.08e-01
MGWSDHIVVQILRASFQLSKITRGLHPHLNGVYIRFRSPSFLSFGSFSVISLHLLCGSCNFLLSFDRLPHFKVHPYSIMSFVSDSAMGMTGSDFEVFNNPLWIVKLFQSVTSPRRRHDVKLLTTSPLPPRGWWTCAISVGVPRPHSRVRPSDAPLDEEFVPVTMILPCVPRMRYLDVVETCWKKRNDLECKVERITKEKEDLAVIMTESAKESMLEVTKEIETTKELEEELLMFKKEAMEQDEKGFYKAVRQAGFFTKGLDLGLFEPFKDVKDGELIDVEEIAATEEGIEEEQDVGANGCIRLGFWQGSPRADLRFDKPLEIQQGMRSSWVSERLTKGRALGLMSLWRFDQGRALPGFTLDLPYVEASFMMMNQVDSKGTSTWVVVTENKRGYISCGSVQVEGTSTWLFKENKGGYIPCGSLLVKDFT

SEQ ID NO: 201737 - protein, 114 aa, Glycine max
  Coding DNA Sequence Number=SeqID_84959
MKDSGLLDKEEIVVVEEDAGSPRADFGFVKPLEIRDSHTADLGFNEPLEKQGSPRMDLGFHEPLEKQGSPRIDLRFNEPLEKRDSPRVDLGFDKPLEKRDAPRVNLRFEKPLEK

SEQ ID NO: 201738 - protein, 366 aa, Glycine max
  Coding DNA Sequence Number=SeqID_84960
  Subcellular localization annotation: CTP_CleavageSite=59; ConfidenceScore=5.30e-01
MECHVTCHIHFVDPKQYISPPSFEPACWRKRLSSVKGRALTSRRVVSLLSPQAWTSVVRCRREDTLLVLQEKSNMSSKGSPLQCTHVTLAYVSLEEWTRIGDVVHGIVGLPREGTRQEASNSKSSSFEREPVPVTMIFPLSASRGVRRSGSGDIRISPYNRGSCNARSPSSSPTVVGYELVWNDVLKYRFSITSVASVFALKRQLKLANSKDSYKMVIQACGSDDFPFLRVVVSKKLFEIDLNVFRHFKDYFFKVLATDIVANGVNKAILEQLPASLDARATLSLPSSDDHFIVLDGRTCWWDCARLLLSILLLEKEGQITTRVDPNIDEVVEVTLNIPSSVLAKRNSGHPSTAGSQGPPLAPSAV

SEQ ID NO: 201739 - protein, 119 aa, Glycine max
  Coding DNA Sequence Number=SeqID_84961
MDILGPLSKALRAIKFLLVAISYFTKWIDARPLREISANEVEKTPQYNLGLSLFTPDNNQQNFFPTYIRHNEEKIRVGLETKEEVRGMARIKEEATKLQASRRFNTKVQPQAFKPSNLM

SEQ ID NO: 201740 - protein, 80 aa, Glycine max
  Coding DNA Sequence Number=SeqID_84962
MKAKAAQPPVARRNLQWLSARKNPEEDELSSLLSVPLQVIKHTASAHPLSETSALSQNPLMHAKRSISVLSTQARTRPPI

SEQ ID NO: 201741 - protein, 69 aa, Glycine max
  Coding DNA Sequence Number=SeqID_84963
  Subcellular localization annotation: CTP_CleavageSite=59; ConfidenceScore=5.41e-01
MTLSLAHQWAKRASTTKRSFSALSATEESGRASISRPRDKREISALSTTVVFSQAQRTTGAKLKSTYSR

SEQ ID NO: 201742 - protein, 67 aa, Glycine max
  Coding DNA Sequence Number=SeqID_84964
MPWARECVFFSKMYICVEMALRKLSSKRSRKEVAAAGTSAAPEFDSHRFRSTEHQQCFEAIKGWSFH

SEQ ID NO: 201743 - protein, 181 aa, Glycine max
  Coding DNA Sequence Number=SeqID_84965
  Gene Ontology: Mol. function=DNA binding; Biological process=DNA integration
MAACGGHRWSWVVEKEFLAQHFMLRAIPLKLEFALSATFCAECNLSRVRIALNALVSLREIPRSVILHIPMVYTGDQTLIVLRSMLSSFLPAQAFTTPVDRVVHLDYHLVTLKVWLEALSLGNECQRYLLYHLVLFLSIMKDMTGKIDGKIGGVAIVFLKAKKACLQASSHENGLIFLSNL

SEQ ID NO: 201744 - protein, 124 aa, Glycine max
  Coding DNA Sequence Number=SeqID_84966
  Gene Ontology: Mol. function=RNA-directed DNA polymerase activity; Cellular component=intracellular; Biological process=RNA-dependent DNA replication
MLTNYTDLNKACPKDAYPLPSIDRQVDNASGFQVLSFRDAYLGYNQIKMHTQDEEKTTFITKDANFYYKVYVDDMVVKSYSIAQHMADLEEVFRELHKYEMRLNWEKCAFKDGGGKFLRFMITC

SEQ ID NO: 201745 - protein, 96 aa, Glycine max
  Coding DNA Sequence Number=SeqID_84967
MGGAVTKLDIPDGGNRVRKYLYLGACHSVWNSLVTQGDHMGGGRGVAYARQGDFDTCYLVFMSVSIGWTCSGYFLTNGTTLHLRIKVKCMHHIEHD

SEQ ID NO: 201746 - protein, 139 aa, Glycine max
  Coding DNA Sequence Number=SeqID_84968
  Subcellular localization annotation: CTP_CleavageSite=36; ConfidenceScore=5.42e-01
MSSGGPTTTSSNTSPRVAAGPTTTRRRVADNNNNIVDAEKQQQVTSSFSDFSEVEADENVPHPHPLHAHAHHHHVHPVTRYLLLRARILLCVPESFFQRVEHLVLWLAGSVQSLRSGKHVGRKIFLALIFMLVMSVFLK

SEQ ID NO: 201747 - protein, 131 aa, Glycine max
  Coding DNA Sequence Number=SeqID_84969
  Gene Ontology: Mol. function=transcription factor activity; Cellular component=nucleus; Biological process=regulation of transcription, DNA-dependent
  Homolog annotation: Hit_ID=Q9SH89; Match level="QueryCoverage=97%, HitCoverage=20%, E-value=6e-51, Identity=73%"; Hit description =Putative axi 1 protein from Nicotiana tabacum
  Pfam annotation: Domain name=DUF246; Domain location=47-131; Score= -198.2; E_value=0.0042; Accession=PF03138.5; Description=Plant protein family
MLGTEKLALTVTLTPEIWMKPNSDKYYKCVSRPRNVIRLKKTNGYLLVHANGGLNQMRTGICDMVAVAKIMNATLVLPSLDHDSFWTDPSDFKDIFDWRHFMKVLKDDIEIVEYLPVQYASLKPLVKAPVS

SEQ ID NO: 201748 - protein, 629 aa, Glycine max
  Coding DNA Sequence Number=SeqID_84970
  Gene Ontology: Mol. function=methyltransferase activity
  Homolog annotation: Hit_ID=Q9FMJ2; Match level="QueryCoverage=59%, HitCoverage=48%, E-value=1e-128, Identity=57%"; Hit description =Ankyrin-like protein
  Pfam annotation: Domain name=DUF248; Domain location=341-629; Score =376.7; E_value=3.6e-110; Accession=PF03141.7; Description=Putative methyltransferase
  Pfam annotation: Domain name=Methyltransf_11; Domain location=459 -554; Score=39.2; E_value=1.5e-08; Accession=PF08241.2; Description =Methyltransferase domain
  Pfam annotation: Domain name=Methyltransf_12; Domain location=459 -552; Score=7.6; E_value=0.088; Accession=PF08242.2; Description =Methyltransferase domain
  Pfam module annotation: Pfam domain module=DUF248::Methyltransf _11::Methyltransf_12; Domain location=341-629::459-554::459-552
  Subcellular localization annotation: CTP_CleavageSite=15; ConfidenceScore=5.36e-01
MAQATKSRNSRRPSSSSSYTSTLTTLIFIALCVLGLWMLTSNTVVTPKTRTAIDDNISETTNTDLTQDTTATTTTTNNIPDDFAESITTISQDLPRETATNIPHEIHTKIQDQKDATVFGDNPGNLPDDAIKNDLKKETSIIANEATGSDSDQKANESEKESQNNIIIAQDEKENLNSKQNTEPEIANVSENIQEEGTGGGGKSNNNDDDANVQQLREDKGEAVAEREQKEKEENEKRKKNNRKKSNKGLKKEGSSTESNDDESTQRGEKKGSSTESNDDESTQRGEKKGSSTESNDDESTQQGEKKGSSSQNDEESSSSEVMQLQDNLKWSLCNVTAGMDYIPCLDNDKYLKTSRRKHYEHRERHCPEDAPTCLVPLPKGYKTPIQWPSSRDKIWYHNIPHTLLADVKGHQNWVKLTGEFLTFPGGGTQFIHGALHYIDFLQQAEPGIAWGKHTRVILDVGCGVGSLGGYLFERDVIAMSFAPKDEHEAQVQFALERGIPAISAVMGTQRLQFPSEVFDLIHCARCRVPWHEDGGLLLLELNRLLRPGGYFVWCATPVYQTIEEDAEIWKQMKALTKSMCWELVTIKKDALNQVGAAFYRKPTSNECYEQREQNQPPMCKTDDDPNAA

SEQ ID NO: 201749 - protein, 66 aa, Glycine max
  Coding DNA Sequence Number=SeqID_84971
MWMTRVAGQHYIRVYIGDSNAVEDFLGYIGVEVQITTFHLYFLGHLWKIIIGQQRFKVITKKNYGY

SEQ ID NO: 201750 - protein, 358 aa, Glycine max
  Coding DNA Sequence Number=SeqID_84972
  Gene Ontology: Mol. function=protein binding; Cellular component =periplasmic space; Biological process=cell wall catabolic process
  Homolog annotation: Hit_ID=Q66A24; Match level="QueryCoverage=88%, HitCoverage=89%, E-value=1e-130, Identity=71%"; Hit description =Hypothetical protein precursor
  Pfam annotation: Domain name=ErfK_YbiS_YhnG; Domain location=108-247; Score=216.7; E_value=5.3e-62; Accession=PF03734.5; Description =ErfKYbiSYcfSYnhG
  Pfam annotation: Domain name=LysM; Domain location=55-100; Score=8.0; E_value=0.083; Accession=PF01476.10; Description=LysM domain
  Pfam module annotation: Pfam domain module=ErfK_YbiS_YhnG::LysM; Domain location=108-247::55-100
MTGVCSIRQRENCMKPALRLAGALLLSCFGLSAPAFATEYPLPAADSRLIGENTLTTVPDDKRPLESIAARYKIGMLGMLEANPGVDPWLPKAGTQLTVPLQMLLPDAPHEGIVINLAELRLYYYPKGENRVVVYPIGIGQLGAATPSMVTSISQKIPNPTWTPTVNIRKRYAKEGITLPAMVPAGPDNPMGLFALRLARGSGQYLIHGTNADFGIGMRVSSGCIRLRPDDIEALFNSVPQGTRVQVINQPIKYAIEPDGKRYIEVHQPLSRNEQDDPQTMPIALSAPLKAFIKSAKSDSALIKAAIERRSGMPVLVSSGEPVNEATPLPAVLQTQQGATGGAQATISQAQGEAAATP

SEQ ID NO: 201751 - protein, 1110 aa, Glycine max
  Coding DNA Sequence Number=SeqID_84973
  Gene Ontology: Mol. function=protein binding; Cellular component =chloroplast
  Homolog annotation: Hit_ID=Q7CQN5; Match level="QueryCoverage=35%, HitCoverage=96%, E-value=1e-160, Identity=69%"; Hit description =Cysteine desulfurase
  Pfam annotation: Domain name=ABC_tran; Domain location=120-315; Score= 119.5; E_value=9.7e-33; Accession=PF00005.17; Description=ABC transporter
  Pfam annotation: Domain name=Aminotran_1_2; Domain location=723-1102; Score=-85.8; E_value=0.0045; Accession=PF00155.11; Description =Aminotransferase class I and II
  Pfam annotation: Domain name=Aminotran_5; Domain location=729-1098; Score=733.8; E_value=1.1e-217; Accession=PF00266.9; Description =Aminotransferase class-V
  Pfam annotation: Domain name=Beta_elim_lyase; Domain location=768 -1034; Score=-104.0; E_value=0.001; Accession=PF01212.11; Description= Beta-eliminating lyase
  Pfam annotation: Domain name=SMC_N; Domain location=103-319; Score= -128.3; E_value=0.032; Accession=PF02463.9; Description=RecFRecNSMC N terminal domain
  Pfam annotation: Domain name=UPF0051; Domain location=477-707; Score =298.2; E_value=1.5e-86; Accession=PF01458.8; Description =Uncharacterized protein family (UPF0051)
  Pfam module annotation: Pfam domain module=ABC_tran::Aminotran_1 _2::Aminotran_5::Beta_elim_lyase::SMC_N::UPF0051; Domain location=120- 315::723-1102::729-1098::768-1034::103-319::477-707
MPTATNARNFTQCDSMLIGPDCGAHTFPYVETRNNSAQLEHEATTSRIGEDQMFYCLQRGISEEDAISMIVNGFCKDVFSELPLEFAVEAQKLLAISLEHSVSVEDKEILRGLNLEVKPGEVHAIMGPNGSGKSTLSATLAGREDYEITGGSVTFKGKDLLELEPEERAGEGIFMAFQYPVEIPGVSNQFFLQTSVNAVRKYREQEELDRFDFQDFIEDKIKLLKMPEDLLTRSVNVGFSGGEKKRNDILQMAALEPELCILDETDSGLDIDALKIVAEGVNSLRDGKRSFIIVTHYQRILDYIKPDHVHVLYQGKIVKSDNALQQWHHLFESRGEQRSLQAQQHWQQLMRVGLPTRKHENWKYTALDSLLAQQFVQAEAPGVSAEQVAALALPLDAICLVFVDGRFQPELSARDTGLFDVQHSRAAERRPLPAAVQPEVFLHLTESLAEEVTSIRLPRGKAAAQPLYLLHITSGQADALNTVHHRHHLELESGAEAQVIEHYVTLNGSAHFTGARFTFAVGDNAQLKHTKLAFEESSSYHFAHNDIVIGRDAQVSSTSFLLGAGLSRHNTSVQLNGENTQLSLNSLVLPVGSEVADTRSYLEHNKGHCLSRQLHKTISRDKGRSVFNGHIKVAQHALKTDGQMTNNNLLLGRLAEVDTKPQLEIYADDVKCSHGATIGRIDDEQMFYLRSRGIAEDAAQQMIIHAFAAELTEALEDDALRQVNGHPLAYLDSAASAQRPLAVINAESHFYQHGYAAVHRGIHSLSAQATSDMENVRAQAARFLRAAAAEEIIFVKGTTEGINLVANSWGGSQLQPGDNLIVTEMEHHANIVPWQMVAQRTGAEIRVLPLNDNGELALEQLAGLIDSRTRLLAVTHVSNVLGTVNPVKAIVAQAKAAGVVTLVDGAQAVMHHPVDVQDIGCDFYVFSGHKIYGPTGIGVLYARKALQEIMPPWEGGGSMIDQVMLPTGTTWNGAPWRFEAGTPNTGGIIGLGAALTWISELGLETIHQRESQLMRYALDKLASVPDLVIYGPAERSGVVAFNLGKHHAFDVGSFLDQYGIAIRTGHHCAMPLMRHYAVPAMCRASFALYNSEDEADRLAAGLTRIHRLLG

SEQ ID NO: 201752 - protein, 523 aa, Glycine max
  Coding DNA Sequence Number=SeqID_84974
  Gene Ontology: Mol. function=protein binding
  Homolog annotation: Hit_ID=Q6D627; Match level="QueryCoverage=35%, HitCoverage=74%, E-value=6e-89, Identity=89%"; Hit description =Probable ABC transporter ATP-dependent protein
MDDHLLRRVFGDAARAQVEHLLVVDATDSRAVAALDVIGVDFQLRLGVHFRQATEQQVVVGHLAVSFQRVLRHFNVAIKHRAPFVTRNGFVQLATQAMAFVVLQIAARIRHFAAYRQHQAVQRQLGVLTVQLHAGIVTRQTGTQQEAGAAHLRVTANHDVVVRKVIAAALFKRQLGMLQLRIVAHRKADRAAAPQLCRAADESRSPLPPDFPSGAGTPPAVPQPVTDVAQRHGCAARQTDRYHARSAQAGSDHRRTPGKSRPAAAPAQPPAQRSRLALPPAQTAEPAGCPARCISSFHACASAGRHASTAASAAVPAANAVRRVTQTGDATAAARYHSWSAVYAFCNNFQRIDIQTGVGFIEDAQLRLQRRHLQDVITLLLTAGEADVDGTGQQIFRHLQQLDLVFDEVLEVETVQLFLLTVFTYRIDRSLQEELVADARDLDRVLKRHEDAFTGTLFRLQLQQVFAFKGHGTAGDFIIFTTGQRGRQGALAGAVRAHDGMHFARLNLEVQTAQNLFVFNANL

SEQ ID NO: 201753 - protein, 147 aa, Glycine max
  Coding DNA Sequence Number=SeqID_84975
  Gene Ontology: Mol. function=peptidase activity; Cellular component =integral to membrane; Biological process=proteolysis
  Homolog annotation: Hit_ID=UPI000068AA4A; Match level="QueryCoverage =92%, HitCoverage=30%, E-value=1e-56, Identity=73%"; Hit description =probable peptidase
  Pfam annotation: Domain name=Peptidase_M16; Domain location=46-147; Score=-13.3; E_value=0.0032; Accession=PF00675.10; Description =Insulinase (Peptidase family M16)
MQDLLTNNFYFMKKRLLSVAAVAFFGVMLNAQQIKFEEYDLPNGLHVILHQDNTAPVVTTGVMYHVGAKDEVKGRTGFAHFFEHLLFEGTPNIKRGDWFKIVSSNGGQNNANTTNDRTYYYETFPSNNEQLGLWMEAERMRHAVINQ

SEQ ID NO: 201754 - protein, 146 aa, Glycine max
  Coding DNA Sequence Number=SeqID_84976
  Gene Ontology: Mol. function=ATP-dependent DNA helicase activity; Cellular component=cytoplasm; Biological process=DNA repair
  Homolog annotation: Hit_ID=UPI000068C76F; Match level="QueryCoverage =95%, HitCoverage=18%, E-value=2e-48, Identity=67%"; Hit description =ATP-dependent DNA helicase
MDYLKGLNESQYEAVTTLQGPLMVLAGAGSGKTRVLTMRIAHLITNGVDPFNILALTFTNKAAREMKERIAKVVGPGNARSLWMGTFHSVFARILRSEAHYLGFPSNFTIYDQQDALNVIRKVLKDMNIDADLYKPKKSPGKNFKL

SEQ ID NO: 201755 - protein, 124 aa, Glycine max
  Coding DNA Sequence Number=SeqID_84977
MVAYEAEKDVSSPLKTVEEEKAVEVIDPLGELVKNLFDIYQRPVEVSWDGAKFGINNVQDGFFITHADVSEIILGDKCLNISILQLWLMFIHDWSASIGYGALYGFLEPQCIHNDAILPRKGIG

SEQ ID NO: 201756 - protein, 61 aa, Glycine max
  Coding DNA Sequence Number=SeqID_84978
MEAFVILNTRGSYMSLFICEGVSIFGTLLRKINGCDSATMQCDCGHRFSASSLIWVLPSFL

SEQ ID NO: 201757 - protein, 71 aa, Glycine max
  Coding DNA Sequence Number=SeqID_84979
  Gene Ontology: Mol. function=catalytic activity; Biological process =metabolic process
  Homolog annotation: Hit_ID=Q1RZ28; Match level="QueryCoverage=97%, HitCoverage=11%, E-value=5e-23, Identity=74%"; Hit description=AMP -dependent synthetase and ligase
MTSSIKIECVCDGADECILETTTVGVASSNGGPEQLVIFVVLKEGYNSNAETLKMKFSKAIQSNINPLLKV

SEQ ID NO: 201758 - protein, 214 aa, Glycine max
  Coding DNA Sequence Number=SeqID_84980
SPFPNVDGLVDLAAIDAFLAFHHSKESPVVTVLADIYDTFDQRGCINCNPVLAISQLGYPMRGAPLVESLTPFITRGFSDPNARDRELRGSSNGTVDGYHRWLRAYTRGLDWLPKLRAAKEEEAEAPEESEEVQALKAELEKAQAVKERFKTRAVRIQRENDERMDINAATAKALEQETKRARKGKHARKELCGAATTSLNSGEKKETSHEWKA

SEQ ID NO: 201759 - protein, 151 aa, Glycine max
  Coding DNA Sequence Number=SeqID_84981
LSLHDKSCQGGENLSTRVGPCKAKQEWGSRSTKEVFGAIDVFLAYHNHKESPVVAMLADLYDTFDRRCEESNARIVCCTPALYVGLVSHLFLQEGRPVYPLQGYRSCVEKGKANWDQLLASMGGRLLIGSLARRKEESRFYLHAKDVQMFP

SEQ ID NO: 201760 - protein, 89 aa, Glycine max
  Coding DNA Sequence Number=SeqID_84982
MQGYSKEFARHGMRREERTESLGEATVRDNEVKASEESDEVQALKAKLERARVVKEKFKAAIVSSSSGKVKGIIMGQRHDLEGRAKDLP

SEQ ID NO: 201761 - protein, 86 aa, Glycine max
  Coding DNA Sequence Number=SeqID_84983
KVIRSSITQAFIEKYCMPRQAQGDAPQAADAPPPPHQADPAGSLGMERYLKHLVGEELAGSPGAAEEACMDEEMMDLLGFLGGSGA

SEQ ID NO: 201762 - protein, 66 aa, Glycine max
  Coding DNA Sequence Number=SeqID_84984
MVGSIVNGDEAGVNEEQDDCSDTFNTSQDFSTRYDVLHWARSVAYEIEFVAVIMRSYTNTGMRGGT

SEQ ID NO: 201763 - protein, 83 aa, Glycine max
  Coding DNA Sequence Number=SeqID_84985
MEDRVTADRRLFPALDKRITSLQDSPVSSPGRAELAWASNPCIQNIKTREGNVFVPKNFPPPPHSKERTREGLRFLLPQVTFG

SEQ ID NO: 201764 - protein, 276 aa, Glycine max
  Coding DNA Sequence Number=SeqID_84986
  Gene Ontology: Mol. function=glycerol-3-phosphate dehydrogenase activity; Cellular component=glycerol-3-phosphate dehydrogenase complex; Biological process=glycerol-3-phosphate metabolic process
  Homolog annotation: Hit_ID=Q9SS48; Match level="QueryCoverage=97%, HitCoverage=42%, E-value=1e-109, Identity=74%"; Hit description =Putative glycerol-3-phosphate dehydrogenase
  Pfam annotation: Domain name=DAO; Domain location=61-274; Score=55.6; E_value=1.6e-13; Accession=PF01266.14; Description=FAD dependent oxidoreductase
MATAYGGAILVSTPVSASDHSVGGSHLAAVREKIHDPFAVVPAREVQRSALTGASAANPLDMLVIGGGATGSGVALDAVTRGLRVGLVEREDFSSGTSSRSTKLIHGGVRYLEKAVFKLDYGQLKLVFHALEERKQLIDNAPHLCHALPCMTPCFDWFEVVYYWMGLKMYDLVAGARLLHLSRYYSAKESVELFPTLAKEGKGRSLRGTVVYYDGQMNDSRLNVGLACTAALAGAAVLNHAEVVSLLKDEASERIIGARIRDNLTGNTFFYFYLLL

SEQ ID NO: 201765 - protein, 107 aa, Glycine max
  Coding DNA Sequence Number=SeqID_84987
MGSQDYDFGASLCVNLTSQGAKSNKVPLRKEGRSEYGGSLRRLSSKLLDDHNWYLENDCRTFIVLGGEDHTANKEPTLHLEDECTWRRRIPNVINDMDHFLGYPGYA

SEQ ID NO: 201766 - protein, 184 aa, Glycine max
  Coding DNA Sequence Number=SeqID_84988
  Gene Ontology: Mol. function=polyribonucleotide nucleotidyltransferase activity; Cellular component=membrane fraction; Biological process =mRNA catabolic process
  Homolog annotation: Hit_ID=Q11U61; Match level="QueryCoverage=92%, HitCoverage=23%, E-value=4e-54, Identity=61%"; Hit description =Polyribonucleotide nucleotidyltransferase
  Pfam annotation: Domain name=RNase_PH; Domain location=1-109; Score =15.0; E_value=0.00027; Accession=PF01138.11; Description=3' exoribonuclease family, domain 1
  Pfam annotation: Domain name=RNase_PH_C; Domain location=112-176; Score=47.0; E_value=6.2e-11; Accession=PF03725.5; Description=3' exoribonuclease family, domain 2
  Pfam module annotation: Pfam domain module=RNase_PH::RNase_PH_C; Domain location=1-109::112-176
MGNGTQIELSTAKEAKSGVDFLPLSVDYQEKYAATGRIPGGFLRREARLSDYEVLISRLVDRALRPLFPENYHADTQVAISLISADKDIMPDALAGLAASAAIAVSDIPFNGPISEVRVAKIDGQLVINPKLSELEKATLEFIVAGSAQDIGMVEGEAKEISEAEMVEAIAFAHEAIKKQVAAQ

SEQ ID NO: 201767 - protein, 33 aa, Glycine max
  Coding DNA Sequence Number=SeqID_84989
MVGAGAMIYFTGEVSGSSPGWPSCVKEKTRKLT

SEQ ID NO: 201768 - protein, 137 aa, Glycine max
  Coding DNA Sequence Number=SeqID_84990
MSEVEEVQEQMKADMKAMKEKMATMMEANMSMKEIMEHTLLPYGLPPNYTPPDVAYTPSENVNNSTPIPIESQQPQSDHEHVSQPMGETHEIPHHNLADFEPCLRYATGGQAVGGIPMPNTLEGPQFRPQPQPLHFA

SEQ ID NO: 201769 - protein, 74 aa, Glycine max
  Coding DNA Sequence Number=SeqID_84991
MTFYIGSERNRCINTFSTKGLKEKIGEVVACVFIEEAHKHITRDDEELYWMMASEAIAIGNSGRKLVGNDVYWY

SEQ ID NO: 201770 - protein, 211 aa, Glycine max
  Coding DNA Sequence Number=SeqID_84992
MGKPTLETGGGGGLLAALSVVAPEKGAAHGGAKWPQSFGCWPIGIDGRGGRQREAKIGTSDTNLEDKELNISVGVQGLQIMKPHTQKDIPMSLITVNGVKEFTEKIGGTDLEVSLILSEDNEHELVNWEVENLKFFIRQPVVCDEDFTIQNEAVVTKEEVQHLTFLCKSEIDSAGRITAGVLRLFKLEGSVGQSAIDQLGNLALHTAGKYT

SEQ ID NO: 201771 - protein, 125 aa, Glycine max
  Coding DNA Sequence Number=SeqID_84993
MRVDYSKEKGLRKGGSWVILKTEGRGSEGINKIFSPEKHSLDGSVCSCGGFSPLQNLTNESPSKTMEPTLALLEEAVADSKAKINSLMTDIGTSESSFQHLTVVKDLSQKIESLQGLVLQLREQL

SEQ ID NO: 201772 - protein, 103 aa, Glycine max
  Coding DNA Sequence Number=SeqID_84994
MALRNFEKTPPNSGGVAGCVSRHHGGHGGIALFFFCAIGVGLTRPNPTRDSIAKAQHTTASTHRTEQSTNRKVSRTTSSTTTTNGSDSEGNAHDTRTCTQPAA

SEQ ID NO: 201773 - protein, 457 aa, Glycine max
  Coding DNA Sequence Number=SeqID_84995
MVTADGNPLLKVPPPGGIVRVGIACEQYLSNTSVEQLFFVLDLYAYFGRVSEKIAIAGKKKQLKDVRNKSFSGKLMDKIPSDTSVTLTLKNLQLQFLEPSSVNAEGMPLAQFVGDDLSFSATHRTLGGAIVVSSTLNWETVVIDCVDSKEPLACEKDSYFSTVENVPSISDVGYPKLRPVFWVHNKKELLNGNAHSYPFLDISVVHVVPFCIVDMESHTLNVSAVVSGVRLGGGVNYFEALLHRFGILGPDGGPGKCLSKGLENLQTGPLAKLFKATPLISDNSENGEGRDTSFPNLKNPDIVDVTIELKDWLFALEGAQEMAERWWFSVHEDVKREERYWHTTFHTLRVNAKSCPKNIPDRKSQSRRIQPYPVELVTVKTPILLSSSLMQCALKHLGNPTLKASCYGGEPCTQILHQASYTTQCGTYASHNPQVLIIAPPLTADVSAVHTLRHFTR

SEQ ID NO: 201774 - protein, 266 aa, Glycine max
  Coding DNA Sequence Number=SeqID_84996
  Homolog annotation: Hit_ID=Q9LT50; Match level="QueryCoverage=81%, HitCoverage=61%, E-value=5e-94, Identity=77%"; Hit description =Arabidopsis thaliana genomic DNA, chromosome 3, P1 clone: MOE17
MLRRVDRRGDDDVVVDSETTFTMLPESLYNLVVAEFSRRVGRVHKRASEIADGMTIQIDTVNLLLETRGSASRQGGATWTPPMASITIHNLLLYTTNESWEVVNLKEAREFSSNKKYIYVFKKLEWESLSIDLLPHPDMFTDATLGRSQEGANLRDEDGAKRVLFGGERFIEGISGEAYITIQRTELNSPFGLEVQLHVTEAVCPALSEPGLRALLRFITGLYVCLNRGNVDFKAQQRSTEAAGRSLVSIVVDHIFLCIKDAEHAK

SEQ ID NO: 201775 - protein, 72 aa, Glycine max
  Coding DNA Sequence Number=SeqID_84997
MQGMAQALRANEHLRRVMGSNDCSPDLRISAKEVIALSELNVLSAHQRLSPTPARLVSKEESRKASAMQACA

SEQ ID NO: 201776 - protein, 131 aa, Glycine max
  Coding DNA Sequence Number=SeqID_84998
  Homolog annotation: Hit_ID=Q9LT50; Match level="QueryCoverage=93%, HitCoverage=34%, E-value=3e-42, Identity=69%"; Hit description =Arabidopsis thaliana genomic DNA, chromosome 3, P1 clone: MOE17
MESILGRALEYTLKHWLKSFSRDQFKLQGRTVQLYNLDLNGDVLHSSVGFPPALNVTAAKVGKLEITLPSVSNVQIEPIIVQIDRLNLVLEENFDFEPSETQPSCSPSSASTKGSGYGFADKVDSFISKCK

SEQ ID NO: 201777 - protein, 83 aa, Glycine max
  Coding DNA Sequence Number=SeqID_84999
MEKQWVWMGVVAAKLRAGVCGEGGGRRDCNLEAKDVDLGGEVLNLVWRRCWQWRRDTKRVVEDEGEEWLGRRTKRLVESLKDL

SEQ ID NO: 201778 - protein, 806 aa, Glycine max
  Coding DNA Sequence Number=SeqID_85000
  Homolog annotation: Hit_ID=UPI00006604AC; Match level="QueryCoverage =47%, HitCoverage=41%, E-value=6e-38, Identity=29%"; Hit description =Homolog of Homo sapiens "Splice Isoform 3 of Breast carcinoma amplified sequence 3
MRQILLLGYWSGFQVWDVNDSNNVRDLVSRQDGPVSFMQMVPTPIVSKRPEDKYAGKHPLLVICMDGGGKTQDGLGATCKGGTLNHHDQVNGNYLPTTVQFYSMRSQSYVHVLKFRSVVYSVRCSSRIVAVSQATQIHCFSATTLEREYTLLTNPIVTPCFGSGGIGFGPLAVGPRWLAYSGSPDATATSGRVRPQHLTPSASFPGISSNVSLVAHYAKESSKHLAAGIVTLGDMGYKKLSRYCSELRPDSSSSIQLVNSSPKGNGIVNGHSTDADNIGMVIVRDIVSKNVVSQFRAHKSPISALCFDPSGTILVTASVQGHNINVFKIIPGYERVSASDAGPSYVHLYRLQRGLTNAVIQDISFSADSRWIMISSSRGTSHLFAINPQGGPVNILSCDNSLTEKNGGLDVMNNQAVCWPHSSALEICKPQSLCTAGPPITLSVVSRIRNGSNGWRSTVTGAAAAATNRMSSLSGAIASSFRNFEGNSTLFVNGNYSKEKCHLLVFSPTGSMIQYALQTINSQDSGVVSGVTPAYESAPATDVRVVVEPIKKWNISQRQSWREGEDNIDIYGENVVSDSNKLYSEEVKKDNIISPKMKNVAVKWNSCSEKEHQLYISEAELQMHQAKTPLWGKTGIYFHSVGKEAILMMDEEAASGGEFEIDKIPTRVIQARSKDLVPIFDYIQTSKFQQIRTPAVGNVLYEQLLRQSSFENGRISTRGFLSSPDCIPNSEFKSMIEGSEWGDSLLSAKTKAFVNKNNTLKPNTWPEIANNRRENLNMNAHQIFVNSDRKGLKLENHCKEKGDEFD

SEQ ID NO: 201779 - protein, 75 aa, Glycine max
  Coding DNA Sequence Number=SeqID_85001
  Subcellular localization annotation: CTP_CleavageSite=34; ConfidenceScore=5.04e-01
MAGMFSDIYACLLAIDEVVFRHVSSRRSYPSSVSNSLEASKLAINQPVATRREFNQRFNTKSNQKNCHLNSINSI

SEQ ID NO: 201780 - protein, 74 aa, Glycine max
  Coding DNA Sequence Number=SeqID_85002
  Homolog annotation: Hit_ID=Q1S4N1; Match level="QueryCoverage=63%, HitCoverage=3%, E-value=5e-09, Identity=59%"; Hit description =Peptidase S8 and S53, subtilisin, kexin, sedolisin; Integrase, catalytic region; Zinc ...
  Homolog annotation: Hit description=finger, CCHC-type; Peptidase aspartic, catalytic
MVEVRKRESLDVLFFEEEKWSKESEKLQVQEESEEGVDDQQVRGTRSLSDIYQRCNVAVMEPVDYNEAATDSKW

SEQ ID NO: 201781 - protein, 79 aa, Glycine max
  Coding DNA Sequence Number=SeqID_85003
MHFTDTRARETVSFLDTTSRGSKVPQQGIKTEPMCDAYAKGATREFSRGIILFEKHIAAVGTTSNNKFSKKKALDEGSL

SEQ ID NO: 201782 - protein, 73 aa, Glycine max
  Coding DNA Sequence Number=SeqID_85004
  Gene Ontology: Mol. function=DNA binding; Cellular component=nucleus; Biological process=regulation of transcription
  Homolog annotation: Hit_ID=Q6K5X2; Match level="QueryCoverage=95%, HitCoverage=25%, E-value=4e-15, Identity=47%"; Hit description =Putative NAC domain protein NAC1
  Pfam annotation: Domain name=NAM; Domain location=10-73; Score=-30.5; E_value=0.00012; Accession=PF02365.6; Description=No apical meristem (NAM) protein
MGLRDIGASLPPGFRFYPSDEELVLHYLYKKITNEEVLKGTLMEIDLHTCEPWQLPVESSQWLLTFTNEAYIA

SEQ ID NO: 201783 - protein, 266 aa, Glycine max
  Coding DNA Sequence Number=SeqID_85005
  Gene Ontology: Mol. function=nucleic acid binding; Biological process= DNA integration
MGVPCSEVHCGGCGQTVIEDKDIKVIEDKDIKDIKGQSVICQGKYGARQTPSKKVNVVTNVSKLVVDSGDTRHICADKNVFTSYTAMRDGEEVYLGGSKTTPVLGKGKVFLKLAYGKMLALSDVIHVPTIKVNLVFVALLGKVRVKVSFESNKIVMIENNVFGKGYCDQGIFVLNVSKVINGNAITSAYMIDSYDMWSCEYTLFNDFYEKEEHSDPYRILILKSNVLDCNTTIETKNADFFEDIFPLRSCASSSTNTSFKQPIEKN

SEQ ID NO: 201784 - protein, 258 aa, Glycine max
  Coding DNA Sequence Number=SeqID_85006
  Gene Ontology: Mol. function=DNA binding; Cellular component=nucleus; Biological process=regulation of transcription
  Homolog annotation: Hit_ID=Q8LB22; Match level="QueryCoverage=61%, HitCoverage=40%, E-value=4e-36, Identity=53%"; Hit description=NAM / CUC2-like protein
  Pfam annotation: Domain name=NAM; Domain location=1-90; Score=70.1; E_ value=6.9e-18; Accession=PF02365.6; Description=No apical meristem (NAM) protein
MCSCMRTCSTEVAKLNANEWYFFSFRDRKYATGFRTNRATTSGYWKATGKDRTVLDPATREVVGMRKTLVFYRNRAPNGASFPRKKYKAYDCSFIYQLKHLDILSEWISPPKEDWVLCRVFHKGKADNSAKLIMYESTVPSLTLASSSPTNLYTTPSIGYNQLLAPFSSSMATHHHHHHHIPNQSQNNNSLMSLLQFSRETNTNNSSTVTQISPKCDDNGYGFLWDMDLEENSFHDGGASNLDGMRFEVDNNNSVVLL

SEQ ID NO: 201785 - protein, 94 aa, Glycine max
  Coding DNA Sequence Number=SeqID_85007
MASLNDLKSRKLHLVIYQSVTIHCHPSMVHAIGEGDILTTCIFAIFHLVLLFVVKKASWLWKAKSSVGSSLGNWSDSKVLDSIGLSCRTITRNQ

SEQ ID NO: 201786 - protein, 69 aa, Glycine max
  Coding DNA Sequence Number=SeqID_85008
MSEFTSDYLPQNLASLHLSDFAPYVSGSYNAQWNAPELLHDKHMLRSSCILRKMEVEEPWLGLWLPLHY

SEQ ID NO: 201787 - protein, 75 aa, Glycine max
  Coding DNA Sequence Number=SeqID_85009
MDKCHLKLQTKFREDPTVNEGWAAFLPRQLHGVTLVEFSLTRGICEQCLIRIWLNYHKESGFSISGDTIRTHEHC

SEQ ID NO: 201788 - protein, 87 aa, Glycine max
  Coding DNA Sequence Number=SeqID_85010
MSVSLRMFNRGDKVLDPYPCQEVFVSLSFELSVVVGEDSIWEVVLGDKVSLAPRAFGSSPSMSIPHMAKGQAPHGRRTKGSLDCEGC

SEQ ID NO: 201789 - protein, 235 aa, Glycine max
  Coding DNA Sequence Number=SeqID_85011
  Gene Ontology: Mol. function=DNA binding
  Homolog annotation: Hit_ID=Q1STZ2; Match level="QueryCoverage=52%, HitCoverage=32%, E-value=2e-15, Identity=34%"; Hit description=IMP dehydrogenase/GMP reductase
MGQLQRQAFRKAYGKIWDLARVEVSMESIASLSQYYDQPLRCFTFEDFQLVPTVKEFEEILGCPLGGRKPYLFSGFYPSTTRVAKVVKISAQELDRANGLSFIDILALLIFGVVLFPNMEGLVDLAAIDAFLAFHHGKESPLGYPMRGAPLDESITPFIARGFSDHNARDKELRGSSNRIISSYHKWLRVRTQGLDWLPNLKTVRDDEVKASEESDEVQALKAELERARVVEEKF

SEQ ID NO: 201790 - protein, 309 aa, Glycine max
  Coding DNA Sequence Number=SeqID_85012
  Homolog annotation: Hit_ID=Q1SS26; Match level="QueryCoverage=69%, HitCoverage=25%, E-value=2e-10, Identity=21%"; Hit description =Unnamed protein product; no similarity, hypothetical start
  Subcellular localization annotation: CTP_CleavageSite=73; ConfidenceScore=5.77e-01
MAESSKKRKGSSASASTSRAHRSEATSASTTPIPPSLSSSPVFSSDEQQKRYSNLFSSRSIINPKFIDMEFFSAETFDCIQAFQNLGLLPFMSLQLPIYPELVKAFYCNLEIQDSTLISKIFGIKMVIDQSLFHDLTKLPSDGVPFEGTLNDDWKFDFSAHDARQLVCTNNADMTGHLLAGSLAFESRILHYLIVRILLPRSSNLAQVSEEDLIIMWAFHTGRQLDWAHLVRYRMHKALRLNAPLPYPQLVTLFFRHFQIPLDSKPYVPIKRSFLIGAVVIASFGYRKEHDGSWVKKGAPPADDEGNQP

SEQ ID NO: 201791 - protein, 394 aa, Glycine max
  Coding DNA Sequence Number=SeqID_85013
  Gene Ontology: Mol. function=oxidoreductase activity, acting on other nitrogenous compounds as donors, iron-sulfur protein as acceptor; Cellular component=sulfite reductase complex (NADPH); Biological process=amino acid biosynthetic process
  Homolog annotation: Hit_ID=Q5L041; Match level="QueryCoverage=47%, HitCoverage=32%, E-value=1e-47, Identity=51%"; Hit description =Sulfite reductase hemoprotein beta-component
  Pfam annotation: Domain name=NIR_SIR_ferr; Domain location=33-105; Score=65.2; E_value=2.2e-16; Accession=PF03460.7; Description =NitriteSulfite reductase ferredoxin-like half domain
MGIEGYRAEVEKRTGFAFDPAREFKFEQRKDRYGWTQNHEGNWFYTAFVEHGRVLNTDNYPLKLGLLKIAETGKVNFRFTCNQNLILADIKEADKPEIERLLKEYGISGYTTGASALRKNSVACVALNTCSLALAEAQRYLPSLVTKIEPVLEKYGLLEEDITIRMTGCPNGCGRSPNAEIGFVGTAYEAQQQLVELSGTIKNTDTRKGISIVKLVDGVDVQSATLGVPLGNAIGPTELDIQSMEVTPGAASALYGMNAINGLASLQTKDPFTSEGLSVYFRGGVNHVDNVNHKISSLGESAIRFAKVLNKNLAVKVNASYFSGVDWISNNQTDQNANPLITANPNFSLANNPAEDLWNKYGDERNNRVAVKVDYNGKPTTFNVSRTGYLEKDL

SEQ ID NO: 201792 - protein, 82 aa, Glycine max
  Coding DNA Sequence Number=SeqID_85014
MEKQALQKDLSSSKIDKIKYKLIQKEDNDNEAKLGATATEDREAATATEDGGPRLRTASEGFQSRITVSSSFSTTRPRSRDS

SEQ ID NO: 201793 - protein, 151 aa, Glycine max
  Coding DNA Sequence Number=SeqID_85015
MSHSDWTINRCTILTESESIRTLMFLMETWGILGNHHTRKSPPVSTVSRRKLYTTMSTMAWQSSPTATTTTPSRRALRTMGRFSRASMCHTPLPFWCWIFRRSTPRSRFSSTPETPLVNTPKSFVASAALTFGSPTRTCYATAFQKKKKPV

SEQ ID NO: 201794 - protein, 83 aa, Glycine max
  Coding DNA Sequence Number=SeqID_85016
MDGSGNHVSFDDDGISKPLVAEATVPALLVAEVAPKPPQRRRAQCLRQLRHELHLPLAFIFLKLKKTKINDVDAYAYMFSDKA

SEQ ID NO: 201795 - protein, 65 aa, Glycine max
  Coding DNA Sequence Number=SeqID_85017
MGGKITLINSVVNALPIYLLSFFKIPQKLLITNSFGLGLSILSMEVGRPCSLLGLKEDILVGGGI

SEQ ID NO: 201796 - protein, 53 aa, Glycine max
  Coding DNA Sequence Number=SeqID_85018
MGCTRTGRYSQNSIPYEIYPDMGHRTKRLIRQALKVMFFTFSLSQSVGLASFC

SEQ ID NO: 201797 - protein, 36 aa, Glycine max
  Coding DNA Sequence Number=SeqID_85019
MKEVDSPLSAQLKLSARKSPQQSPKAHLVQELALSM

SEQ ID NO: 201798 - protein, 189 aa, Glycine max
  Coding DNA Sequence Number=SeqID_85020
MAYGNRLPRVCNRLPGLKMGSGKLRNGDSMLWRPLSNRPLVIDYQLCVIDYTVHIAGFHVLKLCNSSWASDRDGSAINPSPSGDGVPRGSLGDPRRQCKVPITGHDSIHGYFIVEPVQVIEVMSSEEDPEEDPEELTPEPAVDALDFPEGDEDPLPEVDSPEDVMSASEADSTEESGPGGIATSGGSSS

SEQ ID NO: 201799 - protein, 111 aa, Glycine max
  Coding DNA Sequence Number=SeqID_85021
MSDLELYIEKDVAGGSMFHSANSLTSCGNNLSNNEVQPPRNVSNLHGDEDDDDDYLVSNSYVEESLDKDDSVDGISDTDDEVTDMIQPVRIVHPAEVRIVHPNPKPLTPKP

SEQ ID NO: 201800 - protein, 68 aa, Glycine max
  Coding DNA Sequence Number=SeqID_85022
MFSTGFFADGENAYSFGSSGFYSLFFDNDNILRLLYDGLEVSAITGHIHGWHLGKLIRTQCMPDGVVK

SEQ ID NO: 201801 - protein, 118 aa, Glycine max
  Coding DNA Sequence Number=SeqID_85023
FRAPFEHKISCSSLPLPSFISFFLQALIHGLLWCGVSSLSSFSIPLPFIFQEAKESIDEEDPRPTSSNGACIEVAWPGDWPEAQAGEAPTEAPNDADEARMDEEMIDLLDFLGGSGAT

SEQ ID NO: 201802 - protein, 151 aa, Glycine max
  Coding DNA Sequence Number=SeqID_85024
MAGTFFLLKQQNSLEIISGKKEMTPNRVVNWPFRTLYVMARSPNKIKSINGSKESLKLSVRISDLWFIGTPNKSEQAEMVFVDSDCVLRDIPFRKYRFAGFADVVAGQFEPGLLLEVVFHQVSGKGRRVVFKLKDLSQQFLSCTLWDDYCL

SEQ ID NO: 201803 - protein, 114 aa, Glycine max
  Coding DNA Sequence Number=SeqID_85025
MKSSLRSRAFPYYVISCIPFFLMFLVAKFKGRRYMRGIYCRSKKDRGIKCEFETSRGVIRKCTPKLLCMYVELHADGLPETPSSARTRRRVHLGFFSLHFRGSLAQISRQHSPP

SEQ ID NO: 201804 - protein, 110 aa, Glycine max
  Coding DNA Sequence Number=SeqID_85026
MNEDQCMYDTIMFEEVDTDDQNEQECGVNEPQVDYSDAFNTSQVFDSRDDVLQWAQSVAYENGLVAVIIRSDTNTGSRGRTSFVLIGCERSDEYRCRKKEFFKRDTGTRK

SEQ ID NO: 201805 - protein, 85 aa, Glycine max
  Coding DNA Sequence Number=SeqID_85027
MARIAKVVKMSVKHLEQKTRALADQGEWASFIDVLALLGFGVILFPNVDGLVDLAVIDAFLAYHHSKESSVVAVLADAYDTFDRR

SEQ ID NO: 201806 - protein, 290 aa, Glycine max
  Coding DNA Sequence Number=SeqID_85028
  Homolog annotation: Hit_ID=Q5XM22; Match level="QueryCoverage=42%, HitCoverage=84%, E-value=5e-26, Identity=45%"; Hit description =Resistance-like protein HAAS-2
MVRTRGLGRALGWAIGKVLGRRDATAEELNEEQPKAHIEEVVTNVEDFENHIALRIWNGEERPELKLSSHGRKMAKFGRPAPEIEGLVAASGLSPLITCSLDTGDRKQMAFHSFKLLHVDDAFKMLVELLKVNVAEARAETIQCHDSYVRLSWLCDVYEMKIEVCHWIVAVRAYLLHLLGCTLFANKSATHVHVVFLDALRDLTQSGGYAWGVAALVNMYDNLNDASKSTTRQLARYITLLQCWIYGYFPSVGSAVPAKDYDERRVRLDRLTPDVVCWIPYGDHRSFREL

SEQ ID NO: 201807 - protein, 839 aa, Glycine max
  Coding DNA Sequence Number=SeqID_85029
  Gene Ontology: Mol. function=5-methyltetrahydropteroyltriglutamate -homocysteine S-methyltransferase activity; Cellular component =cytosol; Biological process=methionine biosynthetic process
  Homolog annotation: Hit_ID=Q71EW8; Match level="QueryCoverage=90%, HitCoverage=99%, E-value=0.0, Identity=88%"; Hit description =Methionine synthase
  Pfam annotation: Domain name=Meth_synt_1; Domain location=2-318; Score=601.2; E_value=9.6e-178; Accession=PF08267.2; Description =Cobalamin-independent synthase, N-termina
  Pfam annotation: Domain name=Meth_synt_2; Domain location=432-756; Score=750.5; E_value=1.1e-222; Accession=PF01717.8; Description =Cobalamin-independent synthase, Catal
  Pfam module annotation: Pfam domain module=Meth_synt_1::Meth_synt_2; Domain location=2-318::432-756
MASHIVGYPRMGPKRELKFALESFWDGKSSADDLQKVAADLRSAIWKQMADAGIKYIPSNTFSYYDQVLDTTAMLGAVPSRYNWNGGEIGFDVYFSMARGNSSVPAMEMTKWFDTNYHYIVPELGPDVKFSYASHKVVDEYKEAKVLGINTVPVLVGPVSYLLLSKPAKGVEKSFSLLSLIDKILPVYREVVAELKAAGATWIQFDEPTLVKDLNAHQLQAFTHAYAELESSLSGLNVLIETYFADVPAEAYKTLTSLKAVTAYGFDIVRGTKTLDLIKQGFPSGKFLFAGVVDGRNIWANNFASSLNTLQALGDIVGNDKVVVSTSCSLLHTAVDLVNETKLDQEIKSWLAFAAQKVVEVNALAKALSGQKDEVFFSANAAALASRKSSPRVINEAVQKAAAALKGSDHRRATNVSARLDAQQKKLNLSVLPTTTIGSFPQTADLRRVRREFKANKISEEDYIRFIKEEIYNVVKLQEELDIDVLVHGEPERNDMVEYFGEQLSGFAFTANGWVQSYGSRCVKPPIIYGDVSRPKPMTVFWSSTAQSLTKRPMKGMLTGPVTILNWSFVRDDQPRFETCYQIALAIKDEVEDLEKAGITVIQIDEAALREGLPLRKSEEAFYLNWAVHSFRITNCGVEDTTQIHTHMCYSNFNDIIHSIIDMDADVITIENSRSDEKLLSVFREGVKYGAGIGPGVYDIHSPRIPPTEEIADRINKMLAVLESSILWVNPDCGLKTRKYTEVKPALTNMVAAAKLIRNQSAIVMLRTLRRISLQAIVIGASPGAAVKLCLGDLLVMGSNPETASLHMQGSAIVMIGTLKDILASYSNRVCFFLWDLEV

SEQ ID NO: 201808 - protein, 107 aa, Glycine max
  Coding DNA Sequence Number=SeqID_85030
VVVIIKKGENVNHEDFDDVKKIKPWIMVVIIKKGENGENVNVCIHDFDDAKEESNKVASKDKCGFKINTRLLQQTKPCFKINSRSSLVLKQSAFKTFKALVIDYQAV

SEQ ID NO: 201809 - protein, 124 aa, Glycine max
  Coding DNA Sequence Number=SeqID_85031
MITIENENAWDEQCTSHKSAKPFRFKVLQNWDDIVDLCAKDRAIGHGAEMAMDADEAMSRETNKVECIGLGVTATIDLEEPSSNTKGKRQGSTCSGTHSHKRRWEKKEGISASLDKMTNSFNRM

SEQ ID NO: 201810 - protein, 309 aa, Glycine max
  Coding DNA Sequence Number=SeqID_85032
  Gene Ontology: Mol. function=sequence-specific DNA binding; Cellular component=intracellular; Biological process=regulation of transcription, DNA-dependent
  Homolog annotation: Hit_ID=P07642; Match level="QueryCoverage=70%, HitCoverage=70%, E-value=1e-86, Identity=69%"; Hit description =Arabinose operon regulatory protein
MGVVRGRNYNQVQRRVIQQCLRIGHHLHRRPVSVHFTGIAAGDRRQLNVWRTGDQWRMEVSKNKAESPESSGDRTPCRLPALLGHQRVVRILTAAAEIARTDAHPLAEHAREVELVVVADLAPHRGDRFLSGLQQQLGADHPLIFAPAQQVDSHLLAEQVGQTRRRQTDVARHFLDFHLAGQMIGDVLAGFNHAWVANLLMAARILFHRTQQQALQQIHRQLLGKATSGVVRLFDAGKQAVKFGAQRIRQPQPANALVLILPLQPVGPVGARTEIDPAMMPARTVRRAAIIVRRFRLEQQQVARLAVKR

SEQ ID NO: 201811 - protein, 162 aa, Glycine max
  Coding DNA Sequence Number=SeqID_85033
MTLTIPQLFLKPLQVMWDATLFGLFNENFPLYIKHEDLSEIAHGGQCLSISVIQLWILHMTETSIRAGNIDVYGFLEPQSIQRSGQSQFESENYMKNWMQNSKRDVYLGAYLNGAHWQMAVILPKENVVIWFCSLHNKPDNYLKGIINMSVLFFNTFALAIV

SEQ ID NO: 201812 - protein, 147 aa, Glycine max
  Coding DNA Sequence Number=SeqID_85034
  Gene Ontology: Cellular component=integral to membrane
  Homolog annotation: Hit_ID=UPI00005F7AAC; Match level="QueryCoverage =98%, HitCoverage=99%, E-value=2e-33, Identity=45%"; Hit description =COG2244: Membrane protein involved in the export of O-antigen and teichoic acid
MSESVNPPRIAGWLLLPLAWLIMTMLTSALVVALYLRPLFDTELRTTLFSHASILMTQWLVSLLTAAAVWLYSIWVCWIFCQRSHRLPRHYIHWLLMTVLLALKTFAFTPVADGKAIQTLLLALLSAAVFVPYFKRSQRVKQTFIQP

SEQ ID NO: 201813 - protein, 542 aa, Glycine max
  Coding DNA Sequence Number=SeqID_85035
  Homolog annotation: Hit_ID=Q8ZED4; Match level="QueryCoverage=40%, HitCoverage=93%, E-value=2e-74, Identity=66%"; Hit description =Electron transport complex protein rnfE
  Pfam annotation: Domain name=FMN_bind; Domain location=102-191; Score= 91.5; E_value=2.6e-24; Accession=PF04205.5; Description=FMN-binding domain
  Pfam annotation: Domain name=HHH; Domain location=459-488; Score =31.0; E_value=4e-06; Accession=PF00633.13; Description=Helix-hairpin- helix motif
  Pfam annotation: Domain name=HhH-GPD; Domain location=397-529; Score =46.3; E_value=1e-10; Accession=PF00730.15; Description=HhH-GPD superfamily base excision DNA repair protein
  Pfam annotation: Domain name=Rnf-Nqr; Domain location=170-370; Score =337.1; E_value=2.9e-98; Accession=PF02508.5; Description=Rnf-Nqr subunit, membrane protein
  Pfam module annotation: Pfam domain module=FMN_bind::HHH::HhH -GPD::Rnf-Nqr; Domain location=102-191::459-488::397-529::170-370
MMIETIRKNAFTLGMFAVITTGVTAVVNYVTKPTVDHQTALQQKNLLDQVVPTDLYDNNIQQECLLVTDARALGNEKPHHLYVARKGDQPVAAALETTAPDGYSGAIQMLVGADFHGKVLGVRVIEHHETPGLGDKIELRISDWINSFNGKVVHGADDKAFAVKKDGGEFDQFTGATITPRAVNNSALVQLLGLCPLLAVTSTATNALGLGLATTLVLTITNSAISASRRWVPGEIRIPIYVMIIASVVSCVQMLINAYAYGLYQSLGIFIPLIVTNCIVVGRAEAVASKSSIPLSALDGFAIGMGATCAMVTLGSIRELIGNGTLFNGADQLLGPWAKALRIEVVHFDSPMLLAMLPPGAFIGLGMLLAGKYLIDQKMKQRAARQLDAAAAAPQGETGKAATDVSVNKATARLYPVANTPAAMLALGVEGVKEYIKTIGLFNSKAENVIKTCRILQEQHGGVVPEDRAALEALPGVGRKTANVVLNTAFGWPTIAVDTHIFRVSNRTRFAPGKNVEEVEQKLLKVVPTEFKVDCHHWLILH

SEQ ID NO: 201814 - protein, 78 aa, Glycine max
  Coding DNA Sequence Number=SeqID_85036
MDSLEISEKNCFREENPSRGASVTLLRRFRERFHEDSSPFFIVLRSSTVLKELRRSYLLITIKEYVGARETPLLTTKR

SEQ ID NO: 201815 - protein, 99 aa, Glycine max
  Coding DNA Sequence Number=SeqID_85037
  Subcellular localization annotation: CTP_CleavageSite=8; ConfidenceScore=5.15e-01
MEAKGSPRLASGSPRPPNSFMVKKPTRLSELIALALSFNSPGHPRGFIKGSKGQKVREFREDRKKKKKEEETKPRRYRIAIAIISCIIFLFCVLRATVS

SEQ ID NO: 201816 - protein, 186 aa, Glycine max
  Coding DNA Sequence Number=SeqID_85038
  Homolog annotation: Hit_ID=UPI00006A17C9; Match level="QueryCoverage =86%, HitCoverage=89%, E-value=2e-08, Identity=27%"; Hit description =UPI00006A17C9 related cluster
MDPRVLVPWSSEDYTPRQQRAARPHLKRTVCPHFQRTACPHLQRATSPRHQRTACPHLQRVTRPRHQRTACPYLHRATRPHLGYYTSSPTEGCTPSPSGLHVLTLRGLHVPTIRGLHALTSRGLHVLALRGLLALALGTSYPHLQRTTCPHLRRATRPHLERTTCPHLQRATCPRLERATRPHLGY

SEQ ID NO: 201817 - protein, 81 aa, Glycine max
  Coding DNA Sequence Number=SeqID_85039
  Gene Ontology: Mol. function=peptidyl-prolyl cis-trans isomerase activity; Biological process=protein folding
  Homolog annotation: Hit_ID=Q01AE8; Match level="QueryCoverage=85%, HitCoverage=31%, E-value=1e-07, Identity=38%"; Hit description=[O] KOG0865 Cyclophilin type peptidyl-prolyl cis-trans isomerase
MFGRVQSICLHPGLDVITAIASIPTYQPSERIRQFNDLARFFGDERAQNARNIWNRPLTSVYISDCGELKVTKPSLTPSLP

SEQ ID NO: 201818 - protein, 87 aa, Glycine max
  Coding DNA Sequence Number=SeqID_85040
  Subcellular localization annotation: CTP_CleavageSite=4; ConfidenceScore=5.15e-01
MTIIATTKTTVAAITMIVVTTPVMTFVIVVATTMITIGTIIMIVIITTTVATTTVLIVVIVVVATTTTNVNGDGVNNDNDNDHANKQ

SEQ ID NO: 201819 - protein, 144 aa, Glycine max
  Coding DNA Sequence Number=SeqID_85041
MKQQLSYYGILLDHIPIRHRHRYFGFLMLQKGERNRLRNQEINFRTIRHNLQKKGGVWDECTINQNLSKASRRCFHDAKGTRFSSFIQDKNPRYPRNSRNMIKIIPKVLGRKFQVETTKGLAKGINLKCFLKEFYSLIIDYQKM

SEQ ID NO: 201820 - protein, 178 aa, Glycine max
  Coding DNA Sequence Number=SeqID_85042
  Gene Ontology: Mol. function=peroxidase activity
  Homolog annotation: Hit_ID=Q1LMZ0; Match level="QueryCoverage=97%, HitCoverage=97%, E-value=9e-56, Identity=61%"; Hit description =Alkylhydroperoxidase AhpD core
  Pfam annotation: Domain name=CMD; Domain location=43-122; Score=44.8; E_value=2.8e-10; Accession=PF02627.10; Description=Carboxymuconolacton e decarboxylase family
MSRLADIREQDATGKAADIFAGIKKAMGKVPNAYLTIGGHSPAALQQALAHNAMLHKSSLSAQELEAINLSVSEATGCDYCLAAHTLMAKKAGFSGEQIHALRRGEYTEDARLDALVNFAQTLVTTTGTLPEADVAALRHAGFSDQQVIEIISAVSAILFTNMVNRVNDTVVDFPKAD

SEQ ID NO: 201821 - protein, 74 aa, Glycine max
  Coding DNA Sequence Number=SeqID_85043
  Gene Ontology: Biological process=metabolic process
  Homolog annotation: Hit_ID=UPI000038D9FD; Match level="QueryCoverage =98%, HitCoverage=38%, E-value=1e-30, Identity=79%"; Hit description =COG3558: Uncharacterized protein conserved in bacteria
  Pfam annotation: Domain name=DUF1348; Domain location=1-65; Score =42.2; E_value=1.8e-09; Accession=PF07080.2; Description=Protein of unknown function (DUF1348)
DNRIAVRFAYEWCDDSGNWFRSYGNENWQFDEHGLMSTRYACINDLPIAESERLFHWPQGRRPDDHPGLSELGL

SEQ ID NO: 201822 - protein, 179 aa, Glycine max
  Coding DNA Sequence Number=SeqID_85044
  Gene Ontology: Mol. function=RNA-directed DNA polymerase activity; Biological process=RNA-dependent DNA replication
MEADIPLGWKPLNLDRYDGTTNTNEHLDAFLTQANLYTNDDTILCHVFPMSLKVATLTWSYCMTSTALASLRPEDDEYLRKLMDRFGRTGVQIQNLNPKVALHSMFIALHPSKIIDSLREKPPGCMDELCERAKGYIQMEEMSRFRNEVHQAGQRHDKNESNTKANLHKSDKRHKPNKR

SEQ ID NO: 201823 - protein, 143 aa, Glycine max
  Coding DNA Sequence Number=SeqID_85045
  Gene Ontology: Mol. function=electron transporter, transferring electrons within the cyclic electron transport pathway of photosynthesis activity; Cellular component=light-harvesting complex; Biological process=...
  Gene Ontology: Biological process=photosynthetic electron transport in photosystem II
  Homolog annotation: Hit_ID=P56778; Match level="QueryCoverage=80%, HitCoverage=24%, E-value=4e-63, Identity=97%"; Hit description =Photosystem II 44 kDa reaction center protein precursor
  Pfam annotation: Domain name=PSII; Domain location=1-143; Score= -119.1; E_value=2.5e-05; Accession=PF00421.9; Description=Photosystem II protein
MTTILGIHLILLGIGAFLLVFKALYFGGWIVSVDDLEDIIGGHVWLGSICILGGIWHILTKPFAWARRALVWSGEAYLSYSLGALSVFGFIACCFVWFNNTAYPSEFYGPTGPEASQAQAFTFLVRDQRLGANVGSAQGPTGL

SEQ ID NO: 201824 - protein, 83 aa, Glycine max
  Coding DNA Sequence Number=SeqID_85046
MAHQLRNNTDFVSIYRRGRVVACSCVTDYTVSQHALLRASEGETHRKVDKSGTFAPTYPPLERKSDPRSSFLKVNQAILLLER

SEQ ID NO: 201825 - protein, 77 aa, Glycine max
  Coding DNA Sequence Number=SeqID_85047
VVPGDMSRGSRDLGDVRRAPSSQPIKEQSPRSKEACVAAGQLCILGGLKNGDRMLKWPLGDRALVIDYQLGVIDYTG

SEQ ID NO: 201826 - protein, 196 aa, Glycine max
  Coding DNA Sequence Number=SeqID_85048
  Gene Ontology: Mol. function=transition metal ion binding; Cellular component=cytoplasm; Biological process=DNA integration
MQSGSQSERFDVEMGDRLEDMIRDLGQESFQQAHVLVYEGLHSDSMKPLYMGCKNSLTLLSVVLCLVNVKARYGWSDKIFSSLLEVVHNLLPEDNMLPKTYYKAKKILCPMGMEYEKIHACPNDCILYRHDFQEMSKCPIYGTSWYKVEDEEESSSDENSNKGPPVKVLWYLPIIPRRLMVCIRILGKSQEILDLD

SEQ ID NO: 201827 - protein, 84 aa, Glycine max
  Coding DNA Sequence Number=SeqID_85049
MDLINCFLEKESSPKQDSWEREKEVGIPWRVQERWVGLNHSQVDLMQSYLARALDRKLQVDWARDAREGPRVLMSLGVDFGPMG

SEQ ID NO: 201828 - protein, 86 aa, Glycine max
  Coding DNA Sequence Number=SeqID_85050
  Homolog annotation: Hit_ID=Q8W228; Match level="QueryCoverage=44%, HitCoverage=7%, E-value=5e-07, Identity=61%"; Hit description =Cytochrome P450
MQDMLLGSMDTSATAIEWTLSELLKNPQVMKKVQMELETVVVWTARSISGANKKMIETLATRKKEEYLKNLKLGRIFKLYKLEKVE

SEQ ID NO: 201829 - protein, 219 aa, Glycine max
  Coding DNA Sequence Number=SeqID_85051
MDSLLEQATQGSFVPHGRQDILNTTLGRPEHPGRVRVVGTGVTISQYFGQASRASSTSSPSINQQQLADIIGVIKDDIRKLLQDEIRKEVQDEIRKEVQQEHKQQQEDWMRAVEEKQWQNLELMKQELKKSLKVELSHIASHQSAPIKAPEIQALLARVSTKGSCAGPEGSGLLKELLSGGDDLMGLFVVVGENTVLAGLGKVFENSSTIHNVRYENDV

SEQ ID NO: 201830 - protein, 99 aa, Glycine max
  Coding DNA Sequence Number=SeqID_85052
MLGYSVCKVSLAGKEPAKAKGCSAQQMPQGISLGAEDPGLARDQSIKNFTKLPRLSELGSLSHMYYTRRMSVHPQEINSLSAAGALSEFFRKTPIFNEY

SEQ ID NO: 201831 - protein, 387 aa, Glycine max
  Coding DNA Sequence Number=SeqID_85053
  Gene Ontology: Mol. function=transferase activity; Biological process= biosynthetic process
  Homolog annotation: Hit_ID=Q2NQU8; Match level="QueryCoverage=96%, HitCoverage=99%, E-value=1e-137, Identity=62%"; Hit description =Putative lipopolysaccharide glycosyltransferase
  Pfam annotation: Domain name=Glycos_transf_1; Domain location=202 -363; Score=108.8; E_value=1.6e-29; Accession=PF00534.10; Description= Glycosyl transferases group 1
MCLPPPGAFCMTKLRLAIVRQKYRPDGGAERFISRALEALDSEQLDLNIITRSWQGTPNPAWHLHICNPAKFGRISRERGFARAARACWEREKFDIVQSHERIAGCDIFRAGDGVHRVWLEQRARIVSPWQRLSTSLSPYHRYVLQAEAEMFNAPSLKAVICNSHMVKQDILRHFALDASKIHVIHNAIDSQRFQPASDTLRHAARQRLNLPQDATVMIYVGSGFERKGLKAAIEAVANSDRYLVVVGQDKQLARYQQLANQLNCLDRLRFAGVQQDVQPFYHAADALLLPTLYDPFPNVVLEAMACGLAIITSTGCGGAEFITNGEEGFVCDALDIKALNEAVIATPALSHNPALGEAARRKIEPYGPQRLAQALTSLYQHVLQTR

SEQ ID NO: 201832 - protein, 48 aa, Glycine max
  Coding DNA Sequence Number=SeqID_85054
MAAGSASSGILPTRLTRLWSKSRHQINGGMGGMFGITLFGKRAIGQFQ

SEQ ID NO: 201833 - protein, 560 aa, Glycine max
  Coding DNA Sequence Number=SeqID_85055
  Gene Ontology: Mol. function=transferase activity; Cellular component= membrane; Biological process=teichoic acid biosynthetic process
  Homolog annotation: Hit_ID=Q5PC08; Match level="QueryCoverage=53%, HitCoverage=86%, E-value=2e-93, Identity=55%"; Hit description =Putative glycosyl transferase
  Pfam annotation: Domain name=Glyco_transf_9; Domain location=348-560; Score=59.7; E_value=9.4e-15; Accession=PF01075.8; Description =Glycosyltransferase family 9 (heptosyltransferase)
  Pfam annotation: Domain name=Glycos_transf_2; Domain location=13-184; Score=134.7; E_value=2.5e-37; Accession=PF00535.16; Description =Glycosyl transferase
  Pfam module annotation: Pfam domain module=Glyco_transf_9::Glycos _transf_2; Domain location=348-560::13-184
MTAQPDSSSPLLSLIIPMFNAGADFTGCINALLAQTLTSLEIIIVDDGSTDGSGERADALAQQYPHIQVVHQPNGGVSRARNAGLAVARGKYVSFPDADDTMDPAMYQTLVDMAERDRLDAAQCNAEWFFKASQTTKPMIPRDRLTSTGVLSGPEWLNKALKTRRYLHVVWLGIYRRELIEQLNLQFEPGLHHQDIPWTTEFMLNVKRVRYTDRVLYRYYMHDASISNRKRTGQHNVDYQRHYLKIARMLEEINTRYRHKVKIYPSFHAQITREALSVCHAIRREPDAAARQAMIADLFSSQTHKRMLRNARGAQTRPMLEAHPAIRQLHIIDRNWKKEGGWQKFRHEVALVRAVRACHYDVVINLADQWRSAIITGLSGAPVRIGFAYRKRDNAFWRWCHNQLVSTDRHHQLHTVEQNMTALQPLGIPTAGATASMHFSTADQQKVQDVLAQQSITGPFVVLQPTSRWVFKCWEDEKVAQLIDALAADGRSVVLTAAPDQKELAMIAHIQSLCRTPNVVSLAGQLSLPQLAALIDAAQLFIGVDSAPMHMAAALQSGIL

SEQ ID NO: 201834 - protein, 323 aa, Glycine max
  Coding DNA Sequence Number=SeqID_85056
  Gene Ontology: Mol. function=transferase activity, transferring glycosyl groups; Biological process=lipopolysaccharide biosynthetic process
  Homolog annotation: Hit_ID=Q936B6; Match level="QueryCoverage=99%, HitCoverage=99%, E-value=1e-135, Identity=73%"; Hit description =Heptosyltransferase I WaaC
  Pfam annotation: Domain name=Glyco_transf_9; Domain location=75-319; Score=322.3; E_value=8.7e-94; Accession=PF01075.8; Description =Glycosyltransferase family 9 (heptosyltransferase)
MHVLIVKTSSMGDVLHTLPALTDAMQAIPGIRFDWVVEENFAQIPGWHPAVDKVLPVAIRRWRKHWFGSQQREERVQFKRELQSRQYDVVIDAQGLIKSAALVTRLAKGIKHGQDSRSAREPFASWWYDKRHEIGKQQHAVERTRELFAKSLGYEKPATQGDYAIAGHFLAAQPQDSQPYLVFLHATTRDNKHWPEDHWRQLIARVQPTGLRVRLPWGAEHEHQRAQRLAAGFDHAEVLPKLTLEQVAQQLAGARAVVSVDTGLSHLTAALNRPNITLFGPTDPGLIGGYGRNQHALRPAQGSSSMADIQPDDVMAMLAEIAL

SEQ ID NO: 201835 - protein, 314 aa, Glycine max
  Coding DNA Sequence Number=SeqID_85057
  Gene Ontology: Mol. function=transferase activity; Biological process= biosynthetic process
  Homolog annotation: Hit_ID=Q2NQV0; Match level="QueryCoverage=99%, HitCoverage=85%, E-value=1e-109, Identity=61%"; Hit description =Putative lipopolysaccharide glycosyltransferase
  Pfam annotation: Domain name=Glycos_transf_1; Domain location=182 -314; Score=24.8; E_value=3.6e-05; Accession=PF00534.10; Description =Glycosyl transferases group 1
MVIDGLPGGGAEKVVLTLAGGFLSQGHQVSIFSLRKVCDYPIPAGVDYQVILDRCNHPWRKLTETWRRARLLDRAVRDSEARHGKFDLILSHLHKTDRIVRQTPALDGDRTWFCLHGVFSASYLARKTGFSLWLKRLKIRHVYQDRQIVGVSQYVIDDMVQNIGVQPRQAKVIANPFDFDSLARLAAEPCPLAGTDFLVHVGRFHETKRHDRLLEAYALSGITAPLVLLGQGSEKITQKLREQAQNSGIAERVRFEGFQRNPYPWIRHARLLVVSSDSEGFGNVLVEALSCGTPVVSTRCPGGPVSILTGELSR

SEQ ID NO: 201836 - protein, 321 aa, Glycine max
  Coding DNA Sequence Number=SeqID_85058
  Gene Ontology: Mol. function=transferase activity, transferring glycosyl groups; Biological process=biosynthetic process
  Homolog annotation: Hit_ID=Q7MY43; Match level="QueryCoverage=97%, HitCoverage=97%, E-value=1e-121, Identity=63%"; Hit description=WalW protein
MEKPAFLITLDTEGDNLWRNRSGKVTTHNVRFLPRFQALCEKYGFKPTWLTNYEMASDPAYVEFGRDLLARGQGEIGMHLHAWYSPPEYALTDDEWRYQPYLIEYPENVLRDKVAFMTDLLENAFQRKMTSHRAGRWAFNEVYARALIDQGYLVDCSVTPRVSWRNAQGAPQGQGGTDYSHFPDRAYFLDEQDISRPGDSPLLELPMSIQYRYGAFTNQLKQVWNGIRGRQRGPSVNWLRPVGGNLAQMKQVAEQTLAQGNDYVEFMLHSSEFMPDGSPTFKTEADIERLYDDLEGLFSWLATRTQGMTLTEFALLKQQQR

SEQ ID NO: 201837 - protein, 80 aa, Glycine max
  Coding DNA Sequence Number=SeqID_85059
MCFHEENPSRGASVTVPRRYREQIREDFPSFFTVLRSFFGLQSNYVGLSSSSQLRIRRSKSPAFVDHPKRLFMVERRGIL

SEQ ID NO: 201838 - protein, 93 aa, Glycine max
  Coding DNA Sequence Number=SeqID_85060
MEERRPEKKVLEVGTLLDPGNRIDAILPRKGPVTRAMSKRLQEDWARADKEGLRVLMNLRGILSSLCSMEFFVFSCILSWGELSYYRGCVAKL

SEQ ID NO: 201839 - protein, 253 aa, Glycine max
  Coding DNA Sequence Number=SeqID_85061
  Pfam annotation: Domain name=RRM_1; Domain location=45-115; Score =33.4; E_value=8e-07; Accession=PF00076.12; Description=RNA recognition motif. (a.k.a. RRM, R
MVSQCVKSFSFDASTVANVVLRKRKGGQQSYVRENWGDHQNISSFYFTRFLEDTTEEELWQHFKKAGDVREIFISRKRNRNGRRYGFARFKGGEDVNQLEKRLDNIVVGGLKLYVNIPKYGRATPGGTQPETRIPTFARQHEQEGRGTYQAKKSAAVPGLKRGSFADVVARRNPRMDQMIPSTGVSYISHSSRSEVHLDIPLSGRKWLQEAWVGRLKNLTMFDRLEEDMLWDFGINIVPKYIGDDMVLLLGLT

SEQ ID NO: 201840 - protein, 165 aa, Glycine max
  Coding DNA Sequence Number=SeqID_85062
  Gene Ontology: Mol. function=RNA-directed DNA polymerase activity; Cellular component=intracellular; Biological process=RNA-dependent DNA replication
  Homolog annotation: Hit_ID=Q1RW82; Match level="QueryCoverage=90%, HitCoverage=54%, E-value=2e-20, Identity=35%"; Hit description =Multicopper oxidase, copper-binding site
MTKSTYDMVWGKTSEQQQDGVFKESWKIKLPPKITMFAWRLIRDRLPTKANLRRRQIQVGESTCPFYREVEERAGHLFFHCGKITPVWWESLSWVGMSGVFPKHPMQHFLQHIHGVKEGMRSSRWKWWWLALTWTIWKQRNNIIFSNGTFNANSILDDAVFLLWM

SEQ ID NO: 201841 - protein, 83 aa, Glycine max
  Coding DNA Sequence Number=SeqID_85063
MRNFGNGELCWSVEEDEEDLDPSIGRKCLAEARSKVRIECESCDPQRAKSLLEEFLKKKREKLRIRKEIKGHKNKKVSLAPIR

SEQ ID NO: 201842 - protein, 125 aa, Glycine max
  Coding DNA Sequence Number=SeqID_85064
  Gene Ontology: Mol. function=oxidoreductase activity; Cellular component=anchored to membrane; Biological process=lignin catabolic process
  Homolog annotation: Hit_ID=Q9SU40; Match level="QueryCoverage=69%, HitCoverage=14%, E-value=4e-28, Identity=64%"; Hit description =Putative monocopper oxidase precursor
  Pfam annotation: Domain name=Cu-oxidase_2; Domain location=22-122; Score=27.0; E_value=1.3e-06; Accession=PF07731.4; Description =Multicopper oxidase
  Subcellular localization annotation: CTP_CleavageSite=29; ConfidenceScore=5.40e-01
MSSSLAHSLTSHSTLFFPIVNSIDNSSVKLGMEGTTKPLTGSSPCTETSVINGTYKGFMKIILQNNDTKMHTYHMSGYAFFVVGMDFGDWFENSRGTYNKWDGIARAITYIYTSQFIRYLTSMVT

SEQ ID NO: 201843 - protein, 139 aa, Glycine max
  Coding DNA Sequence Number=SeqID_85065
  Gene Ontology: Cellular component=nucleus; Biological process =regulation of progression through cell cycle
  Homolog annotation: Hit_ID=Q39880; Match level="QueryCoverage=50%, HitCoverage=16%, E-value=4e-15, Identity=57%"; Hit description =Mitotic cyclin b1-type
MEREKSCYQQETNTILLDSMVARTDKNMGGEGRKRRVRQDIGNLVTKQGHGNGINELSCSTIGQCTSRNIKEQVVIQKPSTEVNNGAVLATDGVDVHRKMFVCMTTWSTNTFDVIKESITGSMAASGSVAVELAEKLKI

SEQ ID NO: 201844 - protein, 105 aa, Glycine max
  Coding DNA Sequence Number=SeqID_85066
AGEEVGKWNSVGVTGTVPERFLSETSKNFSKDWLKRGIELLKELKLKRRLWKQSRERTSEVVVIEEEAFEIEETVENETDHFEAIAFHALPRAEAEAAREGQEVK

SEQ ID NO: 201845 - protein, 117 aa, Glycine max
  Coding DNA Sequence Number=SeqID_85067
MAKRHRVLQIAKRADDHNLSSHVIGHDRLWMTKGRIMTIICLCVPSDTTVSGWRKGVRNNHNLSPHVIEHDRLWMTKGRRMTIICLCVPSDTIVSGWQKVRNDHNLSPHVIRLAAFG

SEQ ID NO: 201846 - protein, 49 aa, Glycine max
  Coding DNA Sequence Number=SeqID_85068
MGVSACHPILTSRGNIFITAGYIRLPPDSWAGVADCLCMDNHWVYPPAT

SEQ ID NO: 201847 - protein, 70 aa, Glycine max
  Coding DNA Sequence Number=SeqID_85069
MAHHLRNDHDSEGSEVRMEEHHLQTSSQACYGGAIVLLVYHARNLVQVNPQHRSYDTYGDGQTFTLKKHV

SEQ ID NO: 201848 - protein, 84 aa, Glycine max
  Coding DNA Sequence Number=SeqID_85070
MIANFKSMLIDMWDIVENGNHIPFDKELKEIPRSITFDNYDHIDKILGSLSRNWRPRVTKLRALKNLDTISLEELVEAIKVHKQ

SEQ ID NO: 201849 - protein, 62 aa, Glycine max
  Coding DNA Sequence Number=SeqID_85071
MANNIISTRDSGELTLAISSIKTRVDHLPDRLLSSFGANIERNPKEECKAVMTRSKMVNMNK

SEQ ID NO: 201850 - protein, 52 aa, Glycine max
  Coding DNA Sequence Number=SeqID_85072
MEKMKYAQGGPLRVKGHFGAVVARPGELKLSAEAMSSPKRAGARPCELVSSP

SEQ ID NO: 201851 - protein, 42 aa, Glycine max
  Coding DNA Sequence Number=SeqID_85073
VYSAKGLSLKPSLLVASSGDITTRQTEPEVIVEDDYSDEEID

SEQ ID NO: 201852 - protein, 465 aa, Glycine max
  Coding DNA Sequence Number=SeqID_85074
  Gene Ontology: Mol. function=structural molecule activity; Cellular component=flagellin-based flagellum; Biological process=ciliary or flagellar motility
  Homolog annotation: Hit_ID=Q8P9C2; Match level="QueryCoverage=90%, HitCoverage=67%, E-value=1e-143, Identity=59%"; Hit description =Flagellar protein
GDGGFEAPGHARRGLQQKSIIGRRGATDHQLDAIDHQRIGGGASAGQCNGGTRVGAGGLPLGSIELEDDVLCLELGQVAVGRAEAAGSGIARVGRNARVADVEEVAPHLAVQVDALVVGLVERFGQADGELAEFGLGRGQHGVAELQHAADLSAHSLGVERDGIALCLQRQLQALGLVRIGHRGDLGRRRAHHQRIATSGVDVHHATVLDNGGAAGVTDQLRDQLVAAIKQVRRSIGDVGADRSVDLRNLLRQAIDFRGAGDESVVDLAAEVVHLRVELHEAARQGLATIEQALPIGRAGRVRRQAADGIEEVGPGAGDIRGRVREQGIHPVGHAGELLQARQLTAAVEQARDGQLVGSAADVGDAGAAANVPKAVVLRIRRGEVDLLPAVAGGVDVGDVVAGGRQCTLEGEQGTGTGGKYAGHGVPQRRVIPSAAVAVLAKGLLVTRAGLQQAHVVGEALGRRT

SEQ ID NO: 201853 - protein, 320 aa, Glycine max
  Coding DNA Sequence Number=SeqID_85075
  Gene Ontology: Mol. function=oxygen transporter activity; Cellular component=flagellin-based flagellum; Biological process=flagellum organization and biogenesis
  Homolog annotation: Hit_ID=Q4UUH2; Match level="QueryCoverage=99%, HitCoverage=71%, E-value=2e-86, Identity=56%"; Hit description =Flagellar protein
LVQLLFERLDLLVQGRRALGDRAGGRVQAALEQLGHRFAQCALCTEQFGGGLGVLGQRRVELGAIKAHAAIGSNGDAQILEIVDVRTQLGAQLLLQAADHGVAGHGRCSARLGVVGAGVLQCRLNAVVGGDEGREVGFQRAVVRSDGQRLRLALLRLGQGEADAGHQIGDGVGAAGAGEAIHHDHSVLGGHHFGHLRRRCAVIGQLGEPAIAATGADLQRALGAGINGGQHQVHAIVGGNHGRGDALALGGGVDLCRDLLECCAGFDVHAYGLVAVPDRQRTVANHGILRIGLGAELLVLRQGFDFHLVTARGGLACRGA

SEQ ID NO: 201854 - protein, 82 aa, Glycine max
  Coding DNA Sequence Number=SeqID_85076
  Gene Ontology: Mol. function=nucleic acid binding; Biological process= DNA integration
MVEELDQFTKNKVWNLAPPPKGPYVIGTKWVFKSQLNDEWEVTTPGFEDKKKPNLVYKLVKALYGFKQAPRVWYERLTSFPT

SEQ ID NO: 201855 - protein, 40 aa, Glycine max
  Coding DNA Sequence Number=SeqID_85077
MNTYIMSERTHKGMPKQAGCLGLKAFHGSGEPDACRCNCL

SEQ ID NO: 201856 - protein, 94 aa, Glycine max
  Coding DNA Sequence Number=SeqID_85078
MSKVLPADALNFLVASKKYIHVKRSRGRRYLWKMTMDNGLPTVVDPWYKYLTKNDLTSDDEVVFYYRFNERAWEVMFRKQVKWDEAGCSLLFDD

SEQ ID NO: 201857 - protein, 282 aa, Glycine max
  Coding DNA Sequence Number=SeqID_85079
  Gene Ontology: Mol. function=nucleic acid binding; Biological process= DNA integration
  Homolog annotation: Hit_ID=Q1S7C5; Match level="QueryCoverage=93%, HitCoverage=47%, E-value=9e-18, Identity=34%"; Hit description =Integrase, catalytic region
FDIDSYSSFSSFLPTAVANSIGYIINPKIPHKYASIEDHNADKVTSEYSVKYEQDQFLLAWLQSTIFGGIVLQVIGFRNELCNLSFDNCSILDHLLHVQMLVNELTLIGETVSNSEHLDLILNGLPDEYESSDSLITSRFDPFTIDEVETLLLACEVCIERSCKKVLGSINLTQAIVLVMVQVVVVVESLMASAPTQTQTWYPDSGGSHHMTNMSQNKQQVTPFEWPNQITIGNVQGLNINSSAKLPLYYWDHAFVSSIYLINRLPSSSIDNGVPYQKLFNK

SEQ ID NO: 201858 - protein, 373 aa, Glycine max
  Coding DNA Sequence Number=SeqID_85080
  Gene Ontology: Mol. function=RNA-directed DNA polymerase activity; Biological process=RNA-dependent DNA replication
  Homolog annotation: Hit_ID=Q1T5Q8; Match level="QueryCoverage=38%, HitCoverage=20%, E-value=6e-35, Identity=50%"; Hit description=RNA -directed DNA polymerase
MVKRERINILCLQETKREQVDKAVCQALWGDADSPSERVGSCIKEGYCNSRLFHLIVNYTRRHNVLKGVLVNGQWTTEPNRVKEEIRLFFKRFQDSEENRPRLDRVRFQAIGQYHNEILVEHFHEKESNDAIVLIANEVVEEANRCNKPCMVFKVNYEKAYDSVSWEILIYMLKRLGFYPKWIAWIQDCLKSASVSILINGSPLADFIPQRGLRQGDPLAPLLFNIVVEGLNGMMREAMERNMLQGFLVGREKVEINILQYADDTIFFGVASMENVRVFKGSSESFGQIDEVAKRNLDEEKRCNSKSLWWRDLSFICQSNEERRWFQGEVLPLWWESLSWIEIVGPLPQNSRQHFLEHSSSRASSIRKKRWLS

SEQ ID NO: 201859 - protein, 155 aa, Glycine max
  Coding DNA Sequence Number=SeqID_85081
RRWPSSKRARKTATGEGSSTTPPVEIDFDGHHFRSEEHQRCFEVIKDWPFLKERRAEIARRHWTQLAELVTKYDPEVVMEFYANAWPTEEGVMDKCSRARIEVGARSVAAAGSRCTIAASIFATILGVHLSPHVEDGTPNAHIHEAFGLSLGNKS

SEQ ID NO: 201860 - protein, 293 aa, Glycine max
  Coding DNA Sequence Number=SeqID_85082
  Gene Ontology: Mol. function=drug transporter activity; Cellular component=integral to membrane; Biological process=drug transport
  Homolog annotation: Hit_ID=UPI00005F8792; Match level="QueryCoverage =89%, HitCoverage=76%, E-value=2e-71, Identity=55%"; Hit description =COG0477: Permeases of the major facilitator superfamily
  Subcellular localization annotation: CTP_CleavageSite=22; ConfidenceScore=5.05e-01
MTIFAAGALIALFAPSLSVLVLGSAEQGLGTGVAGVMARTMPRDLYSGIALRQANSLLNMGILVSPLLAPVIGALLTHLFGWHACFAFLLLLCVGVTAAMARWLPETRPMDAPATPFLRRYITLLSDGNFVRYLLLLIGALAGIAVFEASCGVLMAGVLGLDGLTLPAGGPADVAAGVVWRDDYLDAAGAGRAVLLWRGHAVSAGNFWRDGAVRVAGRQCRCADWGAAESGFRRGGVALSAAAAARSVEPRHANVCDVAGDAAVLVAALASSGERQTDGYRIKGCSAASLRSR

SEQ ID NO: 201861 - protein, 322 aa, Glycine max
  Coding DNA Sequence Number=SeqID_85083
  Homolog annotation: Hit_ID=Q7WLL3; Match level="QueryCoverage=48%, HitCoverage=60%, E-value=3e-70, Identity=78%"; Hit description=UDP-2, 3-diacylglucosamine hydrolase
QLEAGAGRGGGAVPGHDPGHLAFGRHHHRRHDRRHPAQDGHRVLVLPGHAHHAGRGGVRHVQEHGPVDPARPVGHRRGLRGGLPQRHGGGARRAAFRGQSHLSRVRLVPHRLRRHRGRLDLHPLIRRPRWRPGKRKGRVIRGPFSLVGISRAARPAPRRASLGGGFQIVELQAVAVDDQPAAAGRRDVVTVPIGQHPALALAAVDLQHVAGGTVRVSVHHQGHAAVAEGLLDGGGVDVHDFHGLGLVGHLAFATRLLRHRQALGDGLGQERGLPLRVAHHLAELLVGRVVGTELVAVGQQHIAIVGLQQRRLGHQPGADGAG

SEQ ID NO: 201862 - protein, 61 aa, Glycine max
  Coding DNA Sequence Number=SeqID_85084
  Homolog annotation: Hit_ID=Q6D5R9; Match level="QueryCoverage=68%, HitCoverage=22%, E-value=4e-07, Identity=57%"; Hit description =Hypothetical protein aidA
MSEQELKSSNSIVNVIVVIDTDALIEAFENNNPSQDSSNPTGIGHQYAYMVVTSEQVIGGS

SEQ ID NO: 201863 - protein, 132 aa, Glycine max
  Coding DNA Sequence Number=SeqID_85085
  Gene Ontology: Mol. function=RNA-directed DNA polymerase activity; Cellular component=intracellular; Biological process=RNA-dependent DNA replication
MSLKIKEEVKKQFDASFLAVARYPEWVANIVPIPKKDGKVRKSRFALFSFMDGFSRYNQIKIAPEDMEKMTFITLWGTLCYKVMSFGLTNVGATYQWAMVALFHDMMHKEIKVYIDDMIEKSRMEEEHLVNL

SEQ ID NO: 201864 - protein, 274 aa, Glycine max
  Coding DNA Sequence Number=SeqID_85086
  Gene Ontology: Mol. function=RNA-directed DNA polymerase activity; Cellular component=intracellular; Biological process=RNA-dependent DNA replication
MKKKNAKAIPSVCLHIRREGYQTKTLHAYGVCIKATGEKSAEGDRRREEKRTTKKKNPKAIPSVCLHIRREGYQTKIFAALEPPVRAKDPKGKAKVGMEESDKASPILDEEVPAGRFAKEEEDFSKKGISTEEATEFLRIIQQSEFKPHWVLLVKILNEAHVAQDISVEGFGGIINKITANNYLTFVDEEIPIEGRGHNRALHVSAKCLDHIVAKVLIDNDSSLNFMPKAMLDKLPFNAPHLRPSSMVVWAFDGSRQDVRGEIDLPIQIGPHVF

SEQ ID NO: 201865 - protein, 139 aa, Glycine max
  Coding DNA Sequence Number=SeqID_85087
MKEKIKEKEAKEESQQKEEKMLPNPPWKTQSSCCKYIIRNYASYKQRRNEKEQKKRKRQRPNALPYVAGEACLYPCLQHSDKREVSKTSEKDLTKKNAELYNISIMYDNLNLTIPQNLMIGKSPILKEKDLADEARKNL

SEQ ID NO: 201866 - protein, 389 aa, Glycine max
  Coding DNA Sequence Number=SeqID_85088
  Gene Ontology: Mol. function=protein binding; Cellular component =protein complex; Biological process=chromosome segregation
  Homolog annotation: Hit_ID=Q1S6B8; Match level="QueryCoverage=83%, HitCoverage=80%, E-value=1e-111, Identity=69%"; Hit description=Von Willebrand factor, type A; Ubiquitin interacting motif
  Pfam annotation: Domain name=UIM; Domain location=205-222; Score =14.5; E_value=0.31; Accession=PF02809.10; Description=Ubiquitin interaction motif
  Pfam annotation: Domain name=UIM; Domain location=275-292; Score =19.1; E_value=0.016; Accession=PF02809.10; Description=Ubiquitin interaction motif
  Pfam annotation: Domain name=UIM; Domain location=307-324; Score =12.7; E_value=0.54; Accession=PF02809.10; Description=Ubiquitin interaction motif
  Pfam module annotation: Pfam domain module=UIM::UIM::UIM; Domain location=205-222::275-292::307-324
MMLDAVVDCRVKFARPRLKVVHSNFMMPCFGFLKGDKALSFWSFLKVEHHSGVELFNSSLTWLDIGGEMNLAAGIQVAQLALKHRQNKKQQQRIIVFAGSPVKHEKKMLEMIGRKLKKNSVALDIVNFGEEDEGKTEKLEALLAAVNNNDTSHIVHVPSGPNALSDVLISTPIFTGDGEGGSGFAAAAAAAAAGGVSGFEFGVDPNLDPELALALRVSMEEERARQEAAAKKAAEDAAKQEKGGEQQASSQDATMTERASAAMSEAENKTSDLMDDENALLQQALAMSMDDPAISHDVKDTDMSEASASDPDLALALQLSIADSTKDQGSQSDMSKLLADQSFVSSILASLPGVDPNDPSVKDLLASMQNQSEPQQKNDDKPSNEEEKK

SEQ ID NO: 201867 - protein, 62 aa, Glycine max
  Coding DNA Sequence Number=SeqID_85089
MARRRDGIEDECKKNNEGEGTDSRGSSEGKEASMASMVLQHSRREGGVSEWKNNPKNCTHFF

SEQ ID NO: 201868 - protein, 260 aa, Glycine max
  Coding DNA Sequence Number=SeqID_85090
  Gene Ontology: Mol. function=transferase activity, transferring hexosyl groups; Biological process=metabolic process
  Homolog annotation: Hit_ID=Q0WLE1; Match level="QueryCoverage=91%, HitCoverage=95%, E-value=7e-40, Identity=41%"; Hit description =Putative indole-3-acetate beta-glucosyltransferase
MIQQRQSNNVHVVVLHYPVQGHINPLVQFAKRLASKGIKATVATAHYTANSITAPNISVEPISDGFNEAGIAQTNNKVELFLTSFRTNGSRTLSQLIQYGLIELPVNVEDLPLRVPGLPPLDFWALPILLRFPESYPAYMAMKLSQFSDLPKAHWVFVNTFEALEAEWTDQSSNAVFLEQVWEVGVWPKEDEKGIARKQEFVTSLKVAMEGERSQEIRWDANKWKMLAREAFDEGGSSDNHINHFVNHLMNIRDVQKLVQ

SEQ ID NO: 201869 - protein, 140 aa, Glycine max
  Coding DNA Sequence Number=SeqID_85091
  Homolog annotation: Hit_ID=Q1S6B9; Match level="QueryCoverage=85%, HitCoverage=25%, E-value=2e-45, Identity=77%"; Hit description =Senescence-associated
  Pfam annotation: Domain name=Senescence; Domain location=1-124; Score= 10.9; E_value=2.1e-12; Accession=PF06911.3; Description=Senescence -associated protein
  Subcellular localization annotation: CTP_CleavageSite=52; ConfidenceScore=5.31e-01
MTEKVANGFLSGVVKVSGFFTSSVINSKAGKKFFSFLPGEVLLASLDGFSKVCDAVEVAGKNVMSTSSTVTTELVDHRYGEQAAEATSEGFSAAGHALGTAWAAFKIRKALNPKSVLKPTSLAKAGAKAAASEFKAKSSK

SEQ ID NO: 201870 - protein, 1004 aa, Glycine max
  Coding DNA Sequence Number=SeqID_85092
  Gene Ontology: Mol. function=alpha-mannosidase activity; Cellular component=lysosome; Biological process=carbohydrate metabolic process
  Homolog annotation: Hit_ID=Q1S3T6; Match level="QueryCoverage=98%, HitCoverage=98%, E-value=0.0, Identity=78%"; Hit description =Glycosyl hydrolases family 38 C-terminal domain, putative
  Pfam annotation: Domain name=Alpha-mann_mid; Domain location=357-431; Score=104.1; E_value=4e-28; Accession=PF09261.1; Description=Alpha mannosidase, middle domain
  Pfam annotation: Domain name=Glyco_hydro_38; Domain location=41-353; Score=483.6; E_value=2.4e-142; Accession=PF01074.12; Description =Glycosyl hydrolases family 38
  Pfam annotation: Domain name=Glyco_hydro_38C; Domain location=489 -1001; Score=479.6; E_value=3.7e-141; Accession=PF07748.3; Description=Glycosyl hydrolases family 38 C-termi
  Pfam module annotation: Pfam domain module=Alpha-mann_mid::Glyco _hydro_38::Glyco_hydro_38C; Domain location=357-431::41-353::489-1001
MAKKVTIVSHCFSAFLLFYLCGTVVCVKYNTGASVVPGKLNVHLIAHSHDDVGWLKTVDQYYVGSNNSIQGACVENVLDSVVVSLQLNQKRKFVFAEMAFFHRWWVEQTPQTQVQVRKLVDAGQLEFINGGWCMHDEATTHYIDMIDQTTLGHRFIKNQFNKVPRAGWQIDPFGHSAVQAYLLGAELGFDSVHFARIDYQDRAKRKVDKTLEVVWRSSKTFGSSAQIFANAFPVHYSPPSGFHFEINDDFVPVQDDPLLFDYNVEQRVKDFIAAAITQANVTRTNHIMWTMGDDFQYQNAESWFKQMDKLIHYVNKDGRVNALYSTPSIYTDAKNAANQPWPLKTDDYFPYADGPNAYWTGYFTSRPAFKRYVRILSGYYLAARQLEFFAGKKSTVGHTIDLGDALGVAQHHDAVSGTAKQHTTNDYAKRLAIGASRAEAVVSSSLYCLTSKKLGVQCSAPTSAFSQCQLLNISYCPPTEDGIPQAKSLVLVVYNPLGWNRSDIVRIPVNDANLVVKDSLGNNIETQYIEVDNVTANLREFYVKVYVGVSPQQAPKYWLLFQASVPPLGWSTYFISKTAKKGKNRIGFLSYQSSQNKDTIEVGPGNLKLSFSSESGQLIRMHNSKTGVAVPIQQSYLWYSSSQGEGQDSGAYIFRPHTPPNIVSRSVPFKIIRGPLVDEVHQEFSSWIYQVTRVYKDKEHAEIEYTIGPIPIEDGIGKEVITQMTANMVTDKEFYTDSNGRDFLKRVRDHRDDWPLQVHEPVAGNYYPLNLGIYVKDKKSELSVLVDRATGGGSIKDGQVELMLHRRMLFDDGRGVDERLDELVCQNDRCQGLTVRGNYYVGIHKLGAGSHWRRTTGQEVYSPLLLAFAHEDLGNWKAFHVTRGTVIDPNYNLPPNVALITLEVLDNGMVLLRLAHLYEAGEDAQLSTLTKVELKKMFATKMIRGLIEVSLSANQEKEKMKKKTWNVAGDKGQGSKSVRGGPVSHINLVVELGPMEIRSFLLKF

SEQ ID NO: 201871 - protein, 336 aa, Glycine max
  Coding DNA Sequence Number=SeqID_85093
  Gene Ontology: Mol. function=molecular_function; Cellular component =anchored to membrane; Biological process=defense response
  Homolog annotation: Hit_ID=Q1S6B1; Match level="QueryCoverage=90%, HitCoverage=96%, E-value=1e-112, Identity=65%"; Hit description =Thaumatin, pathogenesis-related
  Pfam annotation: Domain name=Thaumatin; Domain location=37-243; Score= 302.5; E_value=8e-88; Accession=PF00314.8; Description=Thaumatin family
MALFSNHRHSSEALLGFLLFLVFRGVSVSGATFTFVNKCDYTVWPGILGTPELGSTGFELAKGGSRSFQAPTGWSGRFWGRTGCQFDGLGKGTCATADCGSGEVNCNGAGASPPATLAEFTLGTGSMDYYDVSLVDGYNLPMMVVARGGSGSCGATGCGEDLNRRCPSELRVEGGDACQSACGAFGKPEYCCNGAFSNPSTCKPSMYSQMFKSTCPKAYSYAYDDATSTFTCSGADYTITFCPSSPSLKSSTDSSPKGIDGGSGSVGGSSVEQSELASTSWLADMATATGASTRTRPLVASKLLGPPLLVTSQLHPYLPSSLSHRHKNKIDSIDTQ

SEQ ID NO: 201872 - protein, 169 aa, Glycine max
  Coding DNA Sequence Number=SeqID_85094
  Gene Ontology: Mol. function=protein dimerization activity
  Homolog annotation: Hit_ID=Q2R1C3; Match level="QueryCoverage=98%, HitCoverage=23%, E-value=5e-27, Identity=35%"; Hit description=HAT family dimerisation domain containing protein
MVISLEWSIYKDNDVAKAKKVKETLLDDIWWNKIDYILSFIAPIYDVLRKTNSDMTCLHLVYAILDSMIKNTKSNITLHCLVHSSNPRYYSHEWLSEDPSRVPPHEDVEFTDERKKCFKIYFDDVDVRRQVDLEFVYFYGRRKGFDDVDSLRDRGELVTKSWWLVHGIH

SEQ ID NO: 201873 - protein, 137 aa, Glycine max
  Coding DNA Sequence Number=SeqID_85095
  Gene Ontology: Mol. function=oxidoreductase activity; Cellular component=mitochondrion; Biological process=fatty acid biosynthetic process
  Homolog annotation: Hit_ID=Q1SQN2; Match level="QueryCoverage=79%, HitCoverage=38%, E-value=3e-30, Identity=51%"; Hit description =Alcohol dehydrogenase superfamily, zinc-containing
  Pfam annotation: Domain name=ADH_N; Domain location=27-91; Score=6.9; E_value=0.00013; Accession=PF08240.2; Description=Alcohol dehydrogenase GroES-like domain
MTRAFSSSAAAVSPPSKAIVYEAHGDEMLAAPINPSDINRIQGVYPVRPDPPAVGGYEGVGEVHSVGSSVTSLSPGTWLTYIVKDEKVWHKIEKGVPMEYAATITVNPLTALLMLEHCVALNSVNMILGKFSHVQQD

SEQ ID NO: 201874 - protein, 63 aa, Glycine max
  Coding DNA Sequence Number=SeqID_85096
  Subcellular localization annotation: CTP_CleavageSite=31; ConfidenceScore=5.47e-01
MSFQLLTKATKRTATKRTAFSYPFSLGFSHRSERASRSSFGIAFDIDGVLLFGTSPAVVLPVH

SEQ ID NO: 201875 - protein, 142 aa, Glycine max
  Coding DNA Sequence Number=SeqID_85097
  Gene Ontology: Mol. function=hydrolase activity; Biological process =metabolic process
  Homolog annotation: Hit_ID=Q1SQN1; Match level="QueryCoverage=57%, HitCoverage=21%, E-value=5e-31, Identity=78%"; Hit description =Peptidase S26A, signal peptidase I; HAD-superfamily hydrolase, subfamily IIA
MPFHIGALNSVDIPNVLPLPKPDCCADLITISLLLWEKGEPAAMMTEYGFKYALSIDEYASCFENIDPLAPYKKWTTKLAATLNAKFNESVPRNDVFSKRVQAAFVVSDPVDWSRDIQVTKFFGLFKCIPQGSKPSALVDVQ

SEQ ID NO: 201876 - protein, 90 aa, Glycine max
  Coding DNA Sequence Number=SeqID_85098
  Subcellular localization annotation: CTP_CleavageSite=55; ConfidenceScore=5.28e-01
MIIVSKIHFHNSHSESFFLFFIPQKFCFDPMDPPRGTQMVQPRRGRIKMMVFKSVAAALSCSGRRKKKDAAPLSSTSTTPVVPSGYTSEA

SEQ ID NO: 201877 - protein, 348 aa, Glycine max
  Coding DNA Sequence Number=SeqID_85099
  Gene Ontology: Mol. function=nucleoside-triphosphatase activity; Cellular component=nucleus; Biological process=response to DNA damage stimulus
  Homolog annotation: Hit_ID=Q9SK02; Match level="QueryCoverage=85%, HitCoverage=82%, E-value=1e-104, Identity=66%"; Hit description=DNA repair protein RAD51 homolog 2
  Pfam annotation: Domain name=Rad51; Domain location=45-290; Score= -45.7; E_value=3.1e-07; Accession=PF08423.2; Description=Rad51
  Pfam annotation: Domain name=RecA; Domain location=51-344; Score= -165.6; E_value=0.059; Accession=PF00154.11; Description=recA bacterial DNA recombination protein
  Pfam module annotation: Pfam domain module=Rad51::RecA; Domain location=45-290::51-344
MANKLINQMGLPKSIVNIFTARNIITAKDALSHTEFELMELLDVGKEEVTSAMAHALLLLEQRVLNESLAGHLSTRLKGLDEALCGGIPFGVLTELVGPAGIGKTQFCLKLSLLASLPTNCGGLDGRVIYIDVESKFRSKRLIEIGINSFPEIFLKKGMAQEMAGRILILHPTSLSEFAERLCMCLSLHQIRVSLLQQQVKLLIIDSMAALVLGEHDSEASRQQALGWHASRSLAEFSRIPVVLTNQVRSQIGDESRMYSFQAQSHSIIKDNPATYDSHLVAALGINWAHAVTIRLIPPGLKLLEWVGIWVEVVSSSHRMIGMTSKTPKTHYLITNSVVLGVSTSLFV

SEQ ID NO: 201878 - protein, 280 aa, Glycine max
  Coding DNA Sequence Number=SeqID_85100
MVTGTKEHLVSQSRVLPLPIMARIMAMDEVSRWRKATSLDWMKFVVDTKGLWLGHPLQFVEADLGHTQRVRRRRGGNGTFIFIICNKKIKSWPAPVTENPFLITLVRSADPLETGRAKTEEARSDVVCPGVSPLAASPMPPPGLGGLGLPAKDCWRFGGSGVDGKSSKMIKDGIHLAVHCGLGLSEGGMVQRKGGLVLAWCWVESGAELSTTAGAPSHIILQVCWPVMVAGWSGWIKKEGEILEGGKWESESVEDEFRMGMGWWDEIKSEMKQDKLKKDG

SEQ ID NO: 201879 - protein, 98 aa, Glycine max
  Coding DNA Sequence Number=SeqID_85101
MVEFSPTRGICGRCLIRIRLDYHEELRSPIGNLVPLDLEIEATLRRNKAERRRKLLRDKIVASILEEETHFSDSLSPDSPSSRESATQLPEAITMADE

SEQ ID NO: 201880 - protein, 140 aa, Glycine max
  Coding DNA Sequence Number=SeqID_85102
MTRRLLAGSLVIESRILHYLIVCILVPRSSNLAQRSFLIGVVVIASFGYRKEHDGSWVKKGAQPIDEEGHLHGGEDSSLLQKILDRFDGLQTFVGERFDTLELQVDMRFNEMESRITKVEEDVSYICTSFDLPPPPPPSS

SEQ ID NO: 201881 - protein, 115 aa, Glycine max
  Coding DNA Sequence Number=SeqID_85103
MASPFRQALGGTWTGMLANHAISRLIGCWLGCASPIWHCICQGSLQSPKFPKEFFQVCHMLGYALRHDNHVVHIYLNVSSDLLFKDSVVAPGTQRLHRLAYRCWAEGMHLWGMPC

SEQ ID NO: 201882 - protein, 92 aa, Glycine max
  Coding DNA Sequence Number=SeqID_85104
  Subcellular localization annotation: CTP_CleavageSite=51; ConfidenceScore=5.05e-01
MVLPKPSVGLKGKPHQHALTHHAFLYFNKQKLGPPRPKSCFGIYPNSRKLSASKKWILGCLLAAPPACPELGMGRRSIDHGPSLYSRPSLST

SEQ ID NO: 201883 - protein, 124 aa, Glycine max
  Coding DNA Sequence Number=SeqID_85105
  Gene Ontology: Mol. function=RNA-directed DNA polymerase activity; Biological process=RNA-dependent DNA replication
MNYPIKHNFQSSTSSTNLAGNKKTTPDWWNLYVDGASNVKGSGAGIILECLDNVTLELALKLNFKASNNQTKRKLLCTKMVRAGYYWLTLEADALDFTKRCRRCQEFADIPRTPPDNLHNLISP

SEQ ID NO: 201884 - protein, 691 aa, Glycine max
  Coding DNA Sequence Number=SeqID_85106
  Subcellular localization annotation: CTP_CleavageSite=50; ConfidenceScore=5.21e-01
MSSFLSDSAIGMGGSDSGAFPNYCDPFPFCFWGVRRGSSGGDIKASPHMRRSHSVGSLSSPPVVIGYEWVRDDVLKYKSSLTSATSVTALQCQVKLASPEDSWKIVIQACDSDDFPFLRVALGSPPFFFMYKCLFEDHCFKVLDAGVVADGLPLMLNKDGESCFPFYCPLVKQARLANGTMPPSTAAPTEGSQPVVKVGPIVVGIVEIAPTAPSSVLVKRKRDDGVGLSGRKKPRDPSCPKASYKVDTRCGSPFKCARCASDSTNLQGSCEHANCFGWFCCGSLVSHRCTTPLLSVDVATISALMVPPSSSSAPMILPSTALALTSTSSRSYVSLDHIYISNDVDSLSAEFQHATNFAKAKVGKWRATACTIWRVERPKVASATAAFAEAMRLNHQLSSKVGSALAKLLCTKLDSDELSNCYKDLQEEKKNLAKKVDSMAIKKDELAKAAREGKANKELEEELLVYKKEIMEQHEKGFNEAFRQAGFFAEELDLGLFDPFKDVKDGVLLNVEEIVAEEEVAAIMMISVESLTTHEVRPSQNRGKIVVVKGLVTHLVELPSASRSFSLDVFEELNGVLLRTCHSLWVACTRGLMACCHHEWAIPIETKLSRLGIFSGFTLNSSYKVTSLLVDGSPTSTGIMAFMSYTLRLVESSAQGPKDDFVGCLCLTVDLRMFNKVTMAYGRSNLQMRYF

SEQ ID NO: 201885 - protein, 159 aa, Glycine max
  Coding DNA Sequence Number=SeqID_85107
MMITKDDDKGDDKKLKGQSKDEFKMFKKKSRTIQDSRGKVEEHFKIQEETNIPLGWKPLNLERYDGNIDLDENLDAFLTQANLYTNDDVILCHAIPTSLKGASLTWYGGFPPRSIDIFDTLIERLNAQYATSRSHRMTSASLASLRQADNESLRKFMEI

SEQ ID NO: 201886 - protein, 84 aa, Glycine max
  Coding DNA Sequence Number=SeqID_85108
MERNVELAPWMYDEFYGKLHRRYWHKRLTRLIEKKIDVALVKEFYSNVYDSEDGSPKKCIVRRRTIRFNAQTLNEFPGDACHNC

SEQ ID NO: 201887 - protein, 304 aa, Glycine max
  Coding DNA Sequence Number=SeqID_85109
  Gene Ontology: Mol. function=protein serine/threonine kinase activity; Cellular component=anchored to membrane; Biological process=protein amino acid phosphorylation
  Homolog annotation: Hit_ID=Q1S6A8; Match level="QueryCoverage=96%, HitCoverage=99%, E-value=1e-122, Identity=72%"; Hit description =Thaumatin, pathogenesis-related
  Pfam annotation: Domain name=Thaumatin; Domain location=32-247; Score= 288.1; E_value=1.6e-83; Accession=PF00314.8; Description=Thaumatin family
  Subcellular localization annotation: CTP_CleavageSite=43; ConfidenceScore=5.43e-01
MASSTQFSTTLVTLCLFQFLAGSYSTTFTIVNKCSYTVWPGILSGAGTSPLPTTGFVLQPGESNVIAVPAAWSGRLWGRTFCTQDATGKFSCVTGDCGSSAVECNGGGAAPPATLAEFTLNGAGGLDFFDVSLVDGYNLPMIVEPQGGTGAGNCTATGCVVDLNTPCPAELMVMSSGEGVACKSACEAFDDPQYCCSGAYATPDTCKPSSYSQFFKSACPRAYSYAYDDGSSTFTCATADYTITFCPQPSTSSIKSGNGKYPMAVDNSGANVDVRTNNVMAVIASVLVAFVATQLGVPSLPKLH

SEQ ID NO: 201888 - protein, 115 aa, Glycine max
  Coding DNA Sequence Number=SeqID_85110
  Gene Ontology: Mol. function=ferredoxin-NADP+ reductase activity; Cellular component=thylakoid membrane; Biological process=electron transport
  Homolog annotation: Hit_ID=Q0WWE2; Match level="QueryCoverage=68%, HitCoverage=22%, E-value=2e-35, Identity=91%"; Hit description =Ferredoxin-NADP+ reductase
  Pfam annotation: Domain name=NAD_binding_1; Domain location=16-100; Score=26.9; E_value=5.1e-06; Accession=PF00175.11; Description =Oxidoreductase NAD-binding domain
MWNVARHDFRSLDDCGILEISNLSLDEPELEEFEKMKDKVPDNFMLDFAVSREQTNEKGEKMYIQTRMAQYAEELWELLKKDNTFVYMCGLKGMEKVINDIMVLLAAKDGNNTYL

SEQ ID NO: 201889 - protein, 1364 aa, Glycine max
  Coding DNA Sequence Number=SeqID_85111
  Gene Ontology: Mol. function=RNA-directed DNA polymerase activity; Cellular component=chromatin; Biological process=chromatin assembly or disassembly
  Pfam annotation: Domain name=Chromo; Domain location=1291-1340; Score= 27.6; E_value=4.3e-05; Accession=PF00385.14; Description='chromo' (CHRromatin Organisation MOdifier
  Pfam annotation: Domain name=RVP_2; Domain location=311-430; Score= -36.6; E_value=0.00071; Accession=PF08284.2; Description=Retroviral aspartyl protease
  Pfam annotation: Domain name=rve; Domain location=1041-1192; Score= -4.2; E_value=0.013; Accession=PF00665.16; Description=Integrase core domain
  Pfam annotation: Domain name=zf-H2C2; Domain location=982-1023; Score= 8.1; E_value=0.03; Accession=PF09337.1; Description=His(2)-Cys(2) zinc finger
  Pfam module annotation: Pfam domain module=Chromo::RVP_2::RVT _1::Retrotrans_gag::rve::zf-H2C2; Domain location=1291-1340::311 -430::552-729::98-188::1041-1192::982-1023
MADHTRSQTLSRLEEAITLLTQNQHTLTSTQTSLHTRLDDITSRLQALETPSPTHSRPHPPRMNLDVPRFDGSNAPAWIFKINQFFDYHRTPEDERLQVASFYLEGTALSWYQWMYRNYQLPSWPAFLQALELRFAPSLYDDPRGALFKLCQHGSVSAYLAEFESLVNRIVGLPTPFLLICFISRLSPDIRREVLALQPLSLVQAAALAKLQEDKLSDARRNYPPPKTTYKRLTQAEMASRRERGLCYNCNERYGPNHRCKAKFFLIVATEDEDPIPFDHSIPLSPDPPQTPPSPTDHPPAQLSLHALSGQPASATLRVSAAIKGHGVVVLVDSGSTHNFVHDRLAHFLHLAFEPVPPLTVMVGNGTEITCTHVCRGVTILIQGHPFTLDLHVMALGGTDIVLGISWLQHLGPITTDYSHLTMSFVHHGKPITIHGSKNPGPAEINHGQMRRLLSTQRVAALFHIQVHEHSPVTPNTPIPPPIRRLLDHYSTLFLTPQLLPPPRPTDHNIHLEPNAKPVNVRPYRYPYFQKQEIERQVEDLLRREFIRPSRSPYSSPVLLVRKKDGSWRFCVDYRALNDLTIKDRFPLPTIDELLDELGQSSWFSKLDLAQGFHQIRMVDADVPKTAFRTHQGHYEYVVMPFGLCNAPSTFQATMNDLFRPFIRKFVLVFFDDILVYSRDSMLIWNTSNASSKLCDRGVEPDLAKIQAMQDWPLPSSPKQLRGFLGLTGFYRRFVKNYAQIATPLTNLLRKDQYEWSPAAQSAFEHLKLAMATTPVLALPDFSIPFVIETDASGTGMGAVLMQRGHPIAYFSKQFCPKLLRSSTYIRELHAITSAVKRWRQYLLEHSFVILTDHKSLRELMTQLVQTPEQHVYLAKLLGYNYTIQYKAGHHNVVADALSRTTESDSPATHFSIISFPHAQFLDDLKRELANSDEFQALCERTGQDNNPNPDFTLRDNLLLFQGRVWLNRGNAFIPLLLEEFHKSPLGGHMGLAKTLSRLKQNFFWEGMRSDTKDFISRCTDCLQTKYTPQKPAGLLHPIPPPTRPWEDLALDFITGLPNSQGATVIMTVVDRFSKGAHFGSLPSHFTAYTAAQLFIDMVCKLHGFPWSLISDRDPIFVNRGAQSDPRAISAKLRSSETISMGQVTFGKPPPGILDYLPGSSSVEAVDFVLSSRQELFELLRRKLQRSQEKMKQTADTHRRDVHFKVGDWVYVKLRPYRQTSLSAKYQKLGKRFYGPYQITDTVGSVAYRLALPPTAKLHPVFHCSKLKPHRGPILAEQSLPPVTWEDNPVITPLAVLNHKWDDQDPPQLSVLVQWNGLPPEDSTWENWTELKRLYHLEDKVFLEGMGIDSIPAPRTRRTAKRPP

SEQ ID NO: 201890 - protein, 90 aa, Glycine max
  Coding DNA Sequence Number=SeqID_85112
MGLPVRGKSLVAKEVKGIRESRNKEELFLSSPSKRTKDFLVIVGEGVHEKMIEMGVKAKEGITTCRGWILRCSTITKVKATYKRIRFINL

SEQ ID NO: 201891 - protein, 41 aa, Glycine max
  Coding DNA Sequence Number=SeqID_85113
MPKLIELRTLVLGPYIECGSAQAIRMTLRCFVILGSVMERV

SEQ ID NO: 201892 - protein, 92 aa, Glycine max
  Coding DNA Sequence Number=SeqID_85114
  Gene Ontology: Mol. function=nucleoside-triphosphatase activity; Cellular component=mitochondrion; Biological process=ATP-dependent proteolysis
  Homolog annotation: Hit_ID=Q1S0N5; Match level="QueryCoverage=75%, HitCoverage=8%, E-value=1e-26, Identity=70%"; Hit description =Peptidase S16, lon protease
GHAGDPASALLELLDPEQNANFLDHYLDVTIDLSKVVAIAGYITDEKMHIARDYLEKTIREACGIKPGQVFIFATCFAVHSPAENGIFKVLT

SEQ ID NO: 201893 - protein, 76 aa, Glycine max
  Coding DNA Sequence Number=SeqID_85115
  Gene Ontology: Mol. function=structural constituent of ribosome; Cellular component=ribonucleoprotein complex; Biological process =translation
  Homolog annotation: Hit_ID=Q42351; Match level="QueryCoverage=54%, HitCoverage=35%, E-value=6e-14, Identity=90%"; Hit description=60S ribosomal protein L34-1
  Pfam annotation: Domain name=Ribosomal_L34e; Domain location=1-59; Score=36.2; E_value=2.8e-08; Accession=PF01199.8; Description =Ribosomal protein L34e
MAINAWQLQIPHLRPTEYKRLRLPRNRRTVNRAYGGVLSGSVVRERIIRAFLVEEKKIVKKVLKIQKAKEKQALKG

SEQ ID NO: 201894 - protein, 308 aa, Glycine max
  Coding DNA Sequence Number=SeqID_85116
  Gene Ontology: Mol. function=protein serine/threonine kinase activity; Cellular component=anchored to membrane; Biological process=protein amino acid phosphorylation
  Homolog annotation: Hit_ID=Q1SLH3; Match level="QueryCoverage=71%, HitCoverage=96%, E-value=9e-72, Identity=55%"; Hit description =Thaumatin, pathogenesis-related
  Pfam annotation: Domain name=Thaumatin; Domain location=48-234; Score= 147.1; E_value=4.6e-41; Accession=PF00314.8; Description=Thaumatin family
  Subcellular localization annotation: CTP_CleavageSite=59; ConfidenceScore=5.68e-01
MAFVVTMATTCNVRMGNSTKMASIVTMASLFFFQFLSGSCSTRLTITNKCSYTVWPAILSATGSSPLSTSGFVLQPGDFKIVPVPPAWSGRLWGRTLCSLDITSTKFSCVTGDCGSTTIECVGGNATPPVTLVKFTLNGTGGLDFYEVSLVDGFNLPVRVEPRGGRNRRATGCEMDLNLSCPTELKVIRDGDAVACKSSCQAEPCLTSQFFKTACPGAHVHTCSSHDYTITFCPPPTPSSSYQEISRGSGGGQPGSSPINVVVAVVVALASVCGLFIACKITIRLSNGDCVFGIGAGTRTGTIQDVTV

SEQ ID NO: 201895 - protein, 284 aa, Glycine max
  Coding DNA Sequence Number=SeqID_85117
MPFPDPRIEPLLVQSGFSNVTKLGQVKIGGALVATLVERCYSLRECTGGSTLKLKWLKEHMLTLLAEPTPQKLAGHCKAYILGLIGGVLMPDKSGNKVHLMYLPLLIDFDQFHWIPYRGFDLFLPENAYKDFKIWSAYIALICFLVVVWHQTDRIMLQFGLYKNIPDPLHNLDKVHHIDMRGHSDTIGQRNINGGLQFGLYKNIPDPLHNLNKVHHIDMRGHSDTIGQRNINGGLQFGLYKNIPDPLHNLDKVHHTDMRGHSDTIGQRNINRGLQFERKYTNIC

SEQ ID NO: 201896 - protein, 35 aa, Glycine max
  Coding DNA Sequence Number=SeqID_85118
MDNNPWEFLDIDDSDLSSFVRPTNQSSSSSTRLIP

SEQ ID NO: 201897 - protein, 655 aa, Glycine max
  Coding DNA Sequence Number=SeqID_85119
  Gene Ontology: Mol. function=binding
  Homolog annotation: Hit_ID=Q1SPQ2; Match level="QueryCoverage=99%, HitCoverage=99%, E-value=0.0, Identity=71%"; Hit description=IMP dehydrogenase/GMP reductase
  Pfam annotation: Domain name=Arm; Domain location=176-216; Score =28.1; E_value=3.1e-05; Accession=PF00514.13; Description =Armadillobeta-catenin-like repeat
  Pfam annotation: Domain name=Arm; Domain location=217-257; Score =27.7; E_value=4.2e-05; Accession=PF00514.13; Description =Armadillobeta-catenin-like repeat
  Pfam annotation: Domain name=Arm; Domain location=419-459; Score=4.7; E_value=3.2; Accession=PF00514.13; Description=Armadillobeta-catenin -like repeat
  Pfam annotation: Domain name=Arm; Domain location=475-510; Score=7.1; E_value=1.6; Accession=PF00514.13; Description=Armadillobeta-catenin -like repeat
  Pfam annotation: Domain name=Arm; Domain location=553-594; Score =23.7; E_value=0.00066; Accession=PF00514.13; Description =Armadillobeta-catenin-like repeat
  Pfam module annotation: Pfam domain module=Arm::Arm::Arm::Arm::Arm; Domain location=176-216::217-257::419-459::475-510::553-594
MGDIVKQILAKPIQLADQVTKAADEASSFKQECGDLKSKTEKLAALLRQAARASSELYERPTRRIIDETEQVLDKALALVLRCRGNALMKRVFTLNPGAAFRKVSLLLENSTGDVSWLLRVSAGDGGGDYIGGLPPIAANDPILCLIWEQIAVLHTGSAEDRSDAAAQLVSLASSSDRYGKLIIEEGGVGPLLKLLKEGKPEGQEHAARAIGVLGRDPESVEHVIHVGACSVFAKILKEGPMKVQAVVAWAVSELAANYPKCQDLFAQHNIIRLLVGHLAFETVEEHSKYTIVSTKPTSIHALVIASTNNVKMEDPFLDNQNKARMPHPLGERPRNLHRVITSTIAMHAATKHGNESNPKTNGVGNDAKQGNQDQNQNHQPNYSHSGINMKGRDHEDPKTKANMKEMAARALWQLAKGNSPICRSITESRALLCFAVLLEKGTEAVQYNSAMAVMEITAVAEKDAELRKSAFKPNSPACKAVVDQVVKIIEKADSELLIPCIKTIGNLARTFKATETRMIGPLVKLLDEREAEVSREASIALTKFACTENYLHVDHSKAIIIAGGAKHLIQLVYFGGEEMVQIPALVLLSYIAMHVPDSEELAQAEVLGVIEWASKQSSIANDQAIEALLLESKTKLDLYQSRGPRGFHKLHLHQ

SEQ ID NO: 201898 - protein, 778 aa, Glycine max
  Coding DNA Sequence Number=SeqID_85120
  Gene Ontology: Mol. function=DNA binding; Cellular component=beta -galactosidase complex; Biological process=DNA integration
  Homolog annotation: Hit_ID=Q1SS72; Match level="QueryCoverage=84%, HitCoverage=48%, E-value=1e-176, Identity=47%"; Hit description =Integrase, catalytic region
MPSRLLVNSADELVTPKAFVTRNMVYPQAMKEEAKPTTETGKRKHDYPPGYKFGNSKVVNNIVEGKVTSDQMQRQESHDLEAQSLPNPRLRPYLRAPLTPHQDTNTKAKIGTVELYTRPCDISNLQVFGCLCYISTLKSHRQKLDHRAHPCIFIGFKPNTKGYLVYDLHSHSITTSRNIVFYEDHFPLFPDSPESSTPPTSISPLPFSNNPDSFEHPIPPNDNPSSSHIPSPSLRRSMRLKKAPTYLQDYHHALTSQVDTNTRGVRYPLQSVLSYSRLSPSHRHFVMSISVNTEPKSYDDASQFDCWIKAMQAKYKLFNRIKHGPLHHYHHTRQLSDVDGYIRSNIKQKLTTVRLLLALAALHNWHLRQLDVNNAFLHGDLDEEVYMTLPQGLHVHDHNLVCRLQRSLYGLKQASRQWFTRLSSFLISHGFRQSAADHSLFLHFNNSDTIAVLVYVDDIIIAGNNLDTITHITNLLDQTFSIKDLGTLKFFLGLEVARNNQGIHLSQRKYVLDILFDSGMLASRPASTPMDYSTRLTASMGTPLSETSSSSYCRLIGRLIYLTNTRPDITHAVQQLSQYMAHPTSAHSQATFRVLRYLKGSPGSGIFLAANGPLQLKAFSDSDWAGCRDTRRSITGFSVYLGSSLFSWRSKKQPTVSRSSSEAEYRALASTTCELQWLTYLLKDFRVSFLQLATLYCDNKSTIQIACNPVFHERTKHIEIDCHIVRDKVNQGSLKLLPISSQLQLADIFTKPLLPSLFQGLCSNLGMMNIHSQLEGGS

SEQ ID NO: 201899 - protein, 224 aa, Glycine max
  Coding DNA Sequence Number=SeqID_85121
DKLKFGKSLTSYRLLESQIASEAEAATVAALSRLKWHSDDEDDDDAKHEANTVQEVKKAKQKKPKKPKVTVAEAASRINVDDLEAFLAEIILSASYESQQDIILMRFADYFSRTFSSGIYKISTDWINHRSYEALGSFVLWSLDNILADLASHQGVKKAIQQSSLKSLRWTSLSNNMRMGYYFMCPMRQYENALGFKDGKDMPSRLRGKSLDVGCASLDKSIAV

SEQ ID NO: 201900 - protein, 124 aa, Glycine max
  Coding DNA Sequence Number=SeqID_85122
  Homolog annotation: Hit_ID=Q2QXR8; Match level="QueryCoverage=41%, HitCoverage=9%, E-value=2e-12, Identity=65%"; Hit description =Pyruvate kinase family protein, expressed
MLDTVGPELQVVNKTEHPISLQADTLVVLTPDQNKEATSNLLPVNFSGLSKSHASCLAAHLDLFFICLLVYLGVSSILYHVRGNLVTWRSKKQIVVARSIAEAEFRALANGIYEGFCCNGCSRN

SEQ ID NO: 201901 - protein, 598 aa, Glycine max
  Coding DNA Sequence Number=SeqID_85123
  Gene Ontology: Mol. function=protein serine/threonine kinase activity; Cellular component=flagellin-based flagellum; Biological process=protein amino acid phosphorylation
  Homolog annotation: Hit_ID=Q5D875; Match level="QueryCoverage=92%, HitCoverage=92%, E-value=0.0, Identity=83%"; Hit description=Calcium- dependent protein kinase CDPK1444
  Pfam annotation: Domain name=Pkinase; Domain location=100-396; Score =289.1; E_value=8.3e-84; Accession=PF00069.15; Description=Protein kinase domain
  Pfam annotation: Domain name=Pkinase_Tyr; Domain location=100-394; Score=-37.1; E_value=3.4e-10; Accession=PF07714.7; Description =Protein tyrosine kinase
  Pfam annotation: Domain name=efhand; Domain location=443-471; Score =31.1; E_value=4e-06; Accession=PF00036.22; Description=EF hand
  Pfam annotation: Domain name=efhand; Domain location=480-508; Score =18.9; E_value=0.019; Accession=PF00036.22; Description=EF hand
  Pfam annotation: Domain name=efhand; Domain location=522-550; Score =23.6; E_value=0.00071; Accession=PF00036.22; Description=EF hand
  Pfam annotation: Domain name=efhand; Domain location=552-580; Score =25.2; E_value=0.00023; Accession=PF00036.22; Description=EF hand
  Pfam module annotation: Pfam domain module=Pkinase::Pkinase _Tyr::efhand::efhand::efhand::efhand; Domain location=100-396::100 -394::443-471::480-508::522-550::552-580
  Subcellular localization annotation: CTP_CleavageSite=32; ConfidenceScore=5.76e-01
MGLCFSSTKVSGSSSNNNNNNNASSNRNRKCSAAPAAAAPPEPVTPQKKQPSQAQRRRVPEESRKNPRAKDKAGARRQGTRVPCGKRTDFGYEKDFENRFSLGKLLGHGQFGYTYVGIDKKNGDRVAVKRLEKSKKIVPVVDNSVLHFTLALTIMSWHPPGKMVLPIAVEDVKREVKILKELTGHENVVQFFNAFEDDSYVYIVMELCEGGELLDRILAKTYSAFTFIRKDSRYTEKDAAVVVRQMLKVAAECHLHGLVHRDMKPENFLFKSTKEDSPLKATDFGLSDFIKPGKRFQDIVGSAYYVAPEVLKRKSGPESDVWSIGVITYILLCGRRPFWDKTEDGIFKEVLRNKPDFRRKPWPTISNAAKDFMKKLLVKDPRARYTAAQALSHPWVREGGEALEIPIDISVLNNMRQFVKYSRLKQFALRALASTLNEGELSDLKDQFDAIDVDKNGSISLEEMRQALAKDQPWKLKESRVLEILQAIDSNTDGLVDFTEFVAATLHVHQLEEHDSDKWQQRSQAAFEKFDLDKDGYITPDELRMHTGLRGSIDPLLEEADIDKDGKISLPEFRRLLRTASMGSRTVMSPSHRHHRKI

SEQ ID NO: 201902 - protein, 275 aa, Glycine max
  Coding DNA Sequence Number=SeqID_85124
  Gene Ontology: Mol. function=nucleic acid binding; Biological process= metabolic process
MSGCSTTHDNNNVFPQSVATKIHQHVTNLSHQYHREDDFHGSHDDSDEDNGGQTQQPLWGSSPHFSNVNWDYADQEMDVPGLDIPGSWKIGSMIENDPSVSISIIQEHISSQKHFKILYRKAWKAKQIALVRVYGDWEESYDLLHRWLEWMFKKSPNSIYEIETTEFWYGGAFYTQFQQFKHVFWTFKHVVNTFNLCKPINQIDGTFLYRKCEGTLLIATSQDGNGCVLPINFAIVEKETQSDWLWFLSNIQQHVTQQQDICLIQMNIKASNQLL

SEQ ID NO: 201903 - protein, 171 aa, Glycine max
  Coding DNA Sequence Number=SeqID_85125
  Homolog annotation: Hit_ID=UPI000034EE59; Match level="QueryCoverage =81%, HitCoverage=16%, E-value=2e-34, Identity=53%"; Hit description =transcription factor
  Pfam annotation: Domain name=C2; Domain location=6-94; Score=21.0; E _value=0.0034; Accession=PF00168.20; Description=C2 domain
MGIIWVEVCLISAHGLQLSTSLWKRQWFAVGWIDHNNKYCTKVVNSGNANPVWRTKFVIPVDDSVSNIQDLALNVEVYSIDPVFFTEKLLGSATVFLREFLVKRVKNSEVSKPRQEEVGRYQLRKKKSSKPRGFIDILIHIFDKKKAKFPPRGTLKYRYRGQIFGSMADLM

SEQ ID NO: 201904 - protein, 138 aa, Glycine max
  Coding DNA Sequence Number=SeqID_85126
MVTIMRVAAQTQTQLQLKKHMIEGFGSKYMELKWKLSSKPPFPIYISTNPRHVDPHHLRDLFADCNHSTHRFPTRLEPMDIRKLCIALSHSVVLVSVFCNPQHVNGVFLQNSSSSSIADIFMPVSPTNLQGKESSCIV

SEQ ID NO: 201905 - protein, 291 aa, Glycine max
  Coding DNA Sequence Number=SeqID_85127
  Gene Ontology: Mol. function=ATP-dependent helicase activity
  Homolog annotation: Hit_ID=Q8RWX0; Match level="QueryCoverage=27%, HitCoverage=15%, E-value=1e-15, Identity=48%"; Hit description =Putative ATP-dependent RNA helicase
  Subcellular localization annotation: CTP_CleavageSite=35; ConfidenceScore=5.27e-01
MAKGEDALIRKKNKKLRKKNSSGSSSVSAKVAAVIAAKKRRKAGKRRMCQGMCFSLPTLDDPFNDRGGKEETKTKGPKKKSHSKPKDKMDHLNGKSADGKKGAVGGRKIARELNDLQRENESVTASNNLTHKCIINSERKNIDMTEMAHLCGTKQRDCDISEFPSKFIFWCLSSIENALRHGDAYTDGEGNSFFLNPWGLEFLKCYSTGKDLIETSGTSATAEQIAWMVSGAADTFVRKEKEGLSFPGPFLLFLVPSQEKSTQRNWLERVREVLWCAVTRTSAIRGSVIET

SEQ ID NO: 201906 - protein, 365 aa, Glycine max
  Coding DNA Sequence Number=SeqID_85128
  Gene Ontology: Mol. function=oxidoreductase activity; Cellular component=proton-transporting two-sector ATPase complex; Biological process=flavonoid biosynthetic process
  Homolog annotation: Hit_ID=Q2QCX5; Match level="QueryCoverage=99%, HitCoverage=100%, E-value=1e-171, Identity=78%"; Hit description =Gibberellin 20-oxidase 1
  Pfam annotation: Domain name=2OG-FeII_Oxy; Domain location=194-295; Score=138.5; E_value=1.8e-38; Accession=PF03171.10; Description=2OG -Fe(II) oxygenase superfamily
MAPAKTLNSLVEEKSIESRFVRDEDERPKVAYNEFSNDIPVISLAGLEEEDGRRGEICKKIVEAFEEWGIFQIVDHGVDTKLVSEMTRLAKQFFALPPEEKLRFDMTGGKKGGFLVSSHLQGEAVQDWREIVIYFSQPMKSRDYTRWPEKPEGWRKVTEEYSDNLMALACKLLEVLSEAMGLDKEAVRKASVDMDQKIVVNFYPKCPQPELTLGVKRHTDPGTITLLLQDLVGGLQATRDNGNTWITVQPIEGAFVVNLGDHGHYLSNGRFKNADHQAVVNSSCSRVSIATFQNPAQEAIVYPLKVEEGGKPVLEEPISFAEMYRRKMNKDLEIARLKKLAREKKQLQDLDKVKLESKPLDEILA

SEQ ID NO: 201907 - protein, 212 aa, Glycine max
  Coding DNA Sequence Number=SeqID_85129
  Homolog annotation: Hit_ID=Q1S7C5; Match level="QueryCoverage=35%, HitCoverage=5%, E-value=6e-09, Identity=55%"; Hit description =Integrase, catalytic region
  Subcellular localization annotation: CTP_CleavageSite=20; ConfidenceScore=5.53e-01
MLMLFSKVYLPITTRLSKKLASETASLNLTGTSSSGLQQQSSSSSQAHAASEPVNSNYNSYSSFRGSGRGHGGRNSHGGSRGRGDRFPNFSHPNSATPWVIMPRQLQFPRQNQRYQPQQQAQNPPSAMITNAGILGACPTTSSTWFPDSGASYHVTADQNNIRQLSSLKVQTKFSLVMDKKFCFEAQWVLMACTSFQASCILSLSSIFQQIV

SEQ ID NO: 201908 - protein, 343 aa, Glycine max
  Coding DNA Sequence Number=SeqID_85130
  Gene Ontology: Mol. function=sugar porter activity; Cellular component=nucleus
  Homolog annotation: Hit_ID=Q1SNI6; Match level="QueryCoverage=98%, HitCoverage=98%, E-value=3e-63, Identity=48%"; Hit description=Sugar transporter superfamily
METPSSTRRVTRSQALSASNDALITVSRKIEDSEKNASKSKSRVQQQDQSALIDITNDSPIVGLANGVILGTPLAKQRGSRIKNTPGSGEALLRGQVKTLLLKVEEEIELSKFSLESTELVAPMPVNTPQIQNLSGLASVTTPSVVLQQPLIPQVVNHVFDGSESEKSVISRSLLFDFSEKSQLSNASEECFSELSYEEVVQAEREIRSCFIEDDDASMSSIWSMQVNASTHDEDDEEIAEDEEGCYSENVEEEKEENDGGLLLDELCEGLNNISMNERIAPKFEGKHTRFAYNSDDEIVKEEVEENFGESDSSSNILRLKGLPTPKGKHLRFYEEEEGKSVL

SEQ ID NO: 201909 - protein, 266 aa, Glycine max
  Coding DNA Sequence Number=SeqID_85131
GHRDTTILKAYEESYTSFKEMYFWVRHFKDCWDDLFVVDKNEAFIGKSKDKPLLVATPYAATENDKKTLNKSELSDKGNSFTMETHFKSNHDMPPLPLKRQRVINFDDDVELIGSILVYVKKFVAPFMWMSSGVSNSCYSRVQKLLELKQSLGNVNPLNLIKEKDFALKKTQGQVEEEVNQLKEKLVDVETARDQWAPGTVNENFVGQETTNVDTPDDTMTNGFINTLKANIDDRDTKASKLMQISKNLEGWYVGLACIGTSLAAC

SEQ ID NO: 201910 - protein, 50 aa, Glycine max
  Coding DNA Sequence Number=SeqID_85132
MEAADMSCLQETKKEMIDNAMCQALWGDVEVSWEIQPATNTAGNGSEKHS

SEQ ID NO: 201911 - protein, 71 aa, Glycine max
  Coding DNA Sequence Number=SeqID_85133
MFSWYYVPRHYYSIAFCCCRYYIPRHYYVLLHWSEIVPLEEVFQTLRCDSNGLTIASAESISESEMWNPVS

SEQ ID NO: 201912 - protein, 453 aa, Glycine max
  Coding DNA Sequence Number=SeqID_85134
  Gene Ontology: Mol. function=phosphotransferase activity, alcohol group as acceptor; Cellular component=NuA4 histone acetyltransferase complex; Biological process=metabolic process
  Homolog annotation: Hit_ID=UPI0000162BA0; Match level="QueryCoverage =95%, HitCoverage=11%, E-value=0.0, Identity=75%"; Hit description =inositol or phosphatidylinositol kinase/ phosphotransferase, alcohol group as acceptor
MSPVQNFEQHSRHLVEADLPIPARLQMVMEVRDSLEIAHTAEYLNFLKCYFRAFSAILLQITKPQFVDNQEHKLRNIVVEILNRLPHSEVLRPFVQDLLKVAMQVLTTDNEENGLICIRIIFDLLRNFRPTLENEVQPFLDFVCKIYQNFKLTVSHFFDNMAMTGEDVKPMETSLSDQGINTTIATGSQLNPSTRSFKIVTESPLVVMFLFQLYSRLVQANIPQLLPLMVAAISVPGPERVPPHLKTHFIELKGAQVKTVSFLTYLLKSYADYIRPHEESICKSIVNLLVTCSDSVSIRKELLISLKHVLGTDFRRGLFPLIDTLLEVRRSIVMQKSKFGLFKIRVPVASQIIQTFRVLVGTGRACFETLRPLAYSLLAEIVHHVRQDLSLSQVEPIFEKGVDQQSTDEARILLGRILDAFVGKFSTFKRTIPQDTKGRETAVYTYTIQLSPQ

SEQ ID NO: 201913 - protein, 75 aa, Glycine max
  Coding DNA Sequence Number=SeqID_85135
  Subcellular localization annotation: CTP_CleavageSite=43; ConfidenceScore=5.15e-01
MSALSDPSSAKCMLLCTQRNSPILHLCFPFVFSTSKQEPFTIQMSLRKKARTDDIPSSAIPAPQSATIEPDVQHP

SEQ ID NO: 201914 - protein, 62 aa, Glycine max
  Coding DNA Sequence Number=SeqID_85136
MEVGQEVLEVRTKTGYHPLSCESQELSDQPLHLRLSWSAKMAKAEQSQLQFDLNLAKLQPNR

SEQ ID NO: 201915 - protein, 165 aa, Glycine max
  Coding DNA Sequence Number=SeqID_85137
  Gene Ontology: Cellular component=anchored to membrane
  Homolog annotation: Hit_ID=Q9FKT1; Match level="QueryCoverage=79%, HitCoverage=87%, E-value=8e-39, Identity=53%"; Hit description =Similarity to GPI-anchored protein
MGSNAFFSSILYFFLLATLVSSAPFLSDDIFGAEASTGRALLQAKKVDFENQNYTVLTSQCKGPQYPPKVCCEAFKQFACPFANEINDMTTDCSSVMFSYINIYGKYPPGLFANECKEGNQGLDCSQVKPANTSTSSNTIHVAAPPHFFSLMTIAAFLGFLFHLF

SEQ ID NO: 201916 - protein, 68 aa, Glycine max
  Coding DNA Sequence Number=SeqID_85138
MSSLRLGKESITLEQVKSNLYFRELRLKEFGNGDEVFVFGLSMTDSAKREKKNKVNKNNNIMNNGYWT

SEQ ID NO: 201917 - protein, 71 aa, Glycine max
  Coding DNA Sequence Number=SeqID_85139
MEEINSGIDTNEDEEEQMKVYEEEDRTVEKHLDGVYENKWDSLWSSMLRKRKEYAKFKMGGATFEYLIYCM

SEQ ID NO: 201918 - protein, 71 aa, Glycine max
  Coding DNA Sequence Number=SeqID_85140
ITEDWATYLEDKGTGLDDHYRPPYLYFPSSNNQQWTKTSSSCRRVPSPLHLPMPRIRFVWKRGSCKRNSDA

SEQ ID NO: 201919 - protein, 72 aa, Glycine max
  Coding DNA Sequence Number=SeqID_85141
MKDIVSENVLIDQLSHPKKCNNYNSQILLSLVENPSLGIKILRWLKRSIYWIGIQPWENNTPEGSIRRPMDI

SEQ ID NO: 201920 - protein, 80 aa, Glycine max
  Coding DNA Sequence Number=SeqID_85142
MGTPSVNEYRHSEVVNKPKESECVESRGTGKGIKANLGEGGVWGGWYGRWGNGGLRRVVRNDWEYQWVPVRVRMVDGLCG

SEQ ID NO: 201921 - protein, 115 aa, Glycine max
  Coding DNA Sequence Number=SeqID_85143
MTRNFVTWLYGECAASTTGEMHGDTRHSDEVKWCINLNLSKFAAPKLIHGSIGWMQYSNMKEGDNVSRQWEQRDSFHVSYLANDNGGTIFSPPSTLLAIANSGTPISPILLAASA

SEQ ID NO: 201922 - protein, 200 aa, Glycine max
  Coding DNA Sequence Number=SeqID_85144
MVIVEELGDLEDPSHGVVAVEMRDVKFDVVVGRKGKKGGGGATTTLVWSRGARRGHGGSGLDGEPPLPSDWWSWSREKNDKQKAENEYSSLHLDWRDRCAAIRNSEKRAWRREDGAAIVVGEIADVEAVSLLPLARYIVSFLHIAILHPPNGPMNKFRCGKFTVNEANGTKHQMKIDRAAQAISTNTQSKNLDGGYGFNN

SEQ ID NO: 201923 - protein, 131 aa, Glycine max
  Coding DNA Sequence Number=SeqID_85145
MPQVSFCTCIYHLKIKKCEWQKAKLHGESRVIQRCFDDNKDDNKKLKGQSKNEFKIFKIESRTLQDSRGNLISRIKIQEIKISRIKIQDSRLKIQESREGLIKISMKRFSQKLSSTWFFSKHVYQRVFTLW

SEQ ID NO: 201924 - protein, 76 aa, Glycine max
  Coding DNA Sequence Number=SeqID_85146
MEKKESDEVLCRAERRRELKRESNGWSHRGRETNKWREYLTALRNALYTRALGEELLVMCGQWECAWEQLSDNGMV

SEQ ID NO: 201925 - protein, 255 aa, Glycine max
  Coding DNA Sequence Number=SeqID_85147
  Gene Ontology: Mol. function=acetylglucosaminyltransferase activity; Cellular component=membrane; Biological process=isopeptide cross -linking via N6-(L-isoglutamyl)-L-lysine
  Homolog annotation: Hit_ID=Q9FLD7; Match level="QueryCoverage=84%, HitCoverage=48%, E-value=7e-69, Identity=64%"; Hit description =Glycosylation enzyme-like protein
  Pfam annotation: Domain name=Branch; Domain location=64-254; Score =231.1; E_value=2.3e-66; Accession=PF02485.11; Description=Core-2I -Branching enzyme
  Subcellular localization annotation: CTP_CleavageSite=37; ConfidenceScore=5.16e-01
MTLLLGLTKICSLFLLFLATLTSPEGTPILPFYRSITAASYSVFVESKLRPLPVVSSLPPPPSLAYLVSGSKGDGAAVTRVLLALYHPNNRYVVHLDLESSPEERSDLVRFVEGHALFKRFGNVRVIKKANLVTYRGPTMVANTLHAATILLRELGDWDWFINLSASDYPLVTQDDLLHTFSYLPRDLNFIDHTSDIGWKDHQRARPIIVDPGLYMNKKQDVFWICRGGVGQRLSSFSQHLILHWVTLHRTPRKV

SEQ ID NO: 201926 - protein, 266 aa, Glycine max
  Coding DNA Sequence Number=SeqID_85148
MEKEALEEAMVQSVIKASLNESKDNIIEIDPGVEPIRSRPMYHANGSQIDIVLSIVVGEDNARRFEAIYGPPTFDTILDVQVGLERRKRTYSFRMENLQQSLEKQDEPVFKTFPPWQTVALNPNSMIFEHLPTNKKIAVDKTILYQNIKYYKDKEVWFKDNEDANSMHFVKARPQCLFKHELEALKHKFELMTLDGYAIKRFYNHEVGEKPPLDDYNNEAIAPDLKDRSHIEKEARKWSLISDFFYKKAIEWKPPHSLTPQYWGFI

SEQ ID NO: 201927 - protein, 49 aa, Glycine max
  Coding DNA Sequence Number=SeqID_85149
  Subcellular localization annotation: CTP_CleavageSite=14; ConfidenceScore=5.06e-01
MASIDAMMPSSSCMASFLSRCLSIFAFRLNLARVKVEGLKRVKVEELMF

SEQ ID NO: 201928 - protein, 529 aa, Glycine max
  Coding DNA Sequence Number=SeqID_85150
  Gene Ontology: Mol. function=nucleic acid binding; Cellular component= chromatin; Biological process=DNA integration
  Homolog annotation: Hit_ID=Q1T010; Match level="QueryCoverage=81%, HitCoverage=32%, E-value=1e-136, Identity=54%"; Hit description =Peptidase S8 and S53, subtilisin, kexin, sedolisin; Integrase, catalytic region; Zinc ...
  Homolog annotation: Hit description=finger, CCHC-type; Peptidase aspartic, catalytic
  Pfam annotation: Domain name=rve; Domain location=201-364; Score =177.5; E_value=3.3e-50; Accession=PF00665.16; Description=Integrase core domain
MVIEKFDKGGSEVWYLDTGCSNHMIGNKHWLVNLDTSQGSKVRFVDSSSISCEGEGNVVIKRKDESNAVIENVMYCPTMDSNLLSLGQLLEKGYKMRMEDLMLKVYDKKQRFILKAKMSSNRTFKVNFNVADVHCMTAEGNDVNWLWHFSYGHLNFQGLSRLVAKHMVSGMPQIKAPAEVCEGCVAGKPPRNSFNVSLPPRAKEPLGVVCSDVCGPIEPCTYGENLYFVIFVDEFTRMLWVYPIKRKSEVFVVFQKFKAYVEKQSGATLKTLRTDGGGEYTSKEFEDFCESKGIVHEVTTPHTPQHNGLAERRNRTLLNMVRSMLKLKGLPKELWGEVVTKAAYILNRSPIKKLEEITLEEAWTGKKPRVSHFKIFGSPFWKHVPDEKRKKLDDKSIEMIMVGYHPTGAYKLYDPIEKKVTYSRDLIFDEKSLYNWNKTEKVKSKGMSVLDKLGETSGEEEIGNSIGGAPPTMNGSGMEKEERERRRHFKENMSLEEAHHHRRPWIRAWRKKKMNEGRGREEHEILCSK

SEQ ID NO: 201929 - protein, 181 aa, Glycine max
  Coding DNA Sequence Number=SeqID_85151
MVVVSWIGLRVLGLMIEIKRLLMNLLCHRLWFLLLDFSSNMFFSIFGEVISYSQSEKGQSFKLSGSYKWLHNKDIYPTIPHDLSEQHSIRNRVLLVLGMKFFLESLKSVEEDDFRQIYLFNYHHFIHAKSIFITYIVYRSQYGMPMLNKKLWMSFHVYVRLVVLGKLTRPFLSDECGCYFP

SEQ ID NO: 201930 - protein, 58 aa, Glycine max
  Coding DNA Sequence Number=SeqID_85152
MTEVLTPDVTMVGDATMSFIVDASEVKVRPDEGVVAGGVDADKGHARRMGHGGEEEDR

SEQ ID NO: 201931 - protein, 605 aa, Glycine max
  Coding DNA Sequence Number=SeqID_85153
  Gene Ontology: Mol. function=nucleic acid binding; Cellular component= chromatin; Biological process=DNA integration
  Homolog annotation: Hit_ID=Q1T010; Match level="QueryCoverage=96%, HitCoverage=37%, E-value=1e-98, Identity=50%"; Hit description =Peptidase S8 and S53, subtilisin, kexin, sedolisin; Integrase, catalytic region; Zinc ...
  Homolog annotation: Hit description=finger, CCHC-type; Peptidase aspartic, catalytic
PVGYVEALKEEVWKKAMLEELAAIERNNTWKLVRLPKVKKPISLREGLDYTEVFALVARIETVRIVVVLAHSRGWNMWQLDAKSAFLNGLLEEEVYVTQPPGFENKEGGDLVFKLNKALYGLKQAPRAWNKRIDGFLLKIGFEKCKVEYGVYVEEENGDIIILCLYVDDLLIIGSNEVVIQTVKKQLQQEFDMIDLGVMSYFLGIEFIHKNEGLVMHQKKYALEVLKRYKMEECNLAKILVEFGLKLGAGLDEKPVDATLFKQMVGSLRYLCHSRPDIAYGVGLVSRNMNDPRTSHMAAAKRILRYVKGTLDYGLLFSKANHNQGIRCRSNLHDDEPSNFDDAKTQVIDSRLIEDFKIKQQESNPRFKIQEKKSRSNNKAYIYLGCNTENKRGYISCGPVQVEHTSAWLFKENKGGYIPYGSLLVKDFTRLLEISRTGGCLGTRHWSGDVEDSKSTTRYVFKLLGSTICWSSKKQEDVGLSTCESKYMVAASTTCQSSWLESLFAELKIKLDSVVQLNMDNKSAICLANNPISHGRIKHIGTKYHYLRDQVRKGRISLAYCKSEEQEADILTKALRGEKFYKFREKTWRSELLKLELGRNVDVSI

SEQ ID NO: 201932 - protein, 108 aa, Glycine max
  Coding DNA Sequence Number=SeqID_85154
MMMNKCNVEDAVDGVSDVVDELVIVNTNKQVSDYKDTELLMLTYFYFLHPLFASYIRTPTQLQHSNLKCIKNSENRGAYGATLRERACSKRVYVRKSKVKEDNIGCRK

SEQ ID NO: 201933 - protein, 66 aa, Glycine max
  Coding DNA Sequence Number=SeqID_85155
MASSADLWPSFRASILWYWRRDWPWGMNDNGAQIRVGVWVGEEDETMKEGLKERGKMREREEVVRP

SEQ ID NO: 201934 - protein, 101 aa, Glycine max
  Coding DNA Sequence Number=SeqID_85156
  Gene Ontology: Mol. function=ubiquitin thiolesterase activity; Cellular component=intracellular; Biological process=ubiquitin -dependent protein catabolic process
  Homolog annotation: Hit_ID=Q6ZIY2; Match level="QueryCoverage=79%, HitCoverage=20%, E-value=7e-14, Identity=44%"; Hit description =Putative DD1A protein
  Pfam annotation: Domain name=DUF239; Domain location=22-101; Score= -86.3; E_value=0.076; Accession=PF03080.5; Description=Arabidopsis proteins of unknown function
MTQDIPGVHIAEVSLSSLYGPYYGVNGTNNIFNPRVSRKDQVSSSHLWVQNGPVEATNKIAAGWHVAPQLYGDDKTYIYSAWTIISSGQGAIIFDVQALFR

SEQ ID NO: 201935 - protein, 118 aa, Glycine max
  Coding DNA Sequence Number=SeqID_85157
  Gene Ontology: Cellular component=integral to membrane
  Homolog annotation: Hit_ID=Q8S8N9; Match level="QueryCoverage=66%, HitCoverage=11%, E-value=2e-20, Identity=61%"; Hit description =Golgin-84
MNNCNKSTMINHVLIRLLWSTPSSYFACCFSFQRVADERTAKATKLEQKVALLEVQCACLNQELQDIEARVHGEQKKALEEANQAWQEELECARQGQREAENKLSSLEARLIYSFFFL

SEQ ID NO: 201936 - protein, 208 aa, Glycine max
  Coding DNA Sequence Number=SeqID_85158
  Homolog annotation: Hit_ID=O48822; Match level="QueryCoverage=77%, HitCoverage=76%, E-value=4e-17, Identity=38%"; Hit description =Expressed protein
  Pfam annotation: Domain name=DUF827; Domain location=19-196; Score= -30.5; E_value=3.3e-08; Accession=PF05701.2; Description=Plant protein of unknown function (DUF827)
MDKKGGGMVIMERAEIDTRAPFKSVKEAVMLFGEKVLVGEIYANKLKEMRVEASGSGSPQARGGALATELEETKQNLEGARDEASMLVKRIKSLKKELEQTKKELEDTKARELRLLQRRDDPEIEDLKFIANATTNVEIKTQSSDEEKAEEFQKTRYVKFASPHALAQVIPNKGELLGRSPSVKKPKRKPLMSLIGWLFSKKKGSHAS

SEQ ID NO: 201937 - protein, 121 aa, Glycine max
  Coding DNA Sequence Number=SeqID_85159
  Gene Ontology: Mol. function=DNA binding; Cellular component=oxygen evolving complex; Biological process=DNA integration
  Homolog annotation: Hit_ID=Q1S1B7; Match level="QueryCoverage=97%, HitCoverage=26%, E-value=4e-33, Identity=46%"; Hit description =Integrase, catalytic region
APGQGLLYEDKGNTQVSGYCDADWAGWNIISWKSKKQVVVARSSAEAEYRSMAMATFFHKRTKHIKIDCYFIGEKLLSKEINTEFINSNDQSADILTKSLRGARIQSICSKLGAYDLYASA

SEQ ID NO: 201938 - protein, 66 aa, Glycine max
  Coding DNA Sequence Number=SeqID_85160
MERDLKLKEPRSSYLKSPQDLHARDARATMGPRSASLMVGLEARDFACLVAFTCCLRGGEEERGRG

SEQ ID NO: 201939 - protein, 296 aa, Glycine max
  Coding DNA Sequence Number=SeqID_85161
  Gene Ontology: Mol. function=sequence-specific DNA binding; Cellular component=nucleus; Biological process=regulation of transcription, DNA-dependent
  Homolog annotation: Hit_ID=Q8LL11; Match level="QueryCoverage=91%, HitCoverage=90%, E-value=7e-67, Identity=51%"; Hit description =Protein WUSCHEL
  Pfam annotation: Domain name=Homeobox; Domain location=35-97; Score =50.8; E_value=4.7e-12; Accession=PF00046.19; Description=Homeobox domain
MMEPQQQQQQAQGSQQQQQNEDGGSGKGGFLSRQSSTRWTPTNDQIRILKELYYNNGIRSPSAEQIQRISARLRQYGKIEGKNVFYWFQNHKARERQKKRFTSDHNHNNVPMQRPPTNPSAAWKPDLADPIHTTKYCNISSTAGISSASSSVEMVTVGQMGNYGYGSVPMEKSFRDCSISAGGSSGHVGLINHNLGWVGVDPYNSSTYANFFDKIRPSDQETLEEEAENIGATKIETLPLFPMHGEDIHGYCNLKSNSYNYDGNGWYHTEEGFKNASRASLELSLNSYTRRSPDYA

SEQ ID NO: 201940 - protein, 38 aa, Glycine max
  Coding DNA Sequence Number=SeqID_85162
MEIYRLVWLRLLAIPVIEGDQGNERIGLLMALAERKVL

SEQ ID NO: 201941 - protein, 200 aa, Glycine max
  Coding DNA Sequence Number=SeqID_85163
  Pfam annotation: Domain name=Self-incomp_S1; Domain location=5-121; Score=0.5; E_value=0.00065; Accession=PF05938.2; Description=Plant self-incompatibility protein S1
MAEKALIGVTNNLGSRNLTVSCKIDNHPHLLGPTDYYEWKFSPEYNDEFGTEPLFSNCSFQWEGAHHSFDLYVLVRDGDCNNCSWHIKLDAACRYTVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 201942 - protein, 2314 aa, Glycine max
  Coding DNA Sequence Number=SeqID_85164
  Homolog annotation: Hit_ID=Q2HTJ2; Match level="QueryCoverage=96%, HitCoverage=97%, E-value=0.0, Identity=71%"; Hit description=2-oxo acid dehydrogenase, lipoyl-binding site
MVLLFRRQPPLTPYKLKCDKEPLNSRLGPPDYHPQTPNCPEEILTREYLQSGYRDTVEGLEESREISLTQVQNFSKKVVLNCKEAIRKRLRAINESRVQKRKAGQVYGVALSGSQLAKPGVFPEQRPCPEDFRKKWIEFNLVGRSVQIWMDTGHVHMLNTPVQAIAILNFRRAIGLSQPHKRLRSLTDLVPHVRRKSLSEVLIRNNVPLLRATWFIKVSYLNVVRPGSASIPSGTADKTQLSCSELWTKDVIEYLQTLLDEFFSKNSSHFTPHNRDRSPQVPYTASFQHRSDQLLSVADGEEPSLHFRWWYIVRLLQWHHAEGLLLPSLIIDWVLRQLQEKQLLEIWQLLLPIVYGFLEIVVLSQTYVRTLAGVALRIIRDPAPGGSDLVDNSRRAYTTSALIEMLRYLIFAAPETFVALDCFPLPSSVVSHTINDGNFVLKATEAAGKIKSSSEDVVCLFRSKGFDAQFQSLAFDHVISCIQECVEDLTKAVSPGYPGQCLAKAAQALDKSLVLGDIHGAYKFLFEDHCDETVSEGWVAKVSHCLRDFRNAPPCDVKFTGRKDLSHVHIAIRLLKMKLRDMQISPKHKSGSTRGCGVSYLAKCSSQQRNQNFVNNAFKIKSSSRNLDQNICSSAVFESPGPLHDIIVCWIDQHMVHKGEGLKRLHLFIVELIRAGIFYPLAYVRQLIVSGIMDMNVNVVDLERQKRHCRILKQLPGKFVRRALVESGISEGPRLTEALQVYLNERRFILRGSLWENHGNANNVNISSLKQNHCTSSTKDKTSTVSIDPWKSVFSNKTSSKNAKDDNGVEELKTFISTLLQLPKSLSNLSTTGLDESQGSVRKPIGSHNKSDLVEATPGCEECRKAKRQKLSEERSSFVQAPSPILSDDEDTWWVKKGLKSSEHLKVDQPLKPTKQVTKTRQKTVRKTQSLAQLAASRIEGSQGASTSHVCGNKVSCPHHRTAMDGDTTRSVDGIRSGHCEDIVSIGRALKQLRFVERKEVTLWLMTVVRQLIEESEKNVGKVSQFGRPFATVDDKSSIRWKLGEDELSALLYLMDVSDDLVSAVKFLLWLLPKVYSSPNSTIHSGRNALMLPRNVENQACDVGEAFLLSSLRSLFAYARVRLRTIFPPPYLRIAKSLWAMGYENILAAADLLPEALSSIMHRAAAIIASNGRVSGSGALTFACYLLKKYGNVVSVIEWEKSFKSTCDKRLASEIESGRSVDGELGLPLGVPAGVEDPDDFFRQKISGGRLPSRVGSGMRDVVQRNVEEAFRDLFGKDRKLFAAGTPKGPAFEKWDNGYQIAQQIVMSLIDCIRQTGGAAQEGDPSLVTSAVSAIVGSVGPTLAKLPDFSAGSNHSNMSLATSSLNYAKCILRMHITCLCLLKEALGERQSRVFEIALAMEASTALAGVFAPSKASRAQFQMSPETHDTGTISNDVAANNTSKIVVARTTKISAAVSALVVGAIICGVTSLERIVTILRLKEGLDVVHFVRSTRSNSNGNVRSVGAFKLDSSVEVHVHWFRLLVGNCRTICEGLVVDLLGEPSIVALSRMQRMLPLTLVFPPAYSIFAFVMWRPFVMNANVAVREDMNQLYQSLTIAISDAIKHWPFRDVCLRECQGLYDLMAADTSDAEFATLLELNGSDMHSKSLAFVPLRARHILNAMIDCKMPQSIYTKDEGSRNYGHGESKIDFTDSESTLQDKLVDVLDALQPAKFHWQWVELRLLLNEQALIEKLKTHDMSLADAIQLSSPSSEKGAASENENNFIEIILTRLLVRPDAAPLFSELVHLFGKSLEDSMLLQAKWFLAGQDVLFGRKTIKQRLINIAETKRFSVKTQFSEPWGWCSPCKNPVALKGDKMKVDPMPLEEGEVAEEGMDAKRSIKGFSQVFDSESSTSKQQHGTERALLELILPCIDQSSDESRNSFASDLIKQLNYIEQQITLVTRGPSKPTASTPVTEGQTNKVNSRKTIRGGSPGLARRPTPAPDSSPLSPAALRASISLRVQLLMRFLPILCSDGESSARSMRYMLASVLLRLLGSRVVHEDATVNPMHYTPLRREAESHAEASFVDSSAEGLFDHLLLILHGLLSSSPPSWLRSKPVSKTTNEPTREFSGFEREPLEALQNHLDNMQLPDTIRRRIQAAMPLLPPSIRCSFSCQLPTVPASALVSLQPNTTNSGFNSGSSTVPQRNLVPSSRTTTSGKSKQHDNDLDVDPWTLLEDGAGSCPSASNTDIIGSGDRVNIRAASWLKGAYANPSSGVFVVSLSIIDGMTGMKMSFGICPSCVEGKLRGRQFEKQVKGMFSLLKKSEVDVLASSSCWF

SEQ ID NO: 201943 - protein, 112 aa, Glycine max
  Coding DNA Sequence Number=SeqID_85165
MTTITQIWMTLLLSNILPTDHNSDLPMLKCQLVYAILTQGAFAKCDTQWLSARKNPEEDELSSSLSTQLQVFKRTASTHPLSERSALSQNSLKCAKRSIYALSARARTRPPI

SEQ ID NO: 201944 - protein, 83 aa, Glycine max
  Coding DNA Sequence Number=SeqID_85166
MNDHDGLCMPSDLIVSGSQRVRMTMMGVDDHDGLRMPSDLIVSGWKADDHNLSSRANGHDCLWMGADDHDGLRMPSDLIVSGW

SEQ ID NO: 201945 - protein, 227 aa, Glycine max
  Coding DNA Sequence Number=SeqID_85167
MMEAMMNMKKIMEVNMVAGTSVVAKVNPMPSSGLNQMNHPTSNMVGKDLGSMGGPYYVQIQNKHAFPPYGLPPNYTPPNVAYTPSENVNNSTPILIESRQPQTDHAHVSQTMGETHEIPHHNLADFEPCLGYATEGTTVGGIPLQNTLEGPQYHPQPHPLHSTAGKNPHAMAEMGKLDHLEERLRAIEAGEDYAFAKVPDFDKYKGTTCSKNHLNMYCRKMEAYAKD

SEQ ID NO: 201946 - protein, 130 aa, Glycine max
  Coding DNA Sequence Number=SeqID_85168
MACGDHHGHPHPLPSKENQVRWHVETIMVIHTLYHPETIKSDGMRRPSWSSAPFVIQRQSSPMACRDHRGHSFLLFSRLFQSCLPSRDKQVHWHVETINVFCSLSFSKATRVLFRDFDVSLTLQDFKVLC

SEQ ID NO: 201947 - protein, 143 aa, Glycine max
  Coding DNA Sequence Number=SeqID_85169
MMLIIMFNVVIDHISQRAPVDSRNEEHYGISGNNVGCGFLSCRQKLATVTKPGSVTEPSYMIRKEEWSGYRVGLAFEYETGAFLGPSLATREFRVNSTLAERDATHSETKPQILVLCTFDKVTQSNSFNSSHHTDFYFFLARY

SEQ ID NO: 201948 - protein, 60 aa, Glycine max
  Coding DNA Sequence Number=SeqID_85170
MVRENLIEQRMGIEGIRERWITLLHENDKCWVGSWNPKQSREQQIFLVLTKTKMRISGNS

SEQ ID NO: 201949 - protein, 487 aa, Glycine max
  Coding DNA Sequence Number=SeqID_85171
  Gene Ontology: Mol. function=drug transporter activity; Cellular component=membrane; Biological process=multidrug transport
  Homolog annotation: Hit_ID=Q1SB90; Match level="QueryCoverage=95%, HitCoverage=86%, E-value=1e-175, Identity=67%"; Hit description =Multi antimicrobial extrusion protein MatE
  Pfam annotation: Domain name=MatE; Domain location=20-180; Score =143.3; E_value=6.7e-40; Accession=PF01554.9; Description=MatE
  Pfam annotation: Domain name=MatE; Domain location=241-404; Score =150.2; E_value=5.3e-42; Accession=PF01554.9; Description=MatE
  Pfam module annotation: Pfam domain module=MatE::MatE; Domain location=20-180::241-404
MQTHHHVLKELISICKIAFPMILTGLLLYCRSMISMLFLGRLGELALAGGSLAVGFANISGYSILSGLAVGMESICGQAYGAKKFSLLGLCLQRTILLLLFTCIPISLLWLYMKHILLLCGQDEAIATQAQSYLLYSIPDLLAQSFLHPLRIYLRSQSITLPLTLCATFSILLHIPINYLLVSHLNWGIKGVALSGVWTNLNLVASLILYIVFSGTHKKTWGGFSFECFTQWKSLLNLAIPSCISVCLEWWWYEIMILLCGLLVNPRATVASMGILIQTTSLLYIFPSSISFSVSTRVGNKLGAQKPSKAKFSSIVGLSCSFMLGVFALVFTILVRNIWANMFTQDKEIITLTSFVLPVIGLCELGNCPQTTGCGVLRGTARPKVGANINLGCFYLVGMPVAVWLGFFAGFDFQGLWLGLLAAQGSCAVTMLVVLSRTDWDAEALRAKKLTSVVVDDSKEVGAEKPPKAEIKEDSLLSLADSDEDKQ

SEQ ID NO: 201950 - protein, 119 aa, Glycine max
  Coding DNA Sequence Number=SeqID_85172
  Homolog annotation: Hit_ID=Q9FJ89; Match level="QueryCoverage=63%, HitCoverage=19%, E-value=3e-18, Identity=66%"; Hit description =Arabidopsis thaliana genomic DNA, chromosome 5, P1 clone:MSG15
  Subcellular localization annotation: CTP_CleavageSite=48; ConfidenceScore=5.69e-01
MVRQEVMKSSTTTFSGLKARTTRSPPWRNPQKHGWFQSTKWNPVRRIRSSNKGQGRTASSRPKLSSHCQPVRATQGEIRLWRLWRWGFHGKHHDVERENGFLVLEIRKVDLITVMDSME

SEQ ID NO: 201951 - protein, 449 aa, Glycine max
  Coding DNA Sequence Number=SeqID_85173
  Pfam annotation: Domain name=Transposase_23; Domain location=222-288; Score=-15.3; E_value=0.054; Accession=PF03017.5; Description =TNP1ENSPM transposase
KWTLAAEQDGVDDTVYEKYDISKEKLAQFCQTHRDPSWEDVRKKTQFGSTEGIIDPPSPIRRHVKWKMARTKKIGQMTSGAAKKIAEKIGSFVPHGRQDVLTVAIGRAEHLGRVRAAGAGVTIKKYFRSAPRMSRSSSSLPPEELQQLTQQIRDQLEESITEKVTRKLMAFFSQMQSQFQSQMRSQGLALPPEPMVGPSGPRVSTKKSCVDPSGNDPETDDSNKYGLYIKANSPRLVTLGRVYEGSTVHNIPLLHGQVKVGVEEVKDAQAPVPVPTDEVTLVGQTLNTFLAWPTHLVKHLSEQAAVSPAKPPQRLDPEVNWDATVFRVFNPDFLLYIKHEDLSKIAHGGQCLSISIIQLWILHLTETSMRAGNSDVYGFLEPQSIQRFGQSGHWQMVVILPKENVVVWFCSLHNRLDNYLKGIINSALKGLDDTPQPKSKAGARWIVVK

SEQ ID NO: 201952 - protein, 207 aa, Glycine max
  Coding DNA Sequence Number=SeqID_85174
  Gene Ontology: Mol. function=protein serine/threonine kinase activity; Cellular component=integral to membrane; Biological process=protein amino acid phosphorylation
  Homolog annotation: Hit_ID=Q6ZAB7; Match level="QueryCoverage=57%, HitCoverage=52%, E-value=3e-22, Identity=34%"; Hit description =Putative receptor-like protein kinase
  Pfam annotation: Domain name=LRR_1; Domain location=30-52; Score=4.6; E_value=39; Accession=PF00560.23; Description=Leucine Rich Repeat
  Pfam annotation: Domain name=LRR_1; Domain location=54-76; Score =10.4; E_value=3.3; Accession=PF00560.23; Description=Leucine Rich Repeat
  Pfam annotation: Domain name=LRR_1; Domain location=6-28; Score=19.3; E_value=0.014; Accession=PF00560.23; Description=Leucine Rich Repeat
  Pfam annotation: Domain name=LRR_1; Domain location=78-100; Score =6.8; E_value=15; Accession=PF00560.23; Description=Leucine Rich Repeat
  Pfam module annotation: Pfam domain module=LRR_1::LRR_1::LRR_1::LRR _1; Domain location=30-52::54-76::6-28::78-100
IGNIVNLQTLDLAHNNLEGPLPSQLSKCTKMDRFDVGFNFLNGSLPSSLQNWTKLNTLILSENHFSGGLPAFLSEFKMLSELQLGGNMFGGRIPRSVGALQNLMYGMNLSSNDRWQTSPWNWIVYLRKKKQPNTPTMNKSALVAASVAAASATATSFSSSAKLSLQDGGAQRSHGGSSPVANSASTEKFAPRFDGLRFIETLITAHR

SEQ ID NO: 201953 - protein, 88 aa, Glycine max
  Coding DNA Sequence Number=SeqID_85175
  Homolog annotation: Hit_ID=Q6EPN8; Match level="QueryCoverage=42%, HitCoverage=8%, E-value=9e-09, Identity=71%"; Hit description =Putative Ste24p
MVTLGTTTTLNLQALVEEIKARYDKAAVKVVDLILTLLQFGGYTLVQNSVDLYRSFGFDTQPILIGLIIFQVARLEEQDNTLVTNDIK

SEQ ID NO: 201954 - protein, 78 aa, Glycine max
  Coding DNA Sequence Number=SeqID_85176
MLWRLSMIFHVYFLDPSNNGDGVLLQLENDIDILHMCCIGGVLNKVVVNQTKDEVEGIDTNLNKEIEMSDDLNNVTNV

SEQ ID NO: 201955 - protein, 127 aa, Glycine max
  Coding DNA Sequence Number=SeqID_85177
MCKGLLANFLLSPLEVIFLLVKDGEVPFLVEKAGVTVLVGVFDAGFELFGVENGDALEVGSIDFFLVLAEHESDSDLGALQQLLVDQPNLQIEEGVILAILDLALIVVSKSAPAVIAGNSFVLKPPT

SEQ ID NO: 201956 - protein, 50 aa, Glycine max
  Coding DNA Sequence Number=SeqID_85178
MQSQVLTLPPESEDKQGVEGPAKPADRLDPDVNPIYVMTLTIPLVFLKPL

SEQ ID NO: 201957 - protein, 306 aa, Glycine max
  Coding DNA Sequence Number=SeqID_85179
  Gene Ontology: Mol. function=4 iron, 4 sulfur cluster binding; Cellular component=integral to membrane; Biological process=protein -chromophore linkage
  Homolog annotation: Hit_ID=P56766; Match level="QueryCoverage=99%, HitCoverage=58%, E-value=1e-152, Identity=66%"; Hit description =Photosystem I P700 chlorophyll a apoprotein A1
  Pfam annotation: Domain name=PsaA_PsaB; Domain location=1-300; Score =135.3; E_value=1.7e-37; Accession=PF00223.9; Description=Photosystem I psaApsaB protein
TNWGIGHSIKDILEAHKGPFTGQGHKGLYEILTTSWHAQLSINLAMLGSLTIVVAHHMYSMPPYPYLATDYGTQLSLFTHHMWIGGFLIVGAAAHAAIFMVRDYDPTIRYNDLLDRVLRHRDAIISHLNWVYTAIQLQPVFAQWIQNTHALAPGTTAPVGGKVALLPIPLGTADFLVHHIHAFTIHVTVLILLKGVLFARSSRLIPDKANLGFRFPCDGPGRGGTCQSDVWGSISDQGIVNHITGGNFAQSSITINGWLRDFLWAQASQPRALSIVQGRAVGVTHYLLGGIATTWAFFLARIIAVG

SEQ ID NO: 201958 - protein, 407 aa, Glycine max
  Coding DNA Sequence Number=SeqID_85180
  Gene Ontology: Mol. function=nucleic acid binding
  Homolog annotation: Hit_ID=Q1S0C3; Match level="QueryCoverage=94%, HitCoverage=79%, E-value=4e-55, Identity=37%"; Hit description=Zinc finger C-x8-C-x5-C-x3-H type (And similar), putative
  Pfam annotation: Domain name=zf-CCCH; Domain location=339-365; Score =19.5; E_value=0.0035; Accession=PF00642.15; Description=Zinc finger C-x8-C-x5-C-x3-H type (and similar)
MRVLEEVYPRISAIPDGPSVSSNVENECYDDNESVIPLLPLIPVEEEQESVEDTEPDFPTKKLQSQNLQQQYIPPATSLINPQCNNINSRCSGKPLPATSSESDIVAAASAAAVAAIIKSNEQGSLIDMDLLRKLFTDPTMIEKLIEQNRTATTTVSAPSNILSIPTSYSKPAAVASETKPTAPTTTMGLWPTSVTRKATHEKPSITSVPSVSLAMPLTPQTVTRHKPQSTHRPVKKNIPHMPNGVLPSLNTHSPQQGLKRAAPLASVSSSEFKTVAVPSVSANMHSVAKQMKSTTSGAVKDVNYYRSLVKEHGTHKQGKKSLRNLQGLKRSQGEVKFKSKKPCIYFGTPRGCRNGSDCPFQHDMPNQWEAGNVLMAQNAKRLKGKGGGQANILETPVMFSLMRLKN

SEQ ID NO: 201959 - protein, 754 aa, Glycine max
  Coding DNA Sequence Number=SeqID_85181
  Homolog annotation: Hit_ID=O65649; Match level="QueryCoverage=89%, HitCoverage=91%, E-value=1e-101, Identity=40%"; Hit description =Myosin-like protein
  Pfam annotation: Domain name=DUF869; Domain location=95-682; Score =524.7; E_value=1e-154; Accession=PF05911.2; Description=Plant protein of unknown function (DUF869)
  Pfam annotation: Domain name=M; Domain location=340-360; Score=6.5; E_ value=17; Accession=PF02370.7; Description=M protein repeat
  Pfam annotation: Domain name=M; Domain location=583-603; Score=6.6; E_ value=17; Accession=PF02370.7; Description=M protein repeat
  Pfam annotation: Domain name=M; Domain location=69-89; Score=6.0; E _value=20; Accession=PF02370.7; Description=M protein repeat
  Pfam annotation: Domain name=Tropomyosin; Domain location=83-268; Score=-109.4; E_value=0.022; Accession=PF00261.10; Description =Tropomyosin
  Pfam module annotation: Pfam domain module=DUF869::M::M::M::Tropomyosi n; Domain location=95-682::340-360::583-603::69-89::83-268
MDRRGWLWKKRSSDKNIKVENEKPVSTSEFVGPTLFSVAHVGDQQDSSKNKNYVQITMESYAHMSGLEDQVVNLEDQVKALEEKLSAVYSELNNKDDLVKQHAKVAEEAISGWEKADAEVVSLRCQLESLSLSKLTVDEKAAHLDEALKECMKQIRTVKEESDQKLQEVILMKSHQWEKIKLELEAQIDNLDEGLRELANENAALLKSVQESSNKIVKLKEEKSEAEAEVEHLEKSVQSKEKEITSLKYELHMISKELDIRNEEKNMIMRSAEVANKQHTEDVKNITKLESECQRLRGLLRKKLPGPAALAQMKLEVESSHHVFSATHLRKTSSKTDSLQESEFLTKQLKVLEEETKTLKEALASSNAELQASRNLYAKTVGRLKCLEAEMHQERNAQKAILATNYGNSFSRVYSYPPTITSIPDNGHEDSESPVESSAASIPDHSDIRRIGSVGKFENHKTETISELMDDFLEVEKMACLSDNGGVPLCIISKANDDAEDKKETSCLSSNKNCFDGTNQTIEPEAAEYDEHMQDLKEKRMMLEENMQLLEELKAQLVSSNKSCSLAEIQLKCMTESYKSLQTRVEELEAENKYLKEKMDELKNDLAEEKQSHHDALVRYREIKEKMQRDKCLVCAANSVANSGKDKELAAAEKKLAECQETLSILGRQLQAMCPQIGVTMTHHSKRLQMNEKLAKPTYGWSNSYGSCNSNEIDHAEACSIVSDIQGVTDEFSSHNSGATSCLSDTEGNFWLNT

SEQ ID NO: 201960 - protein, 131 aa, Glycine max
  Coding DNA Sequence Number=SeqID_85182
MDRRRRMDNRREGDNGLRRGFSSYRCSSLGCLPFYRHKVAYNSGYLALSGPSILNEYSDDHSLSAQFALSAFLGFFVGLLRVNLELTTKRGDVLGLCWVLSELSQSSTFSSRLFLYVFALIFFGALEIFFF

SEQ ID NO: 201961 - protein, 68 aa, Glycine max
  Coding DNA Sequence Number=SeqID_85183
  Gene Ontology: Mol. function=voltage-gated potassium channel activity; Cellular component=membrane; Biological process=potassium ion transport
  Homolog annotation: Hit_ID=Q9SCF5; Match level="QueryCoverage=72%, HitCoverage=8%, E-value=6e-11, Identity=62%"; Hit description =Potassium channel
MAIPKTNLFPHQLSQRNSFNKILQYANKYRLPEGLKEQMLAHMQLKFNTAELQQQVSDDFIAQLVAIE

SEQ ID NO: 201962 - protein, 221 aa, Glycine max
  Coding DNA Sequence Number=SeqID_85184
  Homolog annotation: Hit_ID=Q9FH60; Match level="QueryCoverage=93%, HitCoverage=97%, E-value=2e-61, Identity=60%"; Hit description =Arabidopsis thaliana genomic DNA, chromosome 5, TAC clone:K1L20
MGASESTLSSGKTPDDKITTITERSEASDPILERLKYLKITPPILTSPPTEGTLTDILVRKPSSSSVSGDDLLWLNHSVIPATVNPKVILELFSIYHDWQEKKAQEISIRQEEIENKIEVADALAIKLLQRYNHSTSTMKTASQHLSGVHSLQVEIGELKGRLTEVISNCDALCKRIATEGPESLVSSIKPFAVTTANQETYSSSSSLRIVSKTNPPSAEE

SEQ ID NO: 201963 - protein, 147 aa, Glycine max
  Coding DNA Sequence Number=SeqID_85185
VLVIAVQVCVEYSLDLTLKLRFLDDSSGGFFLQFLPLAYACGLGMIWLNFATLHCISCYNLLLLVADSRLEVMILATVGHEFISDRTCYRHVLEIPEGRIKASKFIGILDKALVSGSWLDKFRDAKALSSLSLTSLSLTALVVSLTS

SEQ ID NO: 201964 - protein, 83 aa, Glycine max
  Coding DNA Sequence Number=SeqID_85186
QTAIVNGEFAVRSHVAWKTPLVVASCLQVEVATMTSELGQASAGFWKPLVKLAGWLVQAFAVFAGCFCRRCRPKGELQLPLAI

SEQ ID NO: 201965 - protein, 156 aa, Glycine max
  Coding DNA Sequence Number=SeqID_85187
MSVYCIIVLFNLSGHKELEMSVTETPKKTGAPQIVKLDKALKLAELWVNNMSKDADDDRTNADVEGRPSRLGLGAKVSRQSKFVPSDDPVERKLYAKLNAEKRKAANIAKESATIARDALDDDEDNEDLDSRANAFTKRKATAPLISSMLRNKKQK

SEQ ID NO: 201966 - protein, 326 aa, Glycine max
  Coding DNA Sequence Number=SeqID_85188
  Gene Ontology: Mol. function=DNA binding; Cellular component=nucleus; Biological process=regulation of transcription
  Homolog annotation: Hit_ID=Q9SL41; Match level="QueryCoverage=99%, HitCoverage=93%, E-value=1e-107, Identity=59%"; Hit description =Putative NAM (No apical meristem)-like protein
  Pfam annotation: Domain name=NAM; Domain location=5-134; Score=313.1; E_value=4.8e-91; Accession=PF02365.6; Description=No apical meristem (NAM) protein
MESCIPPGFRFHPTDEELVGYYLRKKVASQKIDLDVIREIDLYRIEPWDLQERCRIGYDEQNEWYFFSHKDKKYPTGTRTNRATMAGFWKATGRDKAVYERAKLIGMRKTLVFYKGRAPNGQKSDWIMHEYRLESDENGPPQASIYVTEEGWVVCRAFKKKTTGQTKTINIEGWDSSYFYEEASGASTVVDPIELISRQSQSFVAQNFMCKQELEADNLSCMLQDPFVQLPQLESPSLPLVKRPSTVSLVSDNNEDEDIQNRLLSNNNNTKKVTTDWRALDKFVASQLSQEVDTHESNGVPSSFQPHDDNHDMALLLLQSSRDEGN

SEQ ID NO: 201967 - protein, 61 aa, Glycine max
  Coding DNA Sequence Number=SeqID_85189
MDLNSDTQQQQQQQQQQQQQRQQRKSYILLGKEHKAEMQLGEFTLKAFKNSNFTPPSFLTE

SEQ ID NO: 201968 - protein, 929 aa, Glycine max
  Coding DNA Sequence Number=SeqID_85190
  Homolog annotation: Hit_ID=Q10T01; Match level="QueryCoverage=98%, HitCoverage=100%, E-value=4e-39, Identity=23%"; Hit description =Expressed protein
MAKRCQRFPVNYEKDQSGCMWGFISIFDFRHARFTRKLIADRRHGSKHAVGAALTKNKFEVLSNLDEEYEGNFDRGESKRLTLTNDADKLSVKKLIEEEMIIDQDEIKDQGNAEVESKQSRLGHEGPPKTDSKRKKKSRKKSRDMDSHDLNSDATLKSEFSHKPHSRQQSKDNLDLNKIMDDFCHVEAACSMMNDDHGKIDEQSNQKHVISENLANAIHEFANQMRLNGKDLPEDGQLLSSHELMEALQVISSDKQLFLRLLQDPNSHLLKYIQELENAQGRGGKECSSVTSSNCSEHELVKLKQTRETANRKHRNFFRKRVKSQPKDSTNENEKTEFSNRIVILKPALTGMQISESGNNLASTLNSHDIAQYKNPSVRVGSHFSLTEIKRKLKCAMGKERHGNPELIPRKLPVERQNKLPRGKCKDNAGMRSPNKDHFFIEKITRPMFNVVKGNKTGTMKDSELNVEHESGIPNQSVSNIYIEARKHLCEMLDNADENTNISSRQMPKTLGRILSLPEYNFSSPGRDLEHHSVTAQATFSSSDKTREVSEDKLSPKPATCIGLPDQEINNSEKQSSICDERSDNKVQEIKLVSNLSHDVNHVNTSEACYPVRDEIVTEGNVESTKEKNDLESSLDPNGFIIGKDQNIDISEIPDGAGCSECLNQDIPEENQSSSLLSSPQSSITKKIEELENGTDVSGRPSPVSVLDTSFSDDDFGPGHSRYQPVKLPVQPLQIKFEEHDSSPAEQFDRRKYCFEESELIYDYIKAVLHASGLTTDQLLMKCLSSDKILDPSLFDQVELFSNLLCNNQKLLFDSINEVLMEICQHYFGASPWVSFVNPSTRLTPSMKRVTLKVWEGVCWHMLPLPPPRTLEQIVRKDMARRGTWMDLGLDTETIGFEMGEAILAELMEDTILSLVIESPESKCFSASI

SEQ ID NO: 201969 - protein, 94 aa, Glycine max
  Coding DNA Sequence Number=SeqID_85191
MTKRRGKDPLEGLGGPMTRARARKAKEALQQVLSILFEYKPKFQGEKFKVVSGSLLKSAVKLQYKLNHFINKDKLSFIQKIRVYLFYLSESDSP

SEQ ID NO: 201970 - protein, 101 aa, Glycine max
  Coding DNA Sequence Number=SeqID_85192
  Subcellular localization annotation: CTP_CleavageSite=65; ConfidenceScore=5.08e-01
MASSTCFQQISSQITIMKQKPSKTTHHISQNPVPTKIKDALHDSENAFLSRFGAEMATKGWSFVGASMVEEEEENGNVRERRRKASEILGLSEERECCFLV

SEQ ID NO: 201971 - protein, 155 aa, Glycine max
  Coding DNA Sequence Number=SeqID_85193
  Gene Ontology: Mol. function=chaperone activator activity; Cellular component=endoplasmic reticulum; Biological process=response to stress
  Homolog annotation: Hit_ID=Q9LHL7; Match level="QueryCoverage=93%, HitCoverage=40%, E-value=2e-62, Identity=76%"; Hit description =Arabidopsis thaliana genomic DNA, chromosome 3, P1 clone: MEC18
  Pfam annotation: Domain name=AHSA1; Domain location=28-86; Score =19.9; E_value=0.0016; Accession=PF08327.1; Description=Activator of Hsp90 ATPase homolog 1-l
MTKTTASTPKKEKVKKGRKSISMTERFNCRAKDLFEILMDKNRWKDFTQINVRISKEVEGEFSIFDGSVTGTNLELQEGKLIVQRWRFGSWNDGVQSTVRLVFEEPESGVTVVKLTHTDVPEEDMYGNATVVENTERGWRHLIFQRIRGVFGFGI

SEQ ID NO: 201972 - protein, 83 aa, Glycine max
  Coding DNA Sequence Number=SeqID_85194
MGAGGTSTIVGGLAEIQSLSIISVENLRLLPYSLASFMSTKNWPLGRINSEFEDATQPENLSWHAAIQPYMFHEHENLALGKD

SEQ ID NO: 201973 - protein, 205 aa, Glycine max
  Coding DNA Sequence Number=SeqID_85195
  Homolog annotation: Hit_ID=Q9LU33; Match level="QueryCoverage=99%, HitCoverage=99%, E-value=4e-49, Identity=46%"; Hit description =Arabidopsis thaliana genomic DNA, chromosome 3, P1 clone: MXL8
  Pfam annotation: Domain name=GLTP; Domain location=32-201; Score =94.5; E_value=3.2e-25; Accession=PF08718.1; Description=Glycolipid transfer protein (GLTP)
MKSTRREMEKKSEIGSAIEELSTMTIVKPGENHGSAHIPTKPFLSVCYFVLQVLDKIGPTMTVMRQDVHQNIKTLELMHESNPSLNSNLVEILKSEAREGNARKGSSCSKALVWLTRTLDFASLLLHTLAKDPEKRMEQVVEEAYDVALRLVPESKTFVNILKTEDENYDTLKENMQMLVSLFVPFLEDMHCILRLYNLDKLKST

SEQ ID NO: 201974 - protein, 87 aa, Glycine max
  Coding DNA Sequence Number=SeqID_85196
MGENQNGSCGVKFWKQYKPQWSEGESASYGDLGSAKQRRSLRHTINVTAEGTRSKQRLWHGGGNEVKMQMHATSLRGSVVMHVQQAS

SEQ ID NO: 201975 - protein, 648 aa, Glycine max
  Coding DNA Sequence Number=SeqID_85197
  Gene Ontology: Mol. function=protein dimerization activity; Cellular component=chromatin; Biological process=DNA integration
  Homolog annotation: Hit_ID=Q2R1C3; Match level="QueryCoverage=96%, HitCoverage=88%, E-value=1e-162, Identity=46%"; Hit description=HAT family dimerisation domain containing protein
  Pfam annotation: Domain name=DUF659; Domain location=168-283; Score= -16.7; E_value=5.1e-06; Accession=PF04937.6; Description=Protein of unknown function (DUF 659)
  Pfam annotation: Domain name=hATC; Domain location=492-581; Score =51.2; E_value=3.5e-12; Accession=PF05699.5; Description=hAT family dimerisation domain
  Pfam annotation: Domain name=zf-C2HC_plant; Domain location=10-72; Score=20.9; E_value=0.00014; Accession=PF07567.3; Description =Protein of unknown function, DUF1544
  Pfam module annotation: Pfam domain module=DUF659::hATC::zf-C2HC _plant; Domain location=168-283::492-581::10-72
MFASLEYQDDHAPLWSFVTIKEKIGDGGGNRLWSCNFCEKVIKSSYSRVKAHLLRICGSGIATCLKVTDAYLVDLRRVCKEAENRLKSKNLPLPTDKRTLTPPTLPPKRRKSSNIESAFNIEDKNHLRAEIARMFYSAGLSFHLARNPHFVSSYSFAANCNLSGFLPPSYNALRTSLLQQERSHIERLLQPIKSLWSLKGVTLIADGCNQGGRAQNVVQVITDNASVCKATGLLIEAEFPHIFWTPCVVHTLNLGVKSICAAKNVDGNENVFNECWWIAEVIGDASFIKVFIMTHSMRLAIFNEFSSLKVLSIAETRFASMIVMLKGFKLLKRCLQNMVISDQWNSYREDDVRKAAHWDKVDYILSFMDPIYSMIKICDTDASNLHLVYEMWDSMIEKVKTTIYRHDEVLENEVSSFLEVIHEILNSWWSKSCNPLLCLAHSLNPGYYSDNWLNEVPNRVPPHRDDELSSQRNKCLKIYFPHVNVRTKVYEEFSKFSSCAGDFGSFDSIEDRWALDPKTWWVMHGSSTPILQKVALKLLVQPCSSSCCERNWSTYSFIHSLKRNKMDPKRAEDLVFVHSNLRLLSRKEEGYKKGETRLWDINGAVHDPLDDSAGVLEMKDLSLDEPDLEAMLFLDDGSGGEENETIRV

SEQ ID NO: 201976 - protein, 143 aa, Glycine max
  Coding DNA Sequence Number=SeqID_85198
  Homolog annotation: Hit_ID=Q21HL1; Match level="QueryCoverage=88%, HitCoverage=7%, E-value=3e-40, Identity=59%"; Hit description=1 -deoxy-D-xylulose 5-phosphate reductoisomerase precursor
MVMSRDEQLFNKAYSDYSDLDGDGVLDTTYQDKFDYSGYFDYNLCYSYNSGVFKASAEAKGANKHSCSGAWSGNFLNWVTMSRLDVMRYVLYGGQRFTDTKEKTVLERAPIPSDLHAWVKVYSGSDLREFANLAGSGTTFSFC

SEQ ID NO: 201977 - protein, 215 aa, Glycine max
  Coding DNA Sequence Number=SeqID_85199
  Homolog annotation: Hit_ID=Q9FHI9; Match level="QueryCoverage=92%, HitCoverage=15%, E-value=5e-24, Identity=36%"; Hit description =Arabidopsis thaliana genomic DNA, chromosome 5, P1 clone:MFC19
TAYVFLLTLPENTLWIPTALVFTAGIIKFAERTRSLQLASVGHFRQSIVRKPDPGPNYAKLMEELKSRVDAGLPTEIVTMPEISDDPFLDIDEPETSGGNPDHEHPKTDDEVVGAINNTSQQSDKPEPHANDNAQDQPNNGEAQDVDGAPPKTLDDDANAKINDQEVLTDVEVVKGAYDYFNKFKGLVVDMMFSFQERSDSRNYLLQRTALDALR

SEQ ID NO: 201978 - protein, 86 aa, Glycine max
  Coding DNA Sequence Number=SeqID_85200
  Subcellular localization annotation: CTP_CleavageSite=21; ConfidenceScore=5.12e-01
MASIIVAIFSFMASMSASICSCTSSTSPITLALAQVRHEGPKNHLSLLAHLGAQCPMCAVKKTIWIFRLPSTKDETHIQRMCDDMM

SEQ ID NO: 201979 - protein, 98 aa, Glycine max
  Coding DNA Sequence Number=SeqID_85201
  Gene Ontology: Mol. function=L-cystine transporter activity; Cellular component=integral to membrane; Biological process=transport
  Homolog annotation: Hit_ID=P57758; Match level="QueryCoverage=97%, HitCoverage=34%, E-value=3e-30, Identity=65%"; Hit description =Cystinosin homolog
  Pfam annotation: Domain name=PQ-loop; Domain location=1-42; Score =0.1; E_value=0.057; Accession=PF04193.5; Description=PQ loop repeat
MNFMRKSTEGWSIVNILLDFSGSIANYAQMSVQSIDQNSWVNFYGNIGKLLLSLVSLFFDILFMCQHYLLYPEKKRKLEGSPEPDNAKSSDRPLSENV

SEQ ID NO: 201980 - protein, 44 aa, Glycine max
  Coding DNA Sequence Number=SeqID_85202
MAKERKDSTVKMVNVSQVDWLVLAYFPKRIRIPKIQTHSFPFEN

SEQ ID NO: 201981 - protein, 131 aa, Glycine max
  Coding DNA Sequence Number=SeqID_85203
  Gene Ontology: Mol. function=L-cystine transporter activity; Cellular component=integral to membrane; Biological process=transport
  Homolog annotation: Hit_ID=P57758; Match level="QueryCoverage=86%, HitCoverage=42%, E-value=2e-48, Identity=77%"; Hit description =Cystinosin homolog
  Pfam annotation: Domain name=PQ-loop; Domain location=9-75; Score =99.6; E_value=9.1e-27; Accession=PF04193.5; Description=PQ loop repeat
MASWNSVPLHVSYEVLGWVAFACWSISFYPQVILNFRRKSVVGLNFDFVMLNLTKHSSYLIYNASLYFSSAVQKQYRDKYGQNEMIPVAANDVAFSAHAVLLTAISLFQIAIYDVSATFPLIGLIVLAMNL

SEQ ID NO: 201982 - protein, 138 aa, Glycine max
  Coding DNA Sequence Number=SeqID_85204
  Gene Ontology: Mol. function=metal ion binding; Biological process =metal ion transport
  Homolog annotation: Hit_ID=Q9LF57; Match level="QueryCoverage=59%, HitCoverage=57%, E-value=1e-26, Identity=67%"; Hit description =Farnesylated protein ATFP6-like protein
  Pfam annotation: Domain name=HMA; Domain location=27-87; Score=43.4; E_value=7.8e-10; Accession=PF00403.16; Description=Heavy-metal -associated domain
MDALDYLSNFCTVTSTRTKQKAMQTTEIKVRMDCDGCERRVRNAVSSIKGVKSVEVNRKESRVVVRGYVDPKKVLKRVRSTGKGWLNDEFPSLKSMMQRQLEAENESIGFIYQEKKHKWNQNIESHSEIPSPKPAKDL

SEQ ID NO: 201983 - protein, 124 aa, Glycine max
  Coding DNA Sequence Number=SeqID_85205
  Homolog annotation: Hit_ID=Q7F1Y6; Match level="QueryCoverage=53%, HitCoverage=21%, E-value=2e-18, Identity=65%"; Hit description =Putative ATP synthase mitochondrial F1 complex assembly factor2
  Pfam annotation: Domain name=ATP12; Domain location=33-123; Score =3.1; E_value=1e-05; Accession=PF07542.2; Description=ATP12 chaperone protein
MFSSEGEKVYTKVLVGKWKLSSSSMVTMSMSFMTGLIVGKRFYKELKTQEADDGNGWTVMLDYRTLKTPSKRPFKLPSLPLAKAIAAKWEYQIHSSPFTIKPTHNPCLSCFVDTTFSGKNGLFR

SEQ ID NO: 201984 - protein, 120 aa, Glycine max
  Coding DNA Sequence Number=SeqID_85206
  Homolog annotation: Hit_ID=Q7F1Y6; Match level="QueryCoverage=85%, HitCoverage=32%, E-value=3e-20, Identity=51%"; Hit description =Putative ATP synthase mitochondrial F1 complex assembly factor2
MLMLTQPGVPYLDPNPDRQVEKIDPLLRWVESEFGFKPVVYSSFFGEKQEDGLLTAIENLLKKTDDCELAAIDAIAASAHSLTLAIGMVQGKLQIEEAIELIRLEEDFSGEQVGPRRRWS

SEQ ID NO: 201985 - protein, 52 aa, Glycine max
  Coding DNA Sequence Number=SeqID_85207
  Gene Ontology: Mol. function=succinate dehydrogenase (ubiquinone) activity; Cellular component=mitochondrion; Biological process =tricarboxylic acid cycle
  Homolog annotation: Hit_ID=Q8LB02; Match level="QueryCoverage=66%, HitCoverage=12%, E-value=5e-13, Identity=94%"; Hit description =Succinate dehydrogenase [ubiquinone] iron-sulfur protein 2, mitochondrial precursor
SSTVQYGVAAIELEFIINGIQSLLSVLITTVTYPPANTTTNNISDLNNPIIK

SEQ ID NO: 201986 - protein, 97 aa, Glycine max
  Coding DNA Sequence Number=SeqID_85208
MGGTWHLFVQTYLLMLCSFVQLFLRVQLSHGFSKEFRGQWINIVRKHAKVVVDDDVIFSVFKKYCKYSSDSENWTSWSEGLNWKSGSMARQSCFQIN

SEQ ID NO: 201987 - protein, 246 aa, Glycine max
  Coding DNA Sequence Number=SeqID_85209
  Homolog annotation: Hit_ID=Q0ZCD5; Match level="QueryCoverage=38%, HitCoverage=15%, E-value=2e-16, Identity=44%"; Hit description =Integrase
MLEEGAIVMILTPTHTIRGERQPKLVLQEAKILEASIKSGKPYAKLKKTTPPPPKKEVLTKENPKKVKETSTEGSLENEKENEVLTLYEKIGMGETQPRSITLQLVDKSIVCPRGVVKDVLVKEEKFIFPTDFVVLDMEEDEDIPIILGRPFMNTCDMVIEARNPIDALMEASFLSVGMEDPWKEFLLARTWTVVIAPTLNEIEDEKLLRVLRDNKEAFRWTIHDIKDIDPTSCSQRIQMCNALKF

SEQ ID NO: 201988 - protein, 172 aa, Glycine max
  Coding DNA Sequence Number=SeqID_85210
MRDGWVGEFGGGVREGKRSWMGVTWHAGDVKGGFEYGLVGDGSDKVNVNASITVKVGPRLLQFLRPKGRLRFNIIGKVAWARMVDKEVSTVGEQRREAGWKLPSSKYRKYGEHNWSLEYDIWTFESTILLHRRVEIPEYDPEIERARHKNNNDTRKRRMVEANAGNRGNGGN

SEQ ID NO: 201989 - protein, 101 aa, Glycine max
  Coding DNA Sequence Number=SeqID_85211
MTNANCLQESLHSVSNENLRYDRFILSMIHCYLSLLDWRGTTLKQQSCLAIVDSMEFVESNPLFQNPKSMSYFVLLLQLGVGLAFRELICKDKSDCAGNRS

SEQ ID NO: 201990 - protein, 93 aa, Glycine max
  Coding DNA Sequence Number=SeqID_85212
MQLKGVPQGFYSLVTDYTALAIDYQRPNSSYTVSEHENLQYALCNRLHTTVLVIDYQRPPQHTVSISKPGNRLHPLVIDYQKPSQLPDPIFRP

SEQ ID NO: 201991 - protein, 58 aa, Glycine max
  Coding DNA Sequence Number=SeqID_85213
MVSKVWSFDGGFNGEEEEGNNNSLTFHCTRRGPFSKENGLRHPTLGSFVNKSLRETYP

SEQ ID NO: 201992 - protein, 157 aa, Glycine max
  Coding DNA Sequence Number=SeqID_85214
MTCGDTQVVLRINTLFLSVRLRVRDGKSDDMRRYPSGYPYKLIFVNPDPRRASELVDTERLTSSSAPLSSRDGESDDMRRYPSGYPYKTILLILTEKSGASEPVDTQRLASSSAPLSSRDGESDDMRRYPSGGRRRYPSGYPYKTISVNPDPRSQVA

SEQ ID NO: 201993 - protein, 211 aa, Glycine max
  Coding DNA Sequence Number=SeqID_85215
  Gene Ontology: Mol. function=transcription factor activity; Cellular component=membrane; Biological process=regulation of transcription, DNA-dependent
  Homolog annotation: Hit_ID=Q4KGD2; Match level="QueryCoverage=100%, HitCoverage=71%, E-value=2e-52, Identity=50%"; Hit description =Transcriptional regulator, LysR family
MAETALVQLLLVPVAPRYHAGLLHATHIRIALRQRMLRTAVQPLLLLVQRQRHQIAGAQRKVSDGQVEPIFQHLLLQFVGLAHAEGEKHRRKALVKTGDNRRQIQRAVGDGGIDHAERKRAALRAFQRLHLRLPAAQGRQHFPGVGVELFAFAGQRKACAPALAQDKAQLTFQFTHVGADGRRGHVQRLLRTRIALVFHHAGEHLQQFQIG

SEQ ID NO: 201994 - protein, 284 aa, Glycine max
  Coding DNA Sequence Number=SeqID_85216
  Gene Ontology: Mol. function=nucleic acid binding; Cellular component= nucleus; Biological process=RNA-dependent DNA replication
  Homolog annotation: Hit_ID=Q1SA76; Match level="QueryCoverage=93%, HitCoverage=52%, E-value=5e-39, Identity=35%"; Hit description =Transposase
MFEEIVDEQKEDEASVKSEHVDCSYALNTSHVFVTRDEVLNWARAVAYEIGFVTVIMRLDTKTDMRERASFVLIDCERSSQYMARKKDLSMVKPRNILLMLKEHNANSHTTIKQIYDERSAYRSFIRGSNTEMQQLIKLFELDQYIYWHRLKDEDVERDIFWCHPDAVKLCNACNLVFLIDSTYKTNRYKLPLLDFVGVTPTGMTFSIGFAYLEEESLNNVVWALGHFRGLFLRHDALLGVNVIDKDLALMNAMKTVFPECTNLLCWFHVDKNVKAKCKSRGIL

SEQ ID NO: 201995 - protein, 79 aa, Glycine max
  Coding DNA Sequence Number=SeqID_85217
MRRGAKRKTKQGQEAKHDAPEDNKPKAQHRAKRAKTSKPQSEPKYFEDKRNLCTLYLPLFWFGALTHVLVWHAGSTKKE

SEQ ID NO: 201996 - protein, 106 aa, Glycine max
  Coding DNA Sequence Number=SeqID_85218
  Gene Ontology: Mol. function=damaged DNA binding; Biological process =mismatch repair
  Homolog annotation: Hit_ID=Q1XBQ8; Match level="QueryCoverage=78%, HitCoverage=8%, E-value=2e-18, Identity=58%"; Hit description=DNA mismatch repair protein
MLQFKPKFPRQVLLCRVGEFYEAWGINVCILVEYEVLNPFGVPAILPVYEYMLLINFGLNTALWRRQAQGPTQARSRKRLFISGLKEGRGIWTEVKASSITNRNPT

SEQ ID NO: 201997 - protein, 58 aa, Glycine max
  Coding DNA Sequence Number=SeqID_85219
MVEEEPARLVQTKYCSPGRADPTQTFLGEIMLVWANFALENHTLNMHLDGGFRNFLEI

SEQ ID NO: 201998 - protein, 194 aa, Glycine max
  Coding DNA Sequence Number=SeqID_85220
  Gene Ontology: Mol. function=nucleic acid binding; Biological process= DNA integration
MVYHSKVEDGSHIHLLLYVDDMLIASQNSLEIQELKSLLSSEFEMKDKVCTPLTKCIRLSELNTTQSESQKEYMSHVPYASVVGSLIYTMEETLASCKFLSMQGVPSRVQVLGEEKTDGGGQQYLWDDPYPYKVCRDDMIRHCVPYEEKVCLSGLRRGPITRAMARRLQEDWARDAGEGPRVLMSLRVDFEPMG

SEQ ID NO: 201999 - protein, 239 aa, Glycine max
  Coding DNA Sequence Number=SeqID_85221
  Subcellular localization annotation: CTP_CleavageSite=70; ConfidenceScore=5.06e-01
MISTWPFKVNHLVVPCFEIGPSGVTDLNRRRRVKQGIIFSVSHSSKVSVSQCSRGYGTVVFSGHAKLDLRCGILLGFSKPKFGIIFKPHKSHVGDLAPPLGWALDEEGVGSELVEENIDSDDSSVNSESKCVNSLNLDHVKDSDHEGKMRGDDNSKESGGSELVEEQTDSNDASVNSDLEGVMSLKLDQVQESDCEVKMHGDDNSKEGADEECDGKVDVRALALRLQTVKKSGGRGGDS

SEQ ID NO: 202000 - protein, 197 aa, Glycine max
  Coding DNA Sequence Number=SeqID_85222
  Homolog annotation: Hit_ID=Q9LIE8; Match level="QueryCoverage=96%, HitCoverage=55%, E-value=4e-08, Identity=26%"; Hit description =Similarity to cell wall-plasma membrane linker protein
SILEAPTNCVFVHASSTHEFGAMRSDCLLQFSILYPFFRSPMNCVFVHASSTHEFGAMRSDCLVQFSILYLFFRCPMNCVFVHASSTHEFGAMRSDCLVQFSILYPFFRSHMNCFFVHASSTHEFGAMRSDCLVQFSILYPFFRSPMNCVFVHASSTHEFGAMRSDCLVQFSILYPFFRSSMNCVFVHASSTHEFRA

SEQ ID NO: 202001 - protein, 80 aa, Glycine max
  Coding DNA Sequence Number=SeqID_85223
GSTGSNKDRRKSLKVYQSHTVRGEKVASAQDFVGNQRERTTLGRGQGLTFSPWVKVYDKLGFWLKAYRTAGHDICQGLAS

SEQ ID NO: 202002 - protein, 437 aa, Glycine max
  Coding DNA Sequence Number=SeqID_85224
  Gene Ontology: Mol. function=steroid hormone receptor activity; Cellular component=nucleus; Biological process=regulation of transcription, DNA-dependent
  Homolog annotation: Hit_ID=Q2HU72; Match level="QueryCoverage=69%, HitCoverage=52%, E-value=1e-120, Identity=71%"; Hit description =Steroid nuclear receptor, ligand-binding
MKQYTDSDRRDVRIEQVACRLKLLECSHADLSSIFHFKVVARIVRASTTSICTFREVGAKSTSCNVLQMKQDMMVNRGCSISARSWDNIFEFHLEGMVKVLAEIDRHPLLTYSTRKKKHWAECSGKAKRLVSESSFLFGLSYVIAASAIYDEYSNDILDMPEGSCFPRPQFRKDVDASQRTSNSNSVSRPSSFRKAPSRTSSMKNNNIAELKSFELLDALFKECFHVGEKMVSEGIITREDIEEAKSGNGSRVISIGLPAYCLVQGLLRSAKLNSVGIMISDETELTITNRPRETFFDWFVNPLLIIKEQIKAENLSASEEDYLCKLVLLGGDAERLKKSSVGPAPESDVKRAELEALARRLQGITKSMSRFPTFKRRFNDLVRSLSDDLKEKSGGPIMTRSKSAFARLISLKSFKGTRANGSAQGSQHVARDLENS

SEQ ID NO: 202003 - protein, 463 aa, Glycine max
  Coding DNA Sequence Number=SeqID_85225
  Gene Ontology: Mol. function=electron carrier activity; Cellular component=plastid chromosome; Biological process=electron transport
  Homolog annotation: Hit_ID=Q6UU99; Match level="QueryCoverage=57%, HitCoverage=56%, E-value=1e-25, Identity=24%"; Hit description =Putative fertility restorer
  Pfam annotation: Domain name=PPR; Domain location=143-177; Score =19.8; E_value=0.01; Accession=PF01535.11; Description=PPR repeat
  Pfam annotation: Domain name=PPR; Domain location=15-49; Score=2.0; E_ value=4.4; Accession=PF01535.11; Description=PPR repeat
  Pfam annotation: Domain name=PPR; Domain location=185-219; Score =17.1; E_value=0.066; Accession=PF01535.11; Description=PPR repeat
  Pfam annotation: Domain name=PPR; Domain location=220-254; Score =19.3; E_value=0.014; Accession=PF01535.11; Description=PPR repeat
  Pfam annotation: Domain name=PPR; Domain location=255-289; Score =31.9; E_value=2.2e-06; Accession=PF01535.11; Description=PPR repeat
  Pfam annotation: Domain name=PPR; Domain location=290-324; Score =20.1; E_value=0.0081; Accession=PF01535.11; Description=PPR repeat
  Pfam annotation: Domain name=PPR; Domain location=325-359; Score =44.4; E_value=3.8e-10; Accession=PF01535.11; Description=PPR repeat
  Pfam annotation: Domain name=PPR; Domain location=360-394; Score =18.1; E_value=0.033; Accession=PF01535.11; Description=PPR repeat
  Pfam module annotation: Pfam domain module=PPR::PPR::PPR::PPR::PPR::PP R::PPR::PPR; Domain location=143-177::15-49::185-219::220-254::255 -289::290-324::325-359::360-394
MLEEIRRNGLTPSPVSYSQALLAYRRMEDGNGALNFFVEFREKYHQGEIGKDDDGEDWEKEFMKIEKFTIRVCYQVMRCWLVSRDNLSNNVLKFLFDMDNARIPLPQVDLERLAWACTREDHYIVVKELYTRIRGRYDKISLSVCNHAIWLMGKAKKWWAALEIYEDLLDKGPKPNNLSYELIVSHFNFLLSAAKRKGIWRWGVKLLNKMEDKGLKPGSREWNAVLLACSKASETTAAVQIFKRMVENGEKPTIISYGALLSALEKGKLYDDALRVWNHMVKVGVEPNAYAYTIMASIYTAQGNFNTVDAIIQEMVTLGIEVTVVTYNAIITGCARNGMSSAAYEWFHRMKVQNISPNEITYEMLIEALANDGKPRLAYQLYTRAKNEGLTLSSKAYDAVVQSSQANGATIELGLLGPRPADKKKKVQIRKTLNEFYNLAGVPKRSQPFDRSEIYHSQTQENP

SEQ ID NO: 202004 - protein, 86 aa, Glycine max
  Coding DNA Sequence Number=SeqID_85226
HTRRWRHQTRGTPLASASWEANHDLVFPALVHPQEHAVNFHRSRNTRVSIKETNSIRDIVQYGASLVETYTVAPPVLTAHLKRWYR

SEQ ID NO: 202005 - protein, 67 aa, Glycine max
  Coding DNA Sequence Number=SeqID_85227
MASEPNCRSCLMDEGLTASINEPISNQLVCGRKSTSSLPEASERHGLRTANLTSRGRRHRMPFVRRG

SEQ ID NO: 202006 - protein, 79 aa, Glycine max
  Coding DNA Sequence Number=SeqID_85228
  Subcellular localization annotation: CTP_CleavageSite=45; ConfidenceScore=5.39e-01
MTTSSTNQILAASTTSTNQLLATQTNKHLVVSTSSPNKQTIQHVKDNKESQNMYLGKVLRCHGHKEEEDKDPCSYKEED

SEQ ID NO: 202007 - protein, 72 aa, Glycine max
  Coding DNA Sequence Number=SeqID_85229
SPIGNLVPLDLEIEAMLRRNRAERRRTLLQDRIVASILEEETQFFDSSSPDSPSSGEFVTYLPKVVSMADEH

SEQ ID NO: 202008 - protein, 72 aa, Glycine max
  Coding DNA Sequence Number=SeqID_85230
  Gene Ontology: Mol. function=RNA-directed DNA polymerase activity; Cellular component=intracellular; Biological process=RNA-dependent DNA replication
MDLKSGYYQIRMKEGDEWKTTFKTKYGLYEWLVMPFGLTNAPSTFMSSKGICMDEEKVTAIREWLVPKNANE

SEQ ID NO: 202009 - protein, 97 aa, Glycine max
  Coding DNA Sequence Number=SeqID_85231
MKNVEERSKTFTKSLTEMLRKRLGLDFLHGNNFSKQIRKREKGEACHPARPGEQGCFLQKQQPSNLPLGSPEAHARCPSLPQCKALRYQLLSFVMTL

SEQ ID NO: 202010 - protein, 45 aa, Glycine max
  Coding DNA Sequence Number=SeqID_85232
MSGQGLKKVKKGQGSWEKEYGIRSKQVKSLQKDIIGQAIVGPPTP

SEQ ID NO: 202011 - protein, 150 aa, Glycine max
  Coding DNA Sequence Number=SeqID_85233
  Gene Ontology: Mol. function=protein binding; Biological process =protein modification process
  Homolog annotation: Hit_ID=Q6K5J0; Match level="QueryCoverage=81%, HitCoverage=72%, E-value=6e-32, Identity=59%"; Hit description =Ubiquitin-like protein
  Pfam annotation: Domain name=ubiquitin; Domain location=60-127; Score= 19.8; E_value=0.0026; Accession=PF00240.13; Description=Ubiquitin family
MRFSRSSSKLGNGHKATPPIEKDCRSIGEIQWELRPGGMLVQKRKSNQSAGEGMITIIVSTMSQSQEISIEATSTFGELKMILSLVTSFEPREQRLLFKGKERDDDEYLHMVGVREKDKVLLLEDPAIKEKKLLGLRDQPINNPSRAISV

SEQ ID NO: 202012 - protein, 1378 aa, Glycine max
  Coding DNA Sequence Number=SeqID_85234
  Homolog annotation: Hit_ID=Q75LL9; Match level="QueryCoverage=99%, HitCoverage=100%, E-value=0.0, Identity=46%"; Hit description =Expressed protein
MASNQTLKELQWVQQAIKSEALNLQSISFYLSQPTSGCYQETDNSISINISKENLPFFSLLLTTLAAPRSTNSSSLRNLEFHRVEWDSQHVRNLGTLLGNNQNVQQVVFRRNRFNGKSLLELSDILKTNKVIKEIMLSESGIGSVGAGLIASALMVNDSLEELQIWEDSIGSRGAEELSKMIEVNSTLKLLTIFDSNAITATPLISSVLARNRRMEVHVWSGENGDKSSKVVEFVPENNTLRIYKLNLSGTCRVTCSLGMNFTVKLLDMTGVKLKSRCAKEFRWVLEQNQTLKEVNLSRTCLKDKGIVYVAAGLFKNRSLQTLHLSGNLFSGIGVEHLLCPLSRFSALQMQANTTLTCVTFGGGRTRIGRDGLAAIIQFLITNETVRKLGIHDDESLRSDDFVKIFKNLEKNASLKCLSLQGCKRVEGETLLQTIMETLQINPWIEDIDLSRTPLHNSGMTRGIYQRLGQNEKTEPEMDLVKDMPLTEPKSCRVFFCGQECAGKTTLCHSISQNFSASSLPYFDQVRTIVNPVEQAVKTAGMKIKTFKDEDTRISIWNLAGQHEFLSLHDLMFPGHGSASFFIIISSLFRKPSNKEPKSSTEIEEDLQYWLRFIVSNSKRAIQQCMLPSVAVVLTHFDKINQPSPNLQHTVDSIQRLRDKFQGYVEFYPTVFTVDARSSASVSKLTHHIRKTSKTILQRVPRVYQLCNDLIQILSDWRSENYNKPAMKWKEFGELCQVKVPSLRIRSRNDNKERVEMKRRAIATCLHHIGEVIYFDELGFLILDCEWFCGEALGQLIKLNVRKQHSSENNGFVSRKELEKILRGSLQSPIPGMGSKVFENLDASDLVRMMLKLELCYEQDPSDPNSLLLIPSILEEGRGKPQKWQLSMQDCVYAGRHLECDDSSHMFLTPGFFPRLQVHLHNRLEALKDQHGATYSLEKYLILISINGIYIRVELGGQLGYYIDVLACSTKNLTETLRVINQLIIPAIQSICHGITLTENVIRPECVRKLTPPRYRKTQFASLQQLKQALLSLPADGMYDYQHTWSPVLDSGRPILQDGFDFARDLLSDDDFREVLHRRYHDLYNLSLELQVPPENNPEGQGQSVTMIDEAAKVEPTFGGIAKGVEAVLERLKIIEQEIRDLKQEIQGLRYYEHRLLLELHRKVNHLATFNVQVEERKVPNMIYFVKTENYTRRLVTTMLSGMNALRLHMLCEFRGQMHVVEDQMGCEIMQVDNAAVKSLAPYMKKFMTLVTLALKIGAHLAAGMGQMIPDLSKEVAHLAGSSVLYGAAGATAAGVVGAAAIGSRNRSREGSRDIQQDLRAAQQWVVDFLRERSCSSGKDIAEKFGLWRVRYRDNGQIAWICRRHMYARSAEIIEVPV

SEQ ID NO: 202013 - protein, 137 aa, Glycine max
  Coding DNA Sequence Number=SeqID_85235
  Gene Ontology: Mol. function=nucleic acid binding; Biological process= DNA integration
MEWLPPSLENLRISGCVAYAHIRQGKLKPRALKCMFLGYPQGVKGFKLWCMEARHPWEVLSQQQSEVDDDKSIHLEVEPLHNLTTSDAKVESQEQNGANTQPNLQDNLLASDRQRRSNSPPTRFDYANVVAFALNVA

SEQ ID NO: 202014 - protein, 272 aa, Glycine max
  Coding DNA Sequence Number=SeqID_85236
  Gene Ontology: Mol. function=nucleic acid binding; Cellular component= intracellular; Biological process=DNA integration
  Homolog annotation: Hit_ID=Q1S3Z1; Match level="QueryCoverage=96%, HitCoverage=23%, E-value=2e-32, Identity=32%"; Hit description =Integrase, catalytic region; Zinc finger, CCHC-type
HSALILSLGDKVLREISKKKIVDAIWLKLDNLYMTKSLANMLFLMQKLYTFKMQSIGNHIDDFNKIILDLENIENKLDDEDWALLLLRSLPKLKRKSEERGEQDAEGLYTISGSEKKDFKNKKGSTSMSKEGKKRKCFICVSEERLKKERLEYKKKKKHGDQRNHNGDANDWFNSHDESHGGQVLLGNNKAYKVIGIRLVKLKHADGKIRALQEVRHVPNLKRNITSLEMVDKQGYVCKAEGGLLKVTKGSMELMKGKLEDGLYCISFNKAF

SEQ ID NO: 202015 - protein, 75 aa, Glycine max
  Coding DNA Sequence Number=SeqID_85237
  Gene Ontology: Mol. function=histone-lysine N-methyltransferase activity; Cellular component=nucleus; Biological process=chromatin modification
  Homolog annotation: Hit_ID=Q9ZUM9; Match level="QueryCoverage=80%, HitCoverage=15%, E-value=8e-11, Identity=43%"; Hit description =Histone-lysine N-methyltransferase ASHR2
MEQELEGNGMYMPVDLKTRLVNAKDEGKEVCISYLKIGRDYCTRKRILMEDYRFTCGCDRCKIEANWDGEENNSD

SEQ ID NO: 202016 - protein, 110 aa, Glycine max
  Coding DNA Sequence Number=SeqID_85238
MAGNSSNSVKEDNMEDIERHHIEIDEGEFSDGLPYKPSLIRYKGSYANQPVSFLSSGLIHLETVQVIVDAEETNRIGVNNSANIGTDGDNGGGKEERLLQVEVNIRQEWA

SEQ ID NO: 202017 - protein, 100 aa, Glycine max
  Coding DNA Sequence Number=SeqID_85239
MVVETEPFGSDENGKEEEEEGVVEICVPDRGETHNRKGEADVGGMDAVAGRLCVGPETGGREGEGGNLLWERGGGIVFAVGGGGVDNAIGGGLAEEKDGL

SEQ ID NO: 202018 - protein, 209 aa, Glycine max
  Coding DNA Sequence Number=SeqID_85240
  Homolog annotation: Hit_ID=Q9C770; Match level="QueryCoverage=23%, HitCoverage=14%, E-value=8e-13, Identity=70%"; Hit description =Integral membrane protein, putative; 85705-84183
MGGDFAEAEDGEGCLGTMVFNIWRMASSLEAMEVWAAVSLAMASSRWSKVWCLPLKSGRMDQLLAVVPLSLRLREVSKFPWQSIFFLTSKVYPHHHTRRSNITSRFGQILLLACDQKHKNLGEEWRRCADGLVEGNREVAERGVAVDNGEAEDGAKSEDQLPKTSSRSSAVAVTTSASASAHAIGIDNDSLVKSILYPALSLSNILHFN

SEQ ID NO: 202019 - protein, 136 aa, Glycine max
  Coding DNA Sequence Number=SeqID_85241
  Gene Ontology: Mol. function=indole-3-glycerol-phosphate synthase activity; Cellular component=chloroplast; Biological process =tryptophan metabolic process
  Homolog annotation: Hit_ID=Q8H3R5; Match level="QueryCoverage=76%, HitCoverage=26%, E-value=1e-16, Identity=40%"; Hit description =Putative indole-3-glycerol phosphate synthase
KPQSRAWAKNKHGSIKKKKDAANDDIDDWELPHGSFENVEAIRKDGIKCPLLCKEFIIDAWQLYYAQTKSADVVLLIVVVLPDLDIKYMIKICKLLRLTALVEQELKCIRFKVGHFDYVAFMATTDVEFQTFYIGY

SEQ ID NO: 202020 - protein, 201 aa, Glycine max
  Coding DNA Sequence Number=SeqID_85242
  Gene Ontology: Mol. function=microtubule motor activity; Cellular component=microtubule associated complex; Biological process =microtubule-based movement
  Homolog annotation: Hit_ID=Q1SGR1; Match level="QueryCoverage=99%, HitCoverage=36%, E-value=6e-79, Identity=58%"; Hit description =Kinesin, motor region; Prefoldin
  Pfam annotation: Domain name=Kinesin; Domain location=76-200; Score= -89.0; E_value=1.2e-08; Accession=PF00225.13; Description=Kinesin motor domain
MQLSSQEEAIKQKDVLATEVSSLRGELQQVRDERDRQLSQEKCSLKDNQIKALEEQLATAEKKLQELKGNIRVLCRVRPLLADESCSTEGKIFSYPTSMETSGRTIDLAQNGQKHSFTFDKVFTPEASQEEVFVQISQLVPSALDGYKVCIFAYGQTGSGKTYTMMGRPGHLEEKGLIPRSLEQIFQTKQSQQPQGWKYEM

SEQ ID NO: 202021 - protein, 98 aa, Glycine max
  Coding DNA Sequence Number=SeqID_85243
  Subcellular localization annotation: CTP_CleavageSite=83; ConfidenceScore=5.06e-01
MEEHEQQEATSSLSTQAISLSRFCTALLLGYYTASMGRDIASSNRQSTWRFQCGRRKSPVSLACPPALATCPSCTKSPLPLATCMLGTCKNITPWKNV

SEQ ID NO: 202022 - protein, 183 aa, Glycine max
  Coding DNA Sequence Number=SeqID_85244
MVDYVGPVESLDASEIFLGWSLATIHHWKETMAKANNKTKTMAAKLKSMKVEVGKTKELKLELPKNQQVKDISAKVKELTSEKKIVEENLTTAKDKVADLEKKIEDLKSELRKKEEVKSTLTVKFDKAKRLIVLNHQEGFKKAQRQVKVLLPSSDFSQLDVNCDVVDGEIVRESQLCFESKGE

SEQ ID NO: 202023 - protein, 53 aa, Glycine max
  Coding DNA Sequence Number=SeqID_85245
EELKRKVDMTTLDNVELLIVEPCRTEECVFIRACKEIMNGYDYKNLKSLVVDD

SEQ ID NO: 202024 - protein, 132 aa, Glycine max
  Coding DNA Sequence Number=SeqID_85246
  Gene Ontology: Mol. function=GTPase activity
  Homolog annotation: Hit_ID=Q1SQ91; Match level="QueryCoverage=66%, HitCoverage=13%, E-value=1e-15, Identity=50%"; Hit description =Dynamin central region; Dynamin; Dynamin GTPase effector
MPPRTKSPSTSATPSLMLSVCMEGDFLLPPFGVIGSYGEDKQFAVEVISSMVFMKMCEIQLPSIVVVSDQFFGKSNVLEYLAGISLPHDQGNCIRVPLDMRLCNPPIPTPELVLEFYGKAISLTNQRETTLL

SEQ ID NO: 202025 - protein, 339 aa, Glycine max
  Coding DNA Sequence Number=SeqID_85247
  Gene Ontology: Mol. function=monooxygenase activity; Cellular component=integral to membrane; Biological process=electron transport
  Homolog annotation: Hit_ID=Q2MIZ2; Match level="QueryCoverage=91%, HitCoverage=63%, E-value=1e-106, Identity=65%"; Hit description =Cytochrome P450 monooxygenase CYP93B12
  Pfam annotation: Domain name=p450; Domain location=37-337; Score= -141.9; E_value=0.00016; Accession=PF00067.12; Description=Cytochrome P450
MISESLLLVFLIVFISASLLKLLFVRKNKPKAHLKYPPSPPAIPIIGHLHLLKPLIHHSFRDLCLRYGPLLSLRIGSVKFIVASTPSLAKEFLKTNELTYSSRKMNMAINTVTYHNATFAFAPYDTYWKFMKKLSTTELLGNKTLGHFLPIRTQEVHDFIQILFHKSKAQESVNLTEALLRLSNNVISRMMLSIKSSGTDSQAEQARALVREVTRIFGEFNVSDFLGFCKNMDLQSFRKRALDIHKRYDALLEKIISDREELRRKSKEEGCEDGGDEKVKDFLDILLDVSEQKECEVQLTRNHVKSLILASPGAAVKLCLGELLVMGSNPETASLHMQG

SEQ ID NO: 202026 - protein, 221 aa, Glycine max
  Coding DNA Sequence Number=SeqID_85248
  Gene Ontology: Mol. function=oxidoreductase activity; Cellular component=integral to membrane; Biological process=electron transport
  Homolog annotation: Hit_ID=Q9SSX5; Match level="QueryCoverage=95%, HitCoverage=40%, E-value=3e-73, Identity=62%"; Hit description =Cytochrome P450
  Pfam annotation: Domain name=p450; Domain location=1-200; Score= -134.8; E_value=7.8e-05; Accession=PF00067.12; Description=Cytochrome P450
MEKDYFTAATDTTAISVEWTIAELFNNPKVLKKAQEEVDRVTGNTQLVCEADIPNLPYIHAIIKETMRLHPPIPMIMRKGIEDCVVNGNMIPKGSIVCVNIWAMGRDPNIWKNPLEFKPERFLEGEGSAIDTKGHHFELLPFGSGRRGCPGMPLAMRELPTIIGALIQCFEWKMLGSQGEILDHGRSLISMDERPGLTAPRANDLIGIPVARLNPTPFRQM

SEQ ID NO: 202027 - protein, 99 aa, Glycine max
  Coding DNA Sequence Number=SeqID_85249
MSPSSASSSIPRATASSLKTVLPWERKIKWSKRDSVARLVNGHDEDEEHDGVVDDVGADGDAATFTTGDAAMALVADDQKREKLGRQREKICVNNFILS

SEQ ID NO: 202028 - protein, 204 aa, Glycine max
  Coding DNA Sequence Number=SeqID_85250
MVDYEYLKIVVGGGVSSGNNSISVDPDDTDATTFEPENKTVGIEEFSYDPNSDTFITPNNYEPAYQPPSPNQPSPPSHPPLDSEVPIEKQNCHKRRRSEYGGSSSAVGINNQGNVLENLSVGIETIAVNFEKISNMMEKREKDRDRDRELEGIIWDVIKEIPNLDDITRFKTAELLNTKAKKDFFLKMSPEERSSWINFKLGNN

SEQ ID NO: 202029 - protein, 832 aa, Glycine max
  Coding DNA Sequence Number=SeqID_85251
  Gene Ontology: Mol. function=anthranilate synthase activity; Cellular component=nucleus; Biological process=folic acid and derivative biosynthetic process
  Homolog annotation: Hit_ID=Q6TAS3; Match level="QueryCoverage=99%, HitCoverage=81%, E-value=1e-134, Identity=46%"; Hit description =Aminodeoxychorismate synthase/glutamine amidotransferase
  Pfam annotation: Domain name=Anth_synt_I_N; Domain location=484-668; Score=1.6; E_value=0.005; Accession=PF04715.3; Description =Anthranilate synthase component I, N terminal region
  Pfam annotation: Domain name=Chorismate_bind; Domain location=722 -832; Score=-143.8; E_value=2.6e-05; Accession=PF00425.8; Description= chorismate binding enzyme
  Pfam annotation: Domain name=GATase; Domain location=97-363; Score =33.5; E_value=3.4e-10; Accession=PF00117.18; Description=Glutamine amidotransferase class-I
  Pfam module annotation: Pfam domain module=Anth_synt_I_N::Chorismate _bind::GATase; Domain location=484-668::722-832::97-363
  Subcellular localization annotation: CTP_CleavageSite=37; ConfidenceScore=5.47e-01
MNSSLRLFSSELTCPASESTQNANVNFLLSRPSLRVSCFVKKGGDARVRVSNRDGRKTKAVVCCQLMHSHKEESDERKRRLQVVPVPVQKADFVRTLLIDNYDSYTYNIFQELSIINGVPPVVIQNDDWTWEELCHYLYKENAFDNIVISPGPGSPACPEDIDFVLQMSILGREVSVLRCPMSARNIIKILRFGQSSFLELAFVVEFDPLWVMWPYGCFNYNCKIFWNADIPGGNVAREVGICLQLLLKCWDIPILGVCLGHQALGYVHGAQVVHASEPIHGRLSEVEHNGCQLFRDIPSGKNYGFKVVRYHSLVIDSESLPAELIPIAWTSSTSTLPFIGSKDFGKSNTHEAQPDQSISIDPLLAKVGNGSSNHFDYGKTRSARVLMGIRHSTRPHYGVQVSSANRLYREVCRSISTENNAVDQLKEIVHADRHLEYNKAEMKHLEMFNMVNTHHATTGYKCLKLKWRKFGHLAGQVGGAKGIFCGLFGLEAENTFWLDSSSTEKGAKAHDYKATLRVIGRPIASLQIKGTHPEGKSTLFIYGRKRRITLEAVSVQIVPSKVLVNGFLENNWSAWVLLYASRVELDGSSKGGGYLSTEDSQGSAETIFLEEGFLDFLNRVLQTETMYNLKVECGVKSNRHKSKTPDACFFFADNLVAIDHKNDDVYILAIHEESSSITQWLNDTEEKLLSLNGSVRMALERQKSLPLTFSSCKVGFAAEKSKEQYIEDVKKCLNYIKDGESYELCLTTQIRKSIEELNSLELYLHLRERNPAPYAAWLNFSKVDLSICCSSPERFLQLDRKNILEAKPIKGTIARGATEEEDEQLKFKLQF

SEQ ID NO: 202030 - protein, 119 aa, Glycine max
  Coding DNA Sequence Number=SeqID_85252
  Homolog annotation: Hit_ID=Q1SL99; Match level="QueryCoverage=45%, HitCoverage=48%, E-value=2e-08, Identity=45%"; Hit description=Zinc finger, RING-type; RINGv
  Pfam annotation: Domain name=zf-C3HC4; Domain location=72-105; Score =5.6; E_value=0.041; Accession=PF00097.15; Description=Zinc finger, C3HC4 type (RING finger)
MSSDPAKDLAKWKLEEVISIVIVCVVFLTLSHCFGIFKHHVCGICCGRNQSLPTFQFKKNEREQDKTISVECAICLGEFEEGEWLKRLPHCSHSFHVSCIASHTLLQPLRREDFERVQR

SEQ ID NO: 202031 - protein, 286 aa, Glycine max
  Coding DNA Sequence Number=SeqID_85253
  Pfam annotation: Domain name=DUF1635; Domain location=4-238; Score =116.6; E_value=7e-32; Accession=PF07795.2; Description=Protein of unknown function (DUF1635)
MGEHELRQKLMNARHELEKMKNVKAELLDLLNMAYQERDEARCQLQKLMNPFMPSNPTHLQNVFDSQSHLMFPSAKANSSITESDNSLSHGSSQVDSFFDTVSSPEFTNVNAVDPINIMSYLNQHVVLQDFNFSAPHALMVPSEKPMCDTADAVIDCLAKDRGFPQKGKFVQAVMDAGPLLKTLLLAGPLPKWRNPPPLQNIKVPPLTIKKCDVNSIVPNTFGDTGNTLLKPQLPALHYLNATSTCSASMLNFAGQTNGSSYNTSQLNSTPGVSIQVPSSKRLRHQ

SEQ ID NO: 202032 - protein, 306 aa, Glycine max
  Coding DNA Sequence Number=SeqID_85254
  Gene Ontology: Mol. function=nutrient reservoir activity; Cellular component=protein body; Biological process=protein oligomerization
  Homolog annotation: Hit_ID=Q9SIA7; Match level="QueryCoverage=99%, HitCoverage=85%, E-value=1e-137, Identity=78%"; Hit description =Legumin-like protein
  Pfam annotation: Domain name=Cupin_1; Domain location=190-306; Score =35.2; E_value=2.3e-07; Accession=PF00190.13; Description=Cupin
  Pfam annotation: Domain name=Cupin_1; Domain location=5-157; Score =90.2; E_value=6.1e-24; Accession=PF00190.13; Description=Cupin
  Pfam module annotation: Pfam domain module=Cupin_1::Cupin_1; Domain location=190-306::5-157
MEIDLSPQLAKKVYESNGGSYHAWSPSELPMLPEGNIGAAKLALQKNGFALPCYSDSSKVAYVLQGSGVAGIVLPESEEKVVAIKKGDALALPFGVITWWYNKEDTELVVLFLGDTSKAHKTGEFTDFYLTGSNGIFTGFSTEFVGRAWDLEEKDVKTLVGKQSGKVIVKLEGNINLPEPKEEHRKGMALNCEEAPLDVDIKNGGRVVVLNTKNLPLVGEVGLGADLVRLDGNAMCSPGFSCDSAFQVTYIVRGSGRAQVVGADGCRVLETTVKAGNLFIVPRFFVVSKIADSDGLEWFSIITTPK

SEQ ID NO: 202033 - protein, 45 aa, Glycine max
  Coding DNA Sequence Number=SeqID_85255
MWVKSSTVYYLMFESIFRIDALLGGGLRGGKLTELVGSSSSGKTQ

SEQ ID NO: 202034 - protein, 143 aa, Glycine max
  Coding DNA Sequence Number=SeqID_85256
  Subcellular localization annotation: CTP_CleavageSite=10; ConfidenceScore=5.09e-01
MASAKFQEVKLQQISNPPKLVSPYPPILPTPPDFTVTKPVTTIGDHLSSTLTTHNTHISNTPSQPKQTIQRLTQAEIQAMCEKGLRFYHEKDEFACINQYYSTANIVLQSSKKLHEKMKIPLVLLILISTLRTMLKCKGGTLI

SEQ ID NO: 202035 - protein, 491 aa, Glycine max
  Coding DNA Sequence Number=SeqID_85257
  Gene Ontology: Mol. function=phospholipase A2 activity; Biological process=lipid metabolic process
  Homolog annotation: Hit_ID=O80959; Match level="QueryCoverage=97%, HitCoverage=89%, E-value=1e-159, Identity=61%"; Hit description =Similar to latex allergen from Hevea brasiliensis
  Pfam annotation: Domain name=Patatin; Domain location=77-291; Score =188.9; E_value=1.2e-53; Accession=PF01734.12; Description=Patatin -like phospholipase
MDCSNELDMQEPSIETDKLSYEIFSILESKFLFGYDDPKLWFPKQIPPKPESQTPAATAAVDCVSAVKNQRGKICILAIDGGGMRGILAGKALAYLEAALKKKSGDQNATIADYFDVAAGAGVGGIFTAMLFSTKDHRRPIFSADDTWRFLAEKGNKFYRAGGSASNRGLLKRLLSSGGSGSVSSATAGLEKAVKEAFTAENGGGSLTLKDTLKPVLIPCYDLSSTAPFLFSRADALETDSFDFRLWEVCRATSAEPGLFEPVQMRSVDGQTKCVAVDGGLAMSNPTGAAITHVLHNKQEFPFVRGVEDLLVLSLGTGQLLEVSYDFDRVKRWKAKDWARPMARISADGSSDLVDQAIAMAFGQCRSTNYVRIQLASWMSMYGGSNSIAGFGLVRGISIDERANGSSMGRCGPNVDTDSSPGNVKMLVGIAEEMLKQENVESVLFGGKRIGEQSNFEKLDWFAGELVQEHQRRSCRIAPTVAFKQATPKAT

SEQ ID NO: 202036 - protein, 66 aa, Glycine max
  Coding DNA Sequence Number=SeqID_85258
MSWVPQQELCFEQWSIIANEPPTLVHRQSWFFPSMAQIAPALFSSVINGKNCGGGYVWEQGLIYIG

SEQ ID NO: 202037 - protein, 101 aa, Glycine max
  Coding DNA Sequence Number=SeqID_85259
MKRAQINRTHVENAIEAKDRNVNETGNRNKNEIEAKDRNINETRNRNENEIKAGTEMKLKAEEEIKMKLQLEVENGKVHYENNNNKLQKCKTLNPMLRIIA

SEQ ID NO: 202038 - protein, 158 aa, Glycine max
  Coding DNA Sequence Number=SeqID_85260
MTLSSCQNKLNNKWRDHPALLLLLLLLVQHHTSTTVHHIHLCHDQVKVGVEEVRDADSPILVPTEEVQLMRQTLDTFVAWPTHLVKRLSEQGDVGLAKPPNRLDHDVDDPLYLMTLTIPQLFLKPLQVMWGAIVFGVFNDNFPLYIKHEDLSEIEHGG

SEQ ID NO: 202039 - protein, 159 aa, Glycine max
  Coding DNA Sequence Number=SeqID_85261
MCPVVGFGPWLGLGKPLVEILPPGQLRGFCPLLAWLGSAVLGYGPVLSFGLVGPLLPPVISFVARILPTLACAPLAKSVPRVVDHHVITWQDTRSHAHTHTHTHAGTRGRRGLVVRPPGHTPRFVGDLEGRDESKRQGLNLSGSWQQGHSATYNTPSRI

SEQ ID NO: 202040 - protein, 349 aa, Glycine max
  Coding DNA Sequence Number=SeqID_85262
  Gene Ontology: Mol. function=hydrolase activity, acting on ester bonds; Cellular component=cellulose and pectin-containing cell wall; Biological process=lipid metabolic process
  Homolog annotation: Hit_ID=Q9FLN0; Match level="QueryCoverage=90%, HitCoverage=90%, E-value=1e-75, Identity=45%"; Hit description=GDSL -motif lipase/hydrolase-like protein
  Pfam annotation: Domain name=Lipase_GDSL; Domain location=36-330; Score=115.7; E_value=1.3e-31; Accession=PF00657.12; Description=GDSL- like LipaseAcylhydrolase
MASPKFSFCFLVLFVSSYGITCCLGDIWHPKEHAALFVFGDSLFDVGNNNYINTTADNQANYSPYGETFFNYPSGRFSDGRVIPDLIDTLMESILHQQELGLWLKPIKDWSAVIDLKTQLSYFKKVSKILSQELGDAETTTLLAKAVYLINIGSNDYLVSLTENSSVFTAEKYVDMVVGNLTTVIKGIHKTGGRKFGVLNQSALGCIPLVKALLNGSKGSCVEEASALAKLHNGVLSVELEKLKKQLEGFKYSYVDFFNLSFDLMNNPSKYGLKEGGMACCGSGPYRRYYSCGGKRAVKDYELCENPSDYVFFDSIHPTERFNQIISQLMWSGNQSIAGPYNLKTLFEE

SEQ ID NO: 202041 - protein, 86 aa, Glycine max
  Coding DNA Sequence Number=SeqID_85263
  Gene Ontology: Mol. function=transferase activity
SFVSGLRVVDPISRSLKLYGDNSVAIFMAKNNKNRSRNKHINIKYLAIREHVKEKKVNFEHISIELMIADHLTKDMPPKYFKDHVM

SEQ ID NO: 202042 - protein, 82 aa, Glycine max
  Coding DNA Sequence Number=SeqID_85264
MSSDAILPRKGPITRAMATRLQEDWVRGAGEGPRVLTSLKSHLQSPFLLFHFAIIVLQEAKDFIDEEDPRPTSSTWSYIIKA

SEQ ID NO: 202043 - protein, 268 aa, Glycine max
  Coding DNA Sequence Number=SeqID_85265
MDVVLTMGGEDINSVDETKPTEETITTGNTIKTEEALEKHGGTGFGSRIRRKSKYMCHPYINIEPKKKHLSIEREDLRTHGSSSYSKLCRKRFRKNWNRKFIHNSNIFTSPELINASAARLLSGLRSAAVDCTFPMGNKSFNLVEQFFGRYRISIYHDEAELASSLVNAKEEEMGKAADSDDSVSPEMVKKLKLKEKVEEVTSVHQPQSVDTNLNEGLEEHHQSAQITIELPDLNATVTECNSNSIGFHTPNSNMELEIPDLNAPYAE

SEQ ID NO: 202044 - protein, 350 aa, Glycine max
  Coding DNA Sequence Number=SeqID_85266
  Homolog annotation: Hit_ID=Q1SVK0; Match level="QueryCoverage=96%, HitCoverage=89%, E-value=4e-54, Identity=43%"; Hit description=CCT
  Pfam annotation: Domain name=CCT; Domain location=308-349; Score =50.1; E_value=7.6e-12; Accession=PF06203.4; Description=CCT motif
  Subcellular localization annotation: CTP_CleavageSite=71; ConfidenceScore=5.91e-01
NSPSSSDIQTTSIMKRTRKPNRRYYHNSSSSSSSSSSTTSFKLHRRGNRTKTRKPKFVSLKLQLSEPKKKMASTKPKPKPKAEQLQQQQQLQQQQQQQQPQLNLFPLHPDHHDMHEEQNMALLFSSDGGATLNGLLEEGSTTTTTTSVLTCPAEDTGNWLVRKAMRRRESEEGSEERWVCYSEVVEEKKEAMEEVTSYSVKGETKTTSFGFGLLSLKLDHQGILNAWSDKGSLYVAGEEEGALQTVPDIFNGFLFHNAVAPHVAWDGWGSGGVVGNAWSVHEECGANKANVKEETSWKLAQREASVQRYKEKRQSRLFSKRIRYEVRKLNAEKRPRMKVLLPTFVKGAIV

SEQ ID NO: 202045 - protein, 63 aa, Glycine max
  Coding DNA Sequence Number=SeqID_85267
MSGRILIDVRFCKSYKGSRTMVGDEAYGDHPKVIEIFMESSHVDIAYEIEVLQIDIDLLSGVI

SEQ ID NO: 202046 - protein, 81 aa, Glycine max
  Coding DNA Sequence Number=SeqID_85268
MRNPFVAVGKVCGHRELKGEGLVSAPSGHPHPFEENRVKDCGEEREGLGGAGGSPEVLWRYCLVAVVVEVEPFLFLDGSII

SEQ ID NO: 202047 - protein, 129 aa, Glycine max
  Coding DNA Sequence Number=SeqID_85269
MDLERSDFASISGTLYVQHGAHQSMHPKQQNTHQSEPACHPTALKVFACQMQMVFIMVVVELSNMGPSAPPVAIATMPQTTAFQPVPPQLAPPKHTDSALGNGCGNQHDHGQMITTLPDDGCGQPRGLW

SEQ ID NO: 202048 - protein, 230 aa, Glycine max
  Coding DNA Sequence Number=SeqID_85270
MEQKYGLCKEISMGPNHNLEVEEEALWKGGNVKDDKFRAGQRRKGCNRDVFVLAPSDKDVKGSVATYPSAGERRGAHGCVFQERKMRGVATNAYLRKTSEKPEKEKKGRWLPPSLPKRAQLTQASRVASTRRYRLLLEPPEGPNYLMMGVKYLEAVKRRLHATKQWSPDEIKRSKDKTLILFERNIIRPVNILTSETYHSEGKKWHQKRQQNFSVLKAIKWDNHDISPRH

SEQ ID NO: 202049 - protein, 245 aa, Glycine max
  Coding DNA Sequence Number=SeqID_85271
  Gene Ontology: Mol. function=transporter activity; Cellular component= integral to membrane; Biological process=transport
  Homolog annotation: Hit_ID=Q39883; Match level="QueryCoverage=99%, HitCoverage=98%, E-value=1e-117, Identity=86%"; Hit description =Nodulin-26
  Pfam annotation: Domain name=MIP; Domain location=13-227; Score =367.3; E_value=2.5e-107; Accession=PF00230.10; Description=Major intrinsic protein
MPISRIAIGNPSEFGQADALKAALAEFISMLIFVFAGEGSGMAYNKLTDNGSATPAGVVAASLSHAFALFVAVSVGANISGGHVNPAVTFGAFIGGHISLLRGILFWIAQLLGSVVACLLLKFATVGLSPGVGAANALVFEIVMTFGLVYTVYATAVDPKKGKLGIIAPIAIGFIVGANILAGGTFSGASMNPAVSFGPAVVSGTWANHWVYWAGPLIGSAIAAVVYETFFITPNSYEQLPVTDY

SEQ ID NO: 202050 - protein, 66 aa, Glycine max
  Coding DNA Sequence Number=SeqID_85272
DWGGVRRRGWGQAPGCPALAVAPAAGAPPVVPDPWALPKAPASGALPPCATCHVHSGGARVGGALQ

SEQ ID NO: 202051 - protein, 88 aa, Glycine max
  Coding DNA Sequence Number=SeqID_85273
MSRVVNNSMTWSPPQEHFIKVNIDATVVPKSFFARLDFCSIITQAELLGIFNGLARGASNKSFSNLTPSLRSDLITKAVVRIIPVIPL

SEQ ID NO: 202052 - protein, 114 aa, Glycine max
  Coding DNA Sequence Number=SeqID_85274
  Subcellular localization annotation: CTP_CleavageSite=26; ConfidenceScore=5.40e-01
MPIFATYPTTGMQAKSQKSVFQKGKRVGVATNVYSRKTIEKPKRKGLRILKRGVLALLPGILRCDEEFRPTKFFKSESRPGELKLNLAAVSSPKRAGFFTKKLFGGPGEPKASL

SEQ ID NO: 202053 - protein, 105 aa, Glycine max
  Coding DNA Sequence Number=SeqID_85275
MTKARQKGVRKVNETKIKVRETNGDHQGKIGEDLPHSSPRRARLLPPEATAFWRNILEGPNSVTMLPFDLRLVTELHILCNKGCQAPRSGQTKVTCHETMVPGRN

SEQ ID NO: 202054 - protein, 449 aa, Glycine max
  Coding DNA Sequence Number=SeqID_85276
  Homolog annotation: Hit_ID=Q945F5; Match level="QueryCoverage=94%, HitCoverage=96%, E-value=1e-102, Identity=50%"; Hit description =Auxin-regulated protein
  Pfam annotation: Domain name=DUF966; Domain location=39-418; Score =548.7; E_value=6e-162; Accession=PF06136.4; Description=Domain of unknown function (DUF966)
GRITTELQVPKKWTERETSPERTKVWAEPKPKPKTPRKVSVVYYLSRNGQLEHPHFMEVPLSSPHGLYLKDVINRLNALRGKGMATLYSWSAKRSYKNGFVWHDLSENDFIYPTTQGQDYILKGSEIVEHNVTGAGARVNKSEEESDSPVVITRRRNQSWSSIDMNEYRVYKSESFGDSAGRIGADAATQTEEKRKRRRAGREGEAVEIQEKNDGIEAGMEGERVAHVTCDDDNNNHTTELSREEISPPPSDSSPETLETLMRADGRLGLRSSESEKENLTVESCPSGRTRASSVLLQLLSCGAVSFKECGANAVKDQGFSLVGHYKSRMPRGAGNHSGNETGTSMEIPDLSRVRLEDKEYFSGSLIETKKVETPALKRSSSYNADSLGLSIVSSPCSGSRLQIVEHEGEAVRAKCIPRKSKTLPTKKEEGVSMHIVADSGEEGKSLEM

SEQ ID NO: 202055 - protein, 136 aa, Glycine max
  Coding DNA Sequence Number=SeqID_85277
  Gene Ontology: Mol. function=RNA-directed DNA polymerase activity; Biological process=RNA-dependent DNA replication
  Homolog annotation: Hit_ID=Q1RTD3; Match level="QueryCoverage=96%, HitCoverage=22%, E-value=3e-15, Identity=33%"; Hit description=IMP dehydrogenase/GMP reductase
MEKKVKGNGFIYLEGTWAGDVGKVTIVNIYSPCDTTFKRILWDQARQLRAANNGERVGVCQRLQGGGSQKEFNDWITDLKVEDVPSVGRKFTWNRPNGTAKRKIDRILVSAEWFSKWQDNIQLILDRNFYDHCPIL

SEQ ID NO: 202056 - protein, 338 aa, Glycine max
  Coding DNA Sequence Number=SeqID_85278
MTNVLIHPTTCPSWASESGVSEMRKDCGLVGYDRRRASSPPISLALPSGNKGICMVSRIERMTGGVFKSVEGGGVEEGLVGSGMGVKWYKADMLCVCAKRLSCWAETCDNISTTERQTIKVKDEGVALQLKRYAEGGGIAPQVVGAPTVNQDNHSMMGDGVVETKWEPGSRSIRGRGSGGGLASNGSRVEGSAFGLTIMRAMSLEDNLLKGSYGAEGSAGNGGGTGEFQGGLKDAKKAAKPGPCDAILRGDWTRSRRPVDHRRKTGQNETPMPRASPTMRCGGEGRKVYKDGINFRIEGGLGLGKGGLCLGEAVNGGLTRAMLRHGRQQVGLVVRTID

SEQ ID NO: 202057 - protein, 156 aa, Glycine max
  Coding DNA Sequence Number=SeqID_85279
  Gene Ontology: Mol. function=nucleic acid binding; Cellular component= intracellular; Biological process=regulation of transcription
  Homolog annotation: Hit_ID=Q4FH86; Match level="QueryCoverage=99%, HitCoverage=100%, E-value=8e-41, Identity=58%"; Hit description=C2H2 transcription factor
  Pfam annotation: Domain name=zf-C2H2; Domain location=81-103; Score =17.0; E_value=0.067; Accession=PF00096.16; Description=Zinc finger, C2H2 type
MKRGRDKESEVGMANCLMLLTKVGETETPSRERVLSCGDFRCKTRNRKFHSFQALGGHRASHKKLKLMASNLSCSMAQKKHQCPICGLEFGIGQALGGHMRKHRSASLNEGLITHDHAVPTSNGAERLRLCLDSNLGPYENDLNLILRTPVLNLFI

SEQ ID NO: 202058 - protein, 302 aa, Glycine max
  Coding DNA Sequence Number=SeqID_85280
  Homolog annotation: Hit_ID=Q1S7C5; Match level="QueryCoverage=39%, HitCoverage=13%, E-value=2e-18, Identity=34%"; Hit description =Integrase, catalytic region
DRDAGIENPAFEVWEQQDQVLLTWLQSKLSTSILSRVLGCAHSYEIQATSNSLALVGSLIMLQEHVDSILEGLLSDYHPIIVIIESNFEPQPIEQVGVLLLAHEARLNKILKASLTFVVDLVTAAVSMVVSTTAVVGASGGGGCGHGGGRGGGRFSNFQCQNYGPQNQYNATSGQSNPNSNSRQQYGDYHPSNEILRTFSSLNPLKDLTKSSLGNGQGLPISSSGLAKGNVGPDDLYNFSNIQLQHPLSTSVLACVSNPEKCLGKSHRLPSSSSSSSSSSSSESVYTFPLELVHSDLWGPSH

SEQ ID NO: 202059 - protein, 184 aa, Glycine max
  Coding DNA Sequence Number=SeqID_85281
  Gene Ontology: Mol. function=zinc ion binding; Cellular component =nucleus; Biological process=chromatin modification
  Homolog annotation: Hit_ID=Q1SPG2; Match level="QueryCoverage=94%, HitCoverage=16%, E-value=1e-81, Identity=80%"; Hit description=PWWP; Nuclear protein SET; Zinc finger, RING-type; Protein kinase C, phorbol ...
  Homolog annotation: Hit description=ester/diacylglycerol binding; SET- related region; Zinc finger, FYVE/PHD-type
  Pfam annotation: Domain name=PHD; Domain location=61-110; Score=37.9; E_value=3.5e-08; Accession=PF00628.19; Description=PHD-finger
MTVEVSNHPLSRLMLQVAEFHANAVVSVKPKKPSFKERKQKLLTFLQEKYEPVCAKWTTERCAVCRWVEDWDYNKIIICNRCQIAVHQECYGARNVQDFTSWVCKACETPDIKQECCLCPVKGGALKPTDVDTLWVHVTCAWFRPEVSFASDEKMEPALGILSIPLNSFVKVGVLVTTFSCLFQ

SEQ ID NO: 202060 - protein, 49 aa, Glycine max
  Coding DNA Sequence Number=SeqID_85282
MGRLGIHNKSYHIMSMSVMVTPFCDNTPTIWDQHRLKGALKLSVFTPKA

SEQ ID NO: 202061 - protein, 86 aa, Glycine max
  Coding DNA Sequence Number=SeqID_85283
ENRGGACHSARPGEPGCFFQKQPPSGGTSWKAHVGPKLTDCVTMLPFDLRHVMEFHGLCNNGCKIPRSGIRKLHVTKQWSPDEIRV

SEQ ID NO: 202062 - protein, 146 aa, Glycine max
  Coding DNA Sequence Number=SeqID_85284
  Gene Ontology: Mol. function=oxidoreductase activity; Biological process=metabolic process
  Homolog annotation: Hit_ID=Q3VTK7; Match level="QueryCoverage=76%, HitCoverage=29%, E-value=8e-10, Identity=35%"; Hit description=Short- chain dehydrogenase/reductase SDR
MDALIWYSWLGGVIIGTMIGANMVLEEHCRAGPRNVVITGSTRGLGKALAREFLLSGDPFIYALLTTCRCRAPALSFCEDSPESVQATIKELEENLKEGIANAVGSSLTKLSHAKVVGIACDVCEPHDVQRLANFAVKELGHIDIW

SEQ ID NO: 202063 - protein, 222 aa, Glycine max
  Coding DNA Sequence Number=SeqID_85285
MVIDQSLFYDLTQLSSEGVPFEGTLDDDWKFDFSMHDARRLVCTNQADMTGRLLAGLLALENRSKTSSMNLSKESKKDIDYPWKQDIIGDPTTNVITNWQTKDGELIQSELPPTTQYQLPRIKDNNDKHVMASPFKAKDVNEEVTSKDIKSLMEQENYTNKYLQVLGESIKTKVVPKHKSVEEASSSIPIEKPLFKPSKISDKAKRKIRELRKKQVLNRRSR

SEQ ID NO: 202064 - protein, 77 aa, Glycine max
  Coding DNA Sequence Number=SeqID_85286
MVPRMSSGSPPLDDKGADDHNLSLCVNGLTCLWCGTIRFPRMSSGPPPLDDKGADDHNLSLPVNELACLWLTKGAGP

SEQ ID NO: 202065 - protein, 568 aa, Glycine max
  Coding DNA Sequence Number=SeqID_85287
  Homolog annotation: Hit_ID=Q9FNA6; Match level="QueryCoverage=83%, HitCoverage=97%, E-value=2e-50, Identity=29%"; Hit description =Arabidopsis thaliana genomic DNA, chromosome 5, P1 clone:MSH12
MTLGTSDEKWTLTLGKSNSYCEVYDSLHTWCQSMRCPANCNIPGCVTQSLEFELDLTQFQKLAHEMRIVQAFSLQNKGFWMVKGSGQINDRETIFDNPTKIEPKRPHQWFVDAAEVDFFPNKKQAVEDADEKSSPGFSNVNIPPWENNPNFHSVPNQFIGRLFGSETRPVNFTEKNTSYVLADDSNVRSKMITNQYGDDASFGLSISHSIEDSEACVNFGGIKKVKVNQVKEDDIQALEGHNFGRPNNGNLHQAYNREVETRSASIGQAFDRDGDASLMGLTYSKGDAHVRSFSAPFVKGDDSIVSISESYNKEDTNIISFGGFPDERDIISVGRPAAEYDQLYNQSSVHGSTTAHEKELDVSSSDAVASTLQVAKVKSETVSKNKQELKTAKNEAPNSFPSNVRSLISTGILDGVPVKYISVSREELRGIIKGSGYLCGCQSCNYTKVLNAYEFERHAGCKTKHPNNHIYFENGKTIYQIVQELRSTPESLLFDTIQTVFGAPIHQKAFRNWKGNGNLLSTVHANTFTFVWYVTYPNFFISCQLYPESFQAATRELQRIYGKEELNL

SEQ ID NO: 202066 - protein, 118 aa, Glycine max
  Coding DNA Sequence Number=SeqID_85288
  Gene Ontology: Mol. function=nucleotide binding; Cellular component =membrane; Biological process=small GTPase mediated signal transduction
  Homolog annotation: Hit_ID=Q39433; Match level="QueryCoverage=90%, HitCoverage=49%, E-value=1e-52, Identity=95%"; Hit description=Ras -related protein RAB1BV
  Pfam annotation: Domain name=Ras; Domain location=5-108; Score=104.9; E_value=2.3e-28; Accession=PF00071.12; Description=Ras family
MEIPLGELGFGAYYRGAMGILLVYDVTDEASFNNIRNWIRNIEQHASDNVNKILVGNKADMDESKRAVPTSKGQALADEYGIKFFETSAKTNLNVEEVFFSIARDIKQRLADTDTKAE

SEQ ID NO: 202067 - protein, 36 aa, Glycine max
  Coding DNA Sequence Number=SeqID_85289
MGNSNQNPKQECVANYLNFICAFNMQINRFFQIDLK

SEQ ID NO: 202068 - protein, 424 aa, Glycine max
  Coding DNA Sequence Number=SeqID_85290
  Gene Ontology: Mol. function=zinc ion binding; Cellular component =nucleus; Biological process=chromatin modification
  Homolog annotation: Hit_ID=Q1SPG2; Match level="QueryCoverage=97%, HitCoverage=50%, E-value=1e-114, Identity=48%"; Hit description =PWWP; Nuclear protein SET; Zinc finger, RING-type; Protein kinase C, phorbol ...
  Homolog annotation: Hit description=ester/diacylglycerol binding; SET- related region; Zinc finger, FYVE/PHD-type
  Pfam annotation: Domain name=PHD; Domain location=320-377; Score=7.4; E_value=0.01; Accession=PF00628.19; Description=PHD-finger
  Pfam annotation: Domain name=PWWP; Domain location=178-257; Score =8.5; E_value=0.0019; Accession=PF00855.8; Description=PWWP domain
  Pfam module annotation: Pfam domain module=PHD::PWWP; Domain location= 320-377::178-257
MIIKRNLKSQMPSLKRRRLGDAAGEDDGDECTAERKKRRKTSGYCYPLNLLVGVIPASFSGLLGAPEKGCQVAASSEGGKKNGSRPPALVRTSRGRVQALPSRFNDSVIEDWRKDSSKVEVECELDEEFESVKKSRKGKINNKGRGYSTLCEEVLLKNFDDASKEEKKKKEGLYEPEDFYAGDIVWAKAEMKEPFWPAIVIDPICQAPELVLKSCIPDAACVMFLGSAGSGNERDYAWVKYGMIFPFMDHVDRFQGQSDLGCYNYNPSEFQISIEEAFLADQGFTEKLIADINTAAGRTGCGDSVLKGFQKVTASNQNAACHFLNQDLFDKKKDMRSCEVRCDGCKVWVHAECDKISSNLFKNLGGSDYFCPTCKIKFDFELTDSEKSQPIVKWKKNSGQLVLPNKVTVLCNGMEGTYFPSLHL

SEQ ID NO: 202069 - protein, 68 aa, Glycine max
  Coding DNA Sequence Number=SeqID_85291
  Homolog annotation: Hit_ID=Q9SKM7; Match level="QueryCoverage=86%, HitCoverage=82%, E-value=5e-07, Identity=49%"; Hit description =Expressed protein
MISILSQERLLGASLGVVLTGVVVFEQRRYIYASISDSQSQFGECKNTSFGAELSNKKMDGKGGEFNH

SEQ ID NO: 202070 - protein, 214 aa, Glycine max
  Coding DNA Sequence Number=SeqID_85292
  Homolog annotation: Hit_ID=O49118; Match level="QueryCoverage=44%, HitCoverage=66%, E-value=9e-45, Identity=96%"; Hit description =Histone H2B
  Pfam annotation: Domain name=Histone; Domain location=121-191; Score =105.7; E_value=1.3e-28; Accession=PF00125.14; Description=Core histone H2AH2BH3H4
MEGDDIKKTHVIDLRQPPPANKKRKRFSILIIAAIHSHSQLQSLFALANSNSQSKTLISFKEPIVMAPKAEKKPAEKKPAEEKKSTVGDKAPAEKKPKAGKKLPKEGGAGGEGGKKKKRNKKSVETYKIYIFKVLKQVHPDIGISSKAMGIMNSFINDIFEKLAQESSRLARYNKKPTITSREIQTAVRLVLPGELAKHAVSEGTKAVTKFTSS

SEQ ID NO: 202071 - protein, 104 aa, Glycine max
  Coding DNA Sequence Number=SeqID_85293
  Homolog annotation: Hit_ID=Q9FI01; Match level="QueryCoverage=47%, HitCoverage=11%, E-value=4e-11, Identity=64%"; Hit description =Arabidopsis thaliana genomic DNA, chromosome 5, P1 clone:MGN6
MVPGGGWEVADEDGGVVVEESGDWGKKGGGRVVTVPDADVGVVDPLQGGEGVGYGVADGEGPERRFPKTQIGQFMPRQSSCCHKLSKFEERERKRITREREGEV

SEQ ID NO: 202072 - protein, 193 aa, Glycine max
  Coding DNA Sequence Number=SeqID_85294
  Homolog annotation: Hit_ID=Q9FJE0; Match level="QueryCoverage=70%, HitCoverage=53%, E-value=1e-54, Identity=69%"; Hit description =Arabidopsis thaliana genomic DNA, chromosome 5, P1 clone:MMN10
MYRIDIQTNTRRFQSLFRAQRDTYLMLSRFILFYNKADKIDGFLKQCPAFPTAFLVGGPADILVTELTDQLQKLKVEPVLLHYLSEIKILQGLELRMTTSTRLKTCLYSFTSPGGPMYPTRAVRHAARESLDLLFPVGRYPRHLISLFFRLLYPWYWPSSCWNFVVSCIQAIFYSVLGFIFSTRNKIAKPKSQ

SEQ ID NO: 202073 - protein, 61 aa, Glycine max
  Coding DNA Sequence Number=SeqID_85295
MKCVERNVEKKKESWMRRCGVFLDNENNLRWWRGNVEFVSFLLTLLLLLNCRFSTDMVNRY

SEQ ID NO: 202074 - protein, 286 aa, Glycine max
  Coding DNA Sequence Number=SeqID_85296
  Gene Ontology: Mol. function=RNA-directed DNA polymerase activity; Biological process=RNA-dependent DNA replication
  Pfam annotation: Domain name=AT_hook; Domain location=184-196; Score =14.9; E_value=0.061; Accession=PF02178.9; Description=AT hook motif
MFPLCAGVGTVSDTLTPLQLPCLSFINYLTHTRKHLWHLEPEQMNTGEALLDYQDELQITAKSYESLNFKAPGVLCDAKVPIKLKGKFYRTTVRPVILYRTECWAVKSQHENKVGVAEMRMLRWMCGKTRQDKIRNEAIRERVGVAPIVEKMVENRLRWFGHVERRPVDSVVRRVDQMERRQTIRGRGRPKKTIREVIKKDLEINGLDRSMNLGGCGTVDVRSEEPRTTAEVFLNWNTFCNFLEPWTVNIQGAKNKKCLGERIDKQERQRRKREEQGMEMNNEEHE

SEQ ID NO: 202075 - protein, 156 aa, Glycine max
  Coding DNA Sequence Number=SeqID_85297
  Homolog annotation: Hit_ID=Q1T493; Match level="QueryCoverage=61%, HitCoverage=18%, E-value=4e-12, Identity=35%"; Hit description =Nucleic acid-binding, OB-fold, subgroup
MARIADKIKTINGSKETLKLSGDQIHVVCKQDQLKAWKMDLNEGCSYVMHNFKVTKNDGQYRVCDHPYKLTFIGVTVVRQCGLDGLPLKKYRFVDFLDIIAGQLQFALLVDIIGVVDEVVFHHISPRSKRVVFKLMNLRLLELGIEIRSVLTRRSQ

SEQ ID NO: 202076 - protein, 182 aa, Glycine max
  Coding DNA Sequence Number=SeqID_85298
  Gene Ontology: Mol. function=metal ion binding; Cellular component =integral to membrane
  Homolog annotation: Hit_ID=Q7EYM0; Match level="QueryCoverage=81%, HitCoverage=61%, E-value=2e-53, Identity=63%"; Hit description=Zinc finger protein family-like
MVSFGRLPFLPLMLTFWLIFTASYCKWMCRASDFPREYDGTCLQMRMSYSPAAHLFLFFVQWTDCNLAGALGLLRILIYKVYVDGTTTMSTLERKASIREFYAIIYPSLVQLQESVADTEDKKQKAVCMERYRKRDDEEHRQPSDIDIEREEECGICMEMNSKIVLPDCNHVMCLTCYHECD

SEQ ID NO: 202077 - protein, 122 aa, Glycine max
  Coding DNA Sequence Number=SeqID_85299
MENHRFIGKSDSAKARSKRKRVRQQKVHLDVQHSVHASFNPTSSHTEDDYNQPKTPPHSVHATANRAPHDAKDHCALSKLTFLYLYIQLISVNNVDTISIYSLLLKVNICDSSENETSGSAE

SEQ ID NO: 202078 - protein, 179 aa, Glycine max
  Coding DNA Sequence Number=SeqID_85300
  Gene Ontology: Mol. function=binding
  Homolog annotation: Hit_ID=Q1T2K1; Match level="QueryCoverage=48%, HitCoverage=10%, E-value=8e-09, Identity=37%"; Hit description =Tetratricopeptide-like helical
  Pfam annotation: Domain name=PPR; Domain location=81-115; Score=30.1; E_value=7.9e-06; Accession=PF01535.11; Description=PPR repeat
MGGAVEVVATHDSGFDVVLFGSGDGQSSAKNTKTLHAHLLITRDLQSNIFLMNSLLDLYCKSTDMVVSRKLFDTTALPNLVSWNIMISGFDHNQMFEKSLKMFCRMHLLGVEPMSLVIGVFFRPLVLCELQYFANKVDQGFGGGDHGEEEFWEDHDSVLHHAIPNSEKGRRESTEKGLS

SEQ ID NO: 202079 - protein, 108 aa, Glycine max
  Coding DNA Sequence Number=SeqID_85301
MMFQETRFGRAVVSNNLRETTISVDLQYKSSKEFIKKILDCKSRVISKWACKVFVFLALDCLENLLGKREEINKGETEVWQRSRFAPVEKHRSGDGSLLMKLLCRLDL

SEQ ID NO: 202080 - protein, 272 aa, Glycine max
  Coding DNA Sequence Number=SeqID_85302
  Gene Ontology: Mol. function=allantoinase activity; Cellular component=mitochondrion; Biological process=purine base metabolic process
  Homolog annotation: Hit_ID=Q6S4R9; Match level="QueryCoverage=99%, HitCoverage=49%, E-value=1e-108, Identity=73%"; Hit description =Allantoinase
MDQFLWRVLPLLTILVSFGVFFYLQDSYTAQLFPLIKLPRDKCSLLPHRHFWISSKRIVTPQGIISGSVEINDGKIISVVEGHAIQGKPKQEEVIDYGDAVIMPGLIDVHVHLNEPGRTEWEGFDTGTRAAAAVWFICTLNRSVPTLSTGGVTTVVDMPLNCYPTTVSKEKLKLKLDAAEDKIYVDVGFWGGLIPENALNTSILDGLLSAGVLGVKSFMCPSGIDDFPMATIDHIKAGLSVLAKYRRPIVVHAADSQDFENHLELNEDNLDP

SEQ ID NO: 202081 - protein, 487 aa, Glycine max
  Coding DNA Sequence Number=SeqID_85303
  Gene Ontology: Mol. function=allantoinase activity; Cellular component=mitochondrion; Biological process=purine base metabolic process
  Homolog annotation: Hit_ID=Q6S4R9; Match level="QueryCoverage=98%, HitCoverage=100%, E-value=0.0, Identity=83%"; Hit description =Allantoinase
  Pfam annotation: Domain name=Amidohydro_1; Domain location=76-427; Score=66.1; E_value=1.2e-16; Accession=PF01979.10; Description =Amidohydrolase family
  Pfam annotation: Domain name=Amidohydro_3; Domain location=76-425; Score=-49.0; E_value=0.00024; Accession=PF07969.2; Description =Amidohydrolase family
  Pfam module annotation: Pfam domain module=Amidohydro_1::Amidohydro _3; Domain location=76-427::76-425
MVEIVRNGAVCMEGVAFTHNPHVFSSILLLAGFLQGPFTSSRKVEINEGKIISVIKGYSKQGKSKQEKIIDYGGAVVMPGLIDVHVHLDEPGRTAWEGFDTGTRAAAAGGVTTVVDMPLNNHPTTVSRETLKLKLEAAENKIYVDVGFWGGLIPENAHNTSILEGLLSAGVLGLKSFMCPSGISDFPLTTIHHIKEGLSVLAKYRRPLLVHSEIQQHSKKHLELNDKGGPRAYLTYLHTRPPSWEEAAIKELVGVTKDTRKGGPLEGAHVHVVHLSDSSASLDLIKEAKRRGDSISVETCPHYLAFSSEEIPNGDTRFKCSPPIRDAYNREKLWEAVLEGHIDLLSSDHSPTVPQLKLLEEGDFLKAWGGVTSLQFDLPVTWSYGKKHGLTLEQLSLLWSKKPATFAGLESKGAIAVGNHADIVVWKPEVEFDLNEDYPVFLKHPSLSAYMGRRLSGKVLETFVRGNLVFKKGKHAPSACGVPILAK

SEQ ID NO: 202082 - protein, 245 aa, Glycine max
  Coding DNA Sequence Number=SeqID_85304
  Gene Ontology: Mol. function=allantoinase activity; Cellular component=mitochondrion; Biological process=purine base metabolic process
  Homolog annotation: Hit_ID=Q6S4R9; Match level="QueryCoverage=82%, HitCoverage=39%, E-value=1e-103, Identity=90%"; Hit description =Allantoinase
MTLKMFWNILREPSRMKNQSTLYFSREEAAIKQLVSVTKDTRKGGPLEGAHVHIVHLSDSSASLDLIKEAKSHGDSISVETCPHYLAFTSEEIPNGDTRFKCSPPIRDAYNKDKLWEAVLEGHIDLLSTDHSPTVPELKLMEEGDFLKAWGGISSLQFNLPVTWSYGKKYGLTLEQLSLLWSKKPATLAGLESKGTIAVGNHADIVVWQPELEFDLDDDYPVFIKHSLIRKIDARGTKLFLPLLL

SEQ ID NO: 202083 - protein, 234 aa, Glycine max
  Coding DNA Sequence Number=SeqID_85305
MAYTDFQQPNITNNATNRLRGKGHLQWRRRRRRQLSCGYWRHEQPQRHSDENKRRSKKKKRVWKCTSISGSVQSNCAFDGLPMLHSSTRSSFTVPNHSEFVSLFDRSSSEFSMGRCKGSHIGPSTLQRLGEVIILLELVVPSITMMVELVRIQYKLVKDFMRFKTSGFEDCESNFHEVDLESIFGRCFLTTRLRCIGRFYQLNDLLSYPNFVRGPLLDDMRPFFGPCEVLGTHH

SEQ ID NO: 202084 - protein, 43 aa, Glycine max
  Coding DNA Sequence Number=SeqID_85306
MTEERSMLLNLKPNEGGVFVFGGMCKEKITSIEKMRDGFGKKT

SEQ ID NO: 202085 - protein, 45 aa, Glycine max
  Coding DNA Sequence Number=SeqID_85307
MVVDTVSMAAMEAEDGDGTAQNGEQRKKRKNGAQAMVLDAPSNAH

SEQ ID NO: 202086 - protein, 67 aa, Glycine max
  Coding DNA Sequence Number=SeqID_85308
MGQVKAWKGVGVGGVRRVMEGAWVKEGVVMLVVVHLVMVVGLRVEVAVGEIYGGCRDSGGGGVHWRV

SEQ ID NO: 202087 - protein, 178 aa, Glycine max
  Coding DNA Sequence Number=SeqID_85309
  Homolog annotation: Hit_ID=Q9LJR1; Match level="QueryCoverage=79%, HitCoverage=86%, E-value=1e-53, Identity=70%"; Hit description =Arabidopsis thaliana genomic DNA, chromosome 3, TAC clone: K7L4
  Subcellular localization annotation: CTP_CleavageSite=66; ConfidenceScore=5.06e-01
MQLSLLVKVQLVENDRLRNGNREALTALRKRARTTKSSVPSPFESIMKGVAGSSSRPLVQEVCTTCGKHDSSEQTWMMFPGTDLFARIPFHAAHTILETDQTQLDFESKRLQSIVKEKSYIISEAGVLADKISPGVLKSLVSLNDKPNINWVENGKCFLEVFLEAFRLRLIYSVAVIV

SEQ ID NO: 202088 - protein, 161 aa, Glycine max
  Coding DNA Sequence Number=SeqID_85310
  Gene Ontology: Mol. function=transcription factor activity; Cellular component=transcription factor complex; Biological process =regulation of progression through cell cycle
  Homolog annotation: Hit_ID=Q1SSF0; Match level="QueryCoverage=79%, HitCoverage=34%, E-value=8e-41, Identity=66%"; Hit description =Transcription factor E2F/dimerisation partner
MTSYLYLLFSQNQEIIAIKAPKASCIEVPDPDEELGFRQRQYKMIVRSAIGPINLYLLSKDDRKFEDDSANRMKLMDPSWNSDSIRKRGVGLLESQHDEKKNPSERFSLQGSQAFGIQEITPTDFEMEDDYWFQSDPGVIRKHFPLMDQVDLENAYRSPDP

SEQ ID NO: 202089 - protein, 41 aa, Glycine max
  Coding DNA Sequence Number=SeqID_85311
MDENMKQFQKKLTELEVEAEHILLARHQRSYSAHTFLKFSD

SEQ ID NO: 202090 - protein, 211 aa, Glycine max
  Coding DNA Sequence Number=SeqID_85312
  Gene Ontology: Biological process=intracellular signaling cascade
  Homolog annotation: Hit_ID=Q10MX4; Match level="QueryCoverage=55%, HitCoverage=27%, E-value=9e-31, Identity=52%"; Hit description =Expressed protein
MKYPRGKLPLPIIVITTCVLVFVAILYVERLSFLSSKSIFKFKPCPRKTTKTKSSDKKADEEVGVVNASTWIDDRFDFDPEECNVANGKWVFNHSIKPLYSDISCPYIDRQFSCVKNGRNDSDYHHWEWQPEDCTLPRFNPELTLRKLQGKRLLFVGDSLQRNQWESFVCLVEWVIPHKHKSMQLGRVHSVFTAKHIGGECLGHKLQICKS

SEQ ID NO: 202091 - protein, 217 aa, Glycine max
  Coding DNA Sequence Number=SeqID_85313
  Gene Ontology: Mol. function=transition metal ion binding
MEKPTHRTWMYNRLLPGQKGYTTEFLKGVKDFIDFACQQPKYLNEGVIRCPCKLCKNAKHLTPEEVNVHIIKKGFTPRYWFWTSHGEKLPHINNDVEVHSVSPRLASMTNLEPDLKLDLELNSLNPNLLLNSLNLNLKPALEPDLEVNLDLLNFHLNLNLIPPNLLNLNLNLLLYLNHNLIPPNLNISPLKSYVLKNIQWPIKPHLLHLVKLVKAIT

SEQ ID NO: 202092 - protein, 132 aa, Glycine max
  Coding DNA Sequence Number=SeqID_85314
MVRHNFEERGSAKMTQLMQDVRKNLNEKPTWMEDDVWAQMKAHWESSSFKNKSEINKRNRKSMDGASLHTGGSIPHRLHWKRMKEEKGTDPSLAEFYFRTHRRKKDQSWVGPRAESSYKLNVCPSKVHQPKD

SEQ ID NO: 202093 - protein, 335 aa, Glycine max
  Coding DNA Sequence Number=SeqID_85315
  Gene Ontology: Mol. function=catalytic activity; Cellular component =integral to membrane; Biological process=cellular metabolic process
  Homolog annotation: Hit_ID=Q9SMJ5; Match level="QueryCoverage=99%, HitCoverage=100%, E-value=1e-161, Identity=83%"; Hit description =DTDP-glucose 4-6-dehydratase
  Pfam annotation: Domain name=Epimerase; Domain location=37-258; Score= 127.6; E_value=3.5e-35; Accession=PF01370.11; Description=NAD dependent epimerasedehydratase family
  Pfam annotation: Domain name=NAD_binding_4; Domain location=33-243; Score=-82.7; E_value=0.0028; Accession=PF07993.2; Description=Male sterility protein
  Pfam annotation: Domain name=Polysacc_synt_2; Domain location=33-304; Score=-192.6; E_value=0.052; Accession=PF02719.6; Description =Polysaccharide biosynthesis protein
  Pfam annotation: Domain name=RmlD_sub_bind; Domain location=70-327; Score=-180.2; E_value=0.019; Accession=PF04321.7; Description=RmlD substrate binding domain
  Pfam module annotation: Pfam domain module=Epimerase::NAD_binding _4::Polysacc_synt_2::RmlD_sub_bind; Domain location=37-258::33 -243::33-304::70-327
  Subcellular localization annotation: CTP_CleavageSite=49; ConfidenceScore=5.40e-01
MATNSSNGATKQPPMPSPLRFSKFFQLFNKYNKTLEQYVIVRLSNQVIVADNFFTGSKDNLKKWIGHPRFELIRHDVTEQLLIEVDQIYHLACPASPIFYKYNPVKVGTIKTNVIGTLNMLGLAKRVGARILLTSTSEVYGDPLEHPQPESYWGNVNPIGVRSCYDEGKRVAETLMFDYHRQHGIEIRIARIFNTYGPRMNIDDGRVVSNFIAQAIRGEPLTVQVPGTQTRSFCYVSDMVDGLIRLMEGENTGPINIGNPGEFTMIELAENVKELINPKVEINMVENTPDDPRQRKPDITKAKELLGWEPKVKLRDGLPLMEEDFRQRLGVPKSN

SEQ ID NO: 202094 - protein, 239 aa, Glycine max
  Coding DNA Sequence Number=SeqID_85316
  Homolog annotation: Hit_ID=O24560; Match level="QueryCoverage=40%, HitCoverage=65%, E-value=8e-24, Identity=52%"; Hit description =Ubiquitin carrier protein
  Pfam annotation: Domain name=UQ_con; Domain location=15-133; Score =74.1; E_value=4.3e-19; Accession=PF00179.16; Description=Ubiquitin -conjugating enzyme
  Subcellular localization annotation: CTP_CleavageSite=27; ConfidenceScore=5.69e-01
LTVSSLLFAPPLVCPSWRHLRQAFSFKSSSKGGFFNAIMSFPSNYPNSPPSVKFTSEIWHPNVYPDGRVCISILHPPGEDPNGYELASERWTPVHTGRLESLVISVKSWRCRELQEASLKKIKEFILKALENEDHGRRSMGRSSNEHQEGALEIPLFYENDAYGEILELISMVGVLHAKAILGEQITIVEDLRVKFELYAGPLRGTDPEYLKGIFLNGLREELKAVKLHPVRTLGTMPK

SEQ ID NO: 202095 - protein, 229 aa, Glycine max
  Coding DNA Sequence Number=SeqID_85317
  Homolog annotation: Hit_ID=Q2HUF3; Match level="QueryCoverage=83%, HitCoverage=35%, E-value=9e-51, Identity=58%"; Hit description=UBA -like; HSC20, C-terminal oligomerisation
MYWASPKFPLLSSLLTVTPAQHRPPRLIEMEVSGQNIVKCDEEKALKCLLDAFGSVFSLEEIASAYCKASRNADLAGEMLYEMKGSSSGSSTTLDSSNADVMTEGSSESSDAYSLENSFQERKTSRPKGRPISMGTVSSVIGKDYGRPARSANGSFASVKPTKLDAKSLPMTGIWREKGKADVSISKHDQLHQDMEDFLFKMLGEGFQLDRNMIRQVLACGRFAAIAVL

SEQ ID NO: 202096 - protein, 266 aa, Glycine max
  Coding DNA Sequence Number=SeqID_85318
  Gene Ontology: Mol. function=methyltransferase activity; Cellular component=cytosol; Biological process=cell division
  Homolog annotation: Hit_ID=Q9LFB3; Match level="QueryCoverage=95%, HitCoverage=85%, E-value=1e-119, Identity=83%"; Hit description=Cell division-like protein
  Pfam annotation: Domain name=FtsJ; Domain location=1-161; Score =116.8; E_value=6.3e-32; Accession=PF01728.9; Description=FtsJ-like methyltransferase
VKRVVDLCAAPGSWSQVLSRKLYLPAKLAPDAKDENLPLIVAIDLQPMAPIEGVIQVQGDITNARTAEVVIRHFDGCKADLVVCDGAPDVTGLHDMDEFVQSQLILPGLTIVTHVLKEGGKLIFRGKDTSLLYCQAVNAICANSRRFTLAEAFAVCENYSPPEGFNPKDLHRLLEKVGSPSGVDDTDCCSGWLEGPNKVYIPFLACGDLSGYDSDRSYPLPKVAGGTYQSLDPVQPPIAPPYKRALELKKASSQGFRELEKLSLDS

SEQ ID NO: 202097 - protein, 232 aa, Glycine max
  Coding DNA Sequence Number=SeqID_85319
  Gene Ontology: Mol. function=translation elongation factor activity
  Homolog annotation: Hit_ID=Q41112; Match level="QueryCoverage=71%, HitCoverage=100%, E-value=2e-84, Identity=93%"; Hit description =Stress-related protein
  Pfam annotation: Domain name=REF; Domain location=42-232; Score =349.0; E_value=8e-102; Accession=PF05755.3; Description=Rubber elongation factor protein (REF)
MDAEQQPQLMEEQELQYVAAIGEHPSPSAMRRPLLIREGTHVEERREEQELKYLEFVQFATIQALMRCAILYSYAKERAGPLKPGVNTVEEAVKTVVAPVYDRFHLVPGEVLKYADRKVAELDRHVPSNVKKVSSQARSVVSEVRRDGVSAYAKIVYSKYEPTAEQCAVSAWRKLNQLPLFPQVANVVLPKAAYCTEKYNEAVVSSAEKGYRVSAYLPLVPTEKIAKVFGGN

SEQ ID NO: 202098 - protein, 137 aa, Glycine max
  Coding DNA Sequence Number=SeqID_85320
  Homolog annotation: Hit_ID=Q9SKM9; Match level="QueryCoverage=36%, HitCoverage=45%, E-value=2e-11, Identity=59%"; Hit description =Expressed protein
MSPIGLSFLFLISLALLSIARGQERAPHGLVYESPVAFPPAAYDFFHPNAQKPENKDPCVASKCSPLPLAAQVDATQIYENKASTTQKGGKQIGGGGVAGIITAVAFAVLLAMGIYYVKVTRQANMSRASNSVQSHA

SEQ ID NO: 202099 - protein, 88 aa, Glycine max
  Coding DNA Sequence Number=SeqID_85321
  Homolog annotation: Hit_ID=Q2HUF5; Match level="QueryCoverage=68%, HitCoverage=12%, E-value=3e-16, Identity=67%"; Hit description =Tetratricopeptide-like helical
MVAPFKSETSLVTGLEGLGEPTAFAKVTNDALKFCETKLIPLEHPIVEHRYHTSVGISKGADFRMQVRFLRPARNCNDSAKKNISSLR

SEQ ID NO: 202100 - protein, 551 aa, Glycine max
  Coding DNA Sequence Number=SeqID_85322
  Gene Ontology: Mol. function=binding; Cellular component =intracellular; Biological process=mRNA editing
  Homolog annotation: Hit_ID=Q2HUG1; Match level="QueryCoverage=94%, HitCoverage=100%, E-value=0.0, Identity=68%"; Hit description =Tetratricopeptide-like helical
  Pfam annotation: Domain name=PPR; Domain location=123-157; Score =10.2; E_value=0.47; Accession=PF01535.11; Description=PPR repeat
  Pfam annotation: Domain name=PPR; Domain location=227-261; Score =29.2; E_value=1.5e-05; Accession=PF01535.11; Description=PPR repeat
  Pfam annotation: Domain name=PPR; Domain location=330-364; Score =30.5; E_value=5.9e-06; Accession=PF01535.11; Description=PPR repeat
  Pfam annotation: Domain name=PPR; Domain location=365-399; Score =11.1; E_value=0.36; Accession=PF01535.11; Description=PPR repeat
  Pfam annotation: Domain name=PPR; Domain location=401-435; Score =19.1; E_value=0.016; Accession=PF01535.11; Description=PPR repeat
  Pfam annotation: Domain name=PPR; Domain location=466-500; Score=1.7; E_value=4.7; Accession=PF01535.11; Description=PPR repeat
  Pfam annotation: Domain name=PPR; Domain location=57-91; Score=3.9; E_ value=2.6; Accession=PF01535.11; Description=PPR repeat
  Pfam module annotation: Pfam domain module=PPR::PPR::PPR::PPR::PPR::PP R::PPR; Domain location=123-157::227-261::330-364::365-399::401 -435::466-500::57-91
  Subcellular localization annotation: CTP_CleavageSite=44; ConfidenceScore=5.23e-01
MKAPNLNQIVIRAQQQLLTNPNPQFLNPLLSQLTNSRNAFFDLYNQMLSQPFSHNHYTFTHALKACSFHNARSKALEIHAHLVKSGRYLDLFLQNSLLHFYLAHNDVVSASNLFRSIPSPDVVSWTSLISGLAKSGFEAQALHHFINMYAKPKIVRPNAATLVAALCACSSLGSLRLAKSVHAYGLRLLIFDGNVIFGNAVLDLYAKCGALKNAQNVFDKMFVRDVVSWTTLLMGYARGGYCEEAFAVFKRMVLSEEAQPNDATIVTVLSACASIGTLSLGQWVHSYIDSRHDLVVDGNIGNALLNMYVKCGDMQMGFRVFDMIVHKDVISWGTFICGLAMNGYERNTLELFSRMLVEGVEPDNVTFIGVLSACSHAGLLNEGVMFFKAMRDFYGIVPQMRHYGCMVDMYGRAGLFEEAEAFLRSMPVEAEGPIWGALLQACKIHRNEKMSEWIRGHLKGKSVGVGTLALLSNMYASSERWDDAKKVRKSMRGTGLKKVAGCSWVELEMSNNRLGSNLCTAYGDRWTVQVRKVHGFLFNVRIVKFCGLVQF

SEQ ID NO: 202101 - protein, 224 aa, Glycine max
  Coding DNA Sequence Number=SeqID_85323
  Gene Ontology: Mol. function=methyltransferase activity; Cellular component=cytosol; Biological process=cell division
  Homolog annotation: Hit_ID=Q9LFB3; Match level="QueryCoverage=95%, HitCoverage=68%, E-value=1e-100, Identity=84%"; Hit description=Cell division-like protein
  Pfam annotation: Domain name=FtsJ; Domain location=1-119; Score=16.0; E_value=5.7e-08; Accession=PF01728.9; Description=FtsJ-like methyltransferase
MAPIEGVIQVQGDITNARTAEVVIRHFDGCKADLVVCDGAPDVTGLHDMDEFVQSQLILAGLTIVTHVLKEGGKFIAKIFRGKDTSLLYCQIFEVLESEDLLMRFTLAEAFAVCENYSPPEGFNPKDLHRLLEKVGSPSGVDDTDCCSGWLEGPNKVYIPFLGCGDLSGYDSDRSYPLPKVAGGTYQSLDPVQPPIAPPYKRALELKKASSQGFRELEKLSLDS

SEQ ID NO: 202102 - protein, 119 aa, Glycine max
  Coding DNA Sequence Number=SeqID_85324
  Subcellular localization annotation: CTP_CleavageSite=56; ConfidenceScore=5.24e-01
MLRKSKRVSFSPDVNEKTTMFLKNGVLGNRKRVIGSWSFSRLPKDPLLSPVRFILRLGAKVASSIRVISMGRRSSRKVSSSTLVRSHSLSDPNDSSYRAKAVEDCIEFLHSSSSRERPS

SEQ ID NO: 202103 - protein, 75 aa, Glycine max
  Coding DNA Sequence Number=SeqID_85325
MERDQVQHQPMQKKIGRNLINLANKLASPFRCWKRLDTKCSLKSQISSTKEKFAATAQEHANNKIHLREKDKRIE

SEQ ID NO: 202104 - protein, 94 aa, Glycine max
  Coding DNA Sequence Number=SeqID_85326
  Homolog annotation: Hit_ID=Q2HUG1; Match level="QueryCoverage=63%, HitCoverage=11%, E-value=2e-20, Identity=80%"; Hit description =Tetratricopeptide-like helical
MSEWIRGHLKGKSVGVGTLALLSNMYASSERWDDAKKVRKSMRGTGLKKVAGCSWVELEMSNNRLGSNFSLYYKNQVAKWVICPVLMQVAVIAG

SEQ ID NO: 202105 - protein, 280 aa, Glycine max
  Coding DNA Sequence Number=SeqID_85327
  Homolog annotation: Hit_ID=Q9SIA8; Match level="QueryCoverage=71%, HitCoverage=46%, E-value=3e-65, Identity=63%"; Hit description =Putative disease resistance response protein
  Pfam annotation: Domain name=Dirigent; Domain location=102-280; Score= 189.9; E_value=5.9e-54; Accession=PF03018.5; Description=Dirigent -like protein
MARRESLSMTRALNAIAYVALIFLAFAMSCSTSTRILDEVERPEAEEANNAAESHVADQHHTLSFFMHDILGGSNPTARAVTGVVTNPALNAQVAFAKPNGANLPLNNGVPQNNNNGGILNNNNLPFLTGLGGTTANVFNNGGTGFPVTNTNQLPAGMTLQKVMFGTMTVFDDELTHGHEFGSGLVGKAQGFYIASAVDGTSQVMAFTAKFEENGYVDSLSFFGVHRAQVSESQIAIIGGTGKYVNAEGYAIIKTFPLSPQQHNTDGVQTLLQLTAYLAY

SEQ ID NO: 202106 - protein, 511 aa, Glycine max
  Coding DNA Sequence Number=SeqID_85328
  Gene Ontology: Mol. function=protein binding; Cellular component =mitochondrion; Biological process=embryonic development ending in seed dormancy
  Homolog annotation: Hit_ID=Q9FFE3; Match level="QueryCoverage=73%, HitCoverage=91%, E-value=2e-52, Identity=26%"; Hit description=Salt -inducible protein-like
  Pfam annotation: Domain name=PPR; Domain location=134-168; Score=2.5; E_value=3.8; Accession=PF01535.11; Description=PPR repeat
  Pfam annotation: Domain name=PPR; Domain location=200-234; Score =22.0; E_value=0.0021; Accession=PF01535.11; Description=PPR repeat
  Pfam annotation: Domain name=PPR; Domain location=235-269; Score =32.2; E_value=1.8e-06; Accession=PF01535.11; Description=PPR repeat
  Pfam annotation: Domain name=PPR; Domain location=270-304; Score =39.6; E_value=1.1e-08; Accession=PF01535.11; Description=PPR repeat
  Pfam annotation: Domain name=PPR; Domain location=305-339; Score =24.4; E_value=0.00041; Accession=PF01535.11; Description=PPR repeat
  Pfam annotation: Domain name=PPR; Domain location=340-374; Score =38.5; E_value=2.3e-08; Accession=PF01535.11; Description=PPR repeat
  Pfam annotation: Domain name=PPR; Domain location=375-409; Score =43.9; E_value=5.4e-10; Accession=PF01535.11; Description=PPR repeat
  Pfam annotation: Domain name=PPR; Domain location=410-444; Score =24.9; E_value=0.00029; Accession=PF01535.11; Description=PPR repeat
  Pfam annotation: Domain name=PPR; Domain location=445-479; Score =26.8; E_value=7.9e-05; Accession=PF01535.11; Description=PPR repeat
  Pfam module annotation: Pfam domain module=PPR::PPR::PPR::PPR::PPR::PP R::PPR::PPR::PPR; Domain location=134-168::200-234::235-269::270 -304::305-339::340-374::375-409::410-444::445-479
MEMKSFGVEGEAKMLKGVFLPYISTSHVLPLVDIARIFTMQGGVDAIIMTTPAHAATIQSCSTIGTHVVKFPQVPGLPEGMDTENIDLRRIIIPTPKFRKRIPFVTEVKTVEDPEEALSLFHRYKEQGFRHYYPSYAALLYKLARSRMFDAVETILAHMKDTEMQCRESVFIALFQHYGPEKAVELFNRMPQFNCTRTIQSFNALLNVLIDNDRFDEANDIFGKSYEMGFRPNTVTFNIMVKGRLAKGEWGKACEVFDEMLQKRVQPSVVTYNSLIGFLCRKGDLDKAMALLEDMGQKGKHANEVTYALLMEGLCSVEKTEEAKKLMFDMAYRGCKAQPVNFGVLMNDLGKRGKVEEAKSLLHEMKKRRLKPDVVTYNILINYLCKEGKAMEAYKVLLEMQIGGCVPNAATYRMVVDGLCQIGDFEVALSVLNAMLTSRHCPRSETFNCMVVGLLKSGNIDGSCFVLEEMEKRKLEFDLESWETIIKSACSENKGARRALMVFDGKDESRA

SEQ ID NO: 202107 - protein, 143 aa, Glycine max
  Coding DNA Sequence Number=SeqID_85329
  Subcellular localization annotation: CTP_CleavageSite=20; ConfidenceScore=5.33e-01
MNHFFRKVPGRGFPGVFRKKCSSGRRFGYFQKNTSSGNFPENVLPELPEEPLTGLPEGSAVNLLSPFFSASSPLVFYPKVTILRFHCYNNVVSYKQRGVRETNLVRGEEEDEVRACLAEKKKQFAEKGEEAVRGEGEEASRKE

SEQ ID NO: 202108 - protein, 113 aa, Glycine max
  Coding DNA Sequence Number=SeqID_85330
MTSIEQQLNLVVVAQPINAIKDADILERLWKGFEDQLWKAKTIASERLRLGGDSSVAPTFPMLETNASDNADETSRKTLRKRGRKTASKVLFQVPFSFQPPEFCLKENHQPGH

SEQ ID NO: 202109 - protein, 69 aa, Glycine max
  Coding DNA Sequence Number=SeqID_85331
  Subcellular localization annotation: CTP_CleavageSite=46; ConfidenceScore=5.03e-01
MENSSLTVNHLIQPYFNLLSENQLRVFRRTARKPHYKRNLKESWASSSKGNNTRKSSLPWIQTENAIET

SEQ ID NO: 202110 - protein, 38 aa, Glycine max
  Coding DNA Sequence Number=SeqID_85332
MTQKQSYQLRVRERCIGQLMPYAFSTKPSEPSRSDDRN

SEQ ID NO: 202111 - protein, 882 aa, Glycine max
  Coding DNA Sequence Number=SeqID_85333
  Gene Ontology: Mol. function=1,3-beta-glucan synthase activity; Cellular component=1,3-beta-glucan synthase complex; Biological process=1,3-beta-glucan biosynthetic process
  Homolog annotation: Hit_ID=Q9ZT82; Match level="QueryCoverage=99%, HitCoverage=50%, E-value=0.0, Identity=56%"; Hit description =Putative glucan synthase component
MNLRQRPVAARGGATNLPRPPPLNSVFNIIPVHDLFTDHPSLRYPEVRAAAAALRTVGDLPKHQFMRWEPEMDLLDWLRLLFGFQLDNARNQREHLVLHLANSQMRLEPPPVIVDALDAGVLRRFRRKLLHNYSAWCSFLGLKSNVLLSRRRDPTDLRRELLYVSLYLLVWGEAGNLRFTPECLCYIYHFMAKELNHVIDEHGDPDTGRPYMPTVSGELGFLKSVIMPIYNTIKVEVDSSRNGKAPHSAWRNYDDINEYFWSRRCLKRLGWPLNFECNFFGTTPKEKRVGKTGFVEQRSFWNVYKSFDRLWVMLILFFQAAIIVAWEGTTYPWEALEKRDVQVKMLTVFITWSALRFLQSVLDAGTQYSLVTRETRWLGVRMALKSMAAIMWTVLFSVFYGMIWIEKGSRPIWSDAANQRIYTFLKVVLFFLIPELLALVLFVVPWLRNVIEESDWKIVYLLTWWFHTRIFVGRGVRQALIDNVKYTVFWVAVLASKFSFSYLFQIEPLVAPTKALLNLKNIRYKWHEFFNNTNRVAVVLLWIWYSIFSAFYGAAIGLFSHLGEIRNVTQLRLRFQFFASAMQFNLMPEEKLLSQQATLLKKLRDAIHRLKLRYGLGQPFNKIESSQVDATRFALIWNEIMITFREEDIISDRELELLKLPPNCWNIRVIRWPCSLLCNELLLAVSQAKELENESDWSLWLKICKNEYRRCAVIEAYDSVKYLFPKVLKAEKEEYSIMTNIFGVIDSYIQTGKLTEAYKMSRLPQIHGKVSEFVQLLIQPERDMNKAVNLLQALYELFVREFPKVKRTIIQLREEGLARRSSTADEGLIFENAVKFPDAGDAVFTEQLRRLHTILTSRDSMHNVPLISRHDDELLSLPILCL

SEQ ID NO: 202112 - protein, 790 aa, Glycine max
  Coding DNA Sequence Number=SeqID_85334
  Gene Ontology: Mol. function=1,3-beta-glucan synthase activity; Cellular component=1,3-beta-glucan synthase complex; Biological process=1,3-beta-glucan biosynthetic process
  Homolog annotation: Hit_ID=Q8S1X0; Match level="QueryCoverage=97%, HitCoverage=43%, E-value=0.0, Identity=70%"; Hit description =Putative callose synthase 1 catalytic subunit
  Pfam annotation: Domain name=Glucan_synthase; Domain location=1-669; Score=807.6; E_value=7.1e-240; Accession=PF02364.6; Description=1,3 -beta-glucan synthase component
MRRTSGLQKRPGISAFGALKMLAFLDSASEMDVRQGSEHGSMNQNSSLNGLPSNGPSSLQTNLRPADSSVSMLFKGHEYGSALMKFTYVVACQMYGRHKADKNPRADEILYLMQNNEALRVAYVDEVSLGREGTEYYSVLVKYDQQLQSEVEIYRIRLPGPLKLGEGKPENQNHAIIFTRGDAVQTIDMNQDNYFEEALKMRNLLEEFNAYYGIKKPTILGVRENIFTGSVSSLAWFMSAQDTSFVTLGQRVLANPLKVRMHYGHPDVFDRFWFLGRGGVSKASRVINISEDIFAGFNCTLRGGNVTHHEYIQVGKGRDVGLNQISMFEAKVASGNGEQVLSRDVYRLGHRLDFFRMLSVFYTTIGFYFNSMVIVLMVYAFLWGRLYMALSGIEHAALKNATNNKALGAVLNQQFAIQVGIFTALPMIFENSLEHGFLPALWDFLTMQLQLASLFYTFSLGTRTHFFGRTILHGGAKYRATGRGFVVAHKSFAENYRLYARSHFAKGIELGIILIVYAAHSPLARDTFVYIAMTISSWFLVVSWIMSPFVFNPSGFDWLKTVYDFEDFINWIWYPGGPFKKAEHSWETWWYEEQDHLKTTGIWGKLLEIILNLRFFFFQYGIVYQLGIAGGNNSIAVYLLSWIVMVVIVAIYIIMAYARDKFATKEHLYYRLVQLLVIVITVLVLFLLLEFAHLKFIDLLSSFLAFVPTGWGMISIALVLRPFLQTTKVWETVVSLARLYDLLFGVIVMAPMAIVSWLPGFQSMQTRILFNEAFSRGLQISRIVSGKKSV

SEQ ID NO: 202113 - protein, 176 aa, Glycine max
  Coding DNA Sequence Number=SeqID_85335
  Gene Ontology: Mol. function=prenyltransferase activity; Cellular component=integral to membrane; Biological process=bacteriochlorophyl l biosynthetic process
  Homolog annotation: Hit_ID=Q5W6H5; Match level="QueryCoverage=68%, HitCoverage=32%, E-value=2e-56, Identity=90%"; Hit description =Putative chlorophyll synthase
  Pfam annotation: Domain name=UbiA; Domain location=1-172; Score= -48.2; E_value=0.027; Accession=PF01040.9; Description=UbiA prenyltransferase family
MVAYITTSTFPRHQQVEASVKFYYLDLHCISEDLDWFLTDRWAGQALFGTLTPDIIVLTLLYSIAGLGIAIVNDFKSVEGDRALGLQSLPVAFGAETAKWICVGAIDITQLSVAGYLLGADKPFYALALLGLIIPQVFFQFKYFRKDPVKYDVKYQASAQPFLVLGLLVTALATSH

SEQ ID NO: 202114 - protein, 76 aa, Glycine max
  Coding DNA Sequence Number=SeqID_85336
  Gene Ontology: Biological process=response to abscisic acid stimulus
  Homolog annotation: Hit_ID=Q2Q4Y5; Match level="QueryCoverage=96%, HitCoverage=89%, E-value=3e-21, Identity=61%"; Hit description=Em6
  Pfam annotation: Domain name=LEA_5; Domain location=1-76; Score=88.5; E_value=2e-23; Accession=PF00477.8; Description=Small hydrophilic plant seed protein
MESQQANREELHERARNQIQANTGRNRGGQTRKEQMGREGYQEMGRKGGLSTMDKSGVERAEEEGIDIDESKFKNK

SEQ ID NO: 202115 - protein, 499 aa, Glycine max
  Coding DNA Sequence Number=SeqID_85337
  Gene Ontology: Mol. function=leucyl aminopeptidase activity; Cellular component=intracellular; Biological process=protein metabolic process
  Homolog annotation: Hit_ID=Q1RWG8; Match level="QueryCoverage=88%, HitCoverage=78%, E-value=0.0, Identity=81%"; Hit description=Cytosol aminopeptidase family, catalytic domain, putative
  Pfam annotation: Domain name=Peptidase_M17; Domain location=243-499; Score=445.5; E_value=7.1e-131; Accession=PF00883.11; Description =Cytosol aminopeptidase family, catalytic domain
  Pfam annotation: Domain name=Peptidase_M17_N; Domain location=75-210; Score=88.5; E_value=2e-23; Accession=PF02789.7; Description=Cytosol aminopeptidase family, N-terminal domain
  Pfam module annotation: Pfam domain module=Peptidase_M17::Peptidase _M17_N; Domain location=243-499::75-210
MKERASTTNQTLGEVKKKTLDKQEHLWELSRALAVLASASSVSREREEFLRLVRKEISFGAKDVDVTEWKGDILAVGVTEKDLARDANSKFENVILSKIDSKLGGLLAEASSEEDFSGKVGQSTVLRITGLGSKRVGLIGLGQSPSTPSPFKGLGDAVVEAAKSSQESSAAVVLASSEGLSAQSKLSSAYAIASGAVLGLFEDNRYKSEAKKSTLRSIDIIGLGMGPELEKKLKYAGDVSSGIIFGRELVNSPANVLTPGVLAEEAAKIASTYSDVFTAKILNAEQCAELKMGSYLGVAAASENPPHFIHLCYKPLSGPVNVKLALVGKGLTFDSGGYNIKTGPGCSIELVKFDMGGSTTVLGTTKALGQIKPLGVEVHFIVATCENMISGTSMRPGDIVTTSNGKTIEVNNTDAEGRLTLADALVYACNQGVEKIIDLATLTGACVVALGPSIAGVFTPSDDLAKEVFEASDVSGEKLWRLPLGESYWETMKSGVADM

SEQ ID NO: 202116 - protein, 154 aa, Glycine max
  Coding DNA Sequence Number=SeqID_85338
  Gene Ontology: Mol. function=heat shock protein binding
  Homolog annotation: Hit_ID=Q6NUX7; Match level="QueryCoverage=62%, HitCoverage=20%, E-value=5e-07, Identity=32%"; Hit description=DnaJ (Hsp40) homolog, subfamily C, member 7
  Pfam annotation: Domain name=DnaJ; Domain location=13-97; Score=32.5; E_value=1.4e-06; Accession=PF00226.21; Description=DnaJ domain
MTLSLATKVMQCDFLSIGGIKSADTTTDIKKAYHKAALRHHADKLLARSEVGDEGQLWKEISQEVYKDADKLFKMIGEAYTVLSDPAQDPNMKAQLDWESHYKGLYLSPDYPTCKSYNCQLSLTKDFYIWRGLNMRFLTKKTAAFIMGRMLRIY

SEQ ID NO: 202117 - protein, 76 aa, Glycine max
  Coding DNA Sequence Number=SeqID_85339
  Subcellular localization annotation: CTP_CleavageSite=60; ConfidenceScore=5.60e-01
MASLLNMVSVPPRISPTSHTRITSLQARPVLPAFSVSFSSSGFEILVVFMDIPGRRQSIRATETDTNEGVCYEKQP

SEQ ID NO: 202118 - protein, 608 aa, Glycine max
  Coding DNA Sequence Number=SeqID_85340
  Gene Ontology: Mol. function=RNA-directed DNA polymerase activity; Cellular component=chromatin; Biological process=chromatin assembly or disassembly
  Homolog annotation: Hit_ID=Q947Y6; Match level="QueryCoverage=66%, HitCoverage=31%, E-value=8e-77, Identity=36%"; Hit description =Putative retroelement
  Pfam annotation: Domain name=RVP_2; Domain location=270-390; Score= -52.0; E_value=0.011; Accession=PF08284.2; Description=Retroviral aspartyl protease
  Pfam module annotation: Pfam domain module=RVP_2::RVT_1; Domain location=270-390::399-597
MAEATCSKTSVDRWEDAFAKLSASMTSKFDELLNRMNQLETSHTNPHAPPSFAGASTAATTNVAYRLKLEVPRFDGSDPEGWIFKVTQVFEYHATPDHDRLTTASFYMEGPGVSVVSMDRSTVSAYLSEFEALANRVIGLPVPFVLSCFVSGLSPAIQREGGRPPSTAPPVVNNTRPSLSSNGPSPESSLLPSVTKPRSATIPFKRLTPSELALHREQGLCFNCGEKYSRGHKCTSSLFLFVTEEYEYTQEIDPGPPSLTLPPSQETSPVQISLHALSGQGAPKTLRLTGLIQDHRVQILIDGESTHNFLQQELVSSLQLSPRDTSTLRVTVGNDEELQCNQVCTNISVKIQKHDFQVDFHVLPIRGADVVLGVQWLKSLGPVLTDYTALTMKFIYNGPTNHTITLLPHSAPVNVKPYRYPHFQKKEIETQVAAMLRQGHIQHSSSPFLSLGTHAITVQDRFPIPMVDELLDELGGAVWFSKLDLMQGYHQILMRESDISKTTFRTHHGHYEFRVMPFGLCNAPSSFQATMNRLFQPHLRKYIIVFFDDILIYSHSLDEHVHHLEIAFQVLKDGKFTLKFAKCSFAQKQIDYLGHIVSGDGVRPIPEK

SEQ ID NO: 202119 - protein, 205 aa, Glycine max
  Coding DNA Sequence Number=SeqID_85341
  Gene Ontology: Mol. function=microtubule motor activity; Cellular component=microtubule associated complex; Biological process =microtubule-based movement
  Homolog annotation: Hit_ID=Q1S9J2; Match level="QueryCoverage=62%, HitCoverage=16%, E-value=1e-15, Identity=33%"; Hit description =Kinesin, motor region; Zinc finger, RING-type; tRNA-binding arm; RINGv
MGKQKKGQNGIQNTQDEVILVCEVGDILGGTETMLSREAIADLELEDALDTQKKTRVIDPLSGSDKLLSSPSPLHNDPRAGRKGRISSRANEISGTGVDDFELRSLDADDLKIELQARKQREAALEVALAEKEFVEKQYRKKTEEAKRREEALDNDLANMWEHILDAPKLDEEMPKEDPLVVRLKGLGREEGKERIKTVNNGIFI

SEQ ID NO: 202120 - protein, 155 aa, Glycine max
  Coding DNA Sequence Number=SeqID_85342
  Gene Ontology: Mol. function=copper ion binding; Cellular component =mitochondrion; Biological process=electron transport
  Homolog annotation: Hit_ID=Q8VYP0; Match level="QueryCoverage=80%, HitCoverage=37%, E-value=5e-52, Identity=74%"; Hit description =Putative SCO1 protein
  Pfam annotation: Domain name=AhpC-TSA; Domain location=42-153; Score=- 9.1; E_value=0.0042; Accession=PF00578.11; Description=AhpCTSA family
  Pfam annotation: Domain name=SCO1-SenC; Domain location=9-154; Score =81.1; E_value=3.5e-21; Accession=PF02630.5; Description=SCO1SenC
  Pfam module annotation: Pfam domain module=AhpC-TSA::SCO1-SenC; Domain location=42-153::9-154
MAAIQMTSLVSMTCWACLSLPLVMGPSRIRTNTEAVKQGPSTGKAAIGGPFRVINHHGKHVTEKDFMGKWTLLYFGFTHCPNICPEELQKLAAAVDKIKEKAGIETVPVFISIDPERDIVEQVGEYVKEFHPKLIGLTGSPDEVKNVARAYRVYC

SEQ ID NO: 202121 - protein, 58 aa, Glycine max
  Coding DNA Sequence Number=SeqID_85343
MARLGFDRTNNIAEYDKSAFGIQAAIDFKVKLLKAKEEKVKVANDSLSEADPFNEMHL

SEQ ID NO: 202122 - protein, 546 aa, Glycine max
  Coding DNA Sequence Number=SeqID_85344
  Gene Ontology: Mol. function=heat shock protein binding; Cellular component=integral to membrane; Biological process=protein folding
  Homolog annotation: Hit_ID=Q9SR96; Match level="QueryCoverage=66%, HitCoverage=66%, E-value=1e-114, Identity=56%"; Hit description =Putative DnaJ protein
  Pfam annotation: Domain name=Peptidase_M24; Domain location=22-205; Score=-39.1; E_value=2.3e-05; Accession=PF00557.14; Description =metallopeptidase family M24
MTPLPVKEDKSGGLEASYFRMQTGNVYKNVKRKIERGVAFPTCLSVNNVVCHFSPLASDEAVLEEGDILKIDMACHIDGFIAAVAHTHVLQEGPVTGRAADVIAAANTAAEVALRLVRPGKKGGSKSFSFSVGGGSGDSNPFGFGLDDLFGSFFGGGGGGSQFGGFGSSAKSQSGSKSSSKSLRAVNSQIYKKEIENAGMTWLLLSYMPSSMEIQYFESTIEEVASSLHGALKVGSINCEKEVSFCKELSIYPRRAPRLIVFSYKENEKGYLVEYRGDLAAKNLKAFCQEYLPRFSKRTDLNHLDQFSTTGKLPMVLLLSTKKDTPVIWRVLSGLYHKRITFIDAEVHDVSDPRVKTLGVDALPAIVGWLPNGEKRVLKTGISVKDLKSAVLDLSNILDSFEKVSKKESSGQAKEAQTDSDEGRVPLLSKSNIEALCGEKTPVCIIGAFRSSKAREKLESILSLVSPKSLSRRPNQGSSSSRDSISYALLDAAKQKSFLKAFDKTGKYSIFMGEMTIEEIENFISSVLSGDVPFREATRGKPVLEY

SEQ ID NO: 202123 - protein, 143 aa, Glycine max
  Coding DNA Sequence Number=SeqID_85345
MKLPGNNKNLEDQVLVLTIEANRLEKLNVNAEALVMHLCEVSDPSVFDINKDVYNGDLMMIDNILEDVAPKPERLTTSTKDLHTKGVGVEDEDHKMEWIRRKKVASLWRADWKGFGSKSECVWMENEDDNNDVQVGLKNEGLE

SEQ ID NO: 202124 - protein, 125 aa, Glycine max
  Coding DNA Sequence Number=SeqID_85346
  Subcellular localization annotation: CTP_CleavageSite=44; ConfidenceScore=5.01e-01
MAKRVLDFIGYIASGFSRLDRILIRYTGPLSPFLSSTKKKAFTLCARAVKIFFSDGSLSGESVDNESKVHGYNNEVFEVSENIVAPVLVPAVEKGTSMKVAPWPKKHPMLKDKCSPPPIMLLKYN

SEQ ID NO: 202125 - protein, 333 aa, Glycine max
  Coding DNA Sequence Number=SeqID_85347
MSGPFVTRTFWHTLWGRVRYILIPRYYGDNENWNKHNSNEEIHVEDHTNLFLIVRYKLKSRKCTGITPKLLPFGVRMPIYVKFRTIKECYMVSLRLHLHARMEAPKVIHYVVVKMRTKEVKELELDLRTNDDNQMDPRDEEKMTFITKFVNFCYKFMPSRLKNAGATYQHLMDKEFKGQLGRNLEVYADDMMTDGPIAKVLRKPKLVGRMMAWSIELSEYEIVYETRGTVWAQATCNQAEYETLLIGLRFAKEVGAQRVWSESDSKIAAKQINKVEEGPSRWKKEIVEYLKHETLTIDKGKARKLRTQDGENNGHKSSESRVLLAYFEDGLFK

SEQ ID NO: 202126 - protein, 278 aa, Glycine max
  Coding DNA Sequence Number=SeqID_85348
  Gene Ontology: Mol. function=hydrogen ion transporting ATP synthase activity, rotational mechanism; Cellular component=proton -transporting two-sector ATPase complex; Biological process=ATP synthesis coupled proton transport
  Homolog annotation: Hit_ID=Q10MX4; Match level="QueryCoverage=75%, HitCoverage=51%, E-value=1e-48, Identity=44%"; Hit description =Expressed protein
  Pfam annotation: Domain name=DUF231; Domain location=123-278; Score =109.8; E_value=8.1e-30; Accession=PF03005.6; Description=Arabidopsis proteins of unknown function
MDTKNQQIQSVALKLLLVLWSESTPASSLVSLKASLVDLRMQCLWILDFWFESTLVSSLVALVLVFVAYNATIEFYWVPYLVESNSDIDIIDIKKRIIKVDAIAERAKNWMGVDILVFNTYVWWMSGIRIKTIWGSFANGQEGYEEFDTPVAYNKMSHDCNKSNVLLLRSQDWGNMEGVKCFNETKLVRKKKHWGTGSDKRIMSVVAKVTKKMKVPVTFINITQISEYRIDGHCSVYTETEGKLLTEEERANPQNADYIQWCLPGVPNTWNQILLAML

SEQ ID NO: 202127 - protein, 70 aa, Glycine max
  Coding DNA Sequence Number=SeqID_85349
MAGGANFVQRVLSYVVNEVVVNGLANSPAFQRFAVRTSKRIEDISNKAVQKRQELAEQIKDISKNMEVVC

SEQ ID NO: 202128 - protein, 167 aa, Glycine max
  Coding DNA Sequence Number=SeqID_85350
  Subcellular localization annotation: CTP_CleavageSite=56; ConfidenceScore=5.72e-01
MGVKQQKQNKKKALPTSISGGSACGLGSSSPCSLPSFTPCSSPPFAPWVVAAVLVAAVHAVGRRCWLLCAAGNAWLLSWLVAGVVAGFRGRAVCWSFEGLQLRSKANNNSAFASAFFSFIISARCLVLKPTRTQRNRRALTSSFLTWVTCSKFSENKAKGWEETATT

SEQ ID NO: 202129 - protein, 437 aa, Glycine max
  Coding DNA Sequence Number=SeqID_85351
NYEDILVRNQYYLQDKGKLKDALAGLVRCLSLLPWNKEETDLHNKDATGQRVLHAFEVDVSMSSNGKSFGCMISILHSIYLIVRSIAYGTDKDSESPSSQGGPDAAVWDVNISSTFLKKLFPRFPLNPVDHLSEKDCDRLFDLNMIVAKIFFELNEWTSLPPNLLETFLEFFENALLGKFCRATQSGKAVWEECLVQLLSFIPKFLSRGASSWTSRLLQAFTQTFRESKPGSLMKLACVSAIEDMLTPIESMLSIETSNPENLELQDALLAWIRELPLLLIQLGDKHPTCSQVLHSAYRDGHIKIADYLSVFITLVLRFKVSPARKATELRKVVFIPGQEKVNLVIYEIGSAGFKSDPLCQTLKSMTTVLCSYMAQMGDNSLVLQIVEKVPQMPSLDNSCSLLRMLVTVDSKPTRLSEQSIIILGQHLSEYLMDAVQ

SEQ ID NO: 202130 - protein, 172 aa, Glycine max
  Coding DNA Sequence Number=SeqID_85352
MSSTAIVLPEQSLAAEKAGLAVNKKGLTLKELLQQTSHHNPKVRRDALIGIKDLFTRYPAEQKLHKYAAVEKLRERIGDDDKVVRKSLYDLFKVVILPCCKEPSTYWKPRTRRTFKILSAKAQNAQEWWGRRNLWLKVMESCSHQINLTPAKKRNIFILLPKPLIHPNVEPF

SEQ ID NO: 202131 - protein, 213 aa, Glycine max
  Coding DNA Sequence Number=SeqID_85353
  Gene Ontology: Mol. function=transferase activity
  Homolog annotation: Hit_ID=Q7VXB6; Match level="QueryCoverage=43%, HitCoverage=20%, E-value=7e-18, Identity=54%"; Hit description =Putative amidase
MAEVEPHWDRLELRAWIKVNGDWVTYQQGTLASLLTPMDLLARYFGDRPVSEGFAMSCGTLSAIGGIRPASEFRMALHDPLLNRTLEHHYVTGTLPASQQLRAGDLTASAATQQALRAAEQPSGEGARVFTRTYANSAVQQAQQADARWQQQQPRSPIDGLPISIKDLFDVAGEPTCAGSRVLADAPPAARDAHIVQQLKQAGAAIIGKTNMT

SEQ ID NO: 202132 - protein, 526 aa, Glycine max
  Coding DNA Sequence Number=SeqID_85354
  Subcellular localization annotation: CTP_CleavageSite=18; ConfidenceScore=5.20e-01
MGTPSSNPLFIFFLFYSSVSLNPSDLTFESTYARLCNHHVPAPPSRSAEGTFPGVADELRFQFGYFAGGHRFFNRSVSMKNRASSDAGAGKVAPAGLSGPESDALGSFAVDARFSEWILVALFCSNYRFTIAGNEKDNGCGSGSDGEGLSLRNLSQGACTTFLGHTDKFELEYGSHCGNGSCNPVGGSGGELPDLMLLHATQCAERQKVQMLLGFPESSYQDAVFPFHPNTTLVSEGMWDEKENQLCAVACWILNFTESSVNPYVGDCKIRLSFRFPAVLSLRNRSTVLGQIWSDKVVGESGYFRKVGFQGSSRVSKSLQGFQYKYADTERHVSDKQQKARNPKARGIQTDNLLNVSYTISFNSPADFKFGRGVSSTKVKIGAEGIYNRNTGVLCMIGCQHLRSTDKILIKNETLDCEFMVNVQFPPLNAKGGLQLLHEKKHPDVLPYISVVMLTVITLGHMIPLILNFEALFMGNDSVQNTFLGSGGWLEVNEVVLRMVTMVAFLLELCLVQLIWSSRQGEGSHP

SEQ ID NO: 202133 - protein, 114 aa, Glycine max
  Coding DNA Sequence Number=SeqID_85355
  Gene Ontology: Mol. function=hydrolase activity, acting on ester bonds; Biological process=lipid metabolic process
  Homolog annotation: Hit_ID=Q8LDB1; Match level="QueryCoverage=98%, HitCoverage=64%, E-value=5e-30, Identity=40%"; Hit description=CPRD49
PHVPLQEYIENLRKIVDHLKMNIEAMDLWSAIQKRDNWQDVCFIDGIHLSSEGSKIVLKEILNVLKGAEWEPSLYWKSMPSEFDEDSPYDPIASDGKSTVNLSNWVFPDNDKWD

SEQ ID NO: 202134 - protein, 146 aa, Glycine max
  Coding DNA Sequence Number=SeqID_85356
  Homolog annotation: Hit_ID=Q658I5; Match level="QueryCoverage=78%, HitCoverage=30%, E-value=1e-23, Identity=44%"; Hit description=LMBR1 integral membrane family protein-like
  Subcellular localization annotation: CTP_CleavageSite=88; ConfidenceScore=5.60e-01
MSFPHVNSPPPSLVALCTKGSGLVGKVDFTIRHLSSSTTSFPSTWTFSSGQPCIGSDAHQIFGGVGIACLPLGLIFSFIRRPKAVITRSQYIKEATELGKKARELKKAAEALHQEERTGSKGRKFRKNVKGVEKFVVESIQLLKYS

SEQ ID NO: 202135 - protein, 239 aa, Glycine max
  Coding DNA Sequence Number=SeqID_85357
  Gene Ontology: Mol. function=nucleic acid binding
  Homolog annotation: Hit_ID=Q1RVR4; Match level="QueryCoverage=52%, HitCoverage=35%, E-value=1e-12, Identity=34%"; Hit description =Peptidase aspartic, active site; Aldehyde dehydrogenase
MWEWRILFGFLVNSNVLGRNIPRSFGGQGSGNGPGLNAPAGTGEKNRNWPKDRGNKHLAYQDLMECCRKGLCFKCGESYGPFHQCLVKQLRVILVGDKIQVACDEEERVSGQEEEDVEAEFDGECSVLRLLSSQVEQIGNSRTMKMRGRVFDVPLFILVDNNASHNFISQKLVKAMGWKWEETRSMQILLGDGHKTMTYDDRGDDKKLKDQSKNNSSESRTIQEFKIRIKKNSRLKKKV

SEQ ID NO: 202136 - protein, 656 aa, Glycine max
  Coding DNA Sequence Number=SeqID_85358
  Gene Ontology: Mol. function=RNA-directed DNA polymerase activity; Cellular component=chromatin; Biological process=chromatin assembly or disassembly
  Pfam annotation: Domain name=Chromo; Domain location=584-638; Score =33.8; E_value=6e-07; Accession=PF00385.14; Description='chromo' (CHRromatin Organisation MOdifier
MCVDLRALNRVTIPDKFPIPVIEELLDELQGAKYFSKLDLSSGYHQVLEVLRHNKLFVRREKCTFGQEQVEYLGHIISVRGVAVNPAKVKSVLEWPRPKNVKGVRGFLGLTGYYRKFIGDYGKIARALTALTKKNGFKWGALAQQAFDALKKCVTEAPVLRLPNFEEQFELECDALGTGIEAILMQNRQPIAYFSKTLGEKNLSKSAYEKELMAVVLAIQHWRPHLLGRKFVVFSYQRSLKQLLSQRVLTGNQQNWLAKLMGYNFEIIYKPGNENKGADALSRSLEDAKLTNMIYYPEWLDWQQLTHEVQQDTHWKKVISDLQQDKEAHTGFSYNQGVLPYKGRLVMHEKSPWIQKLLEEFHSTPQASHSDFYRTYRRLTKYSHFVPLKHPYTAKGIAEIFVREVVRLHGVPKSLVEFWINTTHHEFIGTTPFAVVYGREPPKIIPCIPGEVRVESAQRELIDRDEALRQLKTHLLRAQDRMKTQADKHRKEREFEVRDMVFLKLKQHMRHSVMARISPKLSARYYGPFKILEKIGKVAYKLQLPPTSRIHPVFHVSLLKKAVGNYEAEADLPTGLEDDRADINEPEAVLASRKVIKHGEILKQWLIQWKGKSVDEVTWEDEISIRSQFPTLCLEDKTIAQRGGIDQPLVKNYVSL

SEQ ID NO: 202137 - protein, 144 aa, Glycine max
  Coding DNA Sequence Number=SeqID_85359
MKRVVEEEPVVEKKAPLKMACKTINEEEEPCRCRTGSLCSFVFSCHIVWRRKENGFELPVSEPYWSHIEVVSSLRKPIGIGYGCDTDTFPFFTYPSFTGFRDFVNEAVLVVQFLKMERKDGCRVISACFRDFVNEAVLGVVVLD

SEQ ID NO: 202138 - protein, 134 aa, Glycine max
  Coding DNA Sequence Number=SeqID_85360
MEKRFVVSGKYIALQICDDEDVETMLESFKQQEQMLVLELYIEKDVAGGSMFHSANSLTSCGNNLSYNETQPPTNMSNLHVDEDNDDDDDDDYLVSNSYVEESLDEDDNVDGISDTDDEVTDMIQPVRIVHPAE

SEQ ID NO: 202139 - protein, 667 aa, Glycine max
  Coding DNA Sequence Number=SeqID_85361
  Gene Ontology: Mol. function=protein dimerization activity; Cellular component=chromatin; Biological process=DNA integration
  Homolog annotation: Hit_ID=Q2R1C3; Match level="QueryCoverage=96%, HitCoverage=88%, E-value=1e-170, Identity=47%"; Hit description=HAT family dimerisation domain containing protein
  Pfam annotation: Domain name=DUF659; Domain location=135-298; Score =92.0; E_value=1.8e-24; Accession=PF04937.6; Description=Protein of unknown function (DUF 659)
  Pfam annotation: Domain name=hATC; Domain location=511-600; Score =53.2; E_value=8.5e-13; Accession=PF05699.5; Description=hAT family dimerisation domain
  Pfam annotation: Domain name=zf-C2HC_plant; Domain location=10-72; Score=19.1; E_value=0.00022; Accession=PF07567.3; Description =Protein of unknown function, DUF1544
  Pfam module annotation: Pfam domain module=DUF659::hATC::zf-C2HC _plant; Domain location=135-298::511-600::10-72
MFASLEYQDDHAPLWSFVTIKGKIGDGGSNRLWSCNFCEKVVKSSYSRVKAHLLRICGSVIDTCPKVTDAYLVDLRRVCEEVENRLKSKNVPLPTDKRTPTPPTLPPKRRKSSNIESAFNIEDRNHLRAEIARIYNALRTSLLQQERSHIERLLQPIKSLWSLKGVTLVADGWTDAQRRPLINFMAISEEGPMFLKAIDGSKEYKDKHYMFDLLKDVIKEVGPQNVVQVIIDNALVCKAAGLLIEAEFPHIFWTPSVVHTLNLGVKNICAAKNVDGNENVFNECGWIAEVIGDASFIKVFIMTHSMRLAIFNEFSCLKLLSIAETRFASMIVMLKRLKLLKRCLQNMVISDQWNSYREDDVRKAAHVKELILNDIWWDKVDYILSFMDPMYSMIRICDTDASNLHLVYEMWDSMIEKVKTTIYRHDEVLENEVSSFFEVIHEILNSRWSKSCNPLHCLAHSLNPRYYSDNWLNEVPNRVPPHRDDELSSQRNKCLKRYFPHVNVRTKVYEEFSKFSSCAGDFGSFDSIEDRWALDPKTWWVMHGSCTPILQKVALKLLVQPCSSSCCERNWSTYSFIHSLKRNKMDPKRAEDLVFVHSNLRLLSRKEEWYKEGETRLWDINGDVHDPLDDSARVLEMANLSLDEPDLEAMLFLDDGNGGEENETIRV

SEQ ID NO: 202140 - protein, 151 aa, Glycine max
  Coding DNA Sequence Number=SeqID_85362
  Gene Ontology: Mol. function=protein binding
  Homolog annotation: Hit_ID=Q2QNJ0; Match level="QueryCoverage=87%, HitCoverage=66%, E-value=1e-26, Identity=45%"; Hit description =Expressed protein
  Pfam annotation: Domain name=DUF538; Domain location=5-149; Score =139.8; E_value=7.2e-39; Accession=PF04398.3; Description=Protein of unknown function, DUF538
QPMYSLTEELKSKAEVYYGDKVCREKFSLLLAEIGLPDGLLTIQDIEECGYVKEIGFVWLKLKKKREHRIDNILVCYDTVVTAYVEQNKIKNLTGVKARDFLLWFTLNEICVKGNPEEPVITFKSLVGLSMSFPLSLFEAGKEAKEEAKEE

SEQ ID NO: 202141 - protein, 101 aa, Glycine max
  Coding DNA Sequence Number=SeqID_85363
MRIQDSHSIQDEATTSPSSSESEEAKWEESSEEIYPQEEGQPLMVKDEFKEVSVSSKRCSYVMQSYPPRALDRRLQEDWARDAREGPRILMSLRVDFGPMG

SEQ ID NO: 202142 - protein, 181 aa, Glycine max
  Coding DNA Sequence Number=SeqID_85364
MSFLGETDSQTIVNSRLGFIFPNGSIIHNDTGVYFQTSTPVLIRVPNNYDFASLKIRIHNTLQLSDKQFLDEIHYRKPFTHTGNQIRFQCMKLINDDDVNTMLMCNDKFSCVGPIELLCTVGRTPDGVINLLQRTMPRTHDAILYYNGKWNMSPQNKFVGCVFTGKNPKKFQIPSTCTSMN

SEQ ID NO: 202143 - protein, 83 aa, Glycine max
  Coding DNA Sequence Number=SeqID_85365
MAKGGELDTAEPEEIAQDECLGNKAEKGVVKDLEERVDTGSTMAVTEGDLFCDKQMTPNKNLRAANPKKRGEPESSKSKRSGA

SEQ ID NO: 202144 - protein, 142 aa, Glycine max
  Coding DNA Sequence Number=SeqID_85366
MGEAHNVPRGHALANFKPHLGHATEGQAFCGEPLPNTLGGPQYRPQSQPLHFAVGRVPPGMVKRERFDHIKERLRAIEGGGDYAFADMVELCLVPDIAIHPKFKVPDFDKYKGTTCPKNHLKIYNRKMGAYSKNEKLLMHFF

SEQ ID NO: 202145 - protein, 190 aa, Glycine max
  Coding DNA Sequence Number=SeqID_85367
  Gene Ontology: Mol. function=chitin binding; Cellular component =extracellular region; Biological process=chitin metabolic process
  Homolog annotation: Hit_ID=UPI000044A8F0; Match level="QueryCoverage =87%, HitCoverage=99%, E-value=2e-28, Identity=31%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
MTVPLNESISCFLIRVNPWVLVSIAFRGLHSLAFRGLHTPAFRGLDALDFRGQHILDFRGLYALAFRGLQVLTFRGLHVLAFRGLHVLVFRGLHALAFRGLHVLTFRGLHVLTFRGLHALAFKGLHVLPFKGLHVLAFSGLHVLAFRGLHALAFRGLHVLAFRGLHVLAFRGLHALYFRGLHALTVKGLH

SEQ ID NO: 202146 - protein, 68 aa, Glycine max
  Coding DNA Sequence Number=SeqID_85368
MDASRWCRFFVYPFKISVYRSTGVNDFATYDIEEKAQMSYDKTDFVRKDVSYLHGQKLLHQDVTIIRL

SEQ ID NO: 202147 - protein, 183 aa, Glycine max
  Coding DNA Sequence Number=SeqID_85369
MHYPPSSLEPPRIDCPSADRLSGTLKSYQEPHELLVIHASSAIESGTPRVDGLALFVYPPPSNHIRSPMKCLSAVRLSGTLKSYPEPHELLVIHASSAIESGAPRVDCLALAVRLSGTLKSYPEPHELLVIHASSAIESGTPRVDGLARFIYPPPSILIRSSMKCLSFMHPPPSSLERHELIS

SEQ ID NO: 202148 - protein, 109 aa, Glycine max
  Coding DNA Sequence Number=SeqID_85370
MMMKDNYQLKGTLLSFKVFWTGSMDSKHMFMKDCHHQKGGDYGSNALQGYFDDAKESRVKQNPKIQESSFKFQDSRLKNQDLRIIKIKIQESREDSIKISTKKVFQNIE

SEQ ID NO: 202149 - protein, 148 aa, Glycine max
  Coding DNA Sequence Number=SeqID_85371
  Homolog annotation: Hit_ID=Q2HSD9; Match level="QueryCoverage=52%, HitCoverage=35%, E-value=5e-10, Identity=44%"; Hit description =Probable disease resistance protein at1g12280
MKSQRAKNLVDLMREIRKETFNRISYRCALRCNVSPAIREYVALESKTLMLNEIMQVLEDGRMDIVQLYGMVGLGRTTLVKELFDQLTKLGRASRCGSNVCQDYFDDAKESRVKQVSRMKIKIQDSRIIKIKIQVKNQDSRFKNQENT

SEQ ID NO: 202150 - protein, 136 aa, Glycine max
  Coding DNA Sequence Number=SeqID_85372
  Subcellular localization annotation: CTP_CleavageSite=69; ConfidenceScore=5.51e-01
MTAIDFTLFFVLRPGSSLLFCASSSPSPIIGDRFSFVKTNRLRILCPNTLEGTSFVVQVDGTSTWGSVQVEGTSAWLFKENKGGYIPCGSLACKGFYKVERNLKNRLVAWGLNVGMDCGRTSINLVFVFFFPTVIP

SEQ ID NO: 202151 - protein, 113 aa, Glycine max
  Coding DNA Sequence Number=SeqID_85373
MDEDQWMYDNIMFEEVDMDDENEHESGVNKEQHVDCSDAFDTSQVFATRDDVLQSDTNTGMRGRTSFVLIGCERSDQYRSRKKDFVRRDTGVGSVGVPSSFVGNQWLEGKVGW

SEQ ID NO: 202152 - protein, 127 aa, Glycine max
  Coding DNA Sequence Number=SeqID_85374
  Homolog annotation: Hit_ID=Q1SKD7; Match level="QueryCoverage=91%, HitCoverage=30%, E-value=2e-10, Identity=31%"; Hit description =Ankyrin
MGSSAASEFDSHCFRCVEHQQRFEAIKGWSFHRERRVQLREDNYPDFQGDISRRHWARLVTPLAKFNPEIVIEFYANAWPTEEGVRDMRSRVRGHWVQFDANVSSQFLGDPLILKEDQQCEFSQRRS

SEQ ID NO: 202153 - protein, 128 aa, Glycine max
  Coding DNA Sequence Number=SeqID_85375
METARGTFARKVHAWPKQTASGTGEFAVVKESPLGMAICACKGNRQFDWRVPPRRLRARSQAMQVQQAMQVQVQRATAGVGGTRHSHWRVGLCGNRQRGWRFVAERTRQLHWRVALIQISCIIKEEVG

SEQ ID NO: 202154 - protein, 517 aa, Glycine max
  Coding DNA Sequence Number=SeqID_85376
DTLGWTWQKWALGLRTSTLRCALIKRTGGETCKVKDFDAQCVLARDVSECVEGLMELGSSVGAPIVGLTWRVDTRKRLSSVKGEGDEFVEPPSVDECFPMLGMVTSTSMIELQVDVACQAPEPGQVLSGFRAPLQLSPVTEESVFILNGVDDTRCGASNNESSFLERMRVARRIGGALLALVGGRDLLLLSESLPHHSVGLPLSTPAVVGYEWVRDDVLKYKSSLTSAKSVVVLQCHVKLVSPKDSCKLAVQACRSDDFPFLRVAPSSLPFFFMYRCLFKVLGLILPLISFQCVLLEQLNVSPSQLHPNSWAMVLATDVVADGLPLMFNRERDCCFSFYWQSNPTRVDKAILEQLSVSMDAWAILSLPSVSDPLVALDGIMGDFAWRPLVKQVRLVGGTVPPFVAVLVVGERGQPTGEVGPIVVIAEVTHSAPSSILAKRKHDDGVGPSGRKKSKAPMSLHALRQSATFAVVEVSVPATLAGFVVASLSTIATPLLSVSVATINAPAVLPPSSSAPM

SEQ ID NO: 202155 - protein, 124 aa, Glycine max
  Coding DNA Sequence Number=SeqID_85377
EVVAAQLAQASQVASSRSNSLLEEYSGGPKWAWHLVHQQAANHRGQVQIHECVYRFSLSQRGQGSAPFACPTPKQFGAEVAWPRDWPEAQPGEEPAGSPSEVEEARMDEEMTNLLVFLGGSGAT

SEQ ID NO: 202156 - protein, 52 aa, Glycine max
  Coding DNA Sequence Number=SeqID_85378
MEELDEGCMVGHDWLRNPKRMPNSFSFCIRFKKSVLETMTSLKPFNEGVRRG

SEQ ID NO: 202157 - protein, 73 aa, Glycine max
  Coding DNA Sequence Number=SeqID_85379
MQGVKCLQVVFGACSIGCLWVVLGGGGAYLGEAGITCSGMKKIMKVYYELPNLKDWNLPSTPNQLIQKIGIYH

SEQ ID NO: 202158 - protein, 50 aa, Glycine max
  Coding DNA Sequence Number=SeqID_85380
MVEGLGFMPDFFLQSYRHLKTPMIKEARTVECKERELEHQQSSHRKKNHR

SEQ ID NO: 202159 - protein, 78 aa, Glycine max
  Coding DNA Sequence Number=SeqID_85381
TYIQCRSLEEIKNYKKYGSRPRRHKVKTQDKEESNDKTKNEIDEMLVAQGKAKAEVMRTFVEEFLSEAYYNQLHMFNP

SEQ ID NO: 202160 - protein, 111 aa, Glycine max
  Coding DNA Sequence Number=SeqID_85382
  Gene Ontology: Mol. function=transition metal ion binding
MGKTKPIGLPKSHHEDRCRDNGSKILRKLSHWPKQNVLTWKGYDINKYSFYMKSHDDKSKMQNGGISLDTNFEHFCSAFDNIPILTSMPYFGVIENIWELDYSLFIVLVFK

SEQ ID NO: 202161 - protein, 90 aa, Glycine max
  Coding DNA Sequence Number=SeqID_85383
  Homolog annotation: Hit_ID=Q1S1V3; Match level="QueryCoverage=50%, HitCoverage=7%, E-value=2e-08, Identity=67%"; Hit description=AAA ATPase
MTLVEEESVVVGEGAGGEDVKEGGFSSATGAHHDQDLGGEGSEGDVFEDAGWGVCGDGGGGGGGNLRGLPWRVGVRVKSNGGREARKSEK

SEQ ID NO: 202162 - protein, 77 aa, Glycine max
  Coding DNA Sequence Number=SeqID_85384
MARESLIFSHKKMWSKTNNQLLFISEFVTVIIPFQRGSSPGHAIARAFFADIFAVINALEMAKEKGGITFGLSVTLP

SEQ ID NO: 202163 - protein, 157 aa, Glycine max
  Coding DNA Sequence Number=SeqID_85385
  Gene Ontology: Mol. function=transition metal ion binding; Cellular component=cytoplasm; Biological process=DNA integration
MIRDLGQESLQQAHAPMYDTLQTDSKKPLHLRCNNSLTLLSAVLSLVNVKAKYGWSGKSISSLLLVVHAMLPKENTLPKSYYQAKRILCLMGMEYQKIHACPNDCILYKHHFEEIHKCPRCEVSRYNVKDDDECSIDENSKKAPSEGVVVSSNHSKV

SEQ ID NO: 202164 - protein, 58 aa, Glycine max
  Coding DNA Sequence Number=SeqID_85386
  Subcellular localization annotation: CTP_CleavageSite=19; ConfidenceScore=5.01e-01
VKMRLSHEVLKVTVELSSSAQQLSSARLSARLALSSNPLTCTEREGGAKRNIVNSEPI

SEQ ID NO: 202165 - protein, 134 aa, Glycine max
  Coding DNA Sequence Number=SeqID_85387
  Gene Ontology: Mol. function=structural constituent of ribosome; Cellular component=ribonucleoprotein complex; Biological process =translation
  Homolog annotation: Hit_ID=P49209; Match level="QueryCoverage=62%, HitCoverage=43%, E-value=2e-32, Identity=82%"; Hit description=60S ribosomal protein L9-1
  Pfam annotation: Domain name=Ribosomal_L6; Domain location=35-114; Score=36.2; E_value=1.2e-07; Accession=PF00347.13; Description =Ribosomal protein L6
MQFDEEKTHRPGRQREASGFVFLRHLGGGTITEVLGGGTSIGNNSKSIEIRNFLDEKKVRKVKMLDGVSVVRFEKVKDELILDGNDIELVSSSCALINQKCHVKNKDIRKFLDGIYVSEDESICVGFWFGDPFF

SEQ ID NO: 202166 - protein, 80 aa, Glycine max
  Coding DNA Sequence Number=SeqID_85388
MGWLLPLAMSIFLSAMDKKEECGGSLGGEIRQEGKGTNLTTSLYKNEACRYSYGDMNLHCTNVDLGSSRIKPSWKMRKID

SEQ ID NO: 202167 - protein, 111 aa, Glycine max
  Coding DNA Sequence Number=SeqID_85389
GSRPQDTQWTRRSPTGSWSCQALITGLCQFYGVPVAPSKVIRPPTNRAFIKKYCVPRQAQGETPQQPRDGRQRATDAPPSPLEFTSAYPQKVRALLMTHGRPIGDQVQSQR

SEQ ID NO: 202168 - protein, 120 aa, Glycine max
  Coding DNA Sequence Number=SeqID_85390
MAVVTPKWIFQSPFPRWYNLNMTCVYHGGVPGHSIEQCVAFKHKHYARRASFALTGARCRNLLFGGRATRDSRVHLPRKENVWSRHQRLFEENVGKTKKRRGLRTLSERFGSCIYTRGRY

SEQ ID NO: 202169 - protein, 277 aa, Glycine max
  Coding DNA Sequence Number=SeqID_85391
  Gene Ontology: Mol. function=transporter activity; Cellular component= outer membrane; Biological process=transport
  Homolog annotation: Hit_ID=Q3BMH4; Match level="QueryCoverage=98%, HitCoverage=41%, E-value=6e-43, Identity=37%"; Hit description=TonB -dependent outer membrane receptor
  Pfam annotation: Domain name=TonB_dep_Rec; Domain location=29-225; Score=37.2; E_value=5.6e-08; Accession=PF00593.14; Description=TonB dependent receptor
MPLLETLTVTGSGRYDAFKIGSNTVDKATYSVGIEFRPIESLLFRGKYGTAFRAPTLSDAFQGRSGYYANGSTDYYRCGQLGYDPANTTGCPYDSVSVFGTRSGNPDLEPITADVWNAGVVWAPINNLSLSVDYYNWKIKNEVDTLSSDQLLLAEYYCRNGQSNNTSASCQNVDDWITRDASGVLDEIYTPKMNVARQNLEALTASFKYVQDIGRFGSLQFSANYTDMLKRKLQPQPGDEFLDLLHDPYAMWVYDSYAKVRADGSIGWAKDNWDHHP

SEQ ID NO: 202170 - protein, 243 aa, Glycine max
  Coding DNA Sequence Number=SeqID_85392
ALAPKMNGAKRSAEAVGCKKESVGERSALEGRTRASSAGRSGSENVGLSNANVGENPMPRKPKGSSARFVHGGVIRGRENASSQSSSTRRYSAEVIHAILPGKARTTFNKWVPVPETDTGVPPHKGGRSDQARATVYQNTGLRKVGSRRPKPPVNGGRNYNGPKGKEGLLLGGPEPSVRYHSGRARILTLCQDLRAEGQSQAEGSLTARPTRRAGTKVGLSDPTVPSGRAVAQRIKVTLGITG

SEQ ID NO: 202171 - protein, 80 aa, Glycine max
  Coding DNA Sequence Number=SeqID_85393
MYINLPIYGSFWLSTRLALSSNSLTRAKHENGAKHDVKIKKPFLILICIELKEVLNSRQRFEEYEFQRAQSRARGQVFIF

SEQ ID NO: 202172 - protein, 130 aa, Glycine max
  Coding DNA Sequence Number=SeqID_85394
MFLKLPYTRDYLAWYQEKVNTKGAQKKLMTKHQRSTKLDPSYLEYVDALHSVQNSNSSIKHSASSSDQAIPRRTMPMLDQFHLCIHDSIENIVDVKVDDNYGYRAIDVLLGISEDSWSLVCNHFLKELAK

SEQ ID NO: 202173 - protein, 144 aa, Glycine max
  Coding DNA Sequence Number=SeqID_85395
  Subcellular localization annotation: CTP_CleavageSite=58; ConfidenceScore=5.22e-01
WRNHPNLKWTSPPQQEQPVPPFQNVTGPSKPYVPPPMQQQQQQSQQRQPATEAPPQPSLEELQETRASIQSLTNQMGQMATQMNQAQSQNSDKLPSQTVQNPKNVSAITLRSGNQIQVPPPVAAPAPEPVKLHSTPEKEDEIVA

SEQ ID NO: 202174 - protein, 90 aa, Glycine max
  Coding DNA Sequence Number=SeqID_85396
  Subcellular localization annotation: CTP_CleavageSite=7; ConfidenceScore=5.01e-01
MPISPCRCTGIAPTRRPVGPKKSNRALGFLALVTGLCQSYRVLVPPESHPQRHPVDPEKSNRALGFPALVTGLCSPIGCSFPPARSHYHR

SEQ ID NO: 202175 - protein, 136 aa, Glycine max
  Coding DNA Sequence Number=SeqID_85397
  Gene Ontology: Mol. function=transferase activity; Cellular component= intracellular; Biological process=metabolic process
  Homolog annotation: Hit_ID=Q67V33; Match level="QueryCoverage=78%, HitCoverage=44%, E-value=9e-28, Identity=48%"; Hit description =Ribosomal protein-like
MATPLGIAKEEEWYIIIVKKKCAAAIRILAYGSPADSVDEYVRVGETTTVECLQRFVLGICTIFGNEYLRRPNNEDTECLLQMGAARGFPVLSGRAPAVQFTVNKTQYNMRYYLADDIYPDFATFVKTISMPQGEK

SEQ ID NO: 202176 - protein, 35 aa, Glycine max
  Coding DNA Sequence Number=SeqID_85398
MVGEEPTLHLEDECTSGRWIPDMTTGVDHFLGPRL

SEQ ID NO: 202177 - protein, 153 aa, Glycine max
  Coding DNA Sequence Number=SeqID_85399
  Gene Ontology: Mol. function=RNA-directed DNA polymerase activity; Biological process=RNA-dependent DNA replication
MSRKYVGEVGMGDKTRFWIDAWVKGNCLANFFLRLFLILEQKENLVGGDGVWKEDSWSWEFKWRREMFEWERKLTLRLTNLLQNVQIPKKVALFLIWRAMRDGLPTKDNLRKRGIILEESEAEGRLRRLTLRELYGVRLFLPFGRREITLSSI

SEQ ID NO: 202178 - protein, 42 aa, Glycine max
  Coding DNA Sequence Number=SeqID_85400
MQIAIGNDEFVADWTCGTQTANGVGDFTERGISPLPLATQLV

SEQ ID NO: 202179 - protein, 137 aa, Glycine max
  Coding DNA Sequence Number=SeqID_85401
MGQFAKEFVDLKSGAFSANTKTIPKEQCKVVTTRSGAIGRNANGEKTKKKGFLEVVSEEDEIWLMEKPMSGKDKELPYETSRQKSVAEGVELKKTKNETVRKEKKVSKPILPEGLPYPHVPTRKEKDRQFAYFLNIF

SEQ ID NO: 202180 - protein, 74 aa, Glycine max
  Coding DNA Sequence Number=SeqID_85402
MCRMSLKWPQGSLLQRDPGRIKRQKEPVPLPNMIVIVLGALSTSSASRPSRDGHFTGSDASSSGTTSISTSRRR

SEQ ID NO: 202181 - protein, 176 aa, Glycine max
  Coding DNA Sequence Number=SeqID_85403
MGLRGSGEGFNECKSPTLLAVSSPSHSSRWRLPALQLQLRAEPRKWLLCLSLCTLLVALGNRQSMLRFQHSLEIASTAGGMRLPLISLAPVAACYIHVSGAHEIAIEACGFHAQSMQTTYKTTPWRNKFQNNPKWGISLQKDPKWGNLPQTLDLIFRELAQLHQPYFNVVKRPPLR

SEQ ID NO: 202182 - protein, 98 aa, Glycine max
  Coding DNA Sequence Number=SeqID_85404
  Gene Ontology: Mol. function=DNA binding; Cellular component=cytosol; Biological process=regulation of transcription, DNA-dependent
  Homolog annotation: Hit_ID=Q8S8I2; Match level="QueryCoverage=57%, HitCoverage=25%, E-value=4e-14, Identity=54%"; Hit description =Protein ULTRAPETALA2
MSSCRCKISRFRNGTLQSAIKYDEEKSGSEYSLSVQMWELLITCDDDEDGSSLKASRGCSRSSTCQDCSTCYCEGCIKCRFEDCNCQECRDFMLYAKP

SEQ ID NO: 202183 - protein, 64 aa, Glycine max
  Coding DNA Sequence Number=SeqID_85405
MDIEEDEDIPLILGRPFISTASCVVDIGKKKLEIERKLLDQNFCLQVKEFDEKVLKERTKIDPR

SEQ ID NO: 202184 - protein, 130 aa, Glycine max
  Coding DNA Sequence Number=SeqID_85406
MPEESEEVQALKAELEKTRVVNEKLKVAVIRVRKECDELKDINMSAAEALEREMKKARKEEWSRNKFRGALLGSSNELKLRKIERDKSRMESLMLEDKLKSCQRSKRSLKEQLRKMEENMLIIIDQYKKR

SEQ ID NO: 202185 - protein, 52 aa, Glycine max
  Coding DNA Sequence Number=SeqID_85407
MEELEVGDDTKKEYYFCFIVLHFLFLYFSHRDHAFSVGRTFIQTIILPICFA

SEQ ID NO: 202186 - protein, 215 aa, Glycine max
  Coding DNA Sequence Number=SeqID_85408
  Gene Ontology: Mol. function=transcription coactivator activity; Cellular component=nucleus; Biological process=chromatin modification
  Homolog annotation: Hit_ID=Q1T094; Match level="QueryCoverage=97%, HitCoverage=39%, E-value=2e-57, Identity=52%"; Hit description =SWIB/MDM2
  Pfam annotation: Domain name=SWIB; Domain location=2-71; Score=74.9; E_value=2.5e-19; Accession=PF02201.9; Description=SWIBMDM2 domain
MLSPALREVLGVQVDTRARIVSAIWHYVKARKLQIPNDPSFFHCDQALQRVFGEDKVKFTMVSQKISQHLFPPQVILLEHMIKLSGNSPVGSACYDVMVDVPFPIQRELNALVANVERTKEIDACDESICGIIRKIHEHRRRRAFFVGFSQSPLEFIKALVESQNKDLKVLLGESRHNAEKDRKSDFFKQPWVEDAIVRYLNRKPAAGSDAPGST

SEQ ID NO: 202187 - protein, 153 aa, Glycine max
  Coding DNA Sequence Number=SeqID_85409
  Gene Ontology: Mol. function=transcription coactivator activity; Cellular component=nucleus; Biological process=regulation of transcription from RNA polymerase II promoter
  Homolog annotation: Hit_ID=Q1T094; Match level="QueryCoverage=52%, HitCoverage=14%, E-value=3e-15, Identity=51%"; Hit description =SWIB/MDM2
  Subcellular localization annotation: CTP_CleavageSite=41; ConfidenceScore=5.14e-01
MSMNNNNPSNPYGPSSTANPHSQITPGQGQYPRSQAHAIIQAQFQAQLQAHGLTLNPNAKRFPPKPPIHTATTPFKQTEPAPTVPARRKKHKPNEKHLPEKALAILPESEIYTQLLDIEARVDAALVRKKVDIQEALKNPPCIQKTLRIFVFN

SEQ ID NO: 202188 - protein, 93 aa, Glycine max
  Coding DNA Sequence Number=SeqID_85410
TSSKGIRPPTNRAFIKKYCVPRQAQGKTPQQPGDGRQRATDALPSPLEFTSAHPRKGHPLYPQTAGQTLTYIMTSRSTSLEPKSQLIINLDPG

SEQ ID NO: 202189 - protein, 84 aa, Glycine max
  Coding DNA Sequence Number=SeqID_85411
MKNNATTGEGEYADEITTNEILDVCISFLNDHLEETLGSTKIEENHSKFINLTQGKVYGKLGLWLKACRTDGHDICQGVGLVQG

SEQ ID NO: 202190 - protein, 76 aa, Glycine max
  Coding DNA Sequence Number=SeqID_85412
MEEMKREKHASYRGHDSCKSLGDELSDYYRGHHRSYTKHHSQIKEEKRIEGLKREKRIHGDPPVEYWNDLMSALRK

SEQ ID NO: 202191 - protein, 78 aa, Glycine max
  Coding DNA Sequence Number=SeqID_85413
MKEMVIAVVTMMTTMAEVVVVVTIMMTSCDNNGDSGGGGDDDDGGDNSESSESNDGGGCYGDNGGLMTNKTFLEEQKK

SEQ ID NO: 202192 - protein, 105 aa, Glycine max
  Coding DNA Sequence Number=SeqID_85414
PHHNLRIRRSKSPAFVNHPTFCYRDPRVRWHAETPDGNPHTPFAIQQPESPIACGDTLRLSAPCHLETPSLIDKQRPMWSSAPFPKMSASSGRDYFSLTPLSQEL

SEQ ID NO: 202193 - protein, 351 aa, Glycine max
  Coding DNA Sequence Number=SeqID_85415
  Gene Ontology: Mol. function=uroporphyrin-III C-methyltransferase activity; Biological process=cobalamin biosynthetic process
  Homolog annotation: Hit_ID=Q6D1A4; Match level="QueryCoverage=44%, HitCoverage=32%, E-value=1e-48, Identity=65%"; Hit description =Siroheme synthase [includes: uroporphyrin-III C-methyltransferase; precorrin-2 oxidase; ferrochelatase]
PQSARHSAAAFDSAPAPARASHAQPGSVIVHALQTQAAEIIVCLVLAERCPGIQMGDDQNLLRHAAGACGDHRGRRHFMAARDALFLQPVVAGIKLSGIALITKLGELLLQMICRHQLGGAAAHAAGEIGGNVAQLLFGKVARCDRCSLRQQRQTAGNQCCQHAAAESGKHSGCPFLTSRQVALTYCKTNKVNVDYLPLFADLNNRPVLVVGGGEIAARKIELLRRAGAHVRVAARELGHELQALRDINAIEWIAQHFDAAQLDDVFLVIAATDDNALNAQVFDAANARHKLVNVVDDHPKCSFIFPSIVDRSPLVVAISSSGTAPVLARLLREKIEALLPANLGQMAEVA

SEQ ID NO: 202194 - protein, 108 aa, Glycine max
  Coding DNA Sequence Number=SeqID_85416
  Gene Ontology: Mol. function=antiporter activity; Cellular component =integral to membrane; Biological process=transposition, DNA-mediated
  Homolog annotation: Hit_ID=UPI00005F9E54; Match level="QueryCoverage =88%, HitCoverage=86%, E-value=2e-36, Identity=76%"; Hit description =COG2076: Membrane transporters of cations and cationic drugs
MEKSLTEGLNAALSCLCGGRGSDRHHHVESFRGLYPPVAVAAGGAGLRRGILGAVDGGQEYAAGHRVCDLVRHGDRAGVGRRGICLSAKIGLAGDRRHGINYCRRAGD

SEQ ID NO: 202195 - protein, 163 aa, Glycine max
  Coding DNA Sequence Number=SeqID_85417
  Homolog annotation: Hit_ID=Q7N6H2; Match level="QueryCoverage=33%, HitCoverage=13%, E-value=9e-16, Identity=72%"; Hit description =Serine transporter SdaC protein
  Subcellular localization annotation: CTP_CleavageSite=40; ConfidenceScore=5.67e-01
MSNGSSPPAPALIGRNSTPAPIAVPYRPSIHTVSLLRQPVAAASTVPRVPVCELSICLSKIVSNAAGTTAKNSRRPAACGRFTKRAYATRFCPAWIAATQDMHHKGGVQDAARSGRERENEVRGCCLQQGAEEETPPAASLGQRSTSPEDNAGRIENQNARIL

SEQ ID NO: 202196 - protein, 133 aa, Glycine max
  Coding DNA Sequence Number=SeqID_85418
MSEEGELQEQIKADIKALKEKMTTMMEAMMSMKKIMEVNAAAVAATSAIAEVNPTPSSDLNQIKSSNLGYVQNKHAFPPYGLPPNYTPPNVAHTPNENDTNSTPILIEIQQPQSDHAPIPQPMGEHKKYPTII

SEQ ID NO: 202197 - protein, 497 aa, Glycine max
  Coding DNA Sequence Number=SeqID_85419
  Gene Ontology: Mol. function=metal ion binding; Cellular component =nucleus; Biological process=regulation of transcription, DNA -dependent
  Homolog annotation: Hit_ID=Q94JW8; Match level="QueryCoverage=78%, HitCoverage=89%, E-value=2e-56, Identity=38%"; Hit description =Squamosa promoter-binding-like protein 6
  Pfam annotation: Domain name=SBP; Domain location=196-274; Score =187.7; E_value=2.9e-53; Accession=PF03110.5; Description=SBP domain
AASLFHTSVTSIGIVLMESWSYVPEEKGYLFSDEMDFSLDAFMRSRKALVEWDNKSNFVEKDGFNSDREVVRSMEFVDLGFPDLLQKSFHGSQPLETSSYELDSNNSSKRGNSSPHVIALDSSMGEEESDSKHLSSLVESKTHDSSLIDLKLGRLADCKGASSDKVAKEGFTLTSIHPTTLWKRARTSSLPAQAPVCQVYGCNMDLSSSKDYHKRHKVCDAHSKTAKVIVNGIEQRFCQQCSRFHLLAEFDDGKRSCRRRLAGHNERRRKPQFDYVTGKQHKILQSYQGTKYLGSSLQNKPQFPFQDIFQSSILFPGKHAQFSQSGRVKLEEDSIYGSQLAAPVTLDQESSSCALSLLSDQSQYPSCHAAGNPLASPQVFSGIRIPDRDSRVSKKPLRISPADKLAPNESFPCDTISKEVIKNRSAATFSSVGHALEVHNGDDICQPSELFSIKHSLSSEHAATVDLFQLSSHLQRVEQQRNSVLVKWENEDYCFPT

SEQ ID NO: 202198 - protein, 120 aa, Glycine max
  Coding DNA Sequence Number=SeqID_85420
MIHSEVHGISMIIDQSLFFLLTKLPSQGAPFEGTIVDDWKFDYSSHDARCMDLPHEHTPSPPPQRDASSALINEVLSKLRELRTFVDAIDARFDGMDTRITQLEDDMGFIRYCFDPPADP

SEQ ID NO: 202199 - protein, 75 aa, Glycine max
  Coding DNA Sequence Number=SeqID_85421
MTTSLWIMDRAEYFSQIHFNLRVNPATPFFLLFSCFGGNRLSSSTGGEGEGFMFYLEDDLNLVICEARSQLLNSM

SEQ ID NO: 202200 - protein, 1012 aa, Glycine max
  Coding DNA Sequence Number=SeqID_85422
  Gene Ontology: Mol. function=RNA-directed DNA polymerase activity; Cellular component=chromatin; Biological process=chromatin assembly or disassembly
  Pfam annotation: Domain name=zf-CCHC; Domain location=276-293; Score =6.5; E_value=0.082; Accession=PF00098.13; Description=Zinc knuckle
  Pfam module annotation: Pfam domain module=RVT_1::Retrotrans_gag::zf -CCHC; Domain location=527-707::108-198::276-293
MVRDSSDWEQEHEEWRTRLELAEARAKHTEDQLAAFAAKIVSNGSGNVRGEEEETSRCDGRILGDHAERDRWRKLELPIFSGNDAYGWMHHLERYFELRNVHEKEKLRATVVAMEGRALSWYQWWARCNPEPTWDGFKLAVVRRFQPSMAQNPFELLLALKQTGTVVEFVEEFEKYVGALKAIDQEFARGIFMNGLKEEIQVKGTNTFTKPTTIPKASSYTKSMTVDTKPWLDKKTESGTSATNLVSVQAGEMNKTRGGDFKCLSGAEMRDKREKGLCFRCDEPYHREHKCKNKQFCMIIFEEDKEEDKDIEFHEGETFNSLQLSLCSMVGLTSTNYWKIQGVVQNNSVLVLVDCGASHSFISQEVVQKLCLMVEDTPSYIVELGDGHRVKTNFGKLELTLSRDGKLITLVGDPSLTRTELSYGAFVQILKEEGKGLLIQYDSAEQKSVEVSVVPEVISEALQQYSEVFEDPQGLPPQRRLDHTIHLKEGVEIPNLRPYKYPHYQKTEIERLVSEMLEAGIIRPSISPYSSPIILVKKKDSGWRFCMDYRALNKITIPNKFPIPIIEELLDELDGATIFTKLDLKSGYHQIRMKEDDIEKTTFRTHEGHYEFLVMPFSLTNAPSTFQALKNEVLKPFLRRFVLVFFDDILVYSRDLDAHLVHIHQVLAILMQNGLKHLGHVISGGGVAACPIPIDMKGLRGFLGLTGYYRRFVQIYGKLAKPLIELLKKDKFCWTEEATSAFQALKTAMVDLPLLVVPDFTKVFVVETDASSKGLGAVLMQDGKPLAFWSKGLSLRAQQRSVYERELMALVQAQFKWAVKLIGLDFEIQYKPGKENTATNSLSRRDMYAAISILHVEDDDSWDGELQQDPKLQQLVQDLIVSPTSHAGYEFKKGRLLYKGMKGDIKKFIEECDVCQRNKYSTLSPAGLLQTLPIPCQVWQDISMDFVAGLPRVRGKDTIFVVIDRLTKYAHFFPLGHPYNAKEVAALFVKKVVKLHGFPSTIISDKDAIFLS

SEQ ID NO: 202201 - protein, 305 aa, Glycine max
  Coding DNA Sequence Number=SeqID_85423
MGVKVGWVSLNAFKFGKMFQWAKDSSKSDLAKKLTKLMEEHVEGDGARWRKEKKVDTVKKSAVFEKEKVVDVAQKSTSIESEDNPSMRVPWMNNAIHHYHKGTLDHVLVAPNIISLWNANLTNPKFVQSFPFMTQTNRGMMDYVGPEAMKVKLSKTKETSSTRSNSIANDFEFLAKLNMLLWSKGSSISTGIMFSMFELPSIVSHDGLRVSTLIHHNKEESNLAFGHGKWKSARPCPLMGTHTLNHGPNSKSSTDHATNFSVRRIGEVVRKFFNLESIASHYWSHRKFAGYFNSLKNGFALSSIL

SEQ ID NO: 202202 - protein, 144 aa, Glycine max
  Coding DNA Sequence Number=SeqID_85424
MGLPFWGRSLVAREVRGIEEFGSEDEFYASSLSSIFDSNRMEDYLGAKKRTGSKFALIAIYGYKWVFMEGNSYLAQFQTLESIEELKRKIDMMNLDDAKLLIVEPCGAEEHVFMKASKGEADFVYLYEDVFKELNIQFPFLNLE

SEQ ID NO: 202203 - protein, 162 aa, Glycine max
  Coding DNA Sequence Number=SeqID_85425
MDHGGRHLYHVSVDPLREVRKTLHITVLSLEYKFTCMVNASNCLFGSEVPSYHSMFMGFQVMGRRISMMLSWKGCQGMMLLMKVECEFPEHEWVVGMGSEVEMFMEEVPSISLSLSLSRLRRRHWFGGGVMAPPPKAPREGSALEATTEGGGLVIAIIILHP

SEQ ID NO: 202204 - protein, 103 aa, Glycine max
  Coding DNA Sequence Number=SeqID_85426
  Gene Ontology: Mol. function=RNA-directed DNA polymerase activity; Biological process=RNA-dependent DNA replication
MCVVYTDLNKAYPKVAYPLPSIDRLVGATYQKLMDKVFKDILGKNIVVYINGMVAKSSDSSDHPTDLTKIFTELRRYHMRLNSEKCIFRVRREKRFQKSFEKT

SEQ ID NO: 202205 - protein, 217 aa, Glycine max
  Coding DNA Sequence Number=SeqID_85427
  Subcellular localization annotation: CTP_CleavageSite=57; ConfidenceScore=5.12e-01
MDDNNPMVAESTKQKQSQIKSAPHQLAKKEDTGLSTPSQVASSAKVPLSQEASPHPLCSRARDHLRMRRNVKNVTGPVHPYRHQHLLQCLDQKNDIEHSRHAISMPYLSMKLPNQHGDIVTIKADQVEARECYAKSLLDKPYTLTSSKHTDAADVNHVAGATPSLAYLDPRKDEENMRLAPIKELHLLQLGKTPHQCTKIGEKLDDHLKKRIEDVMT

SEQ ID NO: 202206 - protein, 122 aa, Glycine max
  Coding DNA Sequence Number=SeqID_85428
MVVSIIKHLRDFDSIVRDISINMVALLASKLGREADSKEKVFVLLVKAVRYVVLQALKYWIILPAPPDTPNPSETGSSLKGALSYVVEYRGVHVRPSVDERNELKVPCLCKASNYRRFMNWA

SEQ ID NO: 202207 - protein, 70 aa, Glycine max
  Coding DNA Sequence Number=SeqID_85429
MNDQTGFTCLDVRSPSASSSSESLDPIANLFEQDSSQEFDATGCPVCVHVPFHRMPNAWVAGFASVYLNS

SEQ ID NO: 202208 - protein, 46 aa, Glycine max
  Coding DNA Sequence Number=SeqID_85430
MVLTKIDVEIRYSALVLTKIEGDNHGDGEHDRESEDEREQSLQEVE

SEQ ID NO: 202209 - protein, 165 aa, Glycine max
  Coding DNA Sequence Number=SeqID_85431
  Gene Ontology: Mol. function=disulfide oxidoreductase activity; Cellular component=extracellular space; Biological process=antigen processing and presentation of exogenous peptide antigen via MHC class II
  Homolog annotation: Hit_ID=Q5QLT3; Match level="QueryCoverage=87%, HitCoverage=59%, E-value=6e-29, Identity=38%"; Hit description =Putative legumaturain
  Pfam annotation: Domain name=GILT; Domain location=5-93; Score=-20.3; E_value=0.0013; Accession=PF03227.6; Description=Gamma interferon inducible lysosomal thiol reductase (GILT)
MSPEVPLFTIDIVSAPTLGLQFHPISGHVKEYAILAYSNGPDECELNSLESCALNLWHKVDIRYYLINCFEYLVIGGKSMEWVNCLSQLGLPKEPIMKCFNMGNGAQLGKTYINQTAQLYPPPSFLPWVVVNNQPVGKDYANFAHYVCKAYKGAAVPEVCNPPSK

SEQ ID NO: 202210 - protein, 178 aa, Glycine max
  Coding DNA Sequence Number=SeqID_85432
  Gene Ontology: Mol. function=RNA-directed DNA polymerase activity; Biological process=RNA-dependent DNA replication
  Homolog annotation: Hit_ID=Q2HS45; Match level="QueryCoverage=41%, HitCoverage=11%, E-value=8e-12, Identity=50%"; Hit description=RNA -directed DNA polymerase
MVGYPFTWSSSKGIVNGVEERLDRAMVTSVWFEYYPNVELRNSISSILDRSLIILATQEALNHYHMRRRFILKNAWLLEEDVEEMVKGSWNNSSKVDFSDAKKKGDVHEVKLCMDAPIVSHLLLIDDSFFFFRADEREVVVRRFLDDYVATSGKYINLQKSEVTISRNVDQGLKNDVI

SEQ ID NO: 202211 - protein, 123 aa, Glycine max
  Coding DNA Sequence Number=SeqID_85433
MWGSHPQRHPVDPEKSNGALRFPALVTGLYQSYRVPVPPPPRQGHVIIGIVPARHLGDPKKANRVLELSSSNYGSLSVLRSVYRPQQSHQTPLPIELSSRSTAPPGRRRAKHHSSIGMAGSGQ

SEQ ID NO: 202212 - protein, 69 aa, Glycine max
  Coding DNA Sequence Number=SeqID_85434
RSRIVSGHGQKSRQVNGRNQPRYIGTDASGARVTTDRSLPLPGAKQAENVAAGQPSILCVRSFFYYCLF

SEQ ID NO: 202213 - protein, 274 aa, Glycine max
  Coding DNA Sequence Number=SeqID_85435
  Gene Ontology: Mol. function=RNA-directed DNA polymerase activity; Cellular component=chromatin; Biological process=RNA-dependent DNA replication
MSMLLCKGHISCSKCYFANPNDQNVKTWVVSLQSKFDGDPMVNEFEIVVLPKQIEDLLKKEIIRPSVSVWGDVIGQEEEWWLTIKNKYTLPRKDGFMDLLHGTKIFSKIDLKSRYHQVRVKKGDITKMTFRTWYEHYKYMVMPFGVMNALAIFMDYMNNVFHPFADEFVVVFIDDILIYSRTREVHEEHLRVMLEILRETQLYGRLSKCEILLEEVKFLGHVISAEEIAMNPSKVVKISRPTTISNMFSKNFQNGQNPNFVTLLPRSTRGCDAI

SEQ ID NO: 202214 - protein, 96 aa, Glycine max
  Coding DNA Sequence Number=SeqID_85436
MGMYNKVLKYTSDSGASDLTFLPLTVTVASICSEEQGKFEDTDSERNGKMLDREKKLKRRRRRRRKYWMELLWIASTFNRSEWFSSCAPIEESPAV

SEQ ID NO: 202215 - protein, 112 aa, Glycine max
  Coding DNA Sequence Number=SeqID_85437
MSMIRQVVCRSYPLGHYRHAVGIMTGVIKLPVVNNGALKRSRYLGSRICRNEKREEYQRRCSSDENSVENDKEGGIGARGASVAPWHRVPVVVAEVDDPFRFLDDSTILLCF

SEQ ID NO: 202216 - protein, 52 aa, Glycine max
  Coding DNA Sequence Number=SeqID_85438
MVPSKENRVDDHGDDKEGGSGAVGASDDPWCRWATAAEEVDEPFCFFDDSAI

SEQ ID NO: 202217 - protein, 129 aa, Glycine max
  Coding DNA Sequence Number=SeqID_85439
MAHHRGFLKVVRLSEHKGKVVPEIGLCIEKFCDFGLLEYVATYPLAGGRRESSRVRLVEAKLHGESKNNSRVQDKNQEEFKTQEESLESRIKIQGSRSQESRSRFKTQDSRIKRRLNQDKYEKFFSKIE

SEQ ID NO: 202218 - protein, 114 aa, Glycine max
  Coding DNA Sequence Number=SeqID_85440
  Homolog annotation: Hit_ID=Q1SQB0; Match level="QueryCoverage=28%, HitCoverage=8%, E-value=5e-10, Identity=87%"; Hit description =Carbamoyl-phosphate synthase, GATase region
MLAAQLAQASQVASSRSNSLLEESSGGPKELALLLEAPLRAKFRVQRGLAVNKEKGVEDGVGGVLGAGWVVEVAILGYCDWSGSGERPWKNSVARLMLEDGSIWRAKSFGASGT

SEQ ID NO: 202219 - protein, 94 aa, Glycine max
  Coding DNA Sequence Number=SeqID_85441
MTLESEEKRWLFIFAVVRLDNVGVIGAHHVSEDECITCGRNGQHYRSRGTVELVNADAIKFELEESDGGAGQGEVEDGFLGKGVDAILPPKGIG

SEQ ID NO: 202220 - protein, 120 aa, Glycine max
  Coding DNA Sequence Number=SeqID_85442
MTTLAQICMTLLLSNIPPGDHNVDLPLRKDRARRHPVDPEKSNRVLGFPAMVTGLWIAPARHPVDPEKSNRVLGFPALITGLCQFYGVPVAPSKFIRPPINWAFIKKYCAPRQAQGETPQ

SEQ ID NO: 202221 - protein, 402 aa, Glycine max
  Coding DNA Sequence Number=SeqID_85443
  Gene Ontology: Mol. function=GPI anchor binding; Cellular component =anchored to membrane; Biological process=root hair cell differentiation
  Homolog annotation: Hit_ID=Q69F98; Match level="QueryCoverage=92%, HitCoverage=83%, E-value=0.0, Identity=82%"; Hit description =Phytochelatin synthetase-like protein
  Pfam annotation: Domain name=Phytochel_synth; Domain location=10-172; Score=349.7; E_value=4.7e-102; Accession=PF04833.5; Description =Phytochelatin synthetase-like conserv
MSKKQLNGQAVVTMYNFQQYRHISVPGWSLGWTWAKKEVIWSMIGGQTTEQGDCSKYKANIPHCCKKNPIVVDLLPGTPYNQQISNCCKGGVLSSWAQDQSKAVAAFQVSVGSASTTNKTVKVPKDFTLKAPGPGYTCGPATIVKPTQFLQPDKRRVTQALMTWNVTCTYSQFLAQRTPSCCVSLSSFYDNTVVPCTTCACGCQGNSSQSGECVDPDSPHLQSVVSNAGPGKSSITPLVRCTRHMCPIRVHWHVKLNYKEYWRVKVTVTNFNYGMNYSDWNLVVQHPNFDNLTQLFSFNYKAITPYGSITMLWGLKFYNDFLMQAGPLGNVQSELLFRKDKSTFTFDKGWAFPRRVYFNGDVCVMPPPDAYPWLPNAGSRQIVSLLALVMSSLVALVLYADT

SEQ ID NO: 202222 - protein, 119 aa, Glycine max
  Coding DNA Sequence Number=SeqID_85444
  Pfam annotation: Domain name=Chromo; Domain location=38-89; Score =30.8; E_value=4.9e-06; Accession=PF00385.14; Description='chromo' (CHRromatin Organisation MOdifier
MEGDHGGKNKSHPGWALKPQHSPQTLPPMLTEELELVVQPEDILQLRTDAGGNMEVLVKWAHLPSCNNSWERASKMLEVFPSFPLEDKVVLLGGVLIGLLLEQGFLLGRCMREGTKRSF

SEQ ID NO: 202223 - protein, 970 aa, Glycine max
  Coding DNA Sequence Number=SeqID_85445
  Gene Ontology: Mol. function=protein serine/threonine kinase activity; Cellular component=membrane; Biological process=protein amino acid phosphorylation
  Homolog annotation: Hit_ID=Q9FID8; Match level="QueryCoverage=73%, HitCoverage=85%, E-value=1e-168, Identity=46%"; Hit description =Receptor-like protein kinase
  Pfam annotation: Domain name=Pkinase; Domain location=439-711; Score =128.8; E_value=1.5e-35; Accession=PF00069.15; Description=Protein kinase domain
  Pfam annotation: Domain name=Pkinase_Tyr; Domain location=429-711; Score=141.8; E_value=1.8e-39; Accession=PF07714.7; Description =Protein tyrosine kinase
  Pfam module annotation: Pfam domain module=Pkinase::Pkinase_Tyr; Domain location=439-711::429-711
  Subcellular localization annotation: CTP_CleavageSite=92; ConfidenceScore=5.78e-01
MGDTDSMLLSSQDSTVSAKPTSQSPSTNHVPFTTARMSRSQFNYSFPVTPGPKFLRLFFYPASYPSFPHTDSSFKVQCNQFLLLDSFNASLNVDAVKKETIFREYIVYVGDNQMLILSFTPFQPNSYAFINGIEVFSMPSYLYYTSATDTGFTFVGSGTLFSIQSSAVLETYYRIKVGGQGISPGNDTGLFRNWIGHDEDYLITHNLKNNLPGDTDAKMNIIVNPDYVAPKELYSIARDMGSNATLNKISNLIWEFPVDSGCTYMIRLHFCELDPHVYDIGDRVFFIYIASQLAESGADVMSWSQKQKGLAVYKDYAILIPKNDTEKKVNLSLQMHPYQSSWDTEYSGPFLNGLEIFKISDFHLPVQEGHDSMLPVTLWVVSGVFFVLFLFISATYERRQLLLSTNKSINTEDSSLPSDDSHLCRRFSIVEIKVATKNFDDVLIVGVGGFGHVYKGYIDGSSNPVAIKRLKPGSQQGAREFLNEIEMLSELRHRHLVSLIGYCSDDNEMILVYDFMTRGNLRDHLYDTDNPPLSWKQRLQICIGAARGLRYLHSGAKHMIIHRDVKTTNILLDEKWVAKVSDFGLSRIGPTDMSKSHVSTAVKGSFGYLDPEYYNRQRLTEKSDVYSFGVVLFEILCARPPLIHTAEPEELSLANWARYCYQSGTLVQIVDPMLKGSIVPECFTKFCEIGVSCLLQDGMHRPSMNDVVSMLESALQLQEGVEQLKNVGIVTVQVHEERKGNGDNVFNSNEHDYHFKDSDTLLRFLRDNRPKDMHHLDEADERAKGREGEKYIPRKSGTTTVLTYYVKSPIFDVELGGGTYKRDSNKQVNSSLSHVRELFLYVLWASSWAAVEDRHYPMSWGPLELSACRALWVVLYISLKAMNSCVDDKAEYTMVMLGCSYAKVDTMSITDVVDHDDPWVSCHFEKCNGARVTTRPPRGFVISRYAVGMCKDSPFHGVLELEVKFEETQK

SEQ ID NO: 202224 - protein, 47 aa, Glycine max
  Coding DNA Sequence Number=SeqID_85446
MRIKITNRTNMVSGTILDGLHDGLHDSEVWGHDGDDVVTVDLKRVPR

SEQ ID NO: 202225 - protein, 240 aa, Glycine max
  Coding DNA Sequence Number=SeqID_85447
  Gene Ontology: Mol. function=helicase activity; Biological process =viral genome replication
  Homolog annotation: Hit_ID=Q9LTU4; Match level="QueryCoverage=99%, HitCoverage=16%, E-value=4e-74, Identity=53%"; Hit description =Helicase-like protein
MIESERLSYVRNNQKKLRVDKFYSLQQSSEAGNTEGLGQGKRIILPSTFVGSPRYMDQLYFDGIAICSHVGFPNLFITFTCNPNWLEIHRLLTPLNLTPIDRPEIISRIFKLKYEQMLLDLTKNHLLGKVVALEFQKRGLPHVHLLLFLHANNKYPSPNDIDNIISAEIPSQKDDPELYKLVQNHMIHGPCEILRPASPCRKEGKCSRFYPKKFQPTTLIDGDGYPVYRRRNTGQTITKN

SEQ ID NO: 202226 - protein, 390 aa, Glycine max
  Coding DNA Sequence Number=SeqID_85448
  Gene Ontology: Mol. function=hydrolase activity; Cellular component =endoplasmic reticulum; Biological process=metabolic process
  Homolog annotation: Hit_ID=Q5Z861; Match level="QueryCoverage=89%, HitCoverage=89%, E-value=1e-100, Identity=50%"; Hit description =Calcineurin-like phosphoesterase-like
  Pfam annotation: Domain name=Metallophos; Domain location=56-317; Score=25.9; E_value=0.00015; Accession=PF00149.18; Description =Calcineurin-like phosphoesterase
MDSENWKHSLLYLIFLLAILHLTQNYFSHKLFLDNETVRIKKNPDLPLRFRSDGTFKILQVADMHYDSGTIVTRCKDVLASEFEFCSDLNTTQFLKHIIRAENPDFVAFTESLFRAFGPAMESGLPWAAVLGNHDQESTMSREELMSLISLMDYSVSQINPLDDDLTNSSKGGMMTKIDGFGNYNLRVYGAPGSMVANSTVLNLFFLDSGDRAVYQGIRTYGWIRESQLNWLRRVSQKFQGQKQDPLHPTDAISTTKPPALAFFHIPIPEIPQLFYNEIIGQFQEAVACSRVNSGVFQTFVSMGDVKAVFIGHDHTNDFCGNLDGIWFCYGGGFGYHGYGKAEWPRRARIILAEQNGKKSWMNVQRIMTWKRLDDEKMSKIDEQILWQSR

SEQ ID NO: 202227 - protein, 193 aa, Glycine max
  Coding DNA Sequence Number=SeqID_85449
MKREKERERDLEDLEGTVGTEPEGEVGVLLDAHRFIVEEEFVREIVLREVENCEEEDKVSFDQGEGAGVHCCGSWFDIDDKQDQWMYDTIMSEEVDMDDQNEQECGVNEPQVDCSDAFNTSQIIIRDDVLLWTRSIVHENGFVAVIIRSDTNTSSRGRSVGRNNLLEEILGLGNVGVPSSFMANQWLEGKVGW

SEQ ID NO: 202228 - protein, 117 aa, Glycine max
  Coding DNA Sequence Number=SeqID_85450
MAFEFVKKTTKMAATSVTTFRVGSDLRGLIIRIQSKHDTKSGISEMQLLQSNYNAELKMRESLPISSNALKRGSLHYNAQVCKTVLGVLEESGGSGALIANFRDLNCDCNFNLNIVL

SEQ ID NO: 202229 - protein, 55 aa, Glycine max
  Coding DNA Sequence Number=SeqID_85451
MACSPWPIFVGYVNETWIISYKEKFVTAWINKVMHLGNTTNRIICSPGFKKSVTE

SEQ ID NO: 202230 - protein, 116 aa, Glycine max
  Coding DNA Sequence Number=SeqID_85452
  Subcellular localization annotation: CTP_CleavageSite=10; ConfidenceScore=5.01e-01
MMHAPDSTLRSNVVRTNNNQILGNSLSMSTRHSHLGNCAEFVETTRLCIAKDPGRSVHSAPHDHTQHPTYERGQKLVPKTLKGQCIVPPTNIHNMQHVDDVINNNNNLISYSHIHQ

SEQ ID NO: 202231 - protein, 642 aa, Glycine max
  Coding DNA Sequence Number=SeqID_85453
  Gene Ontology: Mol. function=sequence-specific DNA binding; Cellular component=nucleus; Biological process=regulation of transcription, DNA-dependent
  Homolog annotation: Hit_ID=Q66Q67; Match level="QueryCoverage=99%, HitCoverage=88%, E-value=0.0, Identity=74%"; Hit description =Homeodomain protein HOX3
  Pfam annotation: Domain name=START; Domain location=144-368; Score =208.1; E_value=2e-59; Accession=PF01852.10; Description=START domain
AQHERADNCALRAENDKIRCENIAIREALKNVICPSCGGPPMNDDCYFDEQKLRLENAQLKEELDRVSSIAAKYIGRPISQLPPVQPIHISSLDLSMGTFASQGLGGPSLDLDLLPGSSSSPMLNVPPFQPACLSDMDKSLMSDIASNAMEEMIRLLQTNEPLWMKGADGRDVLDLDSYERMFPKANSHLKNPNVHVEASRDSGVVIMNGLTLVDMFMDPNKWMELFPTIVTMARTIEVISSGMMGSHSGSLQLMYEELQVLSPLVSTREFYFLRYCQQIEQGLWAIVDVSYDFPQDNQFAPQYRSHRLPSGVFIQDMPNGYSKVTWIEHVEIEDKTPVHRLYRNLIYSGIAFGAQRWLTTLQRMCERIACLMVTGNSTRDLGGVIPSPEGKRSMMKLAQRMVTNFCASISASAGHRWTTLSGSGMNEIGVRVTVHKSSDPGQPNGVVLSAATTIWLPIPPQTVFNFFKDEKKRPQWDVLSNGNAVQEVAHIANGPHPGNCISVLRAFNSSQNNMLILQESCVDSSGSLVVYCPVDLPAINIAMSGEDPSYIPLLPSGFTISPDGQADQDGGGASTSTSTGSRVMGGGSGPGSGGSLITVAFQILVSSLPSAKLNMESVTTVNSLIGNTVQHIKAALNCPSS

SEQ ID NO: 202232 - protein, 52 aa, Glycine max
  Coding DNA Sequence Number=SeqID_85454
MTKPILKSILWIDQSVAVWKDLHDRFSQRDLLCISDLQEDFYKLHQVVEQLA

SEQ ID NO: 202233 - protein, 165 aa, Glycine max
  Coding DNA Sequence Number=SeqID_85455
DPDLTQLSSDGVPFEGALDDDWKFDFSVHYARRLVCTNQADMTGRLLVDSLALESRILHYLIVLILLPRSSNLAQVSDEDLIVISFLIGAAVVASFGYCKECGGSWVKKGAQQNDDKGHLPVEGDSSLLQSILDRFDGLQTYVGERFDSLERQSGHTIQGDELKD

SEQ ID NO: 202234 - protein, 80 aa, Glycine max
  Coding DNA Sequence Number=SeqID_85456
ISGRGWLRIFNYPRRNTCTWGHVTRFGTPLRLRLITMWGVSCARQGDLDTYYLVFLSESVVWTHLGYFLKDGTTLHLRVE

SEQ ID NO: 202235 - protein, 71 aa, Glycine max
  Coding DNA Sequence Number=SeqID_85457
MAFANALTVMSESSKKVDILESISSSQVVWSSCNATVGHAVGQHSEDNNKLMSCLSILEKLEGIYVAPFTK

SEQ ID NO: 202236 - protein, 89 aa, Glycine max
  Coding DNA Sequence Number=SeqID_85458
MEAEMQTTQQKGEETYLDVNGATQCTSSMPEEKNLQSTTNTSKIMLKKNGLKKKTHNRGRKKKRLKTQLRKEEERAGCTNVFKKRAGVF

SEQ ID NO: 202237 - protein, 60 aa, Glycine max
  Coding DNA Sequence Number=SeqID_85459
MATASGYINARDCCYRDRGQGLAICVIDLQAGNITIHISIGTRSLTRRLRSNFVLQGNKE

SEQ ID NO: 202238 - protein, 125 aa, Glycine max
  Coding DNA Sequence Number=SeqID_85460
MAQKTTLVSACYQAFRITDSKKVYTDNHSGISARQRDSKVSMTYLVSAEDDVNLRVSTGLSAAIDEGRRRRHSKKVYTDNHSGISARQRDSKVSMTDLVSAEDDVNLRVSTGLSAAIDEGRRRRR

SEQ ID NO: 202239 - protein, 99 aa, Glycine max
  Coding DNA Sequence Number=SeqID_85461
MLMHGWLWKGLYILGSGRFLADPNVHDVWMLWKLGGIDGDPVLRGTRIRATWEYVSSVEGGQLGMVDLCVICGCGESTCTIAQSLPSTTYDGYPIILQA

SEQ ID NO: 202240 - protein, 116 aa, Glycine max
  Coding DNA Sequence Number=SeqID_85462
FIEKVAWPGTRPSLVREGGGPSSQEATTPERSPHITPDPPSPVVDHCSPQQLADHPSPVHEMPADPSTPLLKIPEDPATLVLGLTTTPPATPVLHFTDEEGTQDQDTQQDDQSQEF

SEQ ID NO: 202241 - protein, 348 aa, Glycine max
  Coding DNA Sequence Number=SeqID_85463
  Gene Ontology: Mol. function=RNA-directed DNA polymerase activity; Biological process=RNA-dependent DNA replication
FSFIGADETEGTSFQGLTVEGKKPEKNEVSFATWKSAQKVVQEGTGVGWGKVVQLIESKNREGLGFASSAGSATNSVGSSSITSTFCSAGFINNSPEANAVLEDVPEEIVLAFVTPGKLVRNWDAVDIPAVVHASKLGIYEPFEHNNHAFSPNFESPVYEAEEEEDDEIPEELARLLEYEKKAIRPHEEVVEVINLGTEEDKKEVKIGASLEATVKRRVIELLKEYVDVFAWSYQDMPGLDPRIVEHRLPLKPECPPVKQKLRRTRPDMALKIKEEVQKQIDAGFLITSEYPQWLANIVPVPKRDGKVRMCVDYRDLNKASPKDDFPLPHIDVLVDSAAKSKVFSFMD

SEQ ID NO: 202242 - protein, 101 aa, Glycine max
  Coding DNA Sequence Number=SeqID_85464
VLFPNMEGLVDLAAIDAFLAFHHGKESPVVAILAMYDTFDRGCPSIRYKVTARASKRERESRTSPIASQGQSSGGHLLRPRGDPRTSQLLSAYDRLNGPYD

SEQ ID NO: 202243 - protein, 103 aa, Glycine max
  Coding DNA Sequence Number=SeqID_85465
  Gene Ontology: Mol. function=L-gamma-aminobutyric acid transporter activity; Cellular component=integral to membrane; Biological process=gamma-aminobutyric acid transport
  Homolog annotation: Hit_ID=Q48C67; Match level="QueryCoverage=96%, HitCoverage=21%, E-value=3e-44, Identity=84%"; Hit description=GABA permease
MTAQNADVLAQSLKPRHVRMLSIAGVIGAGLFVGSGHAIAEAGPAVLLAYIAAGALVVLIMRMLAEMAVASPDSGSFSTYADKSLGRWAGFTIGWLYWWFWVL

SEQ ID NO: 202244 - protein, 86 aa, Glycine max
  Coding DNA Sequence Number=SeqID_85466
MVAMRTIMLVVTVVDDHDGSCDGSHDSCDENDQDDGGNHGYDRSSPMDKSPNPYGLTVDTDNNKNRTVLLMFLQDNTLWPKWPHKG

SEQ ID NO: 202245 - protein, 57 aa, Glycine max
  Coding DNA Sequence Number=SeqID_85467
MYFFEKRKIACGGELASSFASLCKEQLPMTKVLNMLQVENSSAHSLCESEMLKMQAF

SEQ ID NO: 202246 - protein, 91 aa, Glycine max
  Coding DNA Sequence Number=SeqID_85468
MVNTNLYLCFHQNLKSCMDHPVSNMSVMNMKQETKATHSVDEKGGAYCDREEEDALGVVAIEVKEGVEVGEVVEGREIYLVGKRIARWVMG

SEQ ID NO: 202247 - protein, 48 aa, Glycine max
  Coding DNA Sequence Number=SeqID_85469
MSKQEKANDEKARFTCTEIFFMQTREENRALYWIGKSEITCMHDSLMS

SEQ ID NO: 202248 - protein, 115 aa, Glycine max
  Coding DNA Sequence Number=SeqID_85470
MLGVPLTQFGGGDGFDEEALFLIYPELQVLEWEETLVHLSPLFSPRILPQKPSITFPPVTVKEHFPKASSPTDSDIVARVVGVGRHPQTSSSPVREHRPKPSSPVDSDSDSNSIY

SEQ ID NO: 202249 - protein, 206 aa, Glycine max
  Coding DNA Sequence Number=SeqID_85471
MKYGKVWQVYIARKRDKWGNHYGFVRYLEVGDVKSLKTKLDEIKIENVKMNANVPHFENNSNIGVRRGVMTKNGRAQSDMKPKGPQLGTYRVAREQTYNVPNNKGKGVVDTLYANVVRCPPTDVGQKWRVHKRKENIDNHIKEWTTKMKVDGETKGWLVDRWARRLKDLTLFERLNDIYLSEEGDRVKLRYLNSDAILSLVPPKRC

SEQ ID NO: 202250 - protein, 116 aa, Glycine max
  Coding DNA Sequence Number=SeqID_85472
MIMRGQDIYSSQDEATTSPSSSESEEAKGEASSEEIYPQEDGQPLVVKEKCKEVSVSSKSDQGVPTDPKRIKVIPDWPPPPSVEGRSLEYEEPRDLRSNPFQGGGENAILPPKGIG

SEQ ID NO: 202251 - protein, 103 aa, Glycine max
  Coding DNA Sequence Number=SeqID_85473
MHVRQDLPIMVRTRGLGHALGRIIGKALGREDHHDLDDVPQGQRPTAFVRRQREVAPIAEDDPVLHEDVYAHAAEAIHDVEGFPSGPRDPSVLTNYGDHVAVI

SEQ ID NO: 202252 - protein, 187 aa, Glycine max
  Coding DNA Sequence Number=SeqID_85474
MATRRGGDGYYLPSPRPRLPNIYPYPSPILDGLKFVTPSPCPSGIGIPVLGLSNPRSTLGESLFSKGLSNPRSTLGEPHHNLRQTGPLLLSLLSIGAQVNPWYNNPRSTLGTHSYKTQGTPLVRSLLKNYDDHSQRSKFHKTIYHQTGWQDLQLAEWRKKKDDWRCLFKEKMSQEEVHHHKKPWIRA

SEQ ID NO: 202253 - protein, 50 aa, Glycine max
  Coding DNA Sequence Number=SeqID_85475
MDYIKILRKTSRLLHREKAIWCRGSSSRQAGCFNLKVLACPGKLELTQAS

SEQ ID NO: 202254 - protein, 62 aa, Glycine max
  Coding DNA Sequence Number=SeqID_85476
MKMNLRGRQVEISDPMFPLCNNSEEVAAHLFFNCTQQKECYTNKRYKMELLVDSPHKDHMAT

SEQ ID NO: 202255 - protein, 354 aa, Glycine max
  Coding DNA Sequence Number=SeqID_85477
  Homolog annotation: Hit_ID=Q6D9D7; Match level="QueryCoverage=46%, HitCoverage=98%, E-value=3e-53, Identity=61%"; Hit description=G/U mismatch-specific DNA glycosylase
  Pfam annotation: Domain name=TetR_N; Domain location=14-60; Score =46.7; E_value=8.1e-11; Accession=PF00440.13; Description=Bacterial regulatory proteins, tetR family
  Pfam annotation: Domain name=UDG; Domain location=190-351; Score =84.5; E_value=3.3e-22; Accession=PF03167.9; Description=Uracil DNA glycosylase superfamily
  Pfam module annotation: Pfam domain module=TetR_N::UDG; Domain location=14-60::190-351
MEKLSHKARTRQRILEEAAVVMRECGTEGIGVAALMKRVGLTHGGFYAHFASREALVEAVISEMFADSAQRFAAVLAMEDPAERLNQWIDRYLSAQHCGAPGEGCPIPALVSEVAHLPPDARALFSAKREAVRRQLVQALQQLGHAQAESIASSMQAEMVGGSAPDAGGDASGGQTARRAGDGMSDHDIRDIIAPDLQVLFCGINPGKSSAHTGFHFAHPGNRFWKVIHQAGFTREQLLPEQEQRLLETGCGITMLVERPTIQASELAGAELRDGGARLQEKVLRYQPRALAVLGKDAFQKAFRQRNVAWGEQPQLLGETRLWVLPNPSGLNRASLEEMVAAYRQLHDWLQNKA

SEQ ID NO: 202256 - protein, 127 aa, Glycine max
  Coding DNA Sequence Number=SeqID_85478
MISQWNNRAEFRVEVYPRQEGLLSFNSDYMGEVPETLQYMVSPQGRNTWTVDDLVPYVEKITILSEKQERITEHTKGGHDTDMSTSEHSFGGVVETHPHFSWPTMTPSQQHDAPMATPSAPISSAME

SEQ ID NO: 202257 - protein, 135 aa, Glycine max
  Coding DNA Sequence Number=SeqID_85479
MDARMFSPLLLDVQSTLDIIAAADPANQGPARGVDHKKSDSAAHGNVQLDAVPVSLLDAISGTCIASGASGWSLRSSSEACTSKQILPAWLPWEDFYEGSTVVHNTPLLPGQVKVGVEEVKDPDVPVPVPTDEFP

SEQ ID NO: 202258 - protein, 85 aa, Glycine max
  Coding DNA Sequence Number=SeqID_85480
MSPPPLRPHNHSQTHFKLSGRLPLQALHGLFMLSEWIEAVRLAGRPFAQQKCTAHPSSRFFLALSRGVLRSVDGSLSRQVGLVRG

SEQ ID NO: 202259 - protein, 231 aa, Glycine max
  Coding DNA Sequence Number=SeqID_85481
  Gene Ontology: Cellular component=mitochondrion
MYSLCHLYKIQRFSTLCRLYGIGYRLLCKLNHTKSSTVLRLKAIWLKAKLPFELWLGQCCPVDPYLKGRLIWKLQQAFRPKDLVVPPTSTYKSETFEYLEDMTLLRSWTEAWLKYVRWYYATALSPDVSIEDFIQAPVVTTRSFQRGVRTSLMLRLRLIENCCGETIAEAGLDPKPLTILGSRLGGSEKTKGDADYSIADSEEITDIVGTNLIFMTGPVIDLLLVMQHRVP

SEQ ID NO: 202260 - protein, 50 aa, Glycine max
  Coding DNA Sequence Number=SeqID_85482
  Homolog annotation: Hit_ID=Q9FIJ1; Match level="QueryCoverage=88%, HitCoverage=11%, E-value=1e-12, Identity=73%"; Hit description =Arabidopsis thaliana genomic DNA, chromosome 5, P1 clone:MCA23
MVLVDDAGGAYPRIDHSPWNGCTLADFVMPFFLFIVGVAIALALKYSKAL

SEQ ID NO: 202261 - protein, 85 aa, Glycine max
  Coding DNA Sequence Number=SeqID_85483
  Gene Ontology: Mol. function=hydrolase activity, hydrolyzing O -glycosyl compounds; Cellular component=cellulose and pectin -containing cell wall; Biological process=carbohydrate metabolic process
  Homolog annotation: Hit_ID=Q8S3J3; Match level="QueryCoverage=98%, HitCoverage=14%, E-value=5e-39, Identity=97%"; Hit description =Hydroxyisourate hydrolase
MEELLASGTPLPTLVGGYAHGENGDVACDGYHKYKEDVQLMLETGLDAYRFSISWSRLLPNGRGPVNPKGLQYYNNLINELISNG

SEQ ID NO: 202262 - protein, 371 aa, Glycine max
  Coding DNA Sequence Number=SeqID_85484
ELAKHAYRAKRVHLLGKNIHLLEEIPLAKRGKPRKHKIIGARPTAQYDTRRFHSLDAWNHYIDNVLGRSILPERKVELYHTEFDDFETDFEDPSPKQARVRGHLVKIDADNLNTFLETLVVLEERETLPTYSRYCRLPTDHREIEAALCIPGRGFILNVEGHPGRILKKDLTTLAQVWSVLSYSNLTPTSHTSYLTVDRARLGFPTLIIALCQARGVVSDSLTFECLSSAINLAYIRKNCWNIDDLIVAFRGARRARVRPTDIPSTSAVLTSTPASTSATPSVLAHVDSQHFEAMLQSIHQGQILLLQSLQVVAPPGSILSVEQFLERVAWPGAQPSLDREGEGTTAQVPQQVQDASSETTIPKPFTLHLE

SEQ ID NO: 202263 - protein, 302 aa, Glycine max
  Coding DNA Sequence Number=SeqID_85485
MATGKYLTALGAFGNGPSMFILHMGKGLWGAQAMEIVKRGVWNVYEFLASFALLCEVEGVFSECRLIPLWLQGSAPWYEVWFLPSSSHNLLNVYGGSLEHLLDDSLEVCSGIALPVPNGMTFVAEVDIFDVSAHLPFAVGLFDHDYVGEPRRVPDFSNKIGFEDINYAFVFMDSEVSTELCTLLGPFVHAHNLSATTHCEVRLGRLPGVEAKPHDESRLIQRCFHDNKDDDKGVDKKLKGQSKNEFKMFKIESRTLQDSRGKLKNTSRFKRKVDFKNQESRSRFKTQGSIIKRRLNQDKYEK

SEQ ID NO: 202264 - protein, 135 aa, Glycine max
  Coding DNA Sequence Number=SeqID_85486
  Subcellular localization annotation: CTP_CleavageSite=19; ConfidenceScore=5.32e-01
MVTPLASLPPPPPPSPFPVASESPSTLKRTCKAIWLQSLATRPPGAKRPVVHIDPATGKANGPHKKKLRTYLGIVAHDKVDVTYETWKLNLISLKHLTALAADNDSVDDTVCKKYGISKEKWTQFCQTRRDPSWE

SEQ ID NO: 202265 - protein, 182 aa, Glycine max
  Coding DNA Sequence Number=SeqID_85487
MENYQWEQELQPYNQYEEERNSNLDNLLMQYKEVTESTQRAFKSLEIQVGKLADEVTKFVARREKNFVEVEAHKESLVEEHDSKEKDEEKSEEKTQQWEKHSQVEIQQESILQVNTPPHQLIVKEERHGKHEKALSVILSLIVTTSLAIMWKVLPEYTSFKVLPKCVLCDLHATLKTFDLSS

SEQ ID NO: 202266 - protein, 98 aa, Glycine max
  Coding DNA Sequence Number=SeqID_85488
  Gene Ontology: Mol. function=hydrolase activity, hydrolyzing O -glycosyl compounds; Biological process=carbohydrate metabolic process
  Homolog annotation: Hit_ID=Q8S3J3; Match level="QueryCoverage=76%, HitCoverage=13%, E-value=4e-28, Identity=80%"; Hit description =Hydroxyisourate hydrolase
MEPPQTRLMINVFIVSFLALLVNLVVGVLGADNYSRDDFPLDFVFGSGTSAYQVEGAANKDGRTPSIWDTFAYAGWWLPIIGFDNFGKFLNFLKEIDI

SEQ ID NO: 202267 - protein, 185 aa, Glycine max
  Coding DNA Sequence Number=SeqID_85489
  Gene Ontology: Mol. function=hydrolase activity, hydrolyzing O -glycosyl compounds; Cellular component=cellulose and pectin -containing cell wall; Biological process=carbohydrate metabolic process
  Homolog annotation: Hit_ID=Q8S3J3; Match level="QueryCoverage=94%, HitCoverage=35%, E-value=1e-96, Identity=87%"; Hit description =Hydroxyisourate hydrolase
  Pfam annotation: Domain name=Glyco_hydro_1; Domain location=2-185; Score=-290.2; E_value=0.00039; Accession=PF00232.9; Description =Glycosyl hydrolase family 1
MDKLLGYKCRKDFTYYAEVCFREFGDRVLYWTTVNEPNVFALGGYDQGNSPPRRCSPPFCATNDTMGNSTYEPYLAVHHILLSHSSAARLYWRKYRDKQHGFVGISIYTFGIFPQTNTEKDRVASQRARDFFVGWIMEPLQYGDYPISMKTNAGVIHYTNLNVSDNSDALKNQLRDFTADMAANI

SEQ ID NO: 202268 - protein, 209 aa, Glycine max
  Coding DNA Sequence Number=SeqID_85490
MATMIKAMMSMKKIMEVNAAIVASSSAVAKVDPTPPSGLNQINHPISDMVGQRGKELGSTSDPHFVQVQNKHAFPPYGLPPNYTPPNVVHIPNENFNDSTPILIESQQPQSDHAPIPQPIGVTHERPHHNLANFEPCLEYATEGQAIGGVPLSNTLESPQSRSQPQPLHFAVGRTPPAMGEKGKLDQIEERLRVVEGGEDYALANMEDL

SEQ ID NO: 202269 - protein, 136 aa, Glycine max
  Coding DNA Sequence Number=SeqID_85491
MEAIKEQMATMMKAMMSVKKIMEANVVAIAATSAVAKVNPMLPSGLKQMNHPTSNMVGKDLGKTHEIPYHNLADFEPWLGYTTEGQAVGGIPLQNPLEGPQYHPQLHLLHSTAVKNPHDYGRNGKVGSSRGKAQGH

SEQ ID NO: 202270 - protein, 73 aa, Glycine max
  Coding DNA Sequence Number=SeqID_85492
MPYNMSTGLSKPYHANLSHTRGDNDIASTVINESVVEGEEAQKFLEDVNVLRVEKKGYWKRKRCYNSSGNSMV

SEQ ID NO: 202271 - protein, 78 aa, Glycine max
  Coding DNA Sequence Number=SeqID_85493
MAGEGGGTWQLRWHRRKVGLTDAKYGSPDKNTHRKSCWKTETVRQKKGNELNGTPKIGKRMIEERQEQKGSPRTVGPQ

SEQ ID NO: 202272 - protein, 117 aa, Glycine max
  Coding DNA Sequence Number=SeqID_85494
MNENAIHGGAKQGREWRIALSNQHAWLQTGGWRMHERKRNSWDTEKRGREWRIALSNHYAWLQTRGWRTHERKHYSWGSEKSGREWRIAISNHYAWLQTRGWRMHERKRNSWGSEKK

SEQ ID NO: 202273 - protein, 42 aa, Glycine max
  Coding DNA Sequence Number=SeqID_85495
MSEIERFGGLGMEERRKEEGAAHGLLENVIFIEQDAWPFVLV

SEQ ID NO: 202274 - protein, 206 aa, Glycine max
  Coding DNA Sequence Number=SeqID_85496
  Gene Ontology: Mol. function=nucleic acid binding; Cellular component= integral to membrane; Biological process=protein amino acid autophosphorylation
  Homolog annotation: Hit_ID=Q9FNZ2; Match level="QueryCoverage=99%, HitCoverage=47%, E-value=1e-65, Identity=59%"; Hit description=Zfwd1 protein
  Pfam annotation: Domain name=WD40; Domain location=113-149; Score =36.7; E_value=8.1e-08; Accession=PF00400.22; Description=WD domain, G-beta repeat
  Pfam annotation: Domain name=WD40; Domain location=153-189; Score =33.1; E_value=9.8e-07; Accession=PF00400.22; Description=WD domain, G-beta repeat
  Pfam annotation: Domain name=WD40; Domain location=68-104; Score=6.2; E_value=6.9; Accession=PF00400.22; Description=WD domain, G-beta repeat
  Pfam module annotation: Pfam domain module=WD40::WD40::WD40; Domain location=113-149::153-189::68-104
VITGIALPVGSDKLYSGSTDGTVRIWDCHTGQCAKVINLGAEVTSLISEGSWIFVGLQNAVKAWNIQAMSEFTLDGPKGRVRAMTVGNNTLFAVAEDGVIFAWRGSSKADSPFELVASLTGHTKAVVCLAVGCKMLYSGSMDQSIKVWDMDTLQCTMTLNDHTDAVTSLICWDQYLLSSSSDHTIKVWACIEAGSLEVIYTHTEEN

SEQ ID NO: 202275 - protein, 200 aa, Glycine max
  Coding DNA Sequence Number=SeqID_85497
  Homolog annotation: Hit_ID=Q1SP02; Match level="QueryCoverage=58%, HitCoverage=25%, E-value=1e-07, Identity=32%"; Hit description=IMP dehydrogenase/GMP reductase
MLYAEHRGVRGYDLISSYTGQVRWGPIIVYLRPERVVRQIGYIQTVPPPSVRDSLTGTDIDDRWVHFSDHVAPTGELCVVPGQVAPDYMEWFFQISHPFVTPTEDTVELRPTPPPPTNDDFVEPPVAEVPIASDSPTHSVVDCTTCVRMGRIAEHLERVINLRMVTAGTNLYDIMDLCLRIARDDDPNDNLRPRQRPCIN

SEQ ID NO: 202276 - protein, 56 aa, Glycine max
  Coding DNA Sequence Number=SeqID_85498
MCFREENPSQGASVTLSRRFRKQLCGNSSLLFIVLHRSSFILRHSSTAKSNRSFTL

SEQ ID NO: 202277 - protein, 728 aa, Glycine max
  Coding DNA Sequence Number=SeqID_85499
  Gene Ontology: Mol. function=binding; Cellular component =intracellular; Biological process=metabolic process
  Homolog annotation: Hit_ID=Q1T2K1; Match level="QueryCoverage=93%, HitCoverage=88%, E-value=1e-112, Identity=30%"; Hit description =Tetratricopeptide-like helical
  Pfam annotation: Domain name=PPR; Domain location=197-231; Score =24.3; E_value=0.00042; Accession=PF01535.11; Description=PPR repeat
  Pfam annotation: Domain name=PPR; Domain location=298-332; Score =33.3; E_value=8.7e-07; Accession=PF01535.11; Description=PPR repeat
  Pfam annotation: Domain name=PPR; Domain location=333-367; Score=4.9; E_value=2; Accession=PF01535.11; Description=PPR repeat
  Pfam annotation: Domain name=PPR; Domain location=502-536; Score =39.7; E_value=1e-08; Accession=PF01535.11; Description=PPR repeat
  Pfam annotation: Domain name=PPR; Domain location=537-571; Score=7.6; E_value=0.93; Accession=PF01535.11; Description=PPR repeat
  Pfam annotation: Domain name=PPR; Domain location=573-607; Score=0.4; E_value=6.8; Accession=PF01535.11; Description=PPR repeat
  Pfam annotation: Domain name=PPR; Domain location=96-130; Score=26.5; E_value=9.2e-05; Accession=PF01535.11; Description=PPR repeat
  Pfam module annotation: Pfam domain module=PPR::PPR::PPR::PPR::PPR::PP R::PPR; Domain location=197-231::298-332::333-367::502-536::537 -571::573-607::96-130
MASTPQSLKHGTPQCCAVSPCNQNNTVLLNDWPQFLQFSIGSHDYMLAKAIHGSLIKSGCEGDMFVDNNLMNLYSKFSNMGDAQRIFDEMPVRSIVTWTTLMKGYLKNGDVGSVFCVARDMCMAGEKFNEHTCSVVLQACRSPEDRVFGEQVHAFVVKNGLQENVVVATSLVSMYCRSGQLGCGEKVFGGISVKDAQCINYMILEYGKEGLGDKALWIFVDMLQSGLKPSDYTFTNLISVCDSSVGLYVGKQLHGLAVKYGFMCKTSLGNAVITMYGQHGKVKEAERVFGELDERSLISWSALLSVFVKNGHSNKAFEIFLNMLQVGVPLDSGCFSTVLDGCSEWNNLKFGIQIHGLAIKLGHVSDVNSGTSLVDLYANCGSLQSARVIFDRLPNKTIASFNAILVGYQNSKIRDDEEDPMGFFSKVRFNGVKPDCVTFSRLLCLSANQACLVTGKSLHAYTIKVGLEDDTAVGNAVITMYAKCGTVQDAYQIFSSMNRDFVTWNAIISAYALHAEGNNVLLLFEEMKEQGFAPDEITMLAVLQACSYSGLWETGLHLFNEIESKYGIRPVIEHFSCIIDLLGRAGNLSKAIDIISKCPYPESPLLWRTFVNVCKLCSDLQCGMWASRKLLDLAPNEASSYILVSNMYAEGGMLEEAAKIRTAMNDLKLFKETGSSWIEIDNEVHYFIASDKNHPQSREIYAHLDLLKYEICWSCGNRNNLELISNSL

SEQ ID NO: 202278 - protein, 75 aa, Glycine max
  Coding DNA Sequence Number=SeqID_85500
  Homolog annotation: Hit_ID=P93758; Match level="QueryCoverage=77%, HitCoverage=21%, E-value=2e-19, Identity=74%"; Hit description =Putative DNA binding protein
  Pfam annotation: Domain name=Remorin_C; Domain location=12-75; Score=- 9.7; E_value=0.0079; Accession=PF03763.4; Description=Remorin, C -terminal region
GGALNEVTVQRVRKEEVEAKISAWHNANVAKINNRFKREDAVINGWENEQVQKASSWMKKVEHAIQGLDLGHMQA

SEQ ID NO: 202279 - protein, 95 aa, Glycine max
  Coding DNA Sequence Number=SeqID_85501
MKDEDKGNDKKASCETEKAIRTSNGSVRRITKTARITVRLQHVTNEGNSDVAIPRVVLMPPVTELQCRERLQIRVPKCSSESDQNESESERFQSY

SEQ ID NO: 202280 - protein, 57 aa, Glycine max
  Coding DNA Sequence Number=SeqID_85502
MELASENKPNDLSVQDWEYLINYFSTSKFKDFQYQLLTYVDTTDVKSVNVNPLQNRF

SEQ ID NO: 202281 - protein, 80 aa, Glycine max
  Coding DNA Sequence Number=SeqID_85503
MNRCCGCFGCERGVKKRKIGLYGMCFGEDLSRIRRFEDLGMEEARGEALAAQQDWFRRSDKPYGNRLQDVVIDYRLPVLV

SEQ ID NO: 202282 - protein, 114 aa, Glycine max
  Coding DNA Sequence Number=SeqID_85504
  Gene Ontology: Mol. function=nucleic acid binding; Biological process= DNA integration
MAEEDGIIVSIIFHVNVVANVSKWVVDSEATRHICADRNVLTSYTAVGNGEEQVYLGDSKTTPVLGKGKVLLKITSRKTRAFTLLGKLGVKVSFESKKIVMTKNNVFVGKGYRD

SEQ ID NO: 202283 - protein, 113 aa, Glycine max
  Coding DNA Sequence Number=SeqID_85505
  Subcellular localization annotation: CTP_CleavageSite=52; ConfidenceScore=5.45e-01
MMMIWEGSQSKAHKQIHQGIVVFYAFRSSSSLCSLANAVEFSFSEIRVNATRCMSSSVSTRYCQHRKCWPTKISILDTFRSGLPKAAFDTGGVYTGVTVSTSMSSAIINPLDC

SEQ ID NO: 202284 - protein, 277 aa, Glycine max
  Coding DNA Sequence Number=SeqID_85506
MAQRLHGSSIGDALKDQLLKVNDSLNSALQANMKLARDNENLEDRVHALTIEAKGLEMHAVNVEALVRSQDREIARLQLALAIANKEKEEAIVDKKEEEVLHLCEVSDPSVLDINKDVYDGELMLIDGIPKEVAPTLEKPMTPAKDCNADNVKVKDEGNPYNLNKPSSSTSSEESTREVTDDDSLKLNPYLRRVLRRELLMILLKFILSRRNSTLAEEGTQEETNDESLKFNLGQGEMVLGRELLMILLKFNLSRGDTREGTGPSKLAAKFSFDGTF

SEQ ID NO: 202285 - protein, 86 aa, Glycine max
  Coding DNA Sequence Number=SeqID_85507
MDPRDKKKMTFITKSSNFCYKVMRFRLKMPEQQGEAFGFHAHPPGNTCQLGQVLGHPGHEESLECERNSKANQHDSLLVEIFAKNR

SEQ ID NO: 202286 - protein, 64 aa, Glycine max
  Coding DNA Sequence Number=SeqID_85508
METLGHGQIPSKEGLKFGQQLPREHFEELEVSTFIDTQKLLKVLVIPARELLPIKGKRRFLVEL

SEQ ID NO: 202287 - protein, 150 aa, Glycine max
  Coding DNA Sequence Number=SeqID_85509
  Subcellular localization annotation: CTP_CleavageSite=55; ConfidenceScore=5.01e-01
MKLSMSREKLFGLKCWPTSSTSSTPHHHNLSRNAIKCMWTALPTGMEVELGRYTSASKPQVEYEALLAKLRLAKKDDELARLATSLKPRQLKAFILHSIPEPSVSGKECLQVEEGPPGWKKEILKYLKHETLPTNKGKARKLRVQATKYS

SEQ ID NO: 202288 - protein, 261 aa, Glycine max
  Coding DNA Sequence Number=SeqID_85510
MVEEEEIDKQIKGLALKTTILLSDDSKDDNAKGLDAKNLNFLVKWSFKKKEYIAWDEKESSSSSDSSEEEEANLCLMANNEVDSEDKLLEAFNEMHQEAQKLFMANNFLFGNLRWHVDKLVEIQKELSELKVKNEALQKEKDNSSSNCANTTSVTSTCENCKALQEKVEYFLKKLSKFIMGRDNLEALLAQQKCVIEKAGLGYNNNKKQKADKIFFNVTKASSSPIIFGIPSGKYKWVPMGTKKVANQKGPDIIWVCIAVE

SEQ ID NO: 202289 - protein, 99 aa, Glycine max
  Coding DNA Sequence Number=SeqID_85511
  Gene Ontology: Mol. function=oxidoreductase activity; Biological process=flavonoid biosynthetic process
  Homolog annotation: Hit_ID=Q5Y381; Match level="QueryCoverage=66%, HitCoverage=20%, E-value=3e-17, Identity=75%"; Hit description =Aldo/keto reductase
MAMVESDAEALCHYGLTMTLLVVYDAHELTTTVLSNLATDTLTLHQSIYGSEEALGEAIAEDLQLGLVKSIEELFITSKLWPTNNFPHLVLPALQKSLQ

SEQ ID NO: 202290 - protein, 134 aa, Glycine max
  Coding DNA Sequence Number=SeqID_85512
  Gene Ontology: Mol. function=kinase activity
  Homolog annotation: Hit_ID=Q9SCL8; Match level="QueryCoverage=78%, HitCoverage=27%, E-value=8e-13, Identity=41%"; Hit description =Guanylate kinase-like protein
MVAGEGGEGLGETSGGKDKTSERGDKETKLGEAPTFIPQDLQNGTCNGFELKSGTFETDTIVGNKKYVIGGTYGETFSVKDQILDNNGLGEWVDLIQLGTKPISCNGHSAVLLKDRILILKKNAKPDDCIWFLE

SEQ ID NO: 202291 - protein, 154 aa, Glycine max
  Coding DNA Sequence Number=SeqID_85513
  Gene Ontology: Mol. function=oxidoreductase activity; Cellular component=cytoplasm; Biological process=flavonoid biosynthetic process
  Homolog annotation: Hit_ID=Q5Y381; Match level="QueryCoverage=99%, HitCoverage=52%, E-value=2e-49, Identity=57%"; Hit description =Aldo/keto reductase
  Pfam annotation: Domain name=Aldo_ket_red; Domain location=1-137; Score=-24.6; E_value=7.9e-08; Accession=PF00248.11; Description =Aldoketo reductase family
MEECQKLGLAKSIGVSNFTCKKLEDLLSFATIPPSVNQVEMNPAWHQKKLKEIYDAKGIIITAFSPLGAKGASWGSNVVMGSEILKEIAEAHGRTIAQQGVTIAAKSYNKDKMKQNLEIFDWSLTRDDHEKINQIPHIRINNGPVVFVANLWDG

SEQ ID NO: 202292 - protein, 294 aa, Glycine max
  Coding DNA Sequence Number=SeqID_85514
  Gene Ontology: Mol. function=guanylate kinase activity; Cellular component=intracellular; Biological process=nucleobase, nucleoside, nucleotide and nucleic acid metabolic process
  Homolog annotation: Hit_ID=Q9FVC6; Match level="QueryCoverage=98%, HitCoverage=98%, E-value=1e-113, Identity=69%"; Hit description =Guanylate kinase
  Pfam annotation: Domain name=Guanylate_kin; Domain location=65-169; Score=178.4; E_value=1.7e-50; Accession=PF00625.11; Description =Guanylate kinase
VDTPYVRQQKKILGIDVVAWSNGVIGNAEKPVVISGPSGVGKGTLISMLMTEFPSMFGFSVSHTTRAARGMEKDGVHYHFTEKNVMEKEIKDGKFLEFASVHGNLYGTSVEAVEMVSDAGKRCILDIDVQGARSVRASSLEAMFIFICPPSMEELEKRLRDRGTETEEQVLKRLRNAQAEIEQGKSSGIFDHILYNGKLEECYENLKKLLGLDGYVTPPKSAPKKMNLPRDHSVSKIDDKIIIGCISSGLEKESKNLIMLDVSSLKGGAPGRTRGLDFQVIDSFSDGFNGNEPF

SEQ ID NO: 202293 - protein, 125 aa, Glycine max
  Coding DNA Sequence Number=SeqID_85515
  Homolog annotation: Hit_ID=Q9LIH4; Match level="QueryCoverage=42%, HitCoverage=38%, E-value=2e-10, Identity=61%"; Hit description =Arabidopsis thaliana genomic DNA, chromosome 3, P1 clone:MFD22
MAPVSTRTRMKCKKLEGKKQQKKKSSMVYDATTPTSSATKEIKGEDLNEEDICSSVCSTPKGKRFRIPEVLTCPPAPKKRRVTSCSSSKNKRSPIAFFASPDIELFFFSAIKSSVPASSFTPSGV

SEQ ID NO: 202294 - protein, 203 aa, Glycine max
  Coding DNA Sequence Number=SeqID_85516
MARASDKIIGPSFRLRPEMKLVSHDGQVLPLLTEPIVRAYVLQSRLSALITVWYPFENRGFVNALVERPTDRVPSTFTREVVKVLLMTHLDRGRGYSNDHHRCQATWMTATGTLGEPLHRRTYTIISLMQANTPVSRLESWAFAHLPTIGYFEPKIGALDDLVWDKRVALSSKEGAKAASNMAWAEWQQHIIPLGNVVPPKGP

SEQ ID NO: 202295 - protein, 691 aa, Glycine max
  Coding DNA Sequence Number=SeqID_85517
  Gene Ontology: Mol. function=protein-tyrosine kinase activity; Cellular component=integral to membrane; Biological process=protein amino acid phosphorylation
  Homolog annotation: Hit_ID=P93756; Match level="QueryCoverage=99%, HitCoverage=90%, E-value=0.0, Identity=53%"; Hit description =Putative receptor-like protein kinase
  Pfam annotation: Domain name=B_lectin; Domain location=20-124; Score =77.0; E_value=5.8e-20; Accession=PF01453.15; Description=D-mannose binding lectin
  Pfam annotation: Domain name=PAN_1; Domain location=267-347; Score =35.1; E_value=2.4e-07; Accession=PF00024.16; Description=PAN domain
  Pfam annotation: Domain name=PAN_2; Domain location=267-332; Score= -5.3; E_value=0.0048; Accession=PF08276.2; Description=PAN-like domain
  Pfam annotation: Domain name=Pkinase; Domain location=433-671; Score=- 4.4; E_value=2.7e-08; Accession=PF00069.15; Description=Protein kinase domain
  Pfam annotation: Domain name=Pkinase_Tyr; Domain location=434-671; Score=-24.2; E_value=5.5e-11; Accession=PF07714.7; Description =Protein tyrosine kinase
  Pfam annotation: Domain name=S_locus_glycop; Domain location=134-256; Score=-19.6; E_value=0.001; Accession=PF00954.11; Description=S-locus glycoprotein family
  Pfam module annotation: Pfam domain module=B_lectin::PAN_1::PAN _2::Pkinase::Pkinase_Tyr::S_locus_glycop; Domain location=20-124::267- 347::267-332::433-671::434-671::134-256
QPNQFSVGIRFNSKSIPYNQQTVVWVAGGDVKVGNKSYFELTQEGELVLFDSLGEVSVWTVKTGNRSVASASLLDNGNLVLMDKEQRIIWQSFDTPSDTLLPGQSLFANEMLRAATASKNSKASYYTLHMNASGHLELHWESGVIYWTSENPSASNLSAFLTAGGALELRDRSLKPVWSAFGDDHNDSVKYRYLRLDVDGNLRLYSWVESLESWRSVWQAVENQCKVFATCGQIGVCVFNASGSAECKCPFEVTGGNKCLVPYEGECESGSNMIAYKNTYLYAFYPPDNSFTTTSMQHCEQLCLNDTQCTVATFSNDGTPQCSIKKTGYVTGYSDPSVSSISFVKRCSGPFAVNPGITKSPPPSEPPPRLCVPCVIGASTGTFFTLVILQLGIGLFIYRRKNTTRKKSTLAFTGTNSKGLIVLSFSEIKSLTGDFKNQIGPKVFKGLLPNNHLIAVKDLNASIEERKFRSAVMKMGCIHHKNLVKLEGYCCEFDHRCLVYEYCKKGSVDKYIDDDALGRMLTWRKRVEICSSVAKAICYLHSGCREFISHGNLKCKNVMLDENLVAKVTEFGFAIADGKATYCGFSAEKDIEDFGKLVLTLLTGCCDHDHVKLCKWAYKEWMEERVANVVDKRMEGGYNSEELERTLRIAFWCLQMDERRRPSMGEVVRVLDGSLSVDPPPSPFVFQRPLQ

SEQ ID NO: 202296 - protein, 98 aa, Glycine max
  Coding DNA Sequence Number=SeqID_85518
  Subcellular localization annotation: CTP_CleavageSite=37; ConfidenceScore=5.04e-01
MKNTIFHSSPLQTTTQTLTPSSPPPMTTGCHHEPPLLASEPPHGEERFNHSRILMIHLKDLVENKPPILSFVASLRLIRQALESVVFHLLAKPICWLS

SEQ ID NO: 202297 - protein, 191 aa, Glycine max
  Coding DNA Sequence Number=SeqID_85519
MKGNFYPKLVKVFNFPNLLEAQVLSTLVYMKGNFYPKLVKVFYTCVKDDMEGNFYSIVNGMDMEYVAQSHKEYGGLTAEDRMLMYIITYKLTPRSSNHAQVTNDDLKIINGLKSDYEFLYVVLASRFIDYFKIDVPNEIVDFTKASNEITERHLKKLGMTYLEHEWVMAGEQPVIANDDLMEEKAHEEPAP

SEQ ID NO: 202298 - protein, 86 aa, Glycine max
  Coding DNA Sequence Number=SeqID_85520
  Homolog annotation: Hit_ID=O64438; Match level="QueryCoverage=46%, HitCoverage=17%, E-value=8e-13, Identity=82%"; Hit description=ARG10
MFYSTAVGGLRCYENPKNKITAVPAEEEQIWGAFFKNRESVISPNSNIRLMSVETALGTKGKCEVILELKKLELNIPYVTRIASCN

SEQ ID NO: 202299 - protein, 80 aa, Glycine max
  Coding DNA Sequence Number=SeqID_85521
MAVEWRRRKGYWRCYSTADKVFTPEVLSATQPLRGMLPRIEKTPKIENCGALCELILAERIMTTHLLLGSSAHLAMNYCT

SEQ ID NO: 202300 - protein, 131 aa, Glycine max
  Coding DNA Sequence Number=SeqID_85522
MEDLKKSGCGGVAIIGWEMRVVTTIVIIAVVAICKCVAIVGLEGRVVAVVSLMLLLSTKLASLDVAAMVVLVVSSSLAFGGNNETRPTTSLEIGGMRGGGETNKLGQNITLNQPKKKKEQEFVGFDQLVRI

SEQ ID NO: 202301 - protein, 72 aa, Glycine max
  Coding DNA Sequence Number=SeqID_85523
MEYRERVVVNAERVCKSGVFIAKPPIVRVRVVQDRTVGFRKEGNLVGHCRLVGEAPSIHRNTRTCLDYSFQI

SEQ ID NO: 202302 - protein, 113 aa, Glycine max
  Coding DNA Sequence Number=SeqID_85524
  Gene Ontology: Mol. function=protein-tyrosine kinase activity; Cellular component=integral to membrane; Biological process=protein amino acid phosphorylation
  Homolog annotation: Hit_ID=O49654; Match level="QueryCoverage=94%, HitCoverage=15%, E-value=5e-25, Identity=51%"; Hit description =Leucine rich repeat receptor kinase-like protein
MDAGLPKLVADDVLFSAQKVSAAMGYLAPEYITTGHFTEKSDIYAFGVIILQVLSSNTTIGSSIRTTVESFRFDESVDSNLKGRYSKSEAATLSKLAIQHTLELPDHRLTMLD

SEQ ID NO: 202303 - protein, 110 aa, Glycine max
  Coding DNA Sequence Number=SeqID_85525
  Gene Ontology: Mol. function=transition metal ion binding; Biological process=proteolysis
  Pfam annotation: Domain name=Transposase_21; Domain location=2-108; Score=-66.8; E_value=6.7e-09; Accession=PF02992.5; Description =Transposase family tnp2
MGLKICINASGVGNHGPRQPGNDIDVYLNPLIEDLRKLWDEGVDVFDGNQNETFKLCAMVFCIINNFPTYGNLSGNNVKDHHAFPIYEEDISYVQLKHGKKQCTLNIDVF

SEQ ID NO: 202304 - protein, 64 aa, Glycine max
  Coding DNA Sequence Number=SeqID_85526
MGFTLVDLQKVGYNDDPFITVAQAKQRDIDFLLTNAFINGENQEDYVHENRNDHDEGLWENIPM

SEQ ID NO: 202305 - protein, 87 aa, Glycine max
  Coding DNA Sequence Number=SeqID_85527
MGSEGVPSMVVEVMLVAAVELTDASSWWHEIDDSLAWQDCISYTLVVLYGSTGLDTIESGLSPYQYFGEGFYLLSERAEVKARGIGV

SEQ ID NO: 202306 - protein, 183 aa, Glycine max
  Coding DNA Sequence Number=SeqID_85528
MAICFHWDVLQFSYFFLDLLDLDEEAGMIQKSTNQTDQNENAEEQANDESTNQTLMPDFMKPAHDQYAYRHANGLCVIGLAPSHIAFKDEGGITAIDFNVGKSDRNRIKVTGKQKKIKVIFLVAPVDLSQPNFDFDGSHNFAVFLQPNSNVDLTEIASFPTFDGLLNSAVLSQPNSAMAHLPP

SEQ ID NO: 202307 - protein, 190 aa, Glycine max
  Coding DNA Sequence Number=SeqID_85529
  Pfam annotation: Domain name=G-patch; Domain location=46-90; Score =20.0; E_value=0.00071; Accession=PF01585.13; Description=G-patch domain
MLVSCPSLTPYVEAAEESLETALQSFEVVSCASVETSPLLPCFSNAALMVARVMLKHGYEPRMGVGKDSHGNADVVDIRGNPHKYGLGYESGKLGKRNAPLRLRADRAWPGHVSQCFTSVGIMFEEEVVAIGGEAPQDPSSFVRPCLPNFQLGNWHVTSQSEVYTGDSICEDRSFEDSNNEGLIIDFDRE

SEQ ID NO: 202308 - protein, 93 aa, Glycine max
  Coding DNA Sequence Number=SeqID_85530
MGYEAEMHNMTIAISAKNCTINIVMDSLRDFSLHVTIGVVGPYHCPSQEEYVAYVASLGFGDNAKADQGGGQAIQEEAMEEHAAHDGRGDEGH

SEQ ID NO: 202309 - protein, 208 aa, Glycine max
  Coding DNA Sequence Number=SeqID_85531
  Homolog annotation: Hit_ID=Q1SE16; Match level="QueryCoverage=91%, HitCoverage=52%, E-value=2e-38, Identity=42%"; Hit description=Amino acid/polyamine transporter II
MKNSASESGLYIIESDEDVEKDLQKDENDGNESDYSNDSNENQSMRKPSNYSIAWPQSYRHTLEVLQPEKKPLLKPTEEEQPRHTLLPPQISRKSSIRISKVSHEPHIPGQCTFGQAVLNGINALCGIGILSTPYAAKEGGWVGLSILLLYAVFSFYTGLLLRYCLDSAPGLETYPDIGQAAFGTTGRVIISHGKHGEIAAKWTISSN

SEQ ID NO: 202310 - protein, 134 aa, Glycine max
  Coding DNA Sequence Number=SeqID_85532
  Gene Ontology: Mol. function=protein serine/threonine kinase activity; Cellular component=membrane; Biological process=protein amino acid phosphorylation
  Homolog annotation: Hit_ID=Q40543; Match level="QueryCoverage=70%, HitCoverage=22%, E-value=1e-36, Identity=71%"; Hit description =Protein-serine/threonine kinase
  Pfam annotation: Domain name=Pkinase_Tyr; Domain location=1-119; Score=-141.3; E_value=0.00084; Accession=PF07714.7; Description =Protein tyrosine kinase
MLIQVIMLGRLHHRNLVNLLGYCIDKGQFMLVYEFMSNGSLQNLLYGEEKELGWDERLEIAVHITHGIEYLHERVVPPVVHRDLKYANILLDHSIRAKNFLNNMNGHYSVIIPNISMIFPSLCQHSFKMKVEAY

SEQ ID NO: 202311 - protein, 94 aa, Glycine max
  Coding DNA Sequence Number=SeqID_85533
  Homolog annotation: Hit_ID=P16181; Match level="QueryCoverage=86%, HitCoverage=58%, E-value=8e-08, Identity=38%"; Hit description=40S ribosomal protein S11-1
SKKTRKGKSPGKGGNRFWKFIVVGFKTHREAIEGDFFVFFSLCQGLLLIVFCVLDCVFERMIADLVFTYNHYFRKENCVPLHPRDLVGLKVTSP

SEQ ID NO: 202312 - protein, 161 aa, Glycine max
  Coding DNA Sequence Number=SeqID_85534
  Gene Ontology: Mol. function=electron carrier activity; Cellular component=integral to thylakoid membrane; Biological process =electron transport
  Homolog annotation: Hit_ID=P49161; Match level="QueryCoverage=99%, HitCoverage=65%, E-value=4e-69, Identity=69%"; Hit description =Apocytochrome f precursor
GYENPREATGRIVCANCHLANKPVDIEVPQAVLPDTVFEAVVRIPYDMQVKQVLANGKKGALNVGAVLILPEGFEWAPPDRISPEIKEKIGNLSFQNYRPTKKNILVVGPVPGGNRGRGQIYLDGSKSNNNVYNGTAAVDALDGREVIDIIPPGPELLVSE

SEQ ID NO: 202313 - protein, 147 aa, Glycine max
  Coding DNA Sequence Number=SeqID_85535
EQQAEWVNAQRQILRPLSFRNDKDIFCALIIREQQAEWEREVEWVNAQRQFLCPLSFRSSESGGTTSWVEQQAEWVNAQRQILRPLSFRSSEAGDKRAEANSAPVVIQISQVPLAGRFTGRMGQLSYPNFVWGPSVVGMRPSCDNFE

SEQ ID NO: 202314 - protein, 55 aa, Glycine max
  Coding DNA Sequence Number=SeqID_85536
MSRNFMDCLTMGVRFLETVKQRLHAIKQWSPDEIRPTFSGVLTLLGMVKMLTAKA

SEQ ID NO: 202315 - protein, 99 aa, Glycine max
  Coding DNA Sequence Number=SeqID_85537
MYMVTDNLVVTPMSYIYAVSYLNSLKVPFSDLEERVITIGVKEGLGILKALLTSAFALINDLKHLIKTTKGENESITSVWSKFINKDIKDCNNKTGTKI

SEQ ID NO: 202316 - protein, 102 aa, Glycine max
  Coding DNA Sequence Number=SeqID_85538
  Gene Ontology: Mol. function=transition metal ion binding; Cellular component=cytoplasm; Biological process=fucose metabolic process
MGDRLEDMIRDLGQEFFQLARAPVHEGLQSDSKKPLYTGCKNSLTLFFVVLSPVNVKAKYGWSDKSFTSLLEVVHNLLPEDNTLPKNYYKAKKILCPMGMEC

SEQ ID NO: 202317 - protein, 96 aa, Glycine max
  Coding DNA Sequence Number=SeqID_85539
  Homolog annotation: Hit_ID=Q1SP60; Match level="QueryCoverage=81%, HitCoverage=23%, E-value=1e-30, Identity=79%"; Hit description=MPPN
  Pfam annotation: Domain name=MPPN; Domain location=15-96; Score =101.8; E_value=2.1e-27; Accession=PF05172.3; Description=MPPN (rrm -like) domain
MEGIEKMMRERREFPKEEFSSFRFSPGDTNMVLREFEKCGEILKHVPGPRDANWVHILYQNRSDAHKALNKNGMQINGVLIVGVKLLDPMQRQAFK

SEQ ID NO: 202318 - protein, 559 aa, Glycine max
  Coding DNA Sequence Number=SeqID_85540
  Gene Ontology: Mol. function=nucleoside-triphosphatase activity; Biological process=cell division
  Homolog annotation: Hit_ID=Q9LU17; Match level="QueryCoverage=89%, HitCoverage=49%, E-value=1e-123, Identity=51%"; Hit description=Cell division protein FtsH-like
  Pfam annotation: Domain name=AAA; Domain location=455-558; Score =42.8; E_value=1.2e-09; Accession=PF00004.19; Description=ATPase family associated with various cellular activities (AAA)
  Pfam annotation: Domain name=AAA_2; Domain location=452-555; Score= -42.3; E_value=0.015; Accession=PF07724.4; Description=ATPase family associated with various
  Pfam module annotation: Pfam domain module=AAA::AAA_2; Domain location=455-558::452-555
MASHCFLRFPPSLNPKYKRLPKPRYYPSISSRIQTPKPDNDDDNDKTPNDNRFDFLKLSVTLTVISASLPQPAAAAAAATRKVKKRSPKKQSAKKAEGLSPEELKTWTSGLPVVSDRLPYSEIIELKKSGKLKHIIKPNSAKLRQRGEAVLVVLDDSRVLRTVLPSLESHSKFWDSWDELKIDSVCVNAYTPPIKSPELPTSLLANIWVPPFVQKFITYVFEERQTKPKKESKKAAEYREMRMQLQREKEEELRKSREERETMERNTRARKKEEERRKKREIRKRKYKESLRQASDRNERMAYFWSDLANNSNVANALGVLFFYIFYRTVVLSYRKQKKDYEDRLKIERAEAEERRKMRELEREMEGIEGDDEEGEQGKGEENAYLKMAKQFMKSGARVRRAQNKRLPQYLERGVDVKFSDVAGLGKIRLELEEIVKFFTHGEMYRRRGVKIPGGILLCGPPGVGKTLLAKAVAGEAGVNFFSISASQFVEIYVGVGASRVRALYQEARENAPSVVFIDELDAVGRERGLIKGSGGQERDATLNQVKLAVLNFPTAFHK

SEQ ID NO: 202319 - protein, 190 aa, Glycine max
  Coding DNA Sequence Number=SeqID_85541
  Gene Ontology: Mol. function=electron carrier activity; Cellular component=anchored to membrane; Biological process=electron transport
  Homolog annotation: Hit_ID=Q1SP63; Match level="QueryCoverage=98%, HitCoverage=99%, E-value=1e-51, Identity=57%"; Hit description=Blue (Type 1) copper domain
  Pfam annotation: Domain name=Cu_bind_like; Domain location=46-123; Score=106.2; E_value=9.5e-29; Accession=PF02298.8; Description =Plastocyanin-like domain
MASRLFVLSTCVIIFMAATNTCVEASVQFKVGGSFGWHEPAGTNNTDQLYIQWAERNRFQVGDALVFEYQNDSVLSVEKFDYMNCDASNPITAFDNGKSTFNLDRPGNFYFISGTDDHCKNGQKLLVDVMHPHTVLKSPPPISLPPEGFPPMAPPPSDDQSLEASSASVLLTFMFMSLFVTSVSVMLLAF

SEQ ID NO: 202320 - protein, 397 aa, Glycine max
  Coding DNA Sequence Number=SeqID_85542
  Gene Ontology: Mol. function=oxidoreductase activity, acting on the CH-OH group of donors, NAD or NADP as acceptor; Cellular component =chloroplast; Biological process=malate metabolic process
  Homolog annotation: Hit_ID=Q9M4Q9; Match level="QueryCoverage=91%, HitCoverage=55%, E-value=1e-169, Identity=79%"; Hit description=NADP- dependent malic protein
  Pfam annotation: Domain name=malic; Domain location=172-361; Score =418.9; E_value=7.3e-123; Accession=PF00390.9; Description=Malic enzyme, N-terminal domain
  Subcellular localization annotation: CTP_CleavageSite=36; ConfidenceScore=5.75e-01
MFSSTRCAFLSNSGLGGCSSLCDAAQKKRSTRLRVVSMTPSSSSSSRSGDRNGSVVMETPLKELKKESTVADVDDNAISAGGPQDVYGEDRATEDHFVTPWSVSVASGYTLLRDPHFNKGLAFTEDERDAHYLRGLLPPSVIPQETQVKKMIQHVRQYQVPLQKYMAMMDLQERNERLFYKLLIDHVEELLPVVYTPTVGEACQKYGSIFMHPQGLYISLKEKGKIREVLRNWPEKNIQVIVVTDGERILGLGDLGCQGMGIPVGKLSLYTALGGVRPSACLPITIDVGTNNEKLLNDELYIGLKQRRATGQEYAELMHEFMTAVKQTYGEKVLIQFEDFANHNAFNLLEKYRSTHLVFNDDIQGTASVVLAGLVASLKLVGGNLADHRFLFLGAGE

SEQ ID NO: 202321 - protein, 111 aa, Glycine max
  Coding DNA Sequence Number=SeqID_85543
MTHRSLSMSHLCGEAWRFDDAQMKKGEGGVRIGEGRYQDLVCRSFTSMGSMSRFYSESDLDSKLEVSFQRSEIGTCRRRLETFHENNYAFPDSSKTKNEYFWIVHFGIMHT

SEQ ID NO: 202322 - protein, 939 aa, Glycine max
  Coding DNA Sequence Number=SeqID_85544
  Gene Ontology: Mol. function=nucleoside-triphosphatase activity; Cellular component=integral to membrane; Biological process=transport
  Homolog annotation: Hit_ID=Q1T3I2; Match level="QueryCoverage=97%, HitCoverage=87%, E-value=0.0, Identity=48%"; Hit description=AAA ATPase
  Pfam annotation: Domain name=ABC2_membrane; Domain location=769-939; Score=104.5; E_value=3.1e-28; Accession=PF01061.14; Description=ABC -2 type transporter
  Pfam annotation: Domain name=ABC2_membrane; Domain location=81-294; Score=230.1; E_value=5e-66; Accession=PF01061.14; Description=ABC-2 type transporter
  Pfam annotation: Domain name=ABC_tran; Domain location=487-671; Score= 100.6; E_value=4.7e-27; Accession=PF00005.17; Description=ABC transporter
  Pfam annotation: Domain name=PDR_assoc; Domain location=299-363; Score=109.4; E_value=1e-29; Accession=PF08370.2; Description=Plant PDR ABC transporter associated
  Pfam module annotation: Pfam domain module=ABC2_membrane::ABC2 _membrane::ABC_tran::PDR_assoc; Domain location=769-939::81-294::487 -671::299-363
MLIQIGLLYCTHPVTSRKDQEQYWANRSLSYRYVTVSEFANRFKQFHVGIKLENELSVPFDKSRGHRAALVFKKYTVPTMGLLKACWDKEWLLIKRNAFVYVFKTGQIVIIGIIAATVFFRANMHQRNEADAAVYIGSILFTMIMNMFNGFAELPLTIARLPIFYKHRDHLFHPPWTYTLPNFILRIPITMFEAIVWVLITYYTIGLAPEASRFFKHLLLVFLVQQMAAGMFRFISGVSRTMIIANTGGSLMLLLVFLLGGFILPKSSIPNWWIWGYWISPLTYGFNAFTVNELFAPRWSNLSSDGRTPIGIATLNNFDVFTEKRWYWIGAATLLGFIILYNVLFTFALMYLNPIGKKQAIVSEEEASEMEAEGDFRKDPRLLKPEPNREIALQSLSSTDGNNTREVAMQQMSNRGNPSGIRSVDSMHESATGVAPKRGMVLPFQPLAMSFDSVNYYVDMPAEMKGQGVTDDRLQLLREVTGAFRPGVLTALMGVSGAGKTTLMDVLAGRKTGGYIEGDVRISGFPKNQETFARISGYCEQTDIHSPQVTVRESLIYSAFLRLPIEVNNEEKMKFVDEVMELVELNNLKDAIVGLPGVTGLSTEQRKRLTIAVELVANPSIIFMDEPTSGLDARAAAIVMRTVRNTVDTGRTVVCTIHQPSIDIFEAFDERGGQVIYSGPLGRNSLRIIEYFEAIPGVPKIKDKYNPATWMLEVSSIAAEVRLRMDFAEHYKSSSLYQRNKALIRELSTSPPGVKDLYFPTQYSQSTWEQFKSCLWKQRLTYWRSPDYNLVRGNSGDLTTIIGALYGSVFFVGVNNCQTVQPVVAVERTVFYRERAAGMYSALPYAIAQVISEIPYLFVQTICFSFIVYAMVSFEWKVAKVLWFFFVSFFSFMYFTYYGMMTVSITPNHQVASILGAAFYGIFNLFSGFFIPRPIDIIS

SEQ ID NO: 202323 - protein, 362 aa, Glycine max
  Coding DNA Sequence Number=SeqID_85545
  Gene Ontology: Mol. function=nucleoside-triphosphatase activity; Cellular component=integral to membrane; Biological process=defense response to fungus, incompatible interaction
  Homolog annotation: Hit_ID=Q1T3I2; Match level="QueryCoverage=91%, HitCoverage=22%, E-value=1e-145, Identity=79%"; Hit description=AAA ATPase
  Pfam annotation: Domain name=ABC_tran; Domain location=193-338; Score= -38.2; E_value=0.00041; Accession=PF00005.17; Description=ABC transporter
MESGNLTRSISRSLSRSSWRMEGVFASGRYSRRTSNVDEDEEALKWAAIERLPTYDRLRTSILQTFVEAGHDHADARPSTLQHREVDVRKLDVNERQEFIDRIFKVAEEDNEKYLRKFRNRLDKVGIRLPTVEVRYQNLTVEADCYIGSRALPTLPNVALNIAESALGLCGISTAKRTKLTILKNVSGIIKPSRMALLLGPPSSGKTTLLLALAGKLDNDLRVNGEISYNGHKPNEFVPRKTSAYISQNDVHIGEMTVKETLDFSARCQGVGTRYDLLAELARREKEAGIFPEAELDLFMKATAMEGTESSLITAYTLKILGLDICKDTIVGDEMQRGVSGGQKKRVTTGDRDLPMQSNLPR

SEQ ID NO: 202324 - protein, 220 aa, Glycine max
  Coding DNA Sequence Number=SeqID_85546
MSRFRVSDIIVMRRVVTHCLQRPRIREILLFHVPLTISPLITVFLVDFVVMDIMEDVEFSLIFGRLFMLTSKTIVNMGEGKLTTKKFHLIKEVLEESKVEGEKKEEKPKIELKMLPSHLKYVFLEEGGGKSVIISRSLFKLEEEKLVKVLKENKESIGLTISNLKGICPSFFMHKIMLKENFKPIAQPEKRLSPAMKDVVRKKMLNLLEAYMIYLISNSA

SEQ ID NO: 202325 - protein, 79 aa, Glycine max
  Coding DNA Sequence Number=SeqID_85547
MEEKLRALFSTESLRWILKIPFRLKHSSLYGGRTASNDCSWRPPVVVDGGREGLRIWHAYLTKRILLSGWELRLARLSR

SEQ ID NO: 202326 - protein, 125 aa, Glycine max
  Coding DNA Sequence Number=SeqID_85548
MSEVEEVQEQMKADMEAMKEQMATMMEVMMSMKNIMEAKAVVVAATGVVVKVNQMPPSGLNQMNHPTSDMVGKRFGKYGWPHDVQIQNEHTFLPYGLPPNYTPPNVAYTPNEDVNNSVSILIESQ

SEQ ID NO: 202327 - protein, 175 aa, Glycine max
  Coding DNA Sequence Number=SeqID_85549
MKDKRDAEEKLENQKKKKDSMALSSKAKGKEKEEKDSSKKIVKKENHCDKMEISLSTAIPLELEVIPQVKELLDEGLVSPLIQLVRNHVTSWEDAQEMGFQTLPYSNIPNTTNIYVFILFTCVVGRSPEFQEPLDLRSNPFQGVGNDAILPPPKALDRRLQEDWARDAEKALGFS

SEQ ID NO: 202328 - protein, 206 aa, Glycine max
  Coding DNA Sequence Number=SeqID_85550
  Homolog annotation: Hit_ID=Q9FQZ6; Match level="QueryCoverage=91%, HitCoverage=97%, E-value=9e-39, Identity=52%"; Hit description =Avr9/Cf-9 rapidly elicited protein 146
HPLFPSSPLSQIAIEMESNAPVLAEKVWSMVRVLLFMLRKGISKGKLMMDLNMMLKRRGKLAGKAIANLMSHNHNHRGSHKSQLRFSAPREYEFSCSNTPHNLFPTAGKRHRHFFACVHAPPTQDDDVVTVNAMKAVLEMLNNNDVVKVEASPALPGFGRSPIVRQLRVTDSPFPLRDSDHDNDHQVDKAAEEFIKRFYKDLKKQD

SEQ ID NO: 202329 - protein, 187 aa, Glycine max
  Coding DNA Sequence Number=SeqID_85551
  Homolog annotation: Hit_ID=Q337Z8; Match level="QueryCoverage=49%, HitCoverage=91%, E-value=9e-12, Identity=38%"; Hit description =Expressed protein
  Pfam annotation: Domain name=DUF1677; Domain location=62-179; Score =171.8; E_value=1.8e-48; Accession=PF07911.4; Description=Protein of unknown function (DUF1677)
  Subcellular localization annotation: CTP_CleavageSite=22; ConfidenceScore=5.43e-01
MAPPHGKSLPSSFSKCNNNNSVSMSKPPRLSSDHHIQRTISDMSFELTKEGIDLTLPPITEVVDAKCECCGMSEECTPEYIERVRDKFLGKWVCGLCAEAVKEELEKNGGKKEEALSSHMSACVRFNKYGRAFPVLFQAEAMKEMLKKNKMEGRRAKSFNPRDKGGYYKGGIARSSSCIPAITREMN

SEQ ID NO: 202330 - protein, 204 aa, Glycine max
  Coding DNA Sequence Number=SeqID_85552
MVARHRAKVPRTKLGYDNTDDHSGISARQRDSKVSMTDLVSAEDDAFHLTDNKKVYTDDHSGISARQRDSKVSMTDLVSAEDDIAKRMYTDNHSGISARRRDSKVSMTDFVSTEDDAFRLTDSKKVYTDDHSGISARQRDSKVSMTDLVSAEDDGAEDDISLCVLSGLSSYRQQKVYTDNYSGISARQRDSKVSMTDLVSAEDD

SEQ ID NO: 202331 - protein, 194 aa, Glycine max
  Coding DNA Sequence Number=SeqID_85553
MTLLLSNILPSDRNANLPLQKYQLVCVVPTWGSHPQRHPVDLKKSNRDLGFPSLVTGLCRPYRAPVPPSKFMSSWHRDCARKTPSGPEEGQQGLGVASSKYGSLSVLGSACRPQQGHQVPPTNRAFIKKFCVSRQAQGKTPQQPGDGQQRATDAPPSPLEFTSAHPQKGLSIAYTTWPTNRRPSPKPKDAPSCS

SEQ ID NO: 202332 - protein, 75 aa, Glycine max
  Coding DNA Sequence Number=SeqID_85554
MKENAKNETKSAQRKLGGCCQWWLPCYRVQFYLTAYGTPFIEPNGFVFSEQDRECMFLKTIKSKGHNTGSRDANH

SEQ ID NO: 202333 - protein, 201 aa, Glycine max
  Coding DNA Sequence Number=SeqID_85555
GGGPDDMWRQIMVIPHTFSSFRHSRVRWHAETNVVLYTFLSSRGGGPDDMQRQIMVILHTFSPFRHSRVRWHAETNVIFYTLLSSRGGGPDDMRRQIMVISHTFLPFRHSRVRWHAETNVVFCTFLSSRGGVPDDMLRQIMNSKGSANVQSVKFRNIPEAKEGMITGVQIATRPTWAFQEVLQKAVPSRGSNLARWASWVA

SEQ ID NO: 202334 - protein, 265 aa, Glycine max
  Coding DNA Sequence Number=SeqID_85556
MARVARVVKISAQELDRVKQNRNGVESGLHPNVDGLVDLAAIDAFLAYHHSKESPERLLVGSPDGRKEGPEFCARVKDSQTSPRWKQGARMQGITWLPKKKSPSGEEAEVPEESEKVQALKAELERMRVVKEKLKTSVTTIRKECDKLGDVNMTTAEANNELKLQRAERDKSRVESMILKDKLKACQRLEDEHAKVSTLQVEKEARERVIESLHEEATKWMDRFAFTLNGSQELPRLLARAKAMADVYSAPEEVHGLFDYCQHMV

SEQ ID NO: 202335 - protein, 84 aa, Glycine max
  Coding DNA Sequence Number=SeqID_85557
MAATYAQGISKRELKELCSNAIETFHRALGGHAFRHEYQENGDNVACPIIPECNLGLNPSSTTPYFNKTSTNSRIKLLLGFLQV

SEQ ID NO: 202336 - protein, 280 aa, Glycine max
  Coding DNA Sequence Number=SeqID_85558
MTPKNLSTKRSRKDATGEGSSAALEFDSHREDEYSDFQEEIARRRWAPLVTPMAKFDLEIVLEFYANAWPTEEGVREMRSWRRSQADGFDEEAIAQLLCIPGQDFARTAAGRRVRIMRTSMTTLTQIWMTLLLSNVLPSDHNSDLPLPKCQLVYAILTQMSVHVAQKSNRALGFSALITGLCQSYGVPVTPSKVIQPPITRAFIEKHTATTSVSRSDWATRRGALSIAFGSPAGGQPPWTDWPDAQAGEEPAGSPGEADESHMDEDITDLLGFLGGSGAT

SEQ ID NO: 202337 - protein, 97 aa, Glycine max
  Coding DNA Sequence Number=SeqID_85559
MGFIGLVTWLGVRELCKKKSKRLKECLRVILSKNLQSLACCRNMPSLRACEARLTGALSKGGKMRGVTTNVYLWKTSENPKETGQNENSKFGSCIYV

SEQ ID NO: 202338 - protein, 264 aa, Glycine max
  Coding DNA Sequence Number=SeqID_85560
  Gene Ontology: Mol. function=nucleic acid binding; Biological process= DNA integration
  Homolog annotation: Hit_ID=Q0KIN0; Match level="QueryCoverage=91%, HitCoverage=14%, E-value=4e-32, Identity=31%"; Hit description =Integrase core domain containing protein
MASSGPVFSFSGTPTITTAKLNWKNYPSWSASVELWFLGQGHHDHLEKTSDSVSVDKRPEWEKLDYQLCAVLWQSVEPDILEILRSFKSCRSFWKKAQEIFANDIQSLFDATMKVTALKQTSHDMIAHVGKARAAVEELRKFLVADSLEEVNRKLDKFYMVLILRSLHSDFDHVRDQVLAGDQIPSMDSLITRLLRVPHLLKDENPTDGVETSAMVASRGRGSGRNSRGGRSGRGGRPHCTYCKRIGHTQETSLFITWFHDKSH

SEQ ID NO: 202339 - protein, 90 aa, Glycine max
  Coding DNA Sequence Number=SeqID_85561
  Subcellular localization annotation: CTP_CleavageSite=55; ConfidenceScore=5.02e-01
MASINFTRAGFPPTLLFSDLLSFFSSFKTCHNNQNEMHKQREKEIGTLRERECVREKRKLQGLARSRNTVQAQHEHIITVDLVWEVLTVR

SEQ ID NO: 202340 - protein, 103 aa, Glycine max
  Coding DNA Sequence Number=SeqID_85562
MHETINKLYAELLEKANKEKTLEEKMLQMMKNHDHQSQEMRQQMQEQNEKIPQQNKQMQRILQHLHIQSIMLTPSLSPTIADGTEHHINDAQIDHPHDMGNDH

SEQ ID NO: 202341 - protein, 39 aa, Glycine max
  Coding DNA Sequence Number=SeqID_85563
MPACLVQEKHSWLLARIRAHRSTIEYEGIVEGQKLDAIS

SEQ ID NO: 202342 - protein, 93 aa, Glycine max
  Coding DNA Sequence Number=SeqID_85564
MEPIKEELDNKRQLSQKKLQRYHVSLAALTKDLPPKTPTAAHLAAIVKVTQLCKCHYPSPSMLISMSLKEVPNQVKYHPSTRIFPHEEPQGKF

SEQ ID NO: 202343 - protein, 113 aa, Glycine max
  Coding DNA Sequence Number=SeqID_85565
MVVQENKGRYIPCRSLLVKDFTRPLDPTQVPLACASSSKVIAPLVFVTNNNEKAQHNNEPMVHNEPIVEEPQEVALRSSQRERRPVISNDYVVYLHEIETDLSINDNDPVSFS

SEQ ID NO: 202344 - protein, 60 aa, Glycine max
  Coding DNA Sequence Number=SeqID_85566
HCLELNLRSAFSSNHHDHHQNIKDKGFASTATTAHGSHQWSWVVEKEVLGFRWRFGERRE

SEQ ID NO: 202345 - protein, 90 aa, Glycine max
  Coding DNA Sequence Number=SeqID_85567
MATRPTWAFQGVPIEGGAFWWKQPSSPGGKRVEQKCSALLIASTNKALFQDSLKTKPCLKTKCFQDMQGSGNRLPGSVIDYQKTGLRNSC

SEQ ID NO: 202346 - protein, 128 aa, Glycine max
  Coding DNA Sequence Number=SeqID_85568
  Gene Ontology: Mol. function=DNA binding; Cellular component=nucleus; Biological process=regulation of transcription
  Homolog annotation: Hit_ID=Q1SZA2; Match level="QueryCoverage=99%, HitCoverage=39%, E-value=3e-59, Identity=83%"; Hit description=No apical meristem (NAM) protein
  Pfam annotation: Domain name=NAM; Domain location=11-128; Score =214.8; E_value=1.9e-61; Accession=PF02365.6; Description=No apical meristem (NAM) protein
MDKDANSKIQLPPGFRFHLSYEELIVHYLRNKVTSSPLPASFIAEIDLYNYNPWELPTLFGEDEWYFFTPRDRKYPNGVRPNRATTSGYWKPTGTDKPIFTSCGMKSITVKKALVFYKGRPPKGSKTD

SEQ ID NO: 202347 - protein, 126 aa, Glycine max
  Coding DNA Sequence Number=SeqID_85569
  Subcellular localization annotation: CTP_CleavageSite=26; ConfidenceScore=5.09e-01
MSSVSIYYGTQSNIRVKTCCRLNVVRASTFNFERFDTLRDSIRHPSKKLLSFEFAQSFNIQFRAFRYITGLNQTSEASAFNFELFDILRDSIRHPSKKLLSFEFAQSFNIQFRASRYITGLNQTSE

SEQ ID NO: 202348 - protein, 83 aa, Glycine max
  Coding DNA Sequence Number=SeqID_85570
  Subcellular localization annotation: CTP_CleavageSite=19; ConfidenceScore=5.64e-01
MTTTLISPCQSGSRPQDTQCTRRSPIGSTECPSPLARSSGPLLAGLSSRSTVPLGKRRVRHHNSLGTASNGQQMHRPHLQSPP

SEQ ID NO: 202349 - protein, 69 aa, Glycine max
  Coding DNA Sequence Number=SeqID_85571
MEDCLEGPHLCNHETQLLTRKWRTHEQPYAMTFMGLRKRVRMEDCLEGPHLRDHETQLLNRKCRTHEQP

SEQ ID NO: 202350 - protein, 159 aa, Glycine max
  Coding DNA Sequence Number=SeqID_85572
  Gene Ontology: Mol. function=nucleic acid binding; Biological process= DNA integration
  Homolog annotation: Hit_ID=Q1SIY6; Match level="QueryCoverage=73%, HitCoverage=15%, E-value=2e-12, Identity=32%"; Hit description =Integrase, catalytic region; Zinc finger, CCHC-type
MEDQQWSWEEPISKQLLETPQFFDDDVDDILVKSTRPLFEIYQRCNVVVLEPAEFEEAEKDDKWINAPRAWYNKINYNLQNLGFVKSPSEATFYMKYVYANLVIVVVYVDDWLMTRSDEWHHHRRARVLWFLKIGENVVNKEEDKVSIGAKSGDKDGQR

SEQ ID NO: 202351 - protein, 262 aa, Glycine max
  Coding DNA Sequence Number=SeqID_85573
  Gene Ontology: Mol. function=nucleic acid binding; Biological process= DNA integration
  Pfam annotation: Domain name=zf-CCHC; Domain location=47-64; Score =2.6; E_value=0.36; Accession=PF00098.13; Description=Zinc knuckle
  Pfam annotation: Domain name=zf-CCHC; Domain location=68-85; Score =21.8; E_value=0.00025; Accession=PF00098.13; Description=Zinc knuckle
  Pfam module annotation: Pfam domain module=zf-CCHC::zf-CCHC; Domain location=47-64::68-85
MMRHEEAIQSAFHAKTQNSKGGKDKKSNKWKNKNLEGSNKQQGEVFPPCPHCKKTNHPQRKCWWRPDIKCKKCGNLGHVKRICKSKLEEAKVKLEEQGDKQLFVATCLATSNNSSDSWLIDSGCTNHMTNDQKLFKELGKTIVSKKHALVKGVSMLKDKLVDCVAYQYALNLRLDSLQSPFRSRICRQSTSKEEDEEYSDARSHGRRRRGEQRRNNQLRSIKMIIPTFQGKNDPKLYLEWERKVERVFDNSSEEKNVKLDVV

SEQ ID NO: 202352 - protein, 89 aa, Glycine max
  Coding DNA Sequence Number=SeqID_85574
MAYTYLRMLMRFEDKSVKEGGSDGGATSPSNDPLQGIGGPMTRSKAKRKKQTLQGLILKIKEKEDHYELTVAPNWVTPLPVDEDVFRPT

SEQ ID NO: 202353 - protein, 68 aa, Glycine max
  Coding DNA Sequence Number=SeqID_85575
MSLPSAVHVFSIIKCEASGDWEARYSVVFQIGSFAKYSAPRAAQYVKSREVLRIKRKQAYAISENSVM

SEQ ID NO: 202354 - protein, 333 aa, Glycine max
  Coding DNA Sequence Number=SeqID_85576
  Gene Ontology: Mol. function=RNA-directed DNA polymerase activity; Cellular component=chromatin; Biological process=chromatin assembly or disassembly
ADHVWSPEAENTFQTLKNAVTTVPVLALPDFTKPFTVETDASSSGIGVVLSQEGHPIAFFSKQFCPTLLRSFTYVRELAAITAAVKKLRQYLLGHHFVILTDHRSLKELMSQAIQTPEQHKYLARLLGFDYVIQYRTGKSNVVANALSRSGETTPASLLIISVPHFTFLEDLRKELQTNQEFITLREKIRAKTQAYPDHSLTQHFILYQGRIWLPPNCSFIKTLLSEFHQSPTRGHMGFRKTLDRVAENFTWDAMASDTRNFVANCLDCQLVKYEPAKPRGLLCPLPVPLRPWENLSMDFIMGLPAYRGNTCILVIVDRFSKGVHLVMDRVAS

SEQ ID NO: 202355 - protein, 291 aa, Glycine max
  Coding DNA Sequence Number=SeqID_85577
  Gene Ontology: Mol. function=chromatin binding; Cellular component =chromatin; Biological process=chromatin assembly or disassembly
  Homolog annotation: Hit_ID=Q1SAV4; Match level="QueryCoverage=83%, HitCoverage=66%, E-value=5e-69, Identity=50%"; Hit description =Integrase, catalytic region
  Pfam annotation: Domain name=Chromo; Domain location=190-246; Score =27.9; E_value=3.6e-05; Accession=PF00385.14; Description='chromo' (CHRromatin Organisation MOdifier
MSSTYHPQTDGQTEVANRIIEQYLRAFVHRRPSAWGHFLMWAEWLYNTSTHSATGLTPFEITFGRKPPSFPQYLTGTSTVAAVDELLSQREDMFALLRQKLQKAQARMKEIADGHRRDHEFQVNEWVLVKLRPYRIIARMGPVAYKLELPEHSRIHPVFHCSLQKPFMGSPNTVEVEKLPSGAMDNQPISTPLAILGQKTIPTDQGPKQMVLVQWQGLHPDETSWEDWASLQELHHLEDKVLFEDRGNVTRSNLEPQATRPNEDGNLRLAAGRPKRGSNTPSYLKDYILEV

SEQ ID NO: 202356 - protein, 78 aa, Glycine max
  Coding DNA Sequence Number=SeqID_85578
MEAPFENRRACNGFDLDAIEVTREVSVSTHTTASRIVRHVRHGFLGGGSSNVLQLRKKEGHKVYCMNYNGGLLRELQR

SEQ ID NO: 202357 - protein, 59 aa, Glycine max
  Coding DNA Sequence Number=SeqID_85579
MIIEGASATRGLGNGAMPLDDASGWGLGIHQGWECGLFYVSTSISLSISLCFGVLLLTV

SEQ ID NO: 202358 - protein, 142 aa, Glycine max
  Coding DNA Sequence Number=SeqID_85580
  Subcellular localization annotation: CTP_CleavageSite=15; ConfidenceScore=5.41e-01
MATPPASPPPPPSVVALVSPSTLKWKCKVTRLRSLATRLPGVERPVVHVDPAIGKANGPHKKKLRTYLGIIARDKVDVTYETWKEVPAAQKDLIWEDIQDKEESTSTFADKDSVDDTVSEKYDISKEKWAQFCQTHRDPSWE

SEQ ID NO: 202359 - protein, 114 aa, Glycine max
  Coding DNA Sequence Number=SeqID_85581
MVLGFVSRLGWSRDGRAPLVVVRSRTADGRDSDSAVVCHPLVVVMSHHVLWGSTINTCLIFYMLVEGLYGCDDDLVRARPHSRFTSSSFLFFSKHGSGIACVTGKRTGSSSILN

SEQ ID NO: 202360 - protein, 196 aa, Glycine max
  Coding DNA Sequence Number=SeqID_85582
  Gene Ontology: Mol. function=DNA-3-methyladenine glycosylase I activity; Biological process=base-excision repair
  Homolog annotation: Hit_ID=Q1SSK0; Match level="QueryCoverage=57%, HitCoverage=28%, E-value=6e-53, Identity=88%"; Hit description =Methyladenine glycosylase
  Pfam annotation: Domain name=Adenine_glyco; Domain location=5-127; Score=14.8; E_value=1.9e-11; Accession=PF03352.4; Description =Methyladenine glycosylase
MAKVGSDWTSTLKKRLDFRAAFSEFDAETVANLTDKQMMSISSEYGIDISRVRGAVDNANQILEIKKDFGSFDKYIWGFVNHKPLSTQYKFGHKISVKTSKSESISKDMVRRGFSAPYWQLDPLYHRALSIDPNFNYYYPGTRTNKRLLTLEKKSSRHKNLRVMLARCRVFISITTTNISKLYKMLLIKLPDRLSR

SEQ ID NO: 202361 - protein, 194 aa, Glycine max
  Coding DNA Sequence Number=SeqID_85583
  Gene Ontology: Mol. function=RNA-directed DNA polymerase activity; Cellular component=chromatin; Biological process=chromatin assembly or disassembly
MKFIYNGKLIELVGDRDTSLQLVSPSQLRRLVDIGNTSTYFHIKMEPPPPPPTKTPLPIAHPIPAIQKLLTKHSSLFQPLSTLPPSRPTDHTITLLPHSAPVNVKPYRYPHFQKKEIETQVAAMLKQGHIQHSSSPFSSPVLLVKKCDGTWHLCVDYRALNAITVQDRFPIPTVDELLDELGGVVWILKLDLMQ

SEQ ID NO: 202362 - protein, 80 aa, Glycine max
  Coding DNA Sequence Number=SeqID_85584
  Pfam annotation: Domain name=Transposase_21; Domain location=1-69; Score=-135.9; E_value=0.0053; Accession=PF02992.5; Description =Transposase family tnp2
MRWHKDKRFQDGQLRHPIDSIEWKSVDSKFPSFAAYPRNGQLKDSPNGHRTGPCMVGDEAYGDRPKFVKISIKSCQHFIT

SEQ ID NO: 202363 - protein, 70 aa, Glycine max
  Coding DNA Sequence Number=SeqID_85585
MKHIEVKVNLLPTRKIWTNPSCINTTTRSALAPRSAKSEWRRRRVEWRRHFKEKMSQKEAHHHRKPWIRA

SEQ ID NO: 202364 - protein, 109 aa, Glycine max
  Coding DNA Sequence Number=SeqID_85586
  Gene Ontology: Mol. function=DNA binding; Biological process=DNA integration
  Homolog annotation: Hit_ID=Q1SIT1; Match level="QueryCoverage=87%, HitCoverage=32%, E-value=3e-15, Identity=44%"; Hit description =Integrase, catalytic region
MDQAGEERKLQLSELDEIHLETYENAKFYKEKTKKFHDSMIIKKDSMVGQKVLLYNSNLGLMSVEIKSDSTNKSFKVNGHRLKPFLTNPSLVDVVVEETSLLHHTLPPP

SEQ ID NO: 202365 - protein, 391 aa, Glycine max
  Coding DNA Sequence Number=SeqID_85587
  Gene Ontology: Mol. function=ATP-dependent helicase activity; Biological process=DNA recombination
  Homolog annotation: Hit_ID=P39393; Match level="QueryCoverage=53%, HitCoverage=25%, E-value=6e-99, Identity=77%"; Hit description =Hypothetical protein yjiV
MMFALLQTSATIAGSDAEKQLKKFLSELSGVPQERIDVLGGSRVIPDLAPCKHLSLSLDELEHIPDSDGEGISLERYTALTHSPQARHLREMIVSQPRPMKLDTLTRRLNELTKHQYTQQEILRWLDLCTGTLPSAQEPAFLKVRAHIFQRNTQGIWACVDKHCSAKHNTALEKGWPFGNVYVNQRQSCECGSPVYELAFCNECNEPHLLARDKKGKLVQWDNKGGDEFSLQDEAPDDFDSSSEKVQKEQRLDRQTRSIGVVNPDSIPLAMNDIEQVCSASNCGYRGGKGKQPFRRALLGGPFYVTNIVPTVLEYCQDFISDEGKEGVGPLSLPGRGRRLITFTDSRQGTARMAVRMQQEAERSRLRGSVVDILGWYQRKQSTYAPNAQAD

SEQ ID NO: 202366 - protein, 109 aa, Glycine max
  Coding DNA Sequence Number=SeqID_85588
  Homolog annotation: Hit_ID=Q1S0W0; Match level="QueryCoverage=100%, HitCoverage=9%, E-value=3e-49, Identity=90%"; Hit description=PHD -finger, putative
VSIIVEADPEVLGDKRVQSAVEGRFCDSAISVREAALELVGRHIASHPGVGFKYFEKIAERIKDTGVSVRKRAIKIIRDMCTSNANFSGFTRACTEIISRVSDDEASIQ

SEQ ID NO: 202367 - protein, 85 aa, Glycine max
  Coding DNA Sequence Number=SeqID_85589
  Gene Ontology: Mol. function=ER retention sequence binding; Cellular component=endoplasmic reticulum; Biological process=protein retention in ER
MGTKRSFNSPVNVLIERLRKVPMKVKIFCGVLFAVFALVALKLTITNHYYFFIASETVHVAGIIALIYKLFALKTCTGFVNVFVF

SEQ ID NO: 202368 - protein, 42 aa, Glycine max
  Coding DNA Sequence Number=SeqID_85590
MTALLQAPSEGIGTAPAIPCLRDEGGGQFVTAKVVAGLQKKE

SEQ ID NO: 202369 - protein, 130 aa, Glycine max
  Coding DNA Sequence Number=SeqID_85591
  Gene Ontology: Mol. function=phosphoglycolate phosphatase activity; Cellular component=cytosol; Biological process=methionine biosynthetic process
  Homolog annotation: Hit_ID=Q9FN41; Match level="QueryCoverage=59%, HitCoverage=14%, E-value=6e-26, Identity=70%"; Hit description =Similarity to enolase-phosphatase
MPKATSPECGKCKWPNNEFWIAQSHNPALKNCLVYIYSSGSRLAQRLIFGHTNHGDLRKYLSGFFDTTVGNKRETRSYVEISESLGVDKPSDILFVTDVYQEATAAKAAALLPNHLGAFGSLKPNLALLE

SEQ ID NO: 202370 - protein, 244 aa, Glycine max
  Coding DNA Sequence Number=SeqID_85592
  Gene Ontology: Mol. function=sequence-specific DNA binding; Cellular component=nucleus; Biological process=regulation of transcription
  Homolog annotation: Hit_ID=Q2HTS9; Match level="QueryCoverage=82%, HitCoverage=71%, E-value=3e-37, Identity=50%"; Hit description=DNA -binding WRKY; VQ
  Pfam annotation: Domain name=VQ; Domain location=54-84; Score=44.8; E_ value=3e-10; Accession=PF05678.4; Description=VQ motif
  Subcellular localization annotation: CTP_CleavageSite=48; ConfidenceScore=5.29e-01
MKINLRLQETETPPSMNNSPRSNLSNNNCTNNNSIGIQIPTTPKTIPRSDSTTNPYPTTFVQADTSTFKHVVQMLTGSSETTNPQQQLQDPVQPQSSSSKNFNIPPMKTTPKKQQGFKLYERRNNNNHLKNTLMINTLVPNFAHSSGFSSSSSSPCNKPEILSPSLLDFPSLTLSSPVTPLNDDPFDKSSSLPSLGSTSSEEERAIAEKGFYLHPSPMSTPRDFEPQLLPLFPVTSPRVSESTT

SEQ ID NO: 202371 - protein, 222 aa, Glycine max
  Coding DNA Sequence Number=SeqID_85593
MEDCCKIAGQTRGSDDFPFLRAASGSPPFLFMYHFLFMVLVLVLPLSSFQCALLEHLNMKLTGKIGWISLNNVSKKLYEFDSNVFRHFKDYFFKVLVTDVVADGLPLVFNRDEEPCFPFYQQSNPTGFKSFDEDLLTLVERFDKAILEQLLALSDARAILSLFSTDDLIAAIYGGQPSARVFPNDEVVKVSPNMSFSVLAKRKRDDSVGVSDHKKLRGPFSL

SEQ ID NO: 202372 - protein, 70 aa, Glycine max
  Coding DNA Sequence Number=SeqID_85594
  Subcellular localization annotation: CTP_CleavageSite=47; ConfidenceScore=5.39e-01
MMKEVIHGHNSAAPWLHFSSSPSSSTFFSGLRLLQFDSHYSRYTGCSGQRGSKNLGELASGDYPTFGALI

SEQ ID NO: 202373 - protein, 106 aa, Glycine max
  Coding DNA Sequence Number=SeqID_85595
  Homolog annotation: Hit_ID=Q1S9I4; Match level="QueryCoverage=37%, HitCoverage=3%, E-value=2e-07, Identity=62%"; Hit description =Integrase, catalytic region; Zinc finger, CCHC-type
MGCYKEHKVIYATYMLSGEAEEWLKFASQTLPSEEGVKAWDVFKHIANPIYISAKSFSGSDNFLSDDFEKLMLVSKEAYPSMSCIVINYDKAILCSSQNQCSSWSK

SEQ ID NO: 202374 - protein, 93 aa, Glycine max
  Coding DNA Sequence Number=SeqID_85596
  Gene Ontology: Mol. function=oxidoreductase activity, acting on single donors with incorporation of molecular oxygen, incorporation of two atoms of oxygen; Biological process=response to salicylic acid stimulus
  Homolog annotation: Hit_ID=Q5GQ66; Match level="QueryCoverage=94%, HitCoverage=13%, E-value=7e-41, Identity=87%"; Hit description=Alpha- dioxygenase
MWHTQIVHSIDKLGLWHRLPVFFGLLYLGIRRHLQQQYNLFNVGTTPVGIRFNPSDFPYRTDDGKYNDPFNEVAGSQGSFFGRNILPVDHKNK

SEQ ID NO: 202375 - protein, 113 aa, Glycine max
  Coding DNA Sequence Number=SeqID_85597
  Gene Ontology: Mol. function=oxidoreductase activity, acting on single donors with incorporation of molecular oxygen, incorporation of two atoms of oxygen; Biological process=response to salicylic acid stimulus
  Homolog annotation: Hit_ID=Q5GQ66; Match level="QueryCoverage=79%, HitCoverage=18%, E-value=1e-28, Identity=54%"; Hit description=Alpha- dioxygenase
RIFLPKKDPWLPATSLKGSLYFPSSVLYGKSEGLNLIPTGVVPTLKRDCTMKRKASIIVILATASWKSLWMSWCITLAARALMRSVTRDHMILLSCEIDDTTGLILARAKFDE

SEQ ID NO: 202376 - protein, 94 aa, Glycine max
  Coding DNA Sequence Number=SeqID_85598
MWTDRFALTLNRSQELPRLLAKAKAVADTYSAPEEIHELLSYLRIKSLPHFISSMHCMLVSSFVTGSRKVHITFTWGTAPPNAQLKVCPSHSSL

SEQ ID NO: 202377 - protein, 115 aa, Glycine max
  Coding DNA Sequence Number=SeqID_85599
MLGFTCDSPQISASLHQLDLAPYASGPYHAQWNAPGLLHDKHTLRSSRILREMEVDEPWLGLWLTLNYQVDMGARIAFVDNWAVGKDKEWQSQHGLLLHPQPLSFAPSFSFVQAG

SEQ ID NO: 202378 - protein, 73 aa, Glycine max
  Coding DNA Sequence Number=SeqID_85600
  Gene Ontology: Mol. function=protein serine/threonine kinase activity; Biological process=protein amino acid phosphorylation
  Homolog annotation: Hit_ID=Q1SB07; Match level="QueryCoverage=68%, HitCoverage=5%, E-value=2e-15, Identity=82%"; Hit description =Protein kinase
  Subcellular localization annotation: CTP_CleavageSite=57; ConfidenceScore=5.29e-01
DLSNNSLSGSVPDFLTQLQSLKVLNLAKNNLTGPVPGGLVERSKQGSLSLSTKHGLSCNRESPPLDKLQQFNT

SEQ ID NO: 202379 - protein, 889 aa, Glycine max
  Coding DNA Sequence Number=SeqID_85601
  Gene Ontology: Mol. function=nucleic acid binding; Cellular component= intracellular; Biological process=DNA integration
  Homolog annotation: Hit_ID=Q1RXN8; Match level="QueryCoverage=97%, HitCoverage=74%, E-value=0.0, Identity=43%"; Hit description =Peptidase S8 and S53, subtilisin, kexin, sedolisin; Integrase, catalytic region; Zinc finger, CCHC-type
  Pfam annotation: Domain name=RVP; Domain location=271-372; Score= -9.6; E_value=0.034; Accession=PF00077.10; Description=Retroviral aspartyl protease
  Pfam annotation: Domain name=rve; Domain location=473-621; Score =95.3; E_value=1.8e-25; Accession=PF00665.16; Description=Integrase core domain
  Pfam annotation: Domain name=zf-CCHC; Domain location=243-260; Score =24.6; E_value=8.7e-05; Accession=PF00098.13; Description=Zinc knuckle
  Pfam module annotation: Pfam domain module=RVP::RVT_2::rve::zf-CCHC; Domain location=271-372::747-889::473-621::243-260
MQQYNNWYQEPGSWRDLAMGTWFDVEKFTGENDFSLWRIKMQALLVHQGLDDALQGASKLPSTLSDKEKKDLLSKAHSTIIPSLGDEVLQEVAEEKSVAGIWLKLESLYMTKSLTNKLYLKKRLHQLKMEEGSSIKEHVSLFTKVVLDLKSVDVRIDEEDQAVMLLCSLPSSFENLVDTVLFGRDTLTLEEVKATLNSRELKKKITENKGEGGDPEALMARGRSEKRDSKSKNKRRSKSRNKKACYYYKKEGHFRKECPERKKKNNVVADGYESAEVLSISIEKHSEEWILDSGCSFHMTPNLEWFSSYKEIDGGKVLMGNNMACNVIGIGTVKLKMQDGSVKLLPDVRHVPELKRNLLSLGMLDQSGCSFKGEGGTLKVFKGSLQVIKGTRQNGLYKLQGNTILNSGGLVSISEPNASKLWHYRLGHVSEKGLEELHKQGLIGNGNYQKLSFCEHCVYGKQNRVSFHNATHTTQGILDYVHSDVWGPARVPSLGGAKYFITFIDDWSRKVWTCSLKHENQAFKHVKLFRTDNGLEYLSEEFNEFCKNNGIRRHKTIRLTPQQNGLAERMNRTILERVRCKLEPRAKKGIFLGYPEGVKGYKVWLLDPAGPKSIINRDVLLGEEDMIADYQQKSDSVQKGVQAEQNKHSDQGIRLEVEKLAQTSSPVEDRNEASHDEPMISSILELVDTSYNLVRDRQKRQIKAPVRLGYADLIAYALSIEIDDQGLEPISYKDAISRIDSDQWRSAMQDEFDSLMKNDTWKLVEKPAKQKVVGCKWIFKRKPEETGMDSYRYKARLVARGFTQREGIDYNEIFSPVVKHTSIRIILALVAVHNLELEQMDVKIAFLHGNLEETIYMSQPEGYEVKGKEEMCQMVSAEVPMTVVSTSEG

SEQ ID NO: 202380 - protein, 107 aa, Glycine max
  Coding DNA Sequence Number=SeqID_85602
  Gene Ontology: Mol. function=DNA binding; Biological process=DNA integration
  Homolog annotation: Hit_ID=Q1S9T9; Match level="QueryCoverage=92%, HitCoverage=7%, E-value=8e-29, Identity=58%"; Hit description =Peptidase S8 and S53, subtilisin, kexin, sedolisin; Integrase, catalytic region; Zinc finger, CCHC-type
YIALTEVIKEAIWLKGLVHELEGKTGPVEVWCDSQSAIDLSKNQVFHERTKNIDIRMHYIRDIIAQGEVKVRKVAGANNPADMLTKVVPCSKFTHCLNLVNIGTCDT

SEQ ID NO: 202381 - protein, 109 aa, Glycine max
  Coding DNA Sequence Number=SeqID_85603
MAADVEQVSPLALAKHVRCCFAPGDGEKLVLKAPSPVLRSVLMTSSSSCSSNIKIKSCPVDDEVLWMQDKHVSKHIWNGEEDRKLHIRRVVPTYQGQEEISGEIIHLLR

SEQ ID NO: 202382 - protein, 241 aa, Glycine max
  Coding DNA Sequence Number=SeqID_85604
  Gene Ontology: Mol. function=oxidoreductase activity; Cellular component=membrane; Biological process=hydrogen peroxide catabolic process
  Homolog annotation: Hit_ID=Q9LHA7; Match level="QueryCoverage=86%, HitCoverage=71%, E-value=8e-55, Identity=56%"; Hit description =Peroxidase 31 precursor
MLCAKPKIFCSLLIVAPKPAKENVRRRFIKKGHHTNQGQISTHPNPWEGSRGRVSFVICTSLLKPLSVARVVGGGSVVGEVGDELEAMREFDGVGPTEGDEFFDGEAAFGEELGDLGDGHGGGGEVGGYGEGEGGLAVATTEEDEEEGAAEHGQEVAGGVEEDVRARDGVGAGELEGGLGTDDEVKGVAWEGMVDVGVALNLGEGDGGEKDGGIAVIGEKAVVEEEAEGGNDCGGAHDLLA

SEQ ID NO: 202383 - protein, 219 aa, Glycine max
  Coding DNA Sequence Number=SeqID_85605
  Pfam annotation: Domain name=Transposase_23; Domain location=62-126; Score=-16.7; E_value=0.076; Accession=PF03017.5; Description =TNP1ENSPM transposase
MKEELKETIKIELSQMTSHQSPPIEENIQVFGACVSIKGSCAKTVVNPLGEEHVIDVMPTIRLHVQDDHSTRLVAVGKVYEGASTIHNMPYVDDVVKVSVAKVYDDNAQVPFPMSKVQYVRQTLDTFIAWPRQLVKHVSRDKCLNISILQLWMMFMDELGIRPGHGSVYRFLKPQFIHNAKDTYDECENYNETWMKESQREAYCLLLTSAPDHASSIKR

SEQ ID NO: 202384 - protein, 201 aa, Glycine max
  Coding DNA Sequence Number=SeqID_85606
MPSIIEEHEVDDVHENHNDHDEGLWEYIPTLTLRNLHQPGPIVNVNPVTGGGSSPYKEKFHSYLGVVTREKIPIVHSNWKAILKSLNNLIWDDILGKFAIPEASNAKKKMLSSVAIIWRQFMSSLTTIYVYADNESQDNHIPSKKYGLYPETWEEFAASCKTLNWQIIRKKAQEIKKYNDCPHLLSHGGCDLLEKKLMDEK

SEQ ID NO: 202385 - protein, 55 aa, Glycine max
  Coding DNA Sequence Number=SeqID_85607
MVTPGIATTLNLQALAEEIKARYDKAVVKVVDLVREKVKNLKKFDKNFVYHERIL

SEQ ID NO: 202386 - protein, 323 aa, Glycine max
  Coding DNA Sequence Number=SeqID_85608
  Gene Ontology: Mol. function=nucleoside-triphosphatase activity; Biological process=proteolysis
  Homolog annotation: Hit_ID=Q1SQU6; Match level="QueryCoverage=57%, HitCoverage=15%, E-value=1e-43, Identity=65%"; Hit description =AARP2CN
  Pfam annotation: Domain name=MMR_HSR1; Domain location=84-190; Score=- 15.2; E_value=0.025; Accession=PF01926.13; Description=GTPase of unknown function
  Subcellular localization annotation: CTP_CleavageSite=44; ConfidenceScore=5.04e-01
MTPINPIRLTELVNLVPKPTRRRLRRSRSRIPITSEDPRKQNPKAFAFSSSNKAKCLQSRAVEKEQRRLHAPIIDRSYGGPTPYVVVVQGPPQVGKSLLIKSLVKHYTKHNFPDGSKGGCSLQFVECPNDINGMIDAAKFADLTLLLIDGSYGFEMDAIFEILLHLKETFEFLNILQVHGFPRVMNDKIEALDKYQPGTGSDEDEDALNSTAKNGVHLQEHIDFHDGRWRRRAIFGNDCVDSEGDEDGATSDDDIESSEEEEEDGNDNHDTNGVSFFVRVVAMEEAVLVLAFVGKLRRHLLLLVVAMVLVLLVSSFASPLSDE

SEQ ID NO: 202387 - protein, 100 aa, Glycine max
  Coding DNA Sequence Number=SeqID_85609
  Gene Ontology: Mol. function=DNA binding; Cellular component =mitochondrion; Biological process=DNA integration
  Homolog annotation: Hit_ID=Q1SRN1; Match level="QueryCoverage=98%, HitCoverage=6%, E-value=8e-34, Identity=69%"; Hit description =Integrase, catalytic region
MQTRSKSGIVQPRIHPTLLLAHMETKSTKQALTDLIWLAAMKAEYDALINNSTWTLVSLPPNRVPIGCKWVFRIKENLDGTVSKYKARLVAKGFHQQYGN

SEQ ID NO: 202388 - protein, 117 aa, Glycine max
  Coding DNA Sequence Number=SeqID_85610
  Gene Ontology: Mol. function=protein dimerization activity; Biological process=transposition, DNA-mediated
  Homolog annotation: Hit_ID=Q1T3H7; Match level="QueryCoverage=99%, HitCoverage=18%, E-value=4e-23, Identity=51%"; Hit description=Zinc finger, BED-type predicted; HAT dimerisation
  Pfam annotation: Domain name=hATC; Domain location=48-117; Score =69.0; E_value=1.5e-17; Accession=PF05699.5; Description=hAT family dimerisation domain
MKSLFEEYYVVMNEFEANSQEAHLNEEGSDDPYGFNQFFQTTESSKTKLNIYLDEALESGQEDLDVLSWWKLNLGRFPILPNMTRDLLAIPISIVASESTFSTGGIVIDPHRSSLTP

SEQ ID NO: 202389 - protein, 133 aa, Glycine max
  Coding DNA Sequence Number=SeqID_85611
  Gene Ontology: Mol. function=protein dimerization activity
  Homolog annotation: Hit_ID=Q1T3H7; Match level="QueryCoverage=73%, HitCoverage=15%, E-value=4e-18, Identity=48%"; Hit description=Zinc finger, BED-type predicted; HAT dimerisation
MGPKSTLRLMRTLGPSLASLAQSYWSLLSNALGDRIASDGLEDKMDFVCKIRVVIKYVRSSLSQLANFKKYVIKQNIDFKGLVCLDVETRWSFTYLMLDATLNHQKAFEEFLMEEMKYAYELRNEGGVPISED

SEQ ID NO: 202390 - protein, 362 aa, Glycine max
  Coding DNA Sequence Number=SeqID_85612
  Gene Ontology: Mol. function=RNA-directed DNA polymerase activity; Cellular component=chromatin; Biological process=chromatin assembly or disassembly
MQILLLGVKILMPIQQILSFSYEILQVRWCGSIPLRPVPYCLYPLSVSLCVASLIAITPCRLRKHLVLKVVVSTELVPILPRSIVRAQTIPLDQDLPFWCRRVRQAFGIHNGQRSNKRLIIYGGGRQSDCDVKISTCSLSPDYRTKLGWGGSGGRSNWIRSPKVASSSLAIKRNIREAHLDTDVGVVARPGSNGVAIADKGRGGGTTRSDNTVRKIFKLRKVICDCGPLCKLEMGTGGVLVLRRGKPYLQHLKESWPGGELTITGHPLKPGQGTPLHVEGGDGQPIVLERSMVFEELVDLKDPTKGFGTIKPWDIKFQAVRVRGGTQVEWYWTRKVRERKSQFGYGIFQSIGRSFGPSGFRH

SEQ ID NO: 202391 - protein, 340 aa, Glycine max
  Coding DNA Sequence Number=SeqID_85613
  Gene Ontology: Mol. function=transporter activity; Cellular component= outer membrane-bounded periplasmic space; Biological process=transport
  Homolog annotation: Hit_ID=Q110R7; Match level="QueryCoverage=85%, HitCoverage=65%, E-value=4e-43, Identity=35%"; Hit description =Periplasmic polyamine-binding protein of ABC transporter precursor
MSCSLTKFQVYLRRNREGEMDPKGDIWAAPYRWGCMVIAYKTNKFQKHKLAPVEDWADLWRPDLAGRISMVDSPREVIGAVLKYMGASYNTNDINMEVNGGRDAVKHNLALLAKQVRLFDSSNYLKAFGVGDVWVAVGWSSDIIPAAKRMSNVAVVVPKSGASLWADLWVLLLLLSVILLFKAIPAASRIQTNRIGGRIRGPSPLIHQWIEFCLQSARALPFKQEVIPGASPSHLQGHSANVPVELTKGGPRLNGNLVDGAPPPDILEKCEFLEPLSNSTLSDYHWLLTSIQEPGHGLIHKILTLVKVHFLYYKVKRRGCVQATTMRSACKLCWFCPPYG

SEQ ID NO: 202392 - protein, 69 aa, Glycine max
  Coding DNA Sequence Number=SeqID_85614
MGCYRDGDVAPYEACRLLAVGVSLTKACALSENHALSEALSPLRELGESEKHLRAHHQLTQQSVCLFPR

SEQ ID NO: 202393 - protein, 105 aa, Glycine max
  Coding DNA Sequence Number=SeqID_85615
MVPVKSYHCGSWLEMGPSLIDFAMTEGSSDLLAFLSQLLENVGENIATLVVVTIVETGTSQEVACWPKKHSVLKEKHSPPPIILLGFMWIDREVGTSPDTTPSQT

SEQ ID NO: 202394 - protein, 179 aa, Glycine max
  Coding DNA Sequence Number=SeqID_85616
  Gene Ontology: Mol. function=DNA binding; Cellular component =mitochondrion; Biological process=DNA integration
MHTYSQTSPILSKLDTSKKLIFYLSVSDKAIKAVLVQEERSELRPMYFVSRVLQDPEMRYRLMEKVAFALVNTTFHLRQYFQCPKITTWTNCHIAKILHKPKLLGQMMGWSIKLSKYEIAYELRGTIRAHELPDFNNELHPLLPQFKHEWWTMHVDGSSNWHGSGTSVILEGPNDVTMA

SEQ ID NO: 202395 - protein, 140 aa, Glycine max
  Coding DNA Sequence Number=SeqID_85617
MDNKELKKQLSVVVDGKHERDQSFLVYWQGLVGLLFMGMPWNKSQKNSLVVSILRKQNPQEKGGLPICNTNIGYKSYGTRERVLSNADGGYRSGDTRDRALSNVDGGYRSDDTKEIALSDADIGYRKGNAREKESLNLET

SEQ ID NO: 202396 - protein, 361 aa, Glycine max
  Coding DNA Sequence Number=SeqID_85618
  Gene Ontology: Mol. function=transmembrane receptor activity; Cellular component=membrane; Biological process=defense response
  Homolog annotation: Hit_ID=Q1SI46; Match level="QueryCoverage=67%, HitCoverage=29%, E-value=2e-57, Identity=43%"; Hit description =Leucine Rich Repeat, putative
  Pfam annotation: Domain name=LRR_1; Domain location=106-124; Score =4.0; E_value=50; Accession=PF00560.23; Description=Leucine Rich Repeat
  Pfam annotation: Domain name=LRR_1; Domain location=128-147; Score =5.0; E_value=33; Accession=PF00560.23; Description=Leucine Rich Repeat
  Pfam annotation: Domain name=LRR_1; Domain location=149-170; Score =3.4; E_value=67; Accession=PF00560.23; Description=Leucine Rich Repeat
  Pfam annotation: Domain name=LRR_1; Domain location=59-80; Score=5.1; E_value=31; Accession=PF00560.23; Description=Leucine Rich Repeat
  Pfam annotation: Domain name=LRR_1; Domain location=82-104; Score =14.1; E_value=0.52; Accession=PF00560.23; Description=Leucine Rich Repeat
  Pfam module annotation: Pfam domain module=LRR_1::LRR_1::LRR_1::LRR _1::LRR_1; Domain location=106-124::128-147::149-170::59-80::82-104
GTEAIRSIRADFKYNQDGFPLLPCGLQSFPVELRYLAWMHYPLKSLPENFSVENLNLVNLKEVKVSGSENLKELPDLSEATNLEVLDINFCPQLTSVTPSIFSLNRLERLSVAYCSLTKITSKNHLSSLRYLNLESCKKLREFSVASENMIELDLSSTCVNAFTSSFGYCTALKTVLFPSVAQQLNENRKEVLFWNCLKLDEDSLKAVKLNAHINLRKFAYQHLSAPDENFDDYDRTYGSDQLCYIRSYGEGNNWLLDLHSISLSKNQKRFKIKVEAMEAAVACQRDVGLKGLGVSLINTSAYHSFRKHINTTKHRNFVQEMSTSADHSFIQRIKTSADHQLHSANKILSRSQLHSTNGSI

SEQ ID NO: 202397 - protein, 94 aa, Glycine max
  Coding DNA Sequence Number=SeqID_85619
  Homolog annotation: Hit_ID=Q9SRQ8; Match level="QueryCoverage=41%, HitCoverage=10%, E-value=7e-09, Identity=64%"; Hit description=RING -H2 finger protein ATL3A
MASASFLNNPSAAHGRERSGTAAPDSSPQDAAGVHAFLPRGVHRYVALFPFQLSRLPDSRHAFAGGGAPVAGVECATHHRYHASSSRSKWVSPT

SEQ ID NO: 202398 - protein, 108 aa, Glycine max
  Coding DNA Sequence Number=SeqID_85620
  Gene Ontology: Mol. function=DNA binding; Cellular component =chromatin; Biological process=DNA integration
  Homolog annotation: Hit_ID=Q1RVR8; Match level="QueryCoverage=99%, HitCoverage=9%, E-value=1e-30, Identity=50%"; Hit description =Glycoside hydrolase, family 1; Integrase, catalytic region; Zinc finger, CCHC-type
MTLHLTIEPKNIDEALSEDYWVIAMEEEPSQFTKNKLLMGTINKEGIDFDETFAPVARLEAVRILLAYAAHKDIKLYQMDVKSAFINGFINEEVYVKQPPRFEDKEKP

SEQ ID NO: 202399 - protein, 182 aa, Glycine max
  Coding DNA Sequence Number=SeqID_85621
MGELKFFLGLLIIQKDDEDEKGNDSPKREYKAPALFKDKKLQQKFDASWVSKKVVKGRFPKDSSRLYEDWLETMGLRKTKATKSIKSTSGVSYGMLMTLVFKHFEVSLDGSEQGENNEEEESQKGDSYKDDDQNEGIHPSKGVEVEDVLNLVVPKLTQDDLNVETIDDIFAKLRTTNLSLKK

SEQ ID NO: 202400 - protein, 68 aa, Glycine max
  Coding DNA Sequence Number=SeqID_85622
MEMRPWTETRDATMAGDETKSFIVDTSEGDVLRWWPEVLTPAKVTRDEWAMAERKKINRRKGGSFWRC

SEQ ID NO: 202401 - protein, 181 aa, Glycine max
  Coding DNA Sequence Number=SeqID_85623
  Gene Ontology: Mol. function=transferase activity; Cellular component= intracellular; Biological process=translation
  Homolog annotation: Hit_ID=Q7PC91; Match level="QueryCoverage=86%, HitCoverage=32%, E-value=4e-49, Identity=63%"; Hit description =Putative transposase
MRNWKTTPLGVAKEEEWYIVIVKKVMIDCSMTIFQKKLVYRELQFRRRFRMQRHVFLRIVNAFNNHDEYFQIRVDALRRKGLSPLQKCTTAIRILAYGSHADNVDEYVRIGETTAVECLERFVLGICTIFGNEYLRRPNNEDIERLLQMGVARGFPGMLGSIDCMHWEWKNCLVAWKGQFC

SEQ ID NO: 202402 - protein, 97 aa, Glycine max
  Coding DNA Sequence Number=SeqID_85624
MFRVTGEATKAKETLTNLLRMQILRYKRMKVEHLNQEFELLKVNATKTREKLKAKIIRTHEVDFKKEIRQVKHFFKDADFSFFDINKDSIVKESWLT

SEQ ID NO: 202403 - protein, 68 aa, Glycine max
  Coding DNA Sequence Number=SeqID_85625
MKLAYEINLLVKHWREAHCEVPGISGGVVLNSIVEEEIRKDFEVLLIHWKEALHKAASILRFVVLNPT

SEQ ID NO: 202404 - protein, 181 aa, Glycine max
  Coding DNA Sequence Number=SeqID_85626
  Homolog annotation: Hit_ID=Q1RSP6; Match level="QueryCoverage=51%, HitCoverage=5%, E-value=1e-08, Identity=41%"; Hit description=TIR; Disease resistance protein; AAA ATPase; Winged helix repressor DNA -binding
MECHRTTGQVVVPVFYDVDPSEVRHQTGHFGKAFRNLENRLLKVVEEKEEEKLQRWWKTLAEAAGISGLSVIKTLPAFSGQSEILDKIDLLVEHWRETLCEAAGILGRGMLIAEKLIDLLVKHWRETLCEALCEAVSFSDGAYLYSREFEIGFKIELLVEHWSEAICQAVGISGGAHLNSK

SEQ ID NO: 202405 - protein, 177 aa, Glycine max
  Coding DNA Sequence Number=SeqID_85627
  Gene Ontology: Mol. function=cytokine activity; Cellular component =extracellular space; Biological process=inflammatory response
  Homolog annotation: Hit_ID=Q9SMV2; Match level="QueryCoverage=75%, HitCoverage=99%, E-value=3e-43, Identity=79%"; Hit description=AT -LS1 product
  Pfam annotation: Domain name=MIF; Domain location=2-109; Score=42.4; E_value=1.6e-09; Accession=PF01187.8; Description=Macrophage migration inhibitory factor (MIF)
MPCLNLSTNVSLEGVDTSSILAEATSSVASIIGKPEAYVMIVLKGSVPIAFGGNEQPAAYGELVSIGGLNPSVNKELSAAIASILETKLSVPKSRFFLKFYDTKATTFLIEIYGVMFFKQLRGLMVPTSDGMDLHSEIRIPCYIGCGTLNVGWSVHYVSPVFMSMFVSLYKYTRDFW

SEQ ID NO: 202406 - protein, 556 aa, Glycine max
  Coding DNA Sequence Number=SeqID_85628
  Gene Ontology: Mol. function=binding; Cellular component =intracellular; Biological process=RNA processing
  Homolog annotation: Hit_ID=O64858; Match level="QueryCoverage=96%, HitCoverage=97%, E-value=1e-179, Identity=56%"; Hit description =Expressed protein
  Pfam annotation: Domain name=DUF946; Domain location=22-555; Score =1083.4; E_value=0; Accession=PF06101.2; Description=Plant protein of unknown function (DUF946)
MGSNCLTTCCTGNFFKKKKSLPIDTIFKLPVPVANSSWPQGGNFASGIIDLGGLQVSQISTFNKVWGTYGGGPDNQGFTMFEASGIPQGFFMLGSYCQPNNKPLFGWVLVAKDVSKSTSNPTLKQPIDYTLVWNSASMKINQDGPIYVWLPTAPDGYKALGHVVTTTPNKPSFDKIRCVRLDLTDQCETSLLIWESGSFNVYDVRPSNRGIQAPGVRVGTFVAQNGSTEPPSIACLKNNTNAIPKYMPNLQQIKAIMQVYSPTMCLHPDEEYLPSSVDWFFSNGALLYKKGQESNPVSIAPNGTNLPQDHNNDGAYWLDLPSDAANKERVKKGDLQSAKSYVHVKPMLGGTFTDIAMWVFYPFNGPSRAKVEFINVKLGKIGEHVGDWEHVTLRVSNFNGELWQVYFSQHSKGAWVDSSQIEFQSGGGNKPLYYSSLHGHASYPHAGLNLQGTDNIGIRNDTAKGDKMMDMGAFELVSAEYLGYAVIEPPWLNYFREWGPKIDYSIDVELKKIEKFLPKNLKDALEKIMRSLPSEVLGEEGPTGPKVKNNWIGDEV

SEQ ID NO: 202407 - protein, 140 aa, Glycine max
  Coding DNA Sequence Number=SeqID_85629
MAFNFQTLFTALIVIAMVLAGFVVATYCIWSKVLHTEKNSITAYQKALAKATSTEIKYKKKHEDVAEGHKDSTCQCFKNQSTAVNSGAKLRFSGFSRPQCNPNFSRINRINPQFPTTSKIMTKPQPRPQFTTLTPVPGRL

SEQ ID NO: 202408 - protein, 123 aa, Glycine max
  Coding DNA Sequence Number=SeqID_85630
  Gene Ontology: Mol. function=transferase activity, transferring glycosyl groups; Cellular component=integral to membrane; Biological process=response to oxidative stress
  Homolog annotation: Hit_ID=Q9LXU2; Match level="QueryCoverage=99%, HitCoverage=16%, E-value=2e-42, Identity=66%"; Hit description =Anthranilate phosphoribosyltransferase-like protein
  Pfam annotation: Domain name=C2; Domain location=42-121; Score=69.9; E_value=8.2e-18; Accession=PF00168.20; Description=C2 domain
MHKPKEALDFALKETSSNISASVVMRDKLSCTYDLVEQMHYLYARVVKAKDLLWKDVTGGVDPYVEVKLGNYKGLTNHFEKKSNPQWNQVFCLLQRIQASVLEVVIKDNDAIVEDFVGRVMFD

SEQ ID NO: 202409 - protein, 673 aa, Glycine max
  Coding DNA Sequence Number=SeqID_85631
  Gene Ontology: Mol. function=nucleic acid binding; Cellular component= beta-galactosidase complex; Biological process=DNA integration
  Homolog annotation: Hit_ID=Q1T693; Match level="QueryCoverage=97%, HitCoverage=88%, E-value=1e-115, Identity=45%"; Hit description =Integrase, catalytic region; Zinc finger, CCHC-type; Peptidase aspartic, catalytic
MSSENFVQPAIPRLDGHYDHWSMLMENLLRSKEFWQVVADGVATPSDGVVLTDAQQKEYEVMKLKDLKAKNYLFLAIDRSILETILCKDTSKEIWDSMEKKYQGSSRVKRAQIQALRRDFEVLQMKEGELVTDYCSRTMGIAKPLLLPILIPTTLEEGVEVEVEEEDVEIEEIEISAIILKITMINFKAMVEEEIMINQRYNAMDEKEVETLLMAVKDAKDSEAEIWYVDTGCSNHTSGSDIKMKTRNGFVETISNVLYVPNLKNNLLSAGQLQEKDNEDEELQTRELEEQQIPTITVEDERLQRARRRPAWMSDYEVTEIEDPITHFALFSDCDPTTFESVVKEEKWRKAMDDEIDSIERNNTWELCDLPNGHNTIGVKWVFKTKLKRNGEVDKYKACLVAKGYKQQHGVDYTKVFSPVGRHDTIRLVVALAAQNVWPIFQLDVKSAFLHGYLEEQVFIDQPPAYVKIGNEHKVYKLKKALYGLKQAPRACYSRIESYFIKVGFTKCPYEHSLFIKFDEKGKMLIVCLYVDDLIFTGCCSLMFDEFKKFMMNEFEMTDFGMMHYFLGIEIVQSDVGIFLSQKKYVRDILDRFHMHDCNSVNTPVECGLKFHKDPKGKKINSTLYKQIVESLMYLTATRPDIMYSINLIIRGEKFNLLGFTDSDYAEDSDDRK

SEQ ID NO: 202410 - protein, 39 aa, Glycine max
  Coding DNA Sequence Number=SeqID_85632
MASSSANVIVYYDGFIITTKHGSTFAIGNNIKVYQMVKW

SEQ ID NO: 202411 - protein, 242 aa, Glycine max
  Coding DNA Sequence Number=SeqID_85633
  Gene Ontology: Mol. function=protein binding; Cellular component =membrane; Biological process=defense response
  Homolog annotation: Hit_ID=Q2YE87; Match level="QueryCoverage=98%, HitCoverage=18%, E-value=8e-51, Identity=50%"; Hit description=NBS -LRR type disease resistance protein Rps1-k-2
MAEAVGGAFLSAFLDVVFDKLSTDEVVDFIRGKKLDLNLLENLKTTLRVVGAVLDDAEKKQIQLSSVNQWLIELKDALYDADDLLDEISTKSATQKKVCKVLSRFTDRKMASKLEKIVDKLDKVLGGMKGLPLQVMAGEMNESWNTQPTTSLEDGYGMYGRDTDKEGIMKLLLSDDSSDGVLVSVIAIVGMGGVGKTTLARSVFNNDNLKQMFDLNAWVCVSDQFDIVKVTKTMIEQITQES

SEQ ID NO: 202412 - protein, 129 aa, Glycine max
  Coding DNA Sequence Number=SeqID_85634
  Gene Ontology: Cellular component=mitochondrion
TGKNRPDYTLVPRVQWVHLTVPSSVGTEITNIHRWGAGLRSPYLTMKGDPFPPLSKMMKMKSAGLQMAVSCPPAGGESAPGSSLASYGPSSRHLLKAGSVTTVWWPEIDLASPKGLISRSPAREAYLSQ

SEQ ID NO: 202413 - protein, 606 aa, Glycine max
  Coding DNA Sequence Number=SeqID_85635
  Gene Ontology: Mol. function=protein binding; Cellular component =membrane; Biological process=defense response
  Homolog annotation: Hit_ID=Q2YE87; Match level="QueryCoverage=92%, HitCoverage=45%, E-value=0.0, Identity=72%"; Hit description=NBS-LRR type disease resistance protein Rps1-k-2
  Pfam annotation: Domain name=LRR_1; Domain location=118-139; Score =7.0; E_value=14; Accession=PF00560.23; Description=Leucine Rich Repeat
  Pfam annotation: Domain name=LRR_1; Domain location=141-163; Score =1.1; E_value=1.7e+02; Accession=PF00560.23; Description=Leucine Rich Repeat
  Pfam annotation: Domain name=LRR_1; Domain location=199-222; Score =7.7; E_value=10; Accession=PF00560.23; Description=Leucine Rich Repeat
  Pfam annotation: Domain name=LRR_1; Domain location=333-357; Score =5.1; E_value=31; Accession=PF00560.23; Description=Leucine Rich Repeat
  Pfam annotation: Domain name=LRR_1; Domain location=381-404; Score =1.5; E_value=1.5e+02; Accession=PF00560.23; Description=Leucine Rich Repeat
  Pfam annotation: Domain name=LRR_1; Domain location=405-427; Score =4.6; E_value=39; Accession=PF00560.23; Description=Leucine Rich Repeat
  Pfam annotation: Domain name=LRR_1; Domain location=430-450; Score =11.4; E_value=2.1; Accession=PF00560.23; Description=Leucine Rich Repeat
  Pfam annotation: Domain name=LRR_1; Domain location=453-477; Score =1.8; E_value=1.3e+02; Accession=PF00560.23; Description=Leucine Rich Repeat
  Pfam annotation: Domain name=LRR_1; Domain location=501-524; Score =2.5; E_value=99; Accession=PF00560.23; Description=Leucine Rich Repeat
  Pfam annotation: Domain name=LRR_1; Domain location=526-549; Score =6.0; E_value=22; Accession=PF00560.23; Description=Leucine Rich Repeat
  Pfam module annotation: Pfam domain module=LRR_1::LRR_1::LRR_1::LRR _1::LRR_1::LRR_1::LRR_1::LRR_1::LRR_1::LRR_1; Domain location=118 -139::141-163::199-222::333-357::381-404::405-427::430-450::453 -477::501-524::526-549
MPRGMGMLSHLQHLDFFIVGKHKENGIKELGTLSNLHGSLSIRNLENVTRSNEALEARMLDKKHISHLSLEWSNDTDFQTELDVLCKLKPHHGLEYLTIEGYNGTIFPDWVGNFSYHNLRILGLRDCNNCCVLPSLGQLPSLKQLYISRLKSVKTVDAGFYKNEDCPSVTPFSSLEFLSIDEMCCWELWSIPESDAFPLLKSLKIVDCPKLRGDLPNHLPALETLMIRNCELLVSSLPRAPILKRLEIHKSNNVSLHVFPLLLESIEVEGSPMVESMIEAISSIEPTCLQRLTLMDCSSAISFPGGRLPASVKDLCINNLKNLEFPTQHKHELLESLVLDNSCDSLTSLPLVTFANLKSLKIDNCEHMESLLVSGAESFKSLCSLRIFRCPNFVSFWREGLPAPNLTRIEVLNCDKLKSLPDKMSSLLPKLEYLQISNCPEIESFPEGGMPPNLRTVSIGNCEKLMSGLAWPSMGMLTRLTVAGRCDGIKSFPKEGLLPPSLTSLELYELSNLEMLDCTGLLHLTSLQKLSIWRCPLLENMAGERLPKAHIYACKADLPGQKEEEARAQSADGKVFKIVPWHHLEHSTSNSLSIQALSHDLTGSDR

SEQ ID NO: 202414 - protein, 87 aa, Glycine max
  Coding DNA Sequence Number=SeqID_85636
MQSLAGISDHALSCQMLVKPPNACGLSSDASYSWSPGWLLALSGFLGLSDPNVLSEDVALSVTLQFFNPLPYLCFISTKNTTKITIK

SEQ ID NO: 202415 - protein, 139 aa, Glycine max
  Coding DNA Sequence Number=SeqID_85637
  Homolog annotation: Hit_ID=Q9FKM4; Match level="QueryCoverage=56%, HitCoverage=13%, E-value=6e-08, Identity=36%"; Hit description =Arabidopsis thaliana genomic DNA, chromosome 5, P1 clone:MUA2
MGSTSRSRHLPSPPCRSWRTKLLRRVVEVVAHRDHNAHDLVDDADALEHVRGIVMVDNSDVEHVDMFHVLVDLHIDNDMVAQCRKGVIVDRLHGVGVVGRAVLVDLNQFWCKKRLPQLSLKSMCEDCDSPSSTSDVWKL

SEQ ID NO: 202416 - protein, 113 aa, Glycine max
  Coding DNA Sequence Number=SeqID_85638
MNVEICLHMELGLELVRIGQVELDCVVCWNREKAIEANDLGACPHANKGGDIVVNNPLIIVRTITTMAPTTLPRLLRVMVPPEQLSPITMRTFASSTPRCHKIRVWPQLPCNN

SEQ ID NO: 202417 - protein, 56 aa, Glycine max
  Coding DNA Sequence Number=SeqID_85639
MKNIAKHFNSNGSLRQPSRKKGDAVVDMVGDAVADNGRLGGGKRAAKWLEAHAHGF

SEQ ID NO: 202418 - protein, 183 aa, Glycine max
  Coding DNA Sequence Number=SeqID_85640
  Gene Ontology: Mol. function=protein serine/threonine kinase activity; Cellular component=membrane; Biological process=protein amino acid phosphorylation
  Homolog annotation: Hit_ID=Q1SZ16; Match level="QueryCoverage=84%, HitCoverage=42%, E-value=7e-59, Identity=73%"; Hit description =Protein kinase
MTAELAMFTIDKTSGSIRRSEIMFSECTSGYLAPEYAMGGQLTMKADVYSFGVLILEIISGKSSARTNWGGSNKFLLEWAWQLYEEGKLLELVDPDMVEFPEKEVIRYMKVAFFCTQAAASRRPMMSQVVDMLSKNMRLNEKQLTAPGLFQDSGASSQKKSSFESTGYQFSSNPSSITQLAPR

SEQ ID NO: 202419 - protein, 1065 aa, Glycine max
  Coding DNA Sequence Number=SeqID_85641
  Gene Ontology: Mol. function=structural constituent of ribosome; Cellular component=mitochondrion; Biological process=translation
  Homolog annotation: Hit_ID=Q654Y7; Match level="QueryCoverage=88%, HitCoverage=86%, E-value=4e-82, Identity=26%"; Hit description =Putative fertility restorer
  Pfam annotation: Domain name=PPR; Domain location=154-188; Score =41.7; E_value=2.4e-09; Accession=PF01535.11; Description=PPR repeat
  Pfam annotation: Domain name=PPR; Domain location=189-223; Score =25.0; E_value=0.00026; Accession=PF01535.11; Description=PPR repeat
  Pfam annotation: Domain name=PPR; Domain location=224-258; Score =26.9; E_value=7e-05; Accession=PF01535.11; Description=PPR repeat
  Pfam annotation: Domain name=PPR; Domain location=259-292; Score =22.7; E_value=0.0014; Accession=PF01535.11; Description=PPR repeat
  Pfam annotation: Domain name=PPR; Domain location=315-349; Score =42.6; E_value=1.4e-09; Accession=PF01535.11; Description=PPR repeat
  Pfam annotation: Domain name=PPR; Domain location=350-384; Score =36.5; E_value=9.5e-08; Accession=PF01535.11; Description=PPR repeat
  Pfam annotation: Domain name=PPR; Domain location=385-419; Score =30.5; E_value=6.1e-06; Accession=PF01535.11; Description=PPR repeat
  Pfam annotation: Domain name=PPR; Domain location=420-454; Score =36.3; E_value=1.1e-07; Accession=PF01535.11; Description=PPR repeat
  Pfam annotation: Domain name=PPR; Domain location=455-489; Score =43.3; E_value=8.4e-10; Accession=PF01535.11; Description=PPR repeat
  Pfam annotation: Domain name=PPR; Domain location=490-524; Score =49.0; E_value=1.6e-11; Accession=PF01535.11; Description=PPR repeat
  Pfam annotation: Domain name=PPR; Domain location=525-559; Score =29.1; E_value=1.5e-05; Accession=PF01535.11; Description=PPR repeat
  Pfam annotation: Domain name=PPR; Domain location=54-88; Score=15.3; E_value=0.11; Accession=PF01535.11; Description=PPR repeat
  Pfam annotation: Domain name=PPR; Domain location=560-594; Score =15.3; E_value=0.11; Accession=PF01535.11; Description=PPR repeat
  Pfam annotation: Domain name=PPR; Domain location=595-629; Score =31.9; E_value=2.2e-06; Accession=PF01535.11; Description=PPR repeat
  Pfam annotation: Domain name=PPR; Domain location=630-663; Score=3.1; E_value=3.3; Accession=PF01535.11; Description=PPR repeat
  Pfam annotation: Domain name=PPR; Domain location=664-698; Score =41.5; E_value=3e-09; Accession=PF01535.11; Description=PPR repeat
  Pfam annotation: Domain name=PPR; Domain location=699-733; Score =42.2; E_value=1.8e-09; Accession=PF01535.11; Description=PPR repeat
  Pfam annotation: Domain name=PPR; Domain location=734-768; Score=9.7; E_value=0.53; Accession=PF01535.11; Description=PPR repeat
  Pfam annotation: Domain name=PPR; Domain location=769-803; Score =33.0; E_value=1e-06; Accession=PF01535.11; Description=PPR repeat
  Pfam annotation: Domain name=PPR; Domain location=804-838; Score =42.3; E_value=1.6e-09; Accession=PF01535.11; Description=PPR repeat
  Pfam annotation: Domain name=PPR; Domain location=839-873; Score =40.6; E_value=5.2e-09; Accession=PF01535.11; Description=PPR repeat
  Pfam annotation: Domain name=PPR; Domain location=884-918; Score =39.2; E_value=1.4e-08; Accession=PF01535.11; Description=PPR repeat
  Pfam annotation: Domain name=PPR; Domain location=89-123; Score=16.5; E_value=0.082; Accession=PF01535.11; Description=PPR repeat
  Pfam annotation: Domain name=PPR; Domain location=931-965; Score=3.5; E_value=2.9; Accession=PF01535.11; Description=PPR repeat
  Pfam module annotation: Pfam domain module=PPR::PPR::PPR::PPR::PPR::PP R::PPR::PPR::PPR::PPR::PPR::PPR::PPR::PPR::PPR::PPR::PPR::PPR::PPR::PP R::PPR::PPR::PPR::PPR; Domain location=154-188::189-223::224-258::259- 292::...
  Pfam module annotation: Domain location=315-349::350-384::385 -419::420-454::455-489::490-524::525-559::54-88::560-594::595 -629::630-663::664-698::699-733::734-768::769-803::804-838::839 -873::884-918::89-123::931-965
  Subcellular localization annotation: CTP_CleavageSite=80; ConfidenceScore=5.24e-01
MMHLKNLQSKTLFFVFSPSRTFHRPHYNPIRRFSSPIHKDSILIPPTKTLLYASFFCALIRLYLACGRFYIASDTFSRMRALSLVPSLPLWNDLLYEFNASGFVSQVKVLYSEMVLCGVVPNVFSVNLLVHSLCKVGDLGLALGYLRNSVFDHVTYNTVVWGFCKRGLADQGFGLLSEMVKKGVCFDSVTCNILVKGYCQIGLVQYAEWIMGNLVGGGVPLDAIGLNTLVDGYCEVGLVSRALDLVEDGWKNGVKPDIVTYNTLVNAFCKRGDLAKAESVVNEILGFRRDDESGVLNDCGVETWDGLRDLQPTVVTWTTLIAAYCKHRGIDDFFSLYEQMIMSGVMPDVVTCSSILYGLCRHGKLTEAAMLLREMYNMGLDPNHVSYTTIISALLKSGRVMEAFNHQSQMVVRGISIDLVLCTTMMDGLFKAGKSKEAEEMFQTILKLNLVPNCVTYTALLDGHCKVGDVEFAETVLQKMEKEHVLPNVVTFSSIINGYAKKGMLNKAVEVLRKMVQMNIMPNVFVYAILLDGYFRTGQHEAAAGFYKEMKSWGLEENNIIFDILLNNLKRSGGMKEAQSLIKDILSKGIYLDVFNYSSLMDGYFKEGNESAALSVVQEMTEKDMQFDVVAYNALTKGLLRLGKYEPKSVFSRMIELGLTPDCVTYNSVMNTYFIQGKTENALDLLNEMKSYGVMPNMVTYNILIGGLCKTGAIEKVISVLHEMLAVGYVPTPIIHKFLLKAYSRSRKADAILQIHKKLVDMGLNLNQMVYNTLITVLCRLGMTKKANVVLTEMVIKGISADIVTYNALIRGYCTGSHVEKAFNTYSQMLVSGISPNITTYNALLEGLSTNGLMRDADKLVSEMRERGLVPNATTYNILVSGHGTYNVLIQDYAKAGKMRQARELLNEMLTRGRIPNSSTYDVLICGWCKLSCQPEMDRLLKLSYQNEAKKLLREMCEKGHVPSESTLMYISSNFSAPGKRDDAKRLLKTVIGLYRSTAEEATEKIAQFCFAQILRFMFAQVTEASIEQKFEGILRLNSNRYYKALSDQVVRVKSVYLAASSASD

SEQ ID NO: 202420 - protein, 585 aa, Glycine max
  Coding DNA Sequence Number=SeqID_85642
  Gene Ontology: Mol. function=double-stranded RNA binding; Cellular component=intracellular
  Homolog annotation: Hit_ID=Q5YDB6; Match level="QueryCoverage=98%, HitCoverage=55%, E-value=1e-143, Identity=50%"; Hit description=C -terminal domain phosphatase-like 1
  Pfam annotation: Domain name=dsrm; Domain location=406-469; Score =47.0; E_value=6.4e-11; Accession=PF00035.15; Description=Double -stranded RNA binding motif
MALVIDDRLKVWDEKDQPRVHVVPAFAPYYAPQAEASNTIPVLCVARNVACNVRGGFFKDFDDGLLQKIPQIAYEDDIKDIPSPPDVSNYLVSEDDGSISNGHRDPFLFDGMADAEVERKLKDALSAASTIPVTTANLDPRLTSLQYTMVPSGSVPPPTAQASMMPFPHVQFPQPATLVKPMGQAAPSEPSLHSSPAREEGEVPESELDPDTRRRLLILQHGQDTRDHASAEPPFPVRHPVQTSAPHVPSSRGVWFPAEEEIGSQPLNRVVPKEFPVDSGPLGIAKPRPHHPSFFSKVESSISSDRILHDSHQRLPKEMYHRDDRPRLNHMLSSYRSFSGVICFSDLILNVIPAGFEPSPYGIVLRQLPTIRTKNAGDDIPFSRSFSSHRDLDSESGHSVLHADTPVAVLQEIALKCGTKVDFISSLVASTELQFSMEAWFSGKKIGHRVGRTRKEAQNKAAEDSIKHLADIYLSSAKDEPGSTYGDVSGFPNVNDSGYMGIASSLGNQPLSKEDSASFSTASPSRVLDPRLDVSKRSMGSISSLKELCMMEGLDVNFLSAPAPVSTNSVQKDEVHAQFFVPSID

SEQ ID NO: 202421 - protein, 97 aa, Glycine max
  Coding DNA Sequence Number=SeqID_85643
  Gene Ontology: Mol. function=protein serine/threonine kinase activity; Biological process=protein amino acid phosphorylation
  Homolog annotation: Hit_ID=Q1SZ16; Match level="QueryCoverage=90%, HitCoverage=17%, E-value=3e-12, Identity=46%"; Hit description =Protein kinase
MSCGCFGASTLKKKRNPSDTPNEIDAFNNSALLYNFIFLLLALPMSLHFSDCFPLDNVKNFSDKDLRLATDNYNPSKKLGRGGFGIVYQVFRSQAQV

SEQ ID NO: 202422 - protein, 136 aa, Glycine max
  Coding DNA Sequence Number=SeqID_85644
  Gene Ontology: Mol. function=two-component response regulator activity; Cellular component=membrane; Biological process=two -component signal transduction system (phosphorelay)
  Homolog annotation: Hit_ID=Q0PHI2; Match level="QueryCoverage=95%, HitCoverage=17%, E-value=1e-36, Identity=60%"; Hit description =Ethylene receptor
  Pfam annotation: Domain name=Response_reg; Domain location=48-133; Score=2.1; E_value=0.0024; Accession=PF00072.14; Description =Response regulator receiver domain
MMQGNIWISPNTLGLVQGMTLLKFQIGPSLEKSIFAPKDYSSSQFRGLKAVLAKDDGVNRTVTKKLLEKLGFHVIAVSSGFECLSAISGAGNSFRIILLDLHMPEMDGFEVVKRIRKFHSHSWPLIIALIAVQMNM

SEQ ID NO: 202423 - protein, 126 aa, Glycine max
  Coding DNA Sequence Number=SeqID_85645
  Gene Ontology: Mol. function=two-component response regulator activity; Cellular component=membrane; Biological process=two -component signal transduction system (phosphorelay)
  Homolog annotation: Hit_ID=Q0PHI2; Match level="QueryCoverage=51%, HitCoverage=12%, E-value=5e-10, Identity=42%"; Hit description =Ethylene receptor
MASQARKSFQNVMSHGMRRAMHCILGMLSLFQEDNLRKRKGRLPVRDETFHSMMREAASTAKCLLLKSSQPDEAISTIHYTGRRQYYNNETKEGLSFSMCRKVGTELSNVELFMMFEMGGETIITS

SEQ ID NO: 202424 - protein, 163 aa, Glycine max
  Coding DNA Sequence Number=SeqID_85646
  Homolog annotation: Hit_ID=O82263; Match level="QueryCoverage=49%, HitCoverage=19%, E-value=2e-17, Identity=55%"; Hit description =Expressed protein
  Subcellular localization annotation: CTP_CleavageSite=35; ConfidenceScore=5.39e-01
MASANSNPPPPPPPPTLVADFSFPANVMAIPIPVSAMLIQTAFPQQDLTATPTGIPERLRENEEAGEAHGVGEVAEEEAVAVVGIGVVGGGERGGIGGGVVEEVLAGEEVGGVEAEGRFDVEGRAAQTHDAKRQGMGSSSSLTTLTHLLFFLFTFKELILFQR

SEQ ID NO: 202425 - protein, 106 aa, Glycine max
  Coding DNA Sequence Number=SeqID_85647
MKEHCITVSPICMPTKVFCVVSISKQTLKPWNDQKITQHCGSNVFQGYFDDAKESRVKQSFKQRFKNQVLRFKIQESSFKNQESRSRSRFKTQDSRIKRRLNQDKY

SEQ ID NO: 202426 - protein, 235 aa, Glycine max
  Coding DNA Sequence Number=SeqID_85648
  Gene Ontology: Mol. function=nucleic acid binding; Cellular component= extracellular region; Biological process=RNA-dependent DNA replication
  Homolog annotation: Hit_ID=Q1SKJ3; Match level="QueryCoverage=77%, HitCoverage=20%, E-value=6e-40, Identity=42%"; Hit description=Zinc finger, CCHC-type; Endonuclease/exonuclease/phosphatase
MAFKGCLKDWIGKPFHFECAWLSHENYVETLNNAWNKREPLVSKLENLKSTLSVWRKNIFGEIHKKKQSILARIGGIQNLFYWGNHNPFLINLEKSLHEEIGVVLYQEELSWFQKSRAQWLHDGDQDTRYYHLKTISRRRRNKISMLRDGNGNWLEDEQQIRSLVNEFYINLFSDDDRDDRWSVSPLSFPILDQQHYDSLGVDVLAEKVKMALFGMKLWKAPGPDGLPAGFFQNS

SEQ ID NO: 202427 - protein, 122 aa, Glycine max
  Coding DNA Sequence Number=SeqID_85649
MDFLLASFGMSNLRPRDNGWEVVVVIGVVAGADQKKCGENGDRTRLRRGGGGPNLRSEGKKCKRRGERNRRRSVGLRGGVVASHVGHQRRRKEVMRGGDGSCRRGQNGRKERHKAKTCRRKK

SEQ ID NO: 202428 - protein, 718 aa, Glycine max
  Coding DNA Sequence Number=SeqID_85650
  Gene Ontology: Mol. function=RNA-directed DNA polymerase activity; Cellular component=extracellular region; Biological process=RNA -dependent DNA replication
MSCLSTVVTNVKWNGQRSSMFPPKCGLCQGDSLSPYIFVLYVDKLSHLISKAVEDGVWKPVKMGRNGSLISHLMFADDLILCGQTNLEQMEVVKDILYNFCDMSGQMVSAEKTRIYFSKNVNSQTRRDLVSRSGFFEVSMLGSYLGIPLLGKSPRQRDFQHLLNKVEDKLTAWKAKQLSLVGRIILAKFLIQAIPVHSMISPYIPASVLKKIEKAERSFVWGDQQSKREFHAVGWPTLIKPKDEGGLAMRNLQSMNLACLMKIRWAIRNDGEYWAVGKSDSVSVWYDRWISADIIKLSNVMQVIPDHVANYKVNDMVKQDGQWDFELLSLLIPQDIIKCIKAIIPPRDNADDDRRLWTGNKLGEYFVASGYNQVNGFQNLSQSHIWNKIWKIKAPERIKVFIWQVTHERLLTNSCIAHRGNGQASCHHCVILEENILHVLRDCPLANLVWLHLLDQSNVANFFYPDLMEWIDMNLSRDLNATSKDDWQSVWAQGCYFLWYWRNQQVHNSSFVRPFRLWESILQNCRNYKILMVHMDSSQVVSKKQIMIKWMPPDQRWYKLNSDGLKVGDSGGTGYGGLIRDENGRWVVGFVRNLGIASAYVAKSWGVLEGVTLARQRGIDFLEINVDSKVVVDGLKGDKQGCLEGWTIVGAIRKMVSGLEQVKISHIYREANQCADLHVNHARTQEEDLMILEHPIGLLTQLLLMDSCGVETPHVVVV

SEQ ID NO: 202429 - protein, 408 aa, Glycine max
  Coding DNA Sequence Number=SeqID_85651
  Homolog annotation: Hit_ID=Q1RZZ2; Match level="QueryCoverage=23%, HitCoverage=48%, E-value=1e-14, Identity=42%"; Hit description =Ribonuclease H
  Pfam annotation: Domain name=DUF246; Domain location=200-389; Score= -217.7; E_value=0.058; Accession=PF03138.5; Description=Plant protein family
  Pfam annotation: Domain name=RnaseH; Domain location=36-192; Score= -20.7; E_value=0.0049; Accession=PF00075.14; Description=RNase H
  Pfam module annotation: Pfam domain module=DUF246::RnaseH; Domain location=200-389::36-192
TIHHQWEDYQRISEKPSPLMLARRVEMLVRLEEPMPGWVTLNTDGSSCQGIAGCGGLICGPRGRWIRGFSKVGRANAFMAELCGLFEGLKLLQTQGYQAVNVQVDLEASVKSVVGNNDGCVVGWKFIRCWVVHGVGKQVHTPNSISKLHQLQRSSKSLKEGERLEPDADSKPKTKSVKRNEIKKEKCIQAALEKEKNVSEVEDSGKQESLEALTSQISDMVAIAKIMKATLVLPTLDHDSFWTDSSQTVNLGLKSETASSGVSGASSRYGYFLAIVSSRPRVISWEIGEEIPKFRNDLGNVEHISIPSDAKNLVTLDFEDQHEAAEGVLLDDDLNEPTMGEKLASLSVLDGNKSRSDIEQESSVPTKPPSADSVYVLLKQALNADDRTLLLDCLFTQNEKVLFLSYFY

SEQ ID NO: 202430 - protein, 207 aa, Glycine max
  Coding DNA Sequence Number=SeqID_85652
MAVVLRELLHVWWWSIPTKTLRHLISGVIPLIVGDATSVGGVGATKGERHPNTRVCFFPREDEVKSPLHVPPHNVIDLDSKATVIQVLVYRPFIPHPPSPRKPSKVRKEFPPTTLLGYSWVHEEFQFYEISFQTYESIIDILEFVKLYHIDGLNVMELWPSSITNPSRRLRLRRFQKQRLRRFRPTRPRESNKTASMTRFLLPFPSA

SEQ ID NO: 202431 - protein, 88 aa, Glycine max
  Coding DNA Sequence Number=SeqID_85653
  Subcellular localization annotation: CTP_CleavageSite=43; ConfidenceScore=5.09e-01
MVKFGYNSIKKAQAKKAAKAKTMKVQADKAKVPPPPPISLGVVERANPGPQDEGPSKRLRVELVPLVVTSSIESHPVLLSMKEETVSL

SEQ ID NO: 202432 - protein, 57 aa, Glycine max
  Coding DNA Sequence Number=SeqID_85654
MEASVSSSIGLPSPKHHEISISTLTDVVGCGEDGVKGQCEADFQGGRLGGVDTWHGT

SEQ ID NO: 202433 - protein, 65 aa, Glycine max
  Coding DNA Sequence Number=SeqID_85655
  Subcellular localization annotation: CTP_CleavageSite=50; ConfidenceScore=5.63e-01
MKMNVFSPASLPSSLYFYVASTWSSLVTFGFLPTQCFKGFWTSRHTKGFSSAKRADCLAKQMRLA

SEQ ID NO: 202434 - protein, 63 aa, Glycine max
  Coding DNA Sequence Number=SeqID_85656
MAVNLQCIMIMISQAKPMMNHTWSTPILKSCSKRIPIIRAPMISSYPTELGILTQGCKYTDSN

SEQ ID NO: 202435 - protein, 151 aa, Glycine max
  Coding DNA Sequence Number=SeqID_85657
MAHLAEVVDQLELQNSLSVHLHAKPKNLSAIALLIICTSHHLHFATLPFHSISLLQGVEADKPNSGFCDELAKRACLAEMNLLSKPYSAKRVHQMALKKRRASSSRSQEPYDTSRFLSEVTSERYETNVHNRNILPERNVELAYSHYDEFL

SEQ ID NO: 202436 - protein, 104 aa, Glycine max
  Coding DNA Sequence Number=SeqID_85658
MQNIRGKVVVSSVWKVSMMFSEIKLSNLHNQSLSTLTENFQVKHQKAHIYACKADLPGQKEEEARAQSADGRVFKIVPWHHLEHSTSNSLSIQALSHDLTGSDR

SEQ ID NO: 202437 - protein, 553 aa, Glycine max
  Coding DNA Sequence Number=SeqID_85659
  Gene Ontology: Mol. function=protein binding; Cellular component =integral to membrane; Biological process=protein amino acid phosphorylation
  Homolog annotation: Hit_ID=Q1T435; Match level="QueryCoverage=94%, HitCoverage=83%, E-value=1e-59, Identity=31%"; Hit description =Leucine-rich repeat; Leucine-rich repeat, cysteine-containing type
  Pfam annotation: Domain name=LRRNT_2; Domain location=33-75; Score =54.4; E_value=3.8e-13; Accession=PF08263.3; Description=Leucine rich repeat N-terminal domain
  Pfam annotation: Domain name=LRR_1; Domain location=108-130; Score =13.5; E_value=0.77; Accession=PF00560.23; Description=Leucine Rich Repeat
  Pfam annotation: Domain name=LRR_1; Domain location=133-155; Score =20.0; E_value=0.0083; Accession=PF00560.23; Description=Leucine Rich Repeat
  Pfam annotation: Domain name=LRR_1; Domain location=157-180; Score =8.6; E_value=6.9; Accession=PF00560.23; Description=Leucine Rich Repeat
  Pfam annotation: Domain name=LRR_1; Domain location=182-204; Score =15.0; E_value=0.27; Accession=PF00560.23; Description=Leucine Rich Repeat
  Pfam annotation: Domain name=LRR_1; Domain location=206-228; Score =13.9; E_value=0.59; Accession=PF00560.23; Description=Leucine Rich Repeat
  Pfam annotation: Domain name=LRR_1; Domain location=255-280; Score =1.3; E_value=1.6e+02; Accession=PF00560.23; Description=Leucine Rich Repeat
  Pfam annotation: Domain name=LRR_1; Domain location=283-306; Score =8.5; E_value=7.5; Accession=PF00560.23; Description=Leucine Rich Repeat
  Pfam annotation: Domain name=LRR_1; Domain location=312-334; Score =10.3; E_value=3.3; Accession=PF00560.23; Description=Leucine Rich Repeat
  Pfam annotation: Domain name=LRR_1; Domain location=337-358; Score =0.4; E_value=2.4e+02; Accession=PF00560.23; Description=Leucine Rich Repeat
  Pfam annotation: Domain name=LRR_1; Domain location=360-383; Score =10.7; E_value=2.9; Accession=PF00560.23; Description=Leucine Rich Repeat
  Pfam annotation: Domain name=LRR_1; Domain location=385-409; Score =6.8; E_value=15; Accession=PF00560.23; Description=Leucine Rich Repeat
  Pfam annotation: Domain name=LRR_1; Domain location=413-436; Score =3.4; E_value=66; Accession=PF00560.23; Description=Leucine Rich Repeat
  Pfam annotation: Domain name=LRR_1; Domain location=439-461; Score =13.9; E_value=0.6; Accession=PF00560.23; Description=Leucine Rich Repeat
  Pfam annotation: Domain name=LRR_1; Domain location=464-486; Score =15.1; E_value=0.26; Accession=PF00560.23; Description=Leucine Rich Repeat
  Pfam annotation: Domain name=LRR_1; Domain location=488-510; Score =14.4; E_value=0.41; Accession=PF00560.23; Description=Leucine Rich Repeat
  Pfam annotation: Domain name=LRR_1; Domain location=517-539; Score =8.7; E_value=6.7; Accession=PF00560.23; Description=Leucine Rich Repeat
  Pfam module annotation: Pfam domain module=LRRNT_2::LRR_1::LRR_1::LRR_ 1::LRR_1::LRR_1::LRR_1::LRR_1::LRR_1::LRR_1::LRR_1::LRR_1::LRR_1::LRR_ 1::LRR_1::LRR_1::LRR_1; Domain location=33-75::108-130::133-155::157 -180::...
  Pfam module annotation: Domain location=182-204::206-228::255 -280::283-306::312-334::337-358::360-383::385-409::413-436::439 -461::464-486::488-510::517-539
MERMRGIESVLWVSRGSILGFNSLSNSAEIKCIESERQALLNFKHGLIDGFGMLSTWRDDDSNRDCCKWKGIQCNNQTGHVEMLHLRGQDTQYLIGAINISSLIALENIEHLDLSYNDFEGSPIPELMGSFTNLRYLNLSDCSFVGSIPSDLGKLTHLLSLDLGNNMYLHGQIPYQLGNLIHLQYLDLSDNYLDGELPCQLGNLSQLRYLDLDANSFSGALPFQVGNLPLLHTLGLGSNFDVKSKDVEWLTNLSCLTKLKLSSLRNLSSSHHWLQMISKLIPNLRELRLFDCSLSDTNIQSLFYSPSNFSTALTILDLSSNRLTSSTFQLLSNFSHHLPELYLPYNNIVLSSPLCPNFPSLVILDLSYNNLTSSVFQGSFNFSSKLQNLYLQNCSLTDGSFLMSSFIMSSSSSLVSLGLSSNLLKSSTIFYWLFNSTTNLHNLFLYDNMLEGPIPDGFGKVMNSLEGLYLYGNKLQGEIPSFFGNMCALQSLDLSNNKLNGEISSFFQNSSWCNRYIFKSLDLSYNRLTGMLPKSIGLLSELTDLYLAGNSLE

SEQ ID NO: 202438 - protein, 197 aa, Glycine max
  Coding DNA Sequence Number=SeqID_85660
  Homolog annotation: Hit_ID=Q5XWK4; Match level="QueryCoverage=85%, HitCoverage=54%, E-value=8e-26, Identity=35%"; Hit description =Expressed protein-like
  Pfam annotation: Domain name=DUF616; Domain location=3-197; Score =165.8; E_value=1.1e-46; Accession=PF04765.4; Description=Protein of unknown function (DUF616)
MVIKGISPILLLTSFTFVRGSKPGRNIGFDMDEDDLVEMEQCHGVVAASAIFDEEIESNLRSSTRLGTKKKIGLWRIIVAHNLPYTNPRHKRKSIWLDGKLELLVDPYQILERFLWRKNASFAISKHYRRFDVFVEAKANKAAGKYENASIDFQIDFYKNEGLTPYTEAKLPIISDVPEGCVIVRDHVPISDLFTCL

SEQ ID NO: 202439 - protein, 95 aa, Glycine max
  Coding DNA Sequence Number=SeqID_85661
  Subcellular localization annotation: CTP_CleavageSite=44; ConfidenceScore=5.04e-01
MTLALSLPLSLVALSPSQPLSHTTLRVLSQVWLAMSLLADGLAVAGQPSALNIKDYFIMNWNGIRTLGVPKELMTTHGRHRSYSFILGLGFSGVS

SEQ ID NO: 202440 - protein, 75 aa, Glycine max
  Coding DNA Sequence Number=SeqID_85662
STMLVALGKVYDTSSSIHNVPYANDMVRVSVVTVYHGDAQVPFLMSEVWFVSQAVGTVVAWLKHLVKVVSHVLDK

SEQ ID NO: 202441 - protein, 119 aa, Glycine max
  Coding DNA Sequence Number=SeqID_85663
MTIQMASRKRKAPSTPTQVRFDRSRFTSQEAWEKYTDIVVPHKLLPERNVVVYYTVFDEFKGELERCHWDEELTDFVDDNIDVAIVKEFYANLSDPEDISPKQVRVRGHLIKFDEDTLI

SEQ ID NO: 202442 - protein, 103 aa, Glycine max
  Coding DNA Sequence Number=SeqID_85664
MAQSQHNMSMVIVKFLGWYANRKGDLATGHLPEDPMMIVTYPRRSSDKDDFCGLNNFNNTLFELEFKSEVCVVVVAKAIKEDMVKVATVGGDCGHEIPFQYCC

SEQ ID NO: 202443 - protein, 245 aa, Glycine max
  Coding DNA Sequence Number=SeqID_85665
  Gene Ontology: Mol. function=protein serine/threonine kinase activity; Cellular component=integral to plasma membrane; Biological process=protein amino acid phosphorylation
  Homolog annotation: Hit_ID=Q9STJ8; Match level="QueryCoverage=66%, HitCoverage=25%, E-value=1e-51, Identity=65%"; Hit description =Receptor kinase-like protein
  Subcellular localization annotation: CTP_CleavageSite=80; ConfidenceScore=5.14e-01
MSTLHRSTIISNNNNNLLLLLLLLHLLFIINTPTFQNLNFKPRSLRAQPRKPKVPNSRREIAIKQNVARFNVAVNNRGVAGVKKVNTFRYVEDNREARVPVREFGALAVQKRVLEVAVVHELVDQEEAASFRVGAEVRGGDDVAGEELRGEEEFVVELALTLVVVGGGVHELDGDGGAGEGAGEDGAEASVAEARGEGVGGTAEDGEGEAVRRGGGGRRRRVGGSAFAGEGAVAEEEKEEEKGAC

SEQ ID NO: 202444 - protein, 414 aa, Glycine max
  Coding DNA Sequence Number=SeqID_85666
  Gene Ontology: Mol. function=protein serine/threonine kinase activity; Biological process=protein amino acid phosphorylation
  Homolog annotation: Hit_ID=Q9FLI2; Match level="QueryCoverage=92%, HitCoverage=55%, E-value=4e-66, Identity=41%"; Hit description =Similarity to protein kinase
  Pfam annotation: Domain name=Pkinase; Domain location=67-362; Score= -104.6; E_value=0.025; Accession=PF00069.15; Description=Protein kinase domain
  Pfam annotation: Domain name=Pkinase_Tyr; Domain location=98-362; Score=-163.0; E_value=0.018; Accession=PF07714.7; Description =Protein tyrosine kinase
  Pfam module annotation: Pfam domain module=Pkinase::Pkinase_Tyr; Domain location=67-362::98-362
MEDGGLGVEQSPSPEMAAMTSPETGLAVSAAEASPGFEKGSVQSEKEGVKKINGRGLKSNSVRDWWWKHENEVGVGESKKVKDYVMEWIGRDVNKERVKNGIEYGDVVVGKEEKNKKEKKRRKKELEWWESMEEEKLDGVMKRKRRTVREWWKEERFEENAKTTAKKKKKKRKGGSVKSDDEKCGDDWWMSDDAMDKRKGKSRSRNNRGNMDWWMDGLSGELWRGRRNNSFDSASGEIPKSGGVSSTPSMRGTVCYVAPECGYGGEVSEKSDVYSFGVLLLVIISRRRPLQVSGSPLSEFQRANLLSWARHCARNGKLVELIDESTELLDKEQALLCIKVALLCLLKSPARRPSIKEVVGMLSGELEPPQLPVEYSPSTPSRFPFKSRRKGSGSLPMTETMYRDLGGESYALTI

SEQ ID NO: 202445 - protein, 64 aa, Glycine max
  Coding DNA Sequence Number=SeqID_85667
  Subcellular localization annotation: CTP_CleavageSite=37; ConfidenceScore=5.30e-01
MSRLVPPSCLARRADLALSAQARFLCSSRFSHHTKCAVAARSGRYELSPQVPLNATAPFSTSRL

SEQ ID NO: 202446 - protein, 252 aa, Glycine max
  Coding DNA Sequence Number=SeqID_85668
MPLPEIEDKSGVVIRTFGHYATVLVDIDFALQLRDQILVEWKGYAFLEGKGGKKSETIWQQSDNNVIMPESSPLGVGIGQSTSNPMAQNVQPKHLPRSVPPRASNLISKENIDTTLQLSSTEPVGSHAFDLVSSIGSPIFHNQIDFVALKGVSKDKEGSDEENVIPLGEDDPEFEVVLSKSQKKRLRQKSRNAKALNHPRAFLGDFNTTLGAHEKIGWCPLLRASSDDFFDWSILSNLTHLHSRGAEFTWTN

SEQ ID NO: 202447 - protein, 401 aa, Glycine max
  Coding DNA Sequence Number=SeqID_85669
  Gene Ontology: Mol. function=RNA polymerase II transcription factor activity; Cellular component=nucleus; Biological process=regulation of transcription, DNA-dependent
  Homolog annotation: Hit_ID=Q680U9; Match level="QueryCoverage=92%, HitCoverage=78%, E-value=1e-146, Identity=69%"; Hit description=MRNA, complete cds, clone: RAFL22-33-O09
  Pfam annotation: Domain name=Tfb2; Domain location=13-373; Score =170.5; E_value=4.3e-48; Accession=PF03849.5; Description =Transcription factor Tfb2
MPEVRIIAKNFMDMVASMPAMKLDKLYENGFICEAILRSVPPLAKKYVIQMLHIDVPVAAKLLEEWVLPAGVSKHRVAIDRLVQLRVFLEAVDRKNEKTYKVNPTFQRSLQKLLVQGGTLPRESMPSNITVRLPTLENLEAYALEQWECFLLQLISPSQVEKPLNISSSLMKVFQRRILSHRDKEAPKLTESGFQFLLMDTNAQLWYIIREYISNSEVALTSVMKPSPVIDLVEDRGVDAADLISFMLELSFHVIGEAYSVDTLTSFQRTIINDLADLGLVKIQQGRKGSWFIPTKLATNLSMSLADSSSRKQGFVVVETNFRVYAYSTSKLHCEILRLFSRVEYQLPNLIVGAITKESLYSAYENGITAEQIDGNDLFLAMLLLGIRGPFLKCIPEGLGR

SEQ ID NO: 202448 - protein, 214 aa, Glycine max
  Coding DNA Sequence Number=SeqID_85670
  Gene Ontology: Mol. function=metal ion binding; Cellular component =integral to membrane
  Homolog annotation: Hit_ID=Q7EYM0; Match level="QueryCoverage=81%, HitCoverage=72%, E-value=5e-63, Identity=64%"; Hit description=Zinc finger protein family-like
  Pfam annotation: Domain name=zf-C3HC4; Domain location=159-188; Score= 4.8; E_value=0.05; Accession=PF00097.15; Description=Zinc finger, C3HC4 type (RING finger)
MEGRGCCEMYVASMRKSFKDSLKVLEADIQHANTLASDFPREYDGACLQMRMSYSPAAHLFLFLVQWTDCHLAGALGLLRILIYKVYVDGTTTMSTHERKASIREFYAVIYPSLLQLEKGVTDTEDKKQKAVCMERYRRRDDEEYRQSSDIDIEREDECGICMDMNSKIVLPNCNHAMCLKCYREWYSPYFLNSIQSLLSDHRISVVVKCVIAP

SEQ ID NO: 202449 - protein, 47 aa, Glycine max
  Coding DNA Sequence Number=SeqID_85671
MGSESSSNPILWETYMAAKSVFLLVQKMPAGMSDSWVALSYGLEGKG

SEQ ID NO: 202450 - protein, 40 aa, Glycine max
  Coding DNA Sequence Number=SeqID_85672
MPPNSQGKNRHNHSWCCPQNKCQVYHQADRWGVQVVALAS

SEQ ID NO: 202451 - protein, 51 aa, Glycine max
  Coding DNA Sequence Number=SeqID_85673
  Homolog annotation: Hit_ID=Q9LZ20; Match level="QueryCoverage=90%, HitCoverage=8%, E-value=5e-07, Identity=59%"; Hit description=Amino acid transport-like protein
MTATTTKYISLKPLGRDGTVRRHLVEEILIVVPRYAVKPMVTVALESTDQR

SEQ ID NO: 202452 - protein, 135 aa, Glycine max
  Coding DNA Sequence Number=SeqID_85674
  Homolog annotation: Hit_ID=Q947D9; Match level="QueryCoverage=78%, HitCoverage=36%, E-value=2e-08, Identity=30%"; Hit description =Resistance gene analog NBS9
  Pfam annotation: Domain name=TIR; Domain location=48-135; Score= -32.7; E_value=0.074; Accession=PF01582.10; Description=TIR domain
MATSVYSFYLDKTEENTEKKDGDKVLNLVSCAAFSMMSLSLSRLTGLGFISFRAKDTSNISDYFASILLKKSLKVYFHQELIGDYVPPRVVEQIEKAKVSVIILSESYLDTTWCLDEGREGETPSHPALFPYLPE

SEQ ID NO: 202453 - protein, 94 aa, Glycine max
  Coding DNA Sequence Number=SeqID_85675
MSQQWGSPCGSQCTNKYAALGKIPWRIFCKKGCDSDGETWEECLEDCNQICYKDPVLKDQQWSAYIDRSPGAASYSEECFHACVSGCGYKVGWI

SEQ ID NO: 202454 - protein, 349 aa, Glycine max
  Coding DNA Sequence Number=SeqID_85676
  Gene Ontology: Mol. function=nucleoside-triphosphatase activity; Cellular component=endoplasmic reticulum; Biological process=ER to Golgi vesicle-mediated transport
  Homolog annotation: Hit_ID=Q40495; Match level="QueryCoverage=89%, HitCoverage=42%, E-value=1e-138, Identity=76%"; Hit description=N -ethylmaleimide sensitive fusion protein
  Pfam annotation: Domain name=AAA; Domain location=141-321; Score= -8.2; E_value=0.00089; Accession=PF00004.19; Description=ATPase family associated with various cellular activities (AAA)
MDKLNAAVTQTLTLYIEIQQCKVRSMTNICSRGQKAARTKNYSGAELEGVVKSAVSYALNRQLSLEDLTKPVEEENIKVTMDDFLNALHEVTSAFGASTDDLERCRLHGMVECGDRHKHIYQRAMLLVEQVKVSKGSPLVTCLLEGSRGSGKTALSATVGIDSDFPYVKIVSAESMIGLHESTKCAQIIKVFEDAYKSPLSVIILDDIERLLEYVPIGPRFSNLISQTLLVLLKRLPPKGKKLMVIGTTSELDFLESIGFCDTFSVTYHIPTLNTTDAKKVLEQLNVFTDEDIDSAAEALNDMPIRKLYMLIEMAAQGEHGGSAEAIFSGKEKISIAHFYDCLQDVVRL

SEQ ID NO: 202455 - protein, 964 aa, Glycine max
  Coding DNA Sequence Number=SeqID_85677
  Gene Ontology: Mol. function=nucleoside-triphosphatase activity; Cellular component=cytoplasm; Biological process=maintenance of fidelity during DNA-dependent DNA replication
  Homolog annotation: Hit_ID=Q2JJ70; Match level="QueryCoverage=82%, HitCoverage=98%, E-value=7e-98, Identity=31%"; Hit description=MutS2 family protein
  Pfam annotation: Domain name=MutS_V; Domain location=321-536; Score= -28.6; E_value=6.8e-13; Accession=PF00488.12; Description=MutS domain V
  Pfam annotation: Domain name=REF; Domain location=836-952; Score= -57.0; E_value=1.3e-06; Accession=PF05755.3; Description=Rubber elongation factor protein (REF)
  Pfam annotation: Domain name=Smr; Domain location=763-834; Score =53.2; E_value=8.7e-13; Accession=PF01713.11; Description=Smr domain
  Pfam module annotation: Pfam domain module=MutS_V::REF::Smr; Domain location=321-536::836-952::763-834
  Subcellular localization annotation: CTP_CleavageSite=66; ConfidenceScore=5.60e-01
NKQGTESPMQLSSNVLIPANKPPRPLFFKPRFCSNPNSPESNSLQAETLKTLEWGSVCKQLSAFTSTSMGSAAALNARLPIGRTRRDSQRLLDQTSAARLVAEPLDFSGVHDLTEILGVATSGHLLTIRELCTVRHTLAAARELFDALKRVASASNHPQRASHRYLLPDGVVLNVSSSGATYFMEPKDAIDLNNLEVRLSSSEKAEESVILSMLASEIANSESDINHLLDKILKVDLAFARAAYAQWMNGVCPIFSLGNFEGRDSVEDDDDTLVTQEDDDLTVDIVGIRHPLLLESSLENISDNLTLRSGNAAEFGNGNGTMASKYMPQGISDFPVPVDFKIGHGTRVVVISGPNTGGKTASMKTLGLASLMSKAGMHLPAKKNPKLPWFDLILADIGDHQSLEQNLSTFSGHISRICKILEVASTQSLVLIDEIGGGTDPSEGVALSASILQYLKDRVNLAVVTTHYADLSSMKEKDTRFDNAAMEFSLETLQPTYRILWGCTGDSNALSIAQSIGFDRNIIDRAQKWVEKFKPEQQQERRGMLYQSLQEERNQLKAQAEKAASVHAEIMSVYNEIQGEAEDLDQREMELMAKETQQVQHELEHAKSQIETVIQKFEKQLRISGRDQLNYLIRESESAIASIVKAHTPADSFPINEADRALYTPQIGEQVHVKGLGGKLATVVESPGDDGTIMVQYGKVKVRVKKSNIIAIPSSRKNAVTSSSSTHQGRQSLRNGEYRDNVDNKTNDDISYGPVVRTSKNTVDLRGMRVEEASIQLEMAINASRPYSVLFVIHGMGTGAVKERALQILQNHPRVTNFEPESPMNYGSTIAYVNCHHAFTAVAAICAKERSGVHAVEEAVKSVIGSVYEKFHLVPDELVRIANRNPDLSGAAVHRPTPPPKTTAFGIAGAVYAECELAAKELYERYEGKAEQCAVAAAVPSGAEGGILDGEVQQESCGSGGERL

SEQ ID NO: 202456 - protein, 217 aa, Glycine max
  Coding DNA Sequence Number=SeqID_85678
  Gene Ontology: Mol. function=chitin binding; Cellular component =extracellular region; Biological process=chitin metabolic process
  Homolog annotation: Hit_ID=UPI000044A8F0; Match level="QueryCoverage =81%, HitCoverage=99%, E-value=5e-24, Identity=29%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
RADTLTFRGLHVLAFRGLHLFAFRRLYVLAFKGQHILPLRGLHVLTLRGLHVLPFRGLHVLAFRGLHALAFRGLHVLAFRGLYALAFRGLHALAFRGLHVLAFRGLHVLTFKGLHVLTFKGLSVLAFKGLHVLAFRWLHIFAFRGLHILAFRGLHVFAFRGLHVLAFKGLHVLSFRGLHILAFEDCMPSPSVSYTSSLSEGSISAPSGNSRSSTLSA

SEQ ID NO: 202457 - protein, 95 aa, Glycine max
  Coding DNA Sequence Number=SeqID_85679
  Subcellular localization annotation: CTP_CleavageSite=48; ConfidenceScore=5.55e-01
MAVTAWVSPSSSPSLFAPVFLSHPSRMIKFASFRTHIDPFTGEDQICKALRVRSPPSFHSRVIDNVSTITIIVSLSIIGGTTWAAKIPPPFGRVL

SEQ ID NO: 202458 - protein, 187 aa, Glycine max
  Coding DNA Sequence Number=SeqID_85680
MEAMKEQMTTMMEAIMSIRKMMEVNKAIAVAIGTATEVDPTHPSSLNQVNYPVSDMVGQGGEALGSTGDLHFMQVQNKHSFPPYGLPPNYTPPNVAHAPDENVNNSTPILIETQQPQSGQAQVPQPTEEAHEAPRDHNLANFEPHLKYAAEGQAFCGVPLPSVSPTTITLAFCGGKSPSFYVGKGKI

SEQ ID NO: 202459 - protein, 169 aa, Glycine max
  Coding DNA Sequence Number=SeqID_85681
MEREMITVIVDTLPVFYYKKMVGYTPSGFADLVFVDERIEMGLRRDKFDYLALMNRKPGGNGENKKEEGTHAVTAIPTWPNFPPAQQYHTQPISALLITHYHTLISFGDDHWPTFGFLLAKLSCLTLIVTQSVGSPGQASYFWRKQAAHRGKLSSPGRAAVQPPPLIFL

SEQ ID NO: 202460 - protein, 261 aa, Glycine max
  Coding DNA Sequence Number=SeqID_85682
  Gene Ontology: Mol. function=metal ion binding; Cellular component =integral to membrane
  Homolog annotation: Hit_ID=Q8H222; Match level="QueryCoverage=80%, HitCoverage=84%, E-value=4e-61, Identity=60%"; Hit description =Putative RING protein
  Pfam annotation: Domain name=zf-C3HC4; Domain location=34-80; Score =28.0; E_value=3.2e-05; Accession=PF00097.15; Description=Zinc finger, C3HC4 type (RING finger)
MALEHYLSQEWKTSPSPSPSPMTVTENLDGCFDCNICLDFAHEPVVTLCGHLYCWPCIYKWLHVQSASLAPDEHPQCPVCKDDICHTTMVPLYGRGQGIAHSDRDGKASSYRGSFIPPRPPALGAQSLMSTSSQSAQQLPYRNPYQNQHFNPPLYQDEDESSSQMLNPGANMVAPGFPTLWLGCLERCFMPESLATQKIYTTIQILITWGEKSNVSHASRGGSFVVIFDIADKCNRNYVAVKYAVADGLSEKSFPLKILRE

SEQ ID NO: 202461 - protein, 358 aa, Glycine max
  Coding DNA Sequence Number=SeqID_85683
  Gene Ontology: Mol. function=nucleoside-triphosphatase activity; Cellular component=endoplasmic reticulum; Biological process=ER to Golgi vesicle-mediated transport
  Homolog annotation: Hit_ID=Q40495; Match level="QueryCoverage=99%, HitCoverage=51%, E-value=1e-156, Identity=75%"; Hit description=N -ethylmaleimide sensitive fusion protein
  Pfam annotation: Domain name=AAA; Domain location=229-358; Score =80.5; E_value=5.2e-21; Accession=PF00004.19; Description=ATPase family associated with various cellular activities (AAA)
  Pfam annotation: Domain name=CDC48_2; Domain location=83-158; Score =26.2; E_value=0.00011; Accession=PF02933.7; Description=Cell division protein 48 (CDC48), dom
  Pfam annotation: Domain name=CDC48_N; Domain location=13-70; Score= -9.1; E_value=0.018; Accession=PF02359.8; Description=Cell division protein 48 (CDC48), N-t
  Pfam module annotation: Pfam domain module=AAA::CDC48_2::CDC48_N; Domain location=229-358::83-158::13-70
  Subcellular localization annotation: CTP_CleavageSite=54; ConfidenceScore=5.55e-01
MASRFGLSSSSSSASSMRVTNTPASDLALTNLAFYTAHDTIGSGQIALNAVQRRCAKVSSGDSVQVSRFVPPEDFNLALLTLELEFVKKGSKSEQIDAVLLAKQLRKRFMNQVMTVGQKVLFEYHGNNYSFTVSNAAVEGQEKSNSLERGMISDDTYIVFETSRDSGIKIVNQREGATSNIFKQKEFNLQSLGIGGLSAEFADIFRRAFASRVFPPHVTSKLGIKHVKGMLLYGPPGTGKTLMARQIGKILNGKEPKIVNGPEVLSKFVGETEKNVRDLFADAEQDQRTRGDESDLHVIIFDEIDAICKSRGSTRDGTGVHDSIVNQLLTKIDGVESLNNVLLIGMTNRKDMLDEALL

SEQ ID NO: 202462 - protein, 98 aa, Glycine max
  Coding DNA Sequence Number=SeqID_85684
MTQGLGVVWNKEEGFVEDDFVVDFLGENALLASIAENEKQTEMAARVSTWKQRIENNLEEQESHPPFDIQDYGERVLHKFFVLSLEASSSGVLSFSNL

SEQ ID NO: 202463 - protein, 156 aa, Glycine max
  Coding DNA Sequence Number=SeqID_85685
  Gene Ontology: Mol. function=transition metal ion binding; Biological process=proteolysis
MGDENHCKILDHILHVRVSVLLIQNGYGKVNYLKCQQSLRLRQAQAPLYKKLENNSVKPLYLGCTTFTRLSRVLALVNLKERFGWSDKSFTELLVLLKNMLPEDNMLPKNHYEVKKILCLVDDEKTLHGMHMAEKMMDCSVIPQILPNGRQLIGCI

SEQ ID NO: 202464 - protein, 262 aa, Glycine max
  Coding DNA Sequence Number=SeqID_85686
  Homolog annotation: Hit_ID=Q851M5; Match level="QueryCoverage=65%, HitCoverage=78%, E-value=6e-39, Identity=48%"; Hit description =Myosin-like protein
MICQRGSFEIREHNIAIRARANAESSTLEFLSTQKLCLHSSLSYEAFAMSASKSGSRKRASEFERAKSDKNKRSATDNFDLDLDFDLSDDIKGIVSALHLIRDKAQKDGQKKNEETISSVGSEVKSMIEGLKSKIEKDRQSFAKALSKSSKEYESSLKNETAKFQAFHENFCKEKATSLQALKDIISKFEEEKEKLFVRYEQLRKKERVMISEQEKACNHKIAQLEDSLRKKKQDDKTFSILRKTLGSFLESTSDEDFPPDD

SEQ ID NO: 202465 - protein, 397 aa, Glycine max
  Coding DNA Sequence Number=SeqID_85687
  Gene Ontology: Cellular component=membrane
  Homolog annotation: Hit_ID=Q6ZGZ0; Match level="QueryCoverage=71%, HitCoverage=72%, E-value=3e-57, Identity=43%"; Hit description =Putative purine permease
  Pfam annotation: Domain name=RRM_1; Domain location=290-366; Score =32.4; E_value=1.6e-06; Accession=PF00076.12; Description=RNA recognition motif. (a.k.a. RRM, R
  Pfam annotation: Domain name=TPT; Domain location=187-343; Score=9.5; E_value=0.00015; Accession=PF03151.7; Description=Triose-phosphate Transporter family
  Pfam module annotation: Pfam domain module=RRM_1::TPT; Domain location=290-366::187-343
MNESTISNKKRYYHWLIIAIHSSLVLVCASATIILRRLYYEKGGKSKWMGTLVQLAGFPIQLPVYFFLAPKNLTTNNSIHPKQPSVSMLSFIYVSIGLLVALDRYLYSVGLWYLPVSTYSLICSSQLAFNAFFSYFLNSLKFTPYIINSLVLLTISSTLLVYQNESSLDDDDDSDSTKISKKKYVIGFICTIGAFAGYGLWLSITQLVFKKVIKRETFKVVLDMISYPSLVATLVTLVRLFASGEWSGLKDEMKGYEMRKASYLLNHTFTAILWQVFTIGCLGLIRARSLFIKNLNFKTMDESLRKHLTEHMKKGSILSVKMKKHLKNGKNVSMGFGFVEFDSPETATNVCKDLQGPVLDSHALILQPCNVKNDGQKQKTIEKDMSLTKLLIKKCCF

SEQ ID NO: 202466 - protein, 162 aa, Glycine max
  Coding DNA Sequence Number=SeqID_85688
  Gene Ontology: Mol. function=lipid binding; Biological process=lipid transport
  Homolog annotation: Hit_ID=Q07A24; Match level="QueryCoverage=59%, HitCoverage=64%, E-value=5e-14, Identity=44%"; Hit description=LTP -like protein 2
  Pfam annotation: Domain name=Tryp_alpha_amyl; Domain location=79-161; Score=28.8; E_value=1.9e-05; Accession=PF00234.12; Description =Protease inhibitorseed storageLTP f
MTIMVMAAKMVLVNDGNGGGDNHSSCNDDDNDDNEDHGDFERMMMRDMKGRVLFLVALLMFLLASEVLILEAEGAGGECGKTPIGSAAASLSPCLGAVSNVKAKVPLACCARVGALLKTAPRCLCAVLLSPLAKQAKINPATAITIPKRCNIRNRPAGKKCG

SEQ ID NO: 202467 - protein, 160 aa, Glycine max
  Coding DNA Sequence Number=SeqID_85689
  Gene Ontology: Biological process=response to brassinosteroid stimulus
  Homolog annotation: Hit_ID=Q84UT5; Match level="QueryCoverage=72%, HitCoverage=71%, E-value=3e-26, Identity=48%"; Hit description =Hypothetical protein OsBLE3
  Pfam annotation: Domain name=DUF588; Domain location=2-142; Score =180.2; E_value=5.2e-51; Accession=PF04535.3; Description=Domain of unknown function (DUF588)
MAKTKRLLTLFLRFLAIGATIAAVIVMVTSHESTEVFNLTFTAKYSNDPAFKYFVVAEAIACGYSLILLFTCSQTSLGRLVLILDVVIAMLLTSSVSAALAIAHVGKKGNTHAGWLPICGQVPKFCDHVTGALVAGFAAAIIYLILIFCPLYSAQSPLYL

SEQ ID NO: 202468 - protein, 71 aa, Glycine max
  Coding DNA Sequence Number=SeqID_85690
MNGKIGFFVIKVSLAKAYDRLRWAFVEKVMVEVGLPPSMAFSSNYSTRGWWLDPYEGGEEWVENIPFDVHE

SEQ ID NO: 202469 - protein, 58 aa, Glycine max
  Coding DNA Sequence Number=SeqID_85691
MSIPVPKGIIEDIQKVQCSFVSGNQPRRRRVHAVNWGEGFGGGGDQLEHGFIIDNSSH

SEQ ID NO: 202470 - protein, 80 aa, Glycine max
  Coding DNA Sequence Number=SeqID_85692
MVTHNSTTFTPKTLEAMVFLLTNSARRQKTHFFKFLDVEKVFYMNGRLIIIVYARIFQGWDGFSDGGVCKGHLRGRKSKV

SEQ ID NO: 202471 - protein, 180 aa, Glycine max
  Coding DNA Sequence Number=SeqID_85693
MAGSKTTLFDVHKFVLFHLMENLPFDLPHTIYINIIKNLKGLGSLEDIYYVALIKKLLRDQGVYYVFNNMEEDYKYTLLVKGSVVAKKQKFSKTNLKSMKVALEQTLNEALEVDVDAINEHLGLDSFGITRKIKKIMVEQQKKKKTRKQSQRYEEEEELLAKEHKTKIKKMMELINQEGG

SEQ ID NO: 202472 - protein, 99 aa, Glycine max
  Coding DNA Sequence Number=SeqID_85694
MPDYYECRPEENIVHPLMAPLEMPFQNLSRCNRDGGGRGCGVECRLIEWREEEWTHVRVYQQQQLSFFGWPLVRTLHYHHQTYFGLSPFVRQDLMWVDT

SEQ ID NO: 202473 - protein, 76 aa, Glycine max
  Coding DNA Sequence Number=SeqID_85695
MVNGMPRNSPMISTCHVGVVSYGKWRLRKVAFVDDWAFLVIGWWVSQPALRREDDARLTGASSKEGKRAESPPTFI

SEQ ID NO: 202474 - protein, 136 aa, Glycine max
  Coding DNA Sequence Number=SeqID_85696
MRGEDCTGARSGELLASSKSNLLAQVSCNPAARLTTSESPISETCQKKGHKRHQVYQHKTFKSCKVRETFEVSMKDSDSLRKDKERKTLIVSACQWTRLSLEGKGDCNSLEKMKADDHDCLCMPTDSLVFGRQMRL

SEQ ID NO: 202475 - protein, 281 aa, Glycine max
  Coding DNA Sequence Number=SeqID_85697
MRFDYEDTSSEAFKALPSDAIIHLPPPTWTRPFRPSIVKIPPHWLAFATQQLVRPSTEMTPSQGRFARSGTSQGSIQKEVQPANVQLSNEDRSKRKDLSCITRHTYLLSKPTLRQEGDARLDGASSNKGKHAGSPRKTLEKLKKAKEKQGIWDEGSSPRRVGYFIMKLFWWPKYSFIQRLLQHPSIPYRGTWNLRPIDVVVVAEKVAREAAENEAATAVQVEASVKVVDNTVVHGVFIDLTNIGVMGETSKGSNVAMADEVEPLIPDSVSKQSTTSNEATS

SEQ ID NO: 202476 - protein, 120 aa, Glycine max
  Coding DNA Sequence Number=SeqID_85698
  Homolog annotation: Hit_ID=Q1RYK6; Match level="QueryCoverage=55%, HitCoverage=4%, E-value=1e-07, Identity=48%"; Hit description=Cyclic peptide transporter
MEEFWSMICGDSVCSEAKTFKDEDIPKLPESDQAESCYLFVFCRSIEQAEKKGTIVTKIVFVGNNSVTSERDFDVRTFCFAQVMVLAVLCNTPLAKLQHKFLTKLLVVQDERSRLVRRLY

SEQ ID NO: 202477 - protein, 68 aa, Glycine max
  Coding DNA Sequence Number=SeqID_85699
MEASVSSSIGLSSPKHHEISISISTLTDAIGCGEDGHCEAGAAYRMLFGLAILFGLAERETLVSVSTG

SEQ ID NO: 202478 - protein, 455 aa, Glycine max
  Coding DNA Sequence Number=SeqID_85700
  Gene Ontology: Mol. function=transferase activity; Cellular component= nucleus; Biological process=paclitaxel biosynthetic process
  Homolog annotation: Hit_ID=Q5H873; Match level="QueryCoverage=99%, HitCoverage=100%, E-value=1e-160, Identity=62%"; Hit description=(-)- 13alpha-hydroxymultiflorine/(+)-13alpha- hydroxylupanine O- tigloyltransferase
  Pfam annotation: Domain name=Transferase; Domain location=10-441; Score=443.6; E_value=2.6e-130; Accession=PF02458.6; Description =Transferase family
MVLQTSSLGFIVRRHPPELVAPANPTPHEVKLLSDIDDQNGLRYQLPLVLFFPYQPSMEGKDPVEVIREALSKTLVFYYPFAGRLREGPDGKLMVDCNGEGVMFIEADADVTIEQFGNNFMPPFPCFDELLYNVPGSDGMIDTPLLLIQVTRLKCGGFIFALRMNHTMCDGSGICQFLKALSEIAHGAPKPSILPGWHREILCAREPPRITCIHQEYQQLPPDSRSIFIPHQRSFFFGPKEIASLRALLPHHLATKSTSFEVITACLWRCRTASLKWQNPNQEVRLLCIVNARFGNCRFNPPLPDGFYGNAFVFPAAVTTVGKLLGRSLGYAVELVKKAKDEADEEYVHSVADLMAIKGRPCFTKLGSFMVSDLTKSGLIDVNLGWGKALYSGVAKGGLGDIPGVSFYVPYTNSKGERGRVIPICLPEDAMERFEKELHDTLMIKNNIPMLMSSL

SEQ ID NO: 202479 - protein, 75 aa, Glycine max
  Coding DNA Sequence Number=SeqID_85701
MWKQEKANDEKEFTFKDGYLLITVFELCVRIDIQRRLLQDSVHLLVQAPPTPSQHLHTTPSVAKIFEYPAITSHI

SEQ ID NO: 202480 - protein, 68 aa, Glycine max
  Coding DNA Sequence Number=SeqID_85702
MSRQEKWRYALCTRFLTPTQPIPPEGMAVPLACPAAATGGTHYPAIGTGGSSFPPVSMVAPMFKYTQP

SEQ ID NO: 202481 - protein, 646 aa, Glycine max
  Coding DNA Sequence Number=SeqID_85703
  Gene Ontology: Mol. function=CTP synthase activity; Cellular component=cellular_component; Biological process=pyrimidine nucleotide biosynthetic process
  Homolog annotation: Hit_ID=UPI0000162F30; Match level="QueryCoverage =99%, HitCoverage=99%, E-value=0.0, Identity=67%"; Hit description =CTP synthase/ catalytic
  Pfam annotation: Domain name=CTP_synth_N; Domain location=1-317; Score=600.2; E_value=1.9e-177; Accession=PF06418.4; Description=CTP synthase N-terminus
  Pfam annotation: Domain name=GATase; Domain location=341-590; Score =247.1; E_value=3.6e-71; Accession=PF00117.18; Description=Glutamine amidotransferase class-I
  Pfam module annotation: Pfam domain module=CTP_synth_N::GATase; Domain location=1-317::341-590
MKYVLVTGGVVSGLGKGVTASSIGLLLKACGLRVTAIKIDPYLNTDAGTMSPFEHGEVFVLDDGGEKPDPSFCSKVDLDLGNYERFIDIKLTRDNNITTGKIYQASCLCLDFRVMTQILKIITKFFTKSVIDKERKGDYLGKTVQVVPHITDAIQDWIERVAHIPVDGMIGPADVCVVELGGTIGDIESMPFIQALGQFSYRVGAGNFCLVHVSLVPVLNVVGEQKTKATQHSVRALRGQGLTPHILACRSTMVLDENAKGKLSQFCLIPAENIVTLYDVPNIWHIPLLLRDQKAHEAMFKVLNLHGVAKEPNLEEWTCRAESSDLLYEPVRIALVGKYTCLSDSYLSILKALLHASVDCQKKLVVDWIPASNLETATAKGNHDAYKAAWKLLKGADGVLVPGGFGDRGVQGKIIAAKYARENRIPFLGICLGMQIAVIEFARSVLGVQDANSTEFEPHTKSPYIIFMPEGSKTHMGGTMRLGSRRTYFQTKECKSAKLYGCKSFIDERHRHRYEVFHCDAQNYLVNVNPDLVACLENAGLSFTGKDETGQRMEILELPNHPYFIGAQFHPEFKSRPGKPSPLFLGFIGAACGQLDAVLQRSSIVDNSLSKGVDISPVKTYRTRTTTKTAYRTAEYVYGSCNGLHF

SEQ ID NO: 202482 - protein, 516 aa, Glycine max
  Coding DNA Sequence Number=SeqID_85704
  Gene Ontology: Mol. function=protein serine/threonine kinase activity; Cellular component=anchored to membrane; Biological process=protein amino acid phosphorylation
  Homolog annotation: Hit_ID=Q9M0X5; Match level="QueryCoverage=93%, HitCoverage=35%, E-value=3e-36, Identity=34%"; Hit description =Receptor protein kinase-like protein
  Pfam annotation: Domain name=DUF26; Domain location=194-248; Score =80.9; E_value=4e-21; Accession=PF01657.8; Description=Domain of unknown function DUF26
  Pfam annotation: Domain name=DUF26; Domain location=321-375; Score =79.9; E_value=7.9e-21; Accession=PF01657.8; Description=Domain of unknown function DUF26
  Pfam annotation: Domain name=DUF26; Domain location=437-491; Score =61.7; E_value=2.3e-15; Accession=PF01657.8; Description=Domain of unknown function DUF26
  Pfam annotation: Domain name=DUF26; Domain location=83-137; Score =71.5; E_value=2.6e-18; Accession=PF01657.8; Description=Domain of unknown function DUF26
  Pfam module annotation: Pfam domain module=DUF26::DUF26::DUF26::DUF26; Domain location=194-248::321-375::437-491::83-137
  Subcellular localization annotation: CTP_CleavageSite=90; ConfidenceScore=5.13e-01
MASFKILFLFILLSFLNFATTEAQDQSSTPVELSHACYVGNSIASSAFQINVRTLLSSLSTNAPGDNGFYNTTVPALNPSDSVFGLFMCRGDVPPQLCQQCVQYATHILRSQCSLSIEPVIWYDECTVRYSNRSFFSTVDTRPALAFTNATNISNQESFMRSMFSVMNITADDAAADDKKFATRQKTISEFQSLYCLAQCTPDLSLLDCRSCLSKVIGDLSWCCEGKQGASVLYPSCNIRYELYPFYRSTNTTIPPAWVPATNFPDQDSQISEDPTYLNHSCPTNVTADSTFQIYLSNLLSYLASNATNGKKYYKDNVETVYGLFMCRGDLPSQLCQQCVLNATHRISSVCNSLQEGIIWYSHCMLRYSNRNFFSEVEESPNFDMLNLTSSSTSIIPGQDYFTFTLSDTIVKLAKDAGDAADKYVTKSLKLTGSQTLYTLVQCTQDLSSEGCRTCLKDINGKIPWFRLGSVGGRVLYPSCNLRFELFPFYRGRGEETPSPMAGNPSTPGLQGKVDK

SEQ ID NO: 202483 - protein, 175 aa, Glycine max
  Coding DNA Sequence Number=SeqID_85705
  Gene Ontology: Mol. function=sequence-specific DNA binding; Cellular component=nucleus; Biological process=regulation of transcription, DNA-dependent
  Homolog annotation: Hit_ID=Q5VKS3; Match level="QueryCoverage=79%, HitCoverage=57%, E-value=1e-49, Identity=70%"; Hit description=MADS -box protein GmNMH7
  Pfam annotation: Domain name=K-box; Domain location=54-151; Score =31.7; E_value=9.4e-07; Accession=PF01486.8; Description=K-box region
  Pfam annotation: Domain name=SRF-TF; Domain location=9-45; Score =33.0; E_value=1.1e-06; Accession=PF00319.9; Description=SRF-type transcription factor (DNA-binding and dimerisation domain)
  Pfam module annotation: Pfam domain module=K-box::SRF-TF; Domain location=54-151::9-45
MARGKIQIKRIENTTKKANELTVLCDAKVSIIMFSSTGKLHKIEQSTKQFFDQYQMTLGVDIWNSHYENMQENLKKLKEVNRNLRKEFRYIYLSSLRSISLRMGDCLNELGMEDLRLLEEGMDKAAKVVRERKLRELVLQDIGTYDLPVEECHYCCRCLVCMMLWNFFHAGPLVT

SEQ ID NO: 202484 - protein, 80 aa, Glycine max
  Coding DNA Sequence Number=SeqID_85706
MVGAFSQNIVTLTGLPMILLSESHLTNLLCARNVITHSLCVVVFGSCDDLELVSGRAENRWMTMKNLMLEDTGTQRSDRM

SEQ ID NO: 202485 - protein, 78 aa, Glycine max
  Coding DNA Sequence Number=SeqID_85707
  Gene Ontology: Mol. function=protein serine/threonine kinase activity; Biological process=protein amino acid phosphorylation
  Homolog annotation: Hit_ID=Q1SDW8; Match level="QueryCoverage=93%, HitCoverage=17%, E-value=7e-23, Identity=68%"; Hit description =Protein kinase
MLTVLQRKARKSLKSILRDNFGDESVTLEPLQFSLAVIEAATNNFSNDNRIGKGGFGEVYKGNLSDGRQIAVKKLKKF

SEQ ID NO: 202486 - protein, 387 aa, Glycine max
  Coding DNA Sequence Number=SeqID_85708
  Gene Ontology: Mol. function=protein serine/threonine kinase activity; Cellular component=anchored to membrane; Biological process=protein amino acid phosphorylation
  Homolog annotation: Hit_ID=O65482; Match level="QueryCoverage=91%, HitCoverage=41%, E-value=3e-27, Identity=30%"; Hit description =Serine/threonine kinase-like protein
  Pfam annotation: Domain name=DUF26; Domain location=113-167; Score =86.3; E_value=9.3e-23; Accession=PF01657.8; Description=Domain of unknown function DUF26
  Pfam annotation: Domain name=DUF26; Domain location=241-295; Score =81.7; E_value=2.2e-21; Accession=PF01657.8; Description=Domain of unknown function DUF26
  Pfam module annotation: Pfam domain module=DUF26::DUF26; Domain location=113-167::241-295
  Subcellular localization annotation: CTP_CleavageSite=90; ConfidenceScore=5.26e-01
MASHKILFLFILLGFLNFATTEPQDQSSTPFYLSHACNVDNSIANSAFQFNVRTLLSSLSSNAPGDNGFYNTTVPSQNPTDSVFGLFMCRDEAAKDDKKFATRQTTISEFQNLYCLAQCTPDLSPLDCRSCLSKVIGNLPLFCEGQQGARVLYPSCNVRYDLYPFYRSTKRTKPPAWVPATNYPDADSQISEDPTYLNHSCPTNVTVDTTFQMYLKTLLFYLSSNATNGKKYYEDNVEQTVYGLFMCRGDLPSQLCQQCVLNATQRISSVCNSVQEGIIWYSHCMLRYSNWNFFSELEESPKTDILSVTIPSTGPIPEQDFFNYTISNTIVKLAEEAGNNTERYATKSLKLTDFQTLYTLAQCTQDLSSDDCQKCLEDINRNIPWFR

SEQ ID NO: 202487 - protein, 117 aa, Glycine max
  Coding DNA Sequence Number=SeqID_85709
MGDCLEDIIGDLGQESFQQAHAPMYDTLQSDSKKPLYPGCNNLLTLLLVVLSLVNVKAKYGWSDKSFSSLESPRRIGLASRLAKPNSTNFQNREGFALSAARRNYSTKQHWLSEQAR

SEQ ID NO: 202488 - protein, 542 aa, Glycine max
  Coding DNA Sequence Number=SeqID_85710
  Gene Ontology: Mol. function=protein serine/threonine kinase activity; Cellular component=anchored to membrane; Biological process=protein amino acid phosphorylation
  Homolog annotation: Hit_ID=Q9M0X5; Match level="QueryCoverage=93%, HitCoverage=54%, E-value=2e-35, Identity=33%"; Hit description =Receptor protein kinase-like protein
  Pfam annotation: Domain name=DUF26; Domain location=192-246; Score =85.8; E_value=1.3e-22; Accession=PF01657.8; Description=Domain of unknown function DUF26
  Pfam annotation: Domain name=DUF26; Domain location=319-373; Score =79.9; E_value=7.9e-21; Accession=PF01657.8; Description=Domain of unknown function DUF26
  Pfam annotation: Domain name=DUF26; Domain location=81-135; Score =87.4; E_value=4.3e-23; Accession=PF01657.8; Description=Domain of unknown function DUF26
  Pfam module annotation: Pfam domain module=DUF26::DUF26::DUF26; Domain location=192-246::319-373::81-135
  Subcellular localization annotation: CTP_CleavageSite=60; ConfidenceScore=5.16e-01
MASYKILFLFLFVSFLNFATTDAQDERSTALFLSLYCYDGNTTANSAFQFNVRSLLSSLSSNAPGDNGFYNTTVPALNPSVFGLFMCRGDVPPQLCQHCVQNATQQLSSLCSLSIEAVIWYDECTVRYSNRSFFSTVDTRPALAFTNATNISNQESFMRSMFSVMNITADEAAKDDKKFATRQTTISEFQSLYCLAQCTPDLSPLDCRSCLSKVIGDLSWCCEGKQGASVLYPSCNVRYELYPFYRSTNTTIPPAWVPATNFPDADSQISEDPTYLNHSCPTNVTAYSTFQIYLSNLLSYLASNATNGKKYYKDNVETVYGLFMCRGDLPSQLCQQCVLNATHRISSVCNSLQEGIIWYSHCMLRYSNRNFFSEVEESPNFDMLNLTSSSTSIIPGQDYFTFTLSDTIVKLAKDAGDATDKIRGRVLYPSCNLRFELFPFYGGRGEETPSPIPGSGEETPSPMAGNPSTPGLQVGPEGVTLEPLQFSLAAIEAATSNFSNDNRIGKGGFGEVYKGILFDGRQIAVKRLSKSSKQGANEFKNE

SEQ ID NO: 202489 - protein, 158 aa, Glycine max
  Coding DNA Sequence Number=SeqID_85711
  Gene Ontology: Mol. function=transferase activity; Biological process= paclitaxel biosynthetic process
  Homolog annotation: Hit_ID=Q5H873; Match level="QueryCoverage=94%, HitCoverage=33%, E-value=1e-59, Identity=74%"; Hit description=(-) -13alpha-hydroxymultiflorine/(+)-13alpha- hydroxylupanine O- tigloyltransferase
MVLQTSSLGFIVRRHPPELVAPANPTPREVKLLSDIDDQNGLRYQLPLVLFFPYQPSMEGKDPVEVIREALSKTLVFYYPFAGRLREGPDGKLMVDCNGEGVMFIEADADVTIEQFGNNFMPPFPCFDELLYNVPGSDGMIDTPLLLIQVILDMHFIH

SEQ ID NO: 202490 - protein, 299 aa, Glycine max
  Coding DNA Sequence Number=SeqID_85712
  Gene Ontology: Mol. function=DNA binding; Cellular component=beta -galactosidase complex; Biological process=DNA integration
  Homolog annotation: Hit_ID=Q1S7S0; Match level="QueryCoverage=77%, HitCoverage=21%, E-value=1e-75, Identity=53%"; Hit description =Integrase, catalytic region; Peptidase aspartic, catalytic
  Subcellular localization annotation: CTP_CleavageSite=43; ConfidenceScore=5.73e-01
MPPPTNNISPLSLTPKFSNPSPSSLSTSSSPPNLPQPINPPPRQSSGPSQPPPYISEYKCDLPPLKLTWDIVHTPPYVCPIGCKWVYKIKRLPNGSVEWYKARLVANGFSQIEGVYYFKTFSPVVKMSTIRVVLALASINCWTPQQLDVNNAFLHGDLSEDVYMVIPPGLHGFSPSQSCKLHKSLYKLKQASRKCVKQILRSNFLIKDLGTLKYFLGIEVTHSDQGISLCQRKYCLDLLKDSGMLGCKPSSTPMDSTLRLHVDSSVLLTDPLPYQRLVGRLIYLTSTRPDIVFATQQLS

SEQ ID NO: 202491 - protein, 517 aa, Glycine max
  Coding DNA Sequence Number=SeqID_85713
  Gene Ontology: Mol. function=protein serine/threonine kinase activity; Cellular component=anchored to membrane; Biological process=protein amino acid phosphorylation
  Homolog annotation: Hit_ID=Q9M0X5; Match level="QueryCoverage=93%, HitCoverage=35%, E-value=8e-46, Identity=38%"; Hit description =Receptor protein kinase-like protein
  Pfam annotation: Domain name=DUF26; Domain location=194-248; Score =89.6; E_value=9.5e-24; Accession=PF01657.8; Description=Domain of unknown function DUF26
  Pfam annotation: Domain name=DUF26; Domain location=322-376; Score =75.5; E_value=1.6e-19; Accession=PF01657.8; Description=Domain of unknown function DUF26
  Pfam annotation: Domain name=DUF26; Domain location=438-492; Score =57.8; E_value=3.7e-14; Accession=PF01657.8; Description=Domain of unknown function DUF26
  Pfam annotation: Domain name=DUF26; Domain location=83-137; Score =80.3; E_value=5.9e-21; Accession=PF01657.8; Description=Domain of unknown function DUF26
  Pfam module annotation: Pfam domain module=DUF26::DUF26::DUF26::DUF26; Domain location=194-248::322-376::438-492::83-137
  Subcellular localization annotation: CTP_CleavageSite=43; ConfidenceScore=5.04e-01
MASYKILFLFILLSFLNFATTEAQDQSSTPLYIYHNCSGGNTTANSAFQINVRTLLSSLSSNAPGDNGFYNTTVPPKNPSDSVFGLFMCRGDVPPQLCQQCVQNATQRLRSMCSLSIQAVIWYDECTVRYSNRSFFSTVDTRPRVGLLNTANISNQESFMRLMFSTINKTADEAAKDDKKFATRQTNISEFQNLYCLAQCTPDLSPLDCRSCLSKVIGDLSWCCEGKQGGRVLYPSCNVRYELYPFYRSTNRTKPPAWVPATNFPDADSQFSEDPTYLNHSCPTDVTVDSTFQMYLKTLLFYLSSNATNGKKSYKDNVENTVYGLFMCRGDLPSQLCQQCVLNATHRISSVCNSVQEGIIWYSHCMIRYSNLYFFSEVEESPNFDMLNLTSSSTSIIPGQDYFTFTLSDTIVKLAQEAGDTTERYVTKSLKLTDLQTLYTLAQCTQDLSSDGCKNCLEDINGKIPWFRLGSVGGRVLYPSCNLRFELFQFYRGSDEETQSPMAGNPSTPGLQGKVDK

SEQ ID NO: 202492 - protein, 96 aa, Glycine max
  Coding DNA Sequence Number=SeqID_85714
  Homolog annotation: Hit_ID=Q1S104; Match level="QueryCoverage=82%, HitCoverage=42%, E-value=1e-20, Identity=58%"; Hit description =Embryo-specific 3
  Pfam annotation: Domain name=ATS3; Domain location=30-95; Score= -24.3; E_value=7.4e-06; Accession=PF06232.2; Description=Embryo -specific protein 3, (ATS3)
  Subcellular localization annotation: CTP_CleavageSite=47; ConfidenceScore=5.11e-01
MIKVVLFLFCFASALTLSVSESKSASVQPHAAESFSVGYIQMKTAANCSYLVVISTSCSSPKFTTDKIGITFGDAYGNQVLHFFLQSISLFIVECI

SEQ ID NO: 202493 - protein, 372 aa, Glycine max
  Coding DNA Sequence Number=SeqID_85715
  Gene Ontology: Mol. function=isomerase activity; Cellular component =intracellular; Biological process=proteolysis
  Homolog annotation: Hit_ID=Q1T2S6; Match level="QueryCoverage=97%, HitCoverage=95%, E-value=2e-51, Identity=38%"; Hit description =Cyclin-like F-box; F-box protein interaction domain
  Pfam annotation: Domain name=F-box; Domain location=7-54; Score=29.2; E_value=1.5e-05; Accession=PF00646.23; Description=F-box domain
  Pfam annotation: Domain name=FBA_1; Domain location=208-366; Score= -42.5; E_value=0.01; Accession=PF07734.3; Description=F-box associated
  Pfam module annotation: Pfam domain module=F-box::FBA_1; Domain location=7-54::208-366
MKHMNATLPHTLPEDLITEILMMLPVRSILRFKYMCKSWFSLISHPEFARSHFALAATPTTRLFLSANYHQVECTDIEASLHDDNSAKVVFNFPLPSPQDKYYNCVIDIVGSYRGFILLLTSGAFDFIIWNPSTGLRKGVSYVMDDHVYNFYVDRCGFGYDSSTDDYVIVNLRIEGWCTEVHCFSLRTNSWSRILGTALYYPHYCGHGVFFNGALHWFVRPCDGRPQAVIISFDVTERGLFEIPLPLNFAVEDEIYVKDEIYNLRVMEGCLCLCVVKMGCGTTIWMMKEYQVQSSWTKLIVLIYNQCHPFLPVFYPICLTKNDEFLGSNHKTLVKLNKKGDLLEYHARCHNMGSTILVRCGVYRESLLSLPE

SEQ ID NO: 202494 - protein, 348 aa, Glycine max
  Coding DNA Sequence Number=SeqID_85716
  Gene Ontology: Mol. function=structural constituent of ribosome; Cellular component=ribonucleoprotein complex; Biological process =translation
  Homolog annotation: Hit_ID=Q8VZT8; Match level="QueryCoverage=70%, HitCoverage=79%, E-value=8e-36, Identity=37%"; Hit description =Putative 30S ribosomal protein S11
  Pfam annotation: Domain name=Ribosomal_S11; Domain location=260-336; Score=-1.8; E_value=1.5e-05; Accession=PF00411.9; Description =Ribosomal protein S11
MAVDLPSHHFSRRNPPFHSTPPYDLAVYLKTTLLICYGVHFAEAVDYAEKLFIRSEINQGFQKQPVTFWGLRDRNCGRILISTMFIRGLVQFSETAGHVRGFSSSNFDWRNLIVNENVNADDSMQDAENRNSEKWNNMRLNMNADAKAPPNFVQNRGNINSRSWNNMRQNLNAPPNFMGNRENINSRSQNNLGQNVDANADALPDFMQDKENINIGSKNDAETGWNSRPMDFVRGIIDEDNFMKGSPFHQYQYEQDADFVHIKMLRNNTFVTVTDSQGNIKLSGSAGPLKDLKSGQKLSRYAAEATAEVVGRKARGLGLKSVVMKVNGFTHFRRKRNAIMSWKEGFTA

SEQ ID NO: 202495 - protein, 485 aa, Glycine max
  Coding DNA Sequence Number=SeqID_85717
  Gene Ontology: Mol. function=metal ion binding; Cellular component =intracellular; Biological process=protein kinase C activation
  Homolog annotation: Hit_ID=Q2QWV0; Match level="QueryCoverage=98%, HitCoverage=82%, E-value=1e-145, Identity=55%"; Hit description =Pentatricopeptide, putative, expressed
  Pfam annotation: Domain name=PPR; Domain location=109-143; Score=0.2; E_value=7.1; Accession=PF01535.11; Description=PPR repeat
  Pfam annotation: Domain name=PPR; Domain location=175-209; Score =51.6; E_value=2.7e-12; Accession=PF01535.11; Description=PPR repeat
  Pfam annotation: Domain name=PPR; Domain location=210-244; Score =13.0; E_value=0.21; Accession=PF01535.11; Description=PPR repeat
  Pfam annotation: Domain name=PPR; Domain location=276-310; Score =52.1; E_value=1.9e-12; Accession=PF01535.11; Description=PPR repeat
  Pfam annotation: Domain name=PPR; Domain location=311-345; Score =17.6; E_value=0.046; Accession=PF01535.11; Description=PPR repeat
  Pfam annotation: Domain name=PPR; Domain location=347-381; Score=7.7; E_value=0.93; Accession=PF01535.11; Description=PPR repeat
  Pfam annotation: Domain name=PPR; Domain location=414-448; Score =10.0; E_value=0.49; Accession=PF01535.11; Description=PPR repeat
  Pfam annotation: Domain name=PPR; Domain location=74-108; Score=20.6; E_value=0.0058; Accession=PF01535.11; Description=PPR repeat
  Pfam module annotation: Pfam domain module=PPR::PPR::PPR::PPR::PPR::PP R::PPR::PPR; Domain location=109-143::175-209::210-244::276-310::311 -345::347-381::414-448::74-108
MEGKERRRKSAEYEAVVSAGPHLRRLQQAHAHLVVTGCHRSRALLTKLLTLSCAAGSIAYTRRLFRSVSDPDSFLFNSLIKASSNFGFSLDAVFFYRRMLHSRIVPSTYTFTSVIKACADLSLLRLGTIVHSHVFVSGYASNSFVQAALVTFYAKSCTPRVARKVFDEMPQRSIIAWNSMISGYEQNGLASEAVEVFNKMRESGGEPDSATFVSVLSACSQLGSLDLGCWLHECIVGTGIRMNVVLATSLVNMFSRCGDVGRARAVFDSMNEGNVVSWTAMISGYGMHGYGVEAMEVFHRMKACGVVPNRVTYVAVLSACAHAGLINEGRLVFASMKQEYGVVPGVEHHVCMVDMFGRGGLLNEAYQFVRGLSSEELVPAVWTAMLGACKMHKNFDLGVEVAENLISAEPENPGHYVLLSNMYALAGRMDRVESVRNVMIQRGLKKQVGYSTIDVENRSYLFSMGDKSHPETNEIYCYLDELMWR

SEQ ID NO: 202496 - protein, 437 aa, Glycine max
  Coding DNA Sequence Number=SeqID_85718
  Gene Ontology: Mol. function=small conjugating protein ligase activity; Cellular component=integral to membrane; Biological process=protein modification process
  Homolog annotation: Hit_ID=Q8VY10; Match level="QueryCoverage=98%, HitCoverage=47%, E-value=1e-114, Identity=51%"; Hit description =Putative E2, ubiquitin-conjugating enzyme
  Pfam annotation: Domain name=UQ_con; Domain location=201-343; Score =125.9; E_value=1.2e-34; Accession=PF00179.16; Description=Ubiquitin -conjugating enzyme
MVAPYEIFRIEKHEGSTVTPTPYETNVEELTHEMIEHRSLPSSDKKGKDLLNGDGTRKNCEKNLGECSSFSLPRAAFELFSSIKASIFQTFSGTLLSGAVSSVPTFEKENGYAYPDKKDSETCDLFTEQHPMTELQYTEDKTSYPENIKIHEKNDFPFSLDSNSSNQFKQFDVKENCPDHHFFVQGKGLSISQVKRSWVKKVQQEWSILEKNLPERMDLMRAAIVGASGTPYHEGLFFFDICFPPEYPNKPPMVHYNSGGLRLNPNLYESGKICLSLLNTWTGTGTEVWNPGASTILQVLLSLQALVLNEKPYFNEAGYDQQIGRAEGEKNSVSYNENALLVTTKSMMYLLRKPPKHFEELVEEHFRKRYQHILLACKAYLEGASIGCAFDSEKNEHENQKGTSTGFKIMLAKLFPKLVEAFSDKGIDCSQFVDLQK

SEQ ID NO: 202497 - protein, 231 aa, Glycine max
  Coding DNA Sequence Number=SeqID_85719
  Gene Ontology: Mol. function=structural constituent of ribosome; Cellular component=intracellular; Biological process=translation
  Homolog annotation: Hit_ID=Q6I600; Match level="QueryCoverage=53%, HitCoverage=46%, E-value=4e-34, Identity=64%"; Hit description =Putative ribosomal protein L21
  Pfam annotation: Domain name=Ribosomal_L21p; Domain location=122-195; Score=49.6; E_value=1e-11; Accession=PF00829.11; Description =Ribosomal prokaryotic L21 protein
  Subcellular localization annotation: CTP_CleavageSite=50; ConfidenceScore=5.51e-01
MASRRCLRALTQTRPFLFRKASSLRSLAVLSISQLQRFSTRFHRTRLCFCAMPAPPFDEEDDSDEDYDEEEDYVDDDDVTVSRGKKVYTAEEKEAEAAAIGYRVVGPLQKEEDSVFKPYEPVFAVVQIGSHQFKVSNRDSIFTERLKFCEVNDKLILNKVLLLGSASQTIVGRPIVPDAAVHAVVEEHKNGNAKLDSNGGYDSTKRQRARHSLKTKAEKRSLRQEKNKTNL

SEQ ID NO: 202498 - protein, 449 aa, Glycine max
  Coding DNA Sequence Number=SeqID_85720
  Homolog annotation: Hit_ID=Q5XWK4; Match level="QueryCoverage=78%, HitCoverage=91%, E-value=2e-55, Identity=38%"; Hit description =Expressed protein-like
  Pfam annotation: Domain name=DUF616; Domain location=71-381; Score =547.9; E_value=1.1e-161; Accession=PF04765.4; Description=Protein of unknown function (DUF616)
MGLTKRLVLLPPPTGYFLGYHLPPGHPCNSFTLPPPPADKKRTGPRLCYLPVEEAIGLMPALPSPSPVLGNLTYVYEENLSRDGEFGGSDFGGYPTLKQRNDSFDIRESMTVHCGFVRGIKPGRNTGFDIDGADLFEMEQCDGVVVASAIFDEQTEKYLISSGKLGISKKIGLWRTIVARNLPYPDARRTGKIPKLLLHRLVPNARYSIWLDGKLELVVDPYQILERYFFKLISLTLELIEGWHKWSFQFLWRKNATFAISKHYRRFDVFIEAEANKAAGKYDNASIDFQIEFYKKEGLTPYTEAKLPLISDVPEGCVIVREHVPISNLFACLWFNEVDRFTSRDQISFSTVRDKILSRVDFHFNMFLDCERRNFVVQKYHRDLLLRLAPPASPPPPSPPPPLPVLETSPEKGANSPIRRGPGRRGKDRRAGSRRHRKVVAGGREMEPS

SEQ ID NO: 202499 - protein, 162 aa, Glycine max
  Coding DNA Sequence Number=SeqID_85721
  Gene Ontology: Mol. function=DNA binding; Cellular component =mitochondrion; Biological process=DNA integration
  Homolog annotation: Hit_ID=Q1S9T4; Match level="QueryCoverage=99%, HitCoverage=14%, E-value=7e-80, Identity=78%"; Hit description =Integrase, catalytic region
MNALKRIIRYIKGTITHGLHLSPSSADKLTTYTDADWGGCPDTRRSTSGYCVYLGDNLVSWSAKRQPTLSRSSAEAEYRGVANVVSESCWLRNLLLELQCPIAKATLVYCDNVARGQIRVLHVPSRYQIADIFTKGLPLQLFSDFRDSLNIRPPPVSTTGVY

SEQ ID NO: 202500 - protein, 90 aa, Glycine max
  Coding DNA Sequence Number=SeqID_85722
MSAPLGIGIRSGSYGSLDKQVQNGTARKASKMLKEKEKERLFLWICKFAGRKKVGMLFLCLISAAHQPELGLAEGTSFRNVANQGLNNAG

SEQ ID NO: 202501 - protein, 61 aa, Glycine max
  Coding DNA Sequence Number=SeqID_85723
MYVAPNNDRSLGRSFDSDHEETPSPPLFTDPSQTSSSPFHIHPSESPTLVIVSPPLTGNNY

SEQ ID NO: 202502 - protein, 686 aa, Glycine max
  Coding DNA Sequence Number=SeqID_85724
  Gene Ontology: Mol. function=binding; Cellular component=thylakoid; Biological process=photosynthesis
  Homolog annotation: Hit_ID=Q8GZN1; Match level="QueryCoverage=96%, HitCoverage=98%, E-value=0.0, Identity=66%"; Hit description=Pollen -specific calmodulin-binding protein
  Pfam annotation: Domain name=TPR_1; Domain location=137-170; Score =7.1; E_value=0.76; Accession=PF00515.18; Description=Tetratricopeptid e repeat
  Pfam annotation: Domain name=TPR_1; Domain location=321-354; Score =2.5; E_value=2.7; Accession=PF00515.18; Description=Tetratricopeptide repeat
  Pfam annotation: Domain name=TPR_1; Domain location=647-680; Score =17.7; E_value=0.042; Accession=PF00515.18; Description =Tetratricopeptide repeat
  Pfam annotation: Domain name=TPR_2; Domain location=137-170; Score =12.4; E_value=1.2; Accession=PF07719.7; Description=Tetratricopeptide repeat
  Pfam annotation: Domain name=TPR_2; Domain location=321-354; Score =1.4; E_value=23; Accession=PF07719.7; Description=Tetratricopeptide repeat
  Pfam annotation: Domain name=TPR_2; Domain location=442-475; Score =1.6; E_value=21; Accession=PF07719.7; Description=Tetratricopeptide repeat
  Pfam annotation: Domain name=TPR_2; Domain location=477-510; Score =12.1; E_value=1.3; Accession=PF07719.7; Description=Tetratricopeptide repeat
  Pfam annotation: Domain name=TPR_2; Domain location=647-680; Score =21.3; E_value=0.0034; Accession=PF07719.7; Description =Tetratricopeptide repeat
  Pfam module annotation: Pfam domain module=TPR_1::TPR_1::TPR_1::TPR _2::TPR_2::TPR_2::TPR_2::TPR_2; Domain location=137-170::321-354::647- 680::137-170::321-354::442-475::477-510::647-680
MALINWLSMEKALSKETKSTSSGKNERVTIREFCANGSCMEAKELEAKLDEGNIQEAESALREGLSLNFEEARALLGKLEYQRGNVEGALRVFDGIDLEAAIQRLQSSLSEKTPVKKGPTRSESPSSVSQHAATLVLEAIYLKAKSLQKLDKFTEAAKECKRVLDAVEKIFGQGIPDTQVDNKLQEIVSHAVELLPELWKQTGCYNEALSAYRNALLSQWNLDNDCCARIQMAFAVFMLYSGVEASPPSLAVQIDGSYVPKNNLEEAILLLMILLRKFSLGKINWDPSIMEHLTFALSACGQTSILAKQFEELAPGVYHRIDRWNFLALCNSGAGENESALNLLRMSLHKHERPDDLISLLLAAKICSEDPHHAAEGAGYAQRAINIAQGLDGHLKGVGLRMLGLCLGKQAKVSSSDFERSMLQSKALQSLEEAVRLEQNNYDLIFELAIQYAEHRNLTAALSCAKQFFDKTGGSKLKGWRLLALVLSAQKRFSEAEVVTDAALDETAKWEQGPLLRLKAKLKISQLRPMDAIEIYRYLLALVQAQRKSSGPLKLSSQDHGFNPLPAKLLPKGIWSALMDVIIGIMFDGRGEYQEALIGTFNAVLFEPNYVPSKILMASLILKMGFKASPVARSLLSDALRIEPTNRMAWYYLGLTHKADGRLVDAADCFQAASMLEESDPIENFS

SEQ ID NO: 202503 - protein, 1330 aa, Glycine max
  Coding DNA Sequence Number=SeqID_85725
  Gene Ontology: Mol. function=microtubule motor activity; Cellular component=microtubule associated complex; Biological process =microtubule-based movement
  Homolog annotation: Hit_ID=Q8S8J6; Match level="QueryCoverage=99%, HitCoverage=95%, E-value=1e-129, Identity=29%"; Hit description =Putative myosin heavy chain
  Pfam annotation: Domain name=KID; Domain location=1077-1087; Score =0.6; E_value=3.5e+02; Accession=PF02524.5; Description=KID repeat
  Pfam annotation: Domain name=KID; Domain location=1179-1189; Score =4.2; E_value=62; Accession=PF02524.5; Description=KID repeat
  Pfam annotation: Domain name=KID; Domain location=236-246; Score=1.5; E_value=2.3e+02; Accession=PF02524.5; Description=KID repeat
  Pfam annotation: Domain name=KID; Domain location=502-512; Score=2.8; E_value=1.2e+02; Accession=PF02524.5; Description=KID repeat
  Pfam annotation: Domain name=KID; Domain location=530-540; Score=4.5; E_value=54; Accession=PF02524.5; Description=KID repeat
  Pfam annotation: Domain name=KID; Domain location=58-68; Score=4.7; E_ value=49; Accession=PF02524.5; Description=KID repeat
  Pfam annotation: Domain name=KID; Domain location=712-722; Score=3.2; E_value=1e+02; Accession=PF02524.5; Description=KID repeat
  Pfam annotation: Domain name=KID; Domain location=863-873; Score=6.6; E_value=20; Accession=PF02524.5; Description=KID repeat
  Pfam annotation: Domain name=M; Domain location=1069-1089; Score=1.8; E_value=73; Accession=PF02370.7; Description=M protein repeat
  Pfam annotation: Domain name=M; Domain location=235-255; Score=3.9; E_ value=39; Accession=PF02370.7; Description=M protein repeat
  Pfam annotation: Domain name=M; Domain location=361-381; Score=9.7; E_ value=6.6; Accession=PF02370.7; Description=M protein repeat
  Pfam annotation: Domain name=M; Domain location=445-465; Score=0.6; E_ value=1.1e+02; Accession=PF02370.7; Description=M protein repeat
  Pfam annotation: Domain name=M; Domain location=522-542; Score=0.8; E_ value=1e+02; Accession=PF02370.7; Description=M protein repeat
  Pfam annotation: Domain name=M; Domain location=57-77; Score=13.2; E _value=0.94; Accession=PF02370.7; Description=M protein repeat
  Pfam annotation: Domain name=M; Domain location=606-626; Score=4.6; E_ value=32; Accession=PF02370.7; Description=M protein repeat
  Pfam annotation: Domain name=M; Domain location=662-682; Score=10.5; E_value=5.2; Accession=PF02370.7; Description=M protein repeat
  Pfam annotation: Domain name=M; Domain location=792-812; Score=6.9; E_ value=16; Accession=PF02370.7; Description=M protein repeat
  Pfam annotation: Domain name=M; Domain location=925-945; Score=0.7; E_ value=1e+02; Accession=PF02370.7; Description=M protein repeat
  Pfam annotation: Domain name=Pox_A_type_inc; Domain location=1002 -1024; Score=3.1; E_value=28; Accession=PF04508.3; Description=Viral A-type inclusion protein repeat
  Pfam annotation: Domain name=Pox_A_type_inc; Domain location=1108 -1133; Score=0.8; E_value=63; Accession=PF04508.3; Description=Viral A-type inclusion protein repeat
  Pfam annotation: Domain name=Pox_A_type_inc; Domain location=1216 -1238; Score=9.0; E_value=3.9; Accession=PF04508.3; Description=Viral A-type inclusion protein repeat
  Pfam annotation: Domain name=Pox_A_type_inc; Domain location=494-516; Score=12.7; E_value=1.1; Accession=PF04508.3; Description=Viral A -type inclusion protein repeat
  Pfam annotation: Domain name=Pox_A_type_inc; Domain location=50-72; Score=7.6; E_value=6.2; Accession=PF04508.3; Description=Viral A -type inclusion protein repeat
  Pfam annotation: Domain name=Pox_A_type_inc; Domain location=601-621; Score=5.3; E_value=14; Accession=PF04508.3; Description=Viral A-type inclusion protein repeat
  Pfam annotation: Domain name=Pox_A_type_inc; Domain location=665-687; Score=8.6; E_value=4.5; Accession=PF04508.3; Description=Viral A-type inclusion protein repeat
  Pfam annotation: Domain name=Pox_A_type_inc; Domain location=785-807; Score=8.9; E_value=4.1; Accession=PF04508.3; Description=Viral A-type inclusion protein repeat
  Pfam annotation: Domain name=Pox_A_type_inc; Domain location=856-877; Score=4.1; E_value=21; Accession=PF04508.3; Description=Viral A-type inclusion protein repeat
  Pfam annotation: Domain name=PspA_IM30; Domain location=498-694; Score=-43.7; E_value=0.0063; Accession=PF04012.3; Description =PspAIM30 family
  Pfam annotation: Domain name=Spectrin; Domain location=606-700; Score= -0.3; E_value=0.044; Accession=PF00435.11; Description=Spectrin repeat
  Pfam annotation: Domain name=Tropomyosin; Domain location=378-621; Score=-96.9; E_value=0.0038; Accession=PF00261.10; Description =Tropomyosin
  Pfam module annotation: Pfam domain module=KID::KID::KID::KID::KID::KI D::KID::KID::M::M::M::M::M::M::M::M::M::M::Pox_A_type_inc::Pox_A_type_ inc::Pox_A_type_inc::Pox_A_type_inc::Pox_A_type_inc::Pox_A_type _inc::...
  Pfam module annotation: Pfam domain module=Pox_A_type_inc::Pox_A_type_ inc::Pox_A_type_inc::PspA_IM30::Spectrin::Tropomyosin; Domain location=1077-1087::1179-1189::236-246::502-512::530-540::58-68::712- 722::863-873::...
  Pfam module annotation: Domain location=1069-1089::235-255::361 -381::445-465::522-542::57-77::606-626::662-682::792-812::925 -945::1002-1024::1108-1133::1216-1238::494-516::50-72::601-621::665 -687::785-807::856-877::498-694::606-700::378-621
MGTNGDLASEVKKEEEENAFDGEFIKVEKEENVIDDKSHKTERSSDSPSREFLEAQEKIQELEVELQRLTESLKTSEHENDQLKGEISVTKEKLEESGKKYEELDLSHKKLQEQILEAENRYNQQLGTLEEALQSQEVKQKELFQVKEAFDGMNLELENSRKRMQELQDELQLSADEARKFEELHKQSGSHAESEGKKALEFERLLEEAKLTAKGMEDEMSSLKEELKGVYDKIAENQKVEEALKTTTAELSTIQEELTLSKSQLLEVEKRLSSRDSLVDELTQELNLIKTSETQVKEDMLALQNLLASTKEEMQEKISELEIARSKLQEEEKLRESIEAALKSQEAQFVTVQEELTKFKTEKETLEATVEDLTGSLKKFEELCADLEEKLKLSDENFLKTDSLLSQALSNSAELEQKVKSLEDLHNESGAAAATATQRSLELEGHIQTSTAAAEEAKSQLRELETRFIAAEQRNVELEQQLNLVQLKTSDAEREVAELSEKISNLNAKLEEAEEEKNLLNCQVQEYTEKVAQLESELNQSSLRSSQLEEELKTINGKCAEHEDRASMNHQRSRELEDLIQGSHSKLEDTDKKVSELELLLEAEKYRIQELEQQISTLDEKRNASEAQANKYLDDVSNLTSELEAIQARASTLETTLQAANERGKELEDSLNDVTEEKKKLEDAANSLNEKLAEKENLLEILRDDLNLTQDKLQSTESELRAAELRESEIIEKLKSSEENLVVRGRDIEETATRHSELQLLHESLTRDSEQKLQEAIEKFNNKDSEVQSLLEKIKILEEQIAKAGEQSTSLKNEFEESLSKLTSLESENEDLKRQILDAESKSSQSFSENELLVGTNIQLKTKIDELEESLNHALSEKEAAAQELVSHKNSITELNDLQSKSSEIQRANEARTLEVESQLQEALQRHTEKESETIELNEKLSTLDNQIKLFEEQAREAVATSGTHKAELEESLVKLKHLETVIEDLQNKSLHLEKETTGLNEENSKLNQGIASYESKLSDLQEKLSAALVEKEETVKELLTLKDVIKELGTAHSAEVQTLNSQISSVGDEKNMLNETNQNLKKELQSLIFDLEEKLKEQQKIEGSLRSEVETLKVEVAEKSTLQSQLEEIEGKLAQAESRLNEEVGSVQAAASQREADLSSKLEDYAQKFNDRNVLNDKVAELEKELQLARDAIANQKGAESQKLELEAALKNSLEELETKKNDISLLQKQVTDLEQKLQVAGDKSSVKGDEGVDQKEGLEVKSRDIGSSLSIPSKRKSKKKSEVTSAQTSSSSETHVQTGHDSPIINFKFILGVALVSIVFGIILGKRY

SEQ ID NO: 202504 - protein, 380 aa, Glycine max
  Coding DNA Sequence Number=SeqID_85726
  Gene Ontology: Mol. function=transcription factor activity; Cellular component=nucleus; Biological process=regulation of transcription
  Homolog annotation: Hit_ID=Q9FHZ1; Match level="QueryCoverage=79%, HitCoverage=74%, E-value=1e-112, Identity=69%"; Hit description =SCARECROW gene regulator-like protein
  Pfam annotation: Domain name=GRAS; Domain location=45-342; Score =397.1; E_value=2.5e-116; Accession=PF03514.5; Description=GRAS family transcription factor
MLQSLVPRSPRTSNPNAMKTKRAVDAGGDSPADEPSFKRTNFSGEKTTAEAEEEQAFDPEPHGGDSTGLKLLGLLLQCAECVAMDNLDFANDLLPEIAELSSPYGTSPERVGAYFAQALQARVVSSCIGSYSPLTAKSVTLTQSQKIFNAFQSYNSVSPLVKFSHFTANQAIFQALDGEDRVHIIDLDIMQGLQWPGLFHILASRSKKIRSVRITGFGSSSELLDSTGRRLADFASSLGLPFEFFPVEGKIGSVTELSQLGVRPNEAIVVHWMHHCLYDITGSDLGTLRLLTQLRPKLITTVEQDLSHAGSFLARFVEALHYYSALFDALGDGLGADSLERHTVEQHLLGCEIRNIVAVGGPKRTGEVKLERWGDELKRA

SEQ ID NO: 202505 - protein, 363 aa, Glycine max
  Coding DNA Sequence Number=SeqID_85727
  Gene Ontology: Mol. function=calpain activity; Cellular component =intracellular; Biological process=proteolysis
  Homolog annotation: Hit_ID=Q1T2S5; Match level="QueryCoverage=96%, HitCoverage=95%, E-value=1e-53, Identity=42%"; Hit description =Cyclin-like F-box; F-box protein interaction domain; Galactose oxidase, central
  Pfam annotation: Domain name=F-box; Domain location=4-51; Score=31.4; E_value=3.1e-06; Accession=PF00646.23; Description=F-box domain
  Pfam annotation: Domain name=FBA_1; Domain location=205-357; Score= -45.5; E_value=0.018; Accession=PF07734.3; Description=F-box associated
  Pfam module annotation: Pfam domain module=F-box::FBA_1; Domain location=4-51::205-357
MNATLPHTLPEDLITEILMMLPVRSILRFKCMCKLWFSLISDPEFARSHFALAATPTTRLFLSTNGYQVECTDIEASLHDDNSAKVVFNFPLPSPENEYYNCAINIVGSCRGFILLLTSGALDFIIWNPSTGLRKGIRYVMDDHVYNFYADRCGFGYDSSTDDYVIVNLTIEGWRTEVHCFSLRTNSWSRILGTAIYFPLDCGNGVFFNGALHWFGRLWDGHRQAVITSFDVTERGLFEIPLPPDFAVENQIYDLRVMEGCLCLCVAKMGCGTTIWMMKEYKVQSSWTKLIVPIYNQCHPFLPVFYPICSTKKDEFLGSNHKTLVKLNKKGDLLEHQARWHYMDCTILVHCGVYRESLLSLPE

SEQ ID NO: 202506 - protein, 336 aa, Glycine max
  Coding DNA Sequence Number=SeqID_85728
  Homolog annotation: Hit_ID=Q1T2S5; Match level="QueryCoverage=94%, HitCoverage=85%, E-value=8e-38, Identity=38%"; Hit description =Cyclin-like F-box; F-box protein interaction domain; Galactose oxidase, central
  Pfam annotation: Domain name=FBA_1; Domain location=178-330; Score= -31.1; E_value=0.0011; Accession=PF07734.3; Description=F-box associated
MENIAIRFGDVHGNQEFARSHFALAATPTTRLYLSANDHQVECTDIEASLHDDNSAKVVFNYPLPSPEDKYYNRAIDIVGSCRGFILLMITSGALDFIIWNPSTGLRKGISYVMDDHAYNFCDDRCGFGYDSSTDDYVIVKLKIDGWCTEVHCFSLRTNSWSRILGTALYYPVDLGHGAFFNGALHWFVRRCNGRRQAVIISFDVTERGLFEIPLPPDFAVKDQICDLRVMEGCLCLCGANIGRETTIWMMKEYKVQSSWTRLIVPIHNQCHPFLRVFYPICLTKKDEFLGSNHKTLVKLNKKGDLLEHHARCHNLGCGILLRGGVYRESLLSLPE

SEQ ID NO: 202507 - protein, 420 aa, Glycine max
  Coding DNA Sequence Number=SeqID_85729
  Gene Ontology: Mol. function=solute:hydrogen antiporter activity; Cellular component=integral to membrane; Biological process =regulation of pH
  Homolog annotation: Hit_ID=Q9FLI8; Match level="QueryCoverage=85%, HitCoverage=59%, E-value=1e-136, Identity=71%"; Hit description =Potassium/proton antiporter-like protein
  Pfam annotation: Domain name=Na_H_Exchanger; Domain location=162-420; Score=52.6; E_value=1.4e-12; Accession=PF00999.11; Description =Sodiumhydrogen exchanger family
GEGGVYHALTTCEKILARTSLVCQLWSVSMGFWDQPGYLGVMLGQPARTLQLGVLDLELLMEGAVLETVAKITHDKAKRNETHEGKYGYTHMFPDVVSQLHLIMDYWIATRAFQFQDVFSLENEDSDDVTTLIDKKDNVFVMSNKKSKYPVLQVDLRLISDLVVVIVSAAIGGIVFSCLGQPVIVGYLLAGSLIGPGGLKFISEMVQVETVAQFGVVFLLFALGLEFSLAKLKAVGPVAVLGGLLQIIIFMFMCGILSMLFGAKLSEGVFVGSFLSMSSTAVVVKFLVERNSNNALHVQVTIGTLIFQDCAVGLLFALLPVLGGNSGLLQGLMSMGKLLLVLSLYITATSVLSWTFVPRFLKLMMRLSSQTNELYQLAAVAFCLLSAWCSDKLGLSLELGSFMAGVMISTTDFAQHTLDQ

SEQ ID NO: 202508 - protein, 108 aa, Glycine max
  Coding DNA Sequence Number=SeqID_85730
MGMNQLQELWESRRERENTYGRGREDESMMKEHFAYSSGGRMLSSKVCLIGVSSNYDLVHLHDDYDITSYQVSNIHTGDVVASDVVVFPDAELVKKVDMPMEEMPDLA

SEQ ID NO: 202509 - protein, 959 aa, Glycine max
  Coding DNA Sequence Number=SeqID_85731
  Gene Ontology: Mol. function=protein serine/threonine kinase activity; Cellular component=integral to membrane; Biological process=protein amino acid phosphorylation
  Homolog annotation: Hit_ID=Q6XAT2; Match level="QueryCoverage=99%, HitCoverage=96%, E-value=0.0, Identity=68%"; Hit description=ERECTA -like kinase 2
  Pfam annotation: Domain name=LRRNT_2; Domain location=4-41; Score =30.5; E_value=6e-06; Accession=PF08263.3; Description=Leucine rich repeat N-terminal domain
  Pfam annotation: Domain name=LRR_1; Domain location=118-137; Score =10.8; E_value=2.7; Accession=PF00560.23; Description=Leucine Rich Repeat
  Pfam annotation: Domain name=LRR_1; Domain location=142-161; Score =14.9; E_value=0.3; Accession=PF00560.23; Description=Leucine Rich Repeat
  Pfam annotation: Domain name=LRR_1; Domain location=166-188; Score =8.7; E_value=6.7; Accession=PF00560.23; Description=Leucine Rich Repeat
  Pfam annotation: Domain name=LRR_1; Domain location=212-234; Score =12.9; E_value=1.1; Accession=PF00560.23; Description=Leucine Rich Repeat
  Pfam annotation: Domain name=LRR_1; Domain location=235-256; Score =10.6; E_value=3; Accession=PF00560.23; Description=Leucine Rich Repeat
  Pfam annotation: Domain name=LRR_1; Domain location=259-281; Score =14.5; E_value=0.4; Accession=PF00560.23; Description=Leucine Rich Repeat
  Pfam annotation: Domain name=LRR_1; Domain location=283-305; Score =8.1; E_value=8.8; Accession=PF00560.23; Description=Leucine Rich Repeat
  Pfam annotation: Domain name=LRR_1; Domain location=307-329; Score =15.1; E_value=0.25; Accession=PF00560.23; Description=Leucine Rich Repeat
  Pfam annotation: Domain name=LRR_1; Domain location=368-390; Score =10.0; E_value=3.9; Accession=PF00560.23; Description=Leucine Rich Repeat
  Pfam annotation: Domain name=LRR_1; Domain location=392-414; Score =15.7; E_value=0.17; Accession=PF00560.23; Description=Leucine Rich Repeat
  Pfam annotation: Domain name=LRR_1; Domain location=416-438; Score =18.7; E_value=0.021; Accession=PF00560.23; Description=Leucine Rich Repeat
  Pfam annotation: Domain name=LRR_1; Domain location=440-462; Score =9.0; E_value=6; Accession=PF00560.23; Description=Leucine Rich Repeat
  Pfam annotation: Domain name=LRR_1; Domain location=46-68; Score=3.5; E_value=62; Accession=PF00560.23; Description=Leucine Rich Repeat
  Pfam annotation: Domain name=LRR_1; Domain location=464-486; Score =11.9; E_value=1.7; Accession=PF00560.23; Description=Leucine Rich Repeat
  Pfam annotation: Domain name=LRR_1; Domain location=488-509; Score =12.1; E_value=1.6; Accession=PF00560.23; Description=Leucine Rich Repeat
  Pfam annotation: Domain name=LRR_1; Domain location=70-92; Score =18.5; E_value=0.023; Accession=PF00560.23; Description=Leucine Rich Repeat
  Pfam annotation: Domain name=LRR_1; Domain location=94-116; Score =16.2; E_value=0.12; Accession=PF00560.23; Description=Leucine Rich Repeat
  Pfam annotation: Domain name=Pkinase; Domain location=627-893; Score =133.9; E_value=4.5e-37; Accession=PF00069.15; Description=Protein kinase domain
  Pfam annotation: Domain name=Pkinase_Tyr; Domain location=627-893; Score=93.6; E_value=6e-25; Accession=PF07714.7; Description=Protein tyrosine kinase
  Pfam module annotation: Pfam domain module=LRRNT_2::LRR_1::LRR_1::LRR_ 1::LRR_1::LRR_1::LRR_1::LRR_1::LRR_1::LRR_1::LRR_1::LRR_1::LRR_1::LRR_ 1::LRR_1::LRR_1::LRR_1::LRR_1::Pkinase::Pkinase_Tyr; Domain location =4-41::...
  Pfam module annotation: Domain location=118-137::142-161::166 -188::212-234::235-256::259-281::283-305::307-329::368-390::392 -414::416-438::440-462::46-68::464-486::488-509::70-92::94-116::627 -893::627-893
MYIGQALMKIKSSFSNVADVLHDWDALHNDDFCSWRGVLCDNVSLSVLFLNLSSLNLGGEISPAIGDLVNLQSIDLQGNKLTGQIPDEIGNCAELIYLDLSDNQLYGDIPFSISNLKQLVFLNLKSNQLTGPIPSTLTQISNLKTLDLARNRLTGEIPRLLYWNEVLQYLGLRGNMLSGTLSSDICQLTGLCDVRGNNLTGTIPDSIGNCTNFAILDLSYNQISGEIPYNIGFLQVATLSLQGNRLTGKIPEVIGLMQALAILDLSDNELIGPIPPILGNLSYTGKLYLHGNMLTGPIPPELGNMSRLSYLQLNDNQLVGQIPDELGKLVHLFEFVSGVNLLQLLSSRNLANNHLEGSIPLNISSCTALNKLNLSANNFKGSIPVELGHIINLDTLDLSSNNFSGHVPGSVGYLEHLLTLNLSHNSLQGPLPAEFGNLRSIQIIDMSFNYLLGSVPPEIGQLQNLVSLILNNNDLRGKIPDQLTNCLSLNFLNVSYNNLSGVIPLMKNFSRFSADSFIGNPLLCGNWLGSICDLYMPKSRGVFSRAAIVCLIVGTITLLAMVTIAIYRSSQSTQLIKGSSGTGQGMLNIRTAYVYCLVLLWPPKLVILHMGLAIHTFDDIMRVTDNLNEKYIVGYGASSTVYKCVLKNSRPIAIKRLYNQHPHSSREFETELETIGSIRHRNLVTLHGYALTPNGNLLFYDYMENGSLWDLLHGPSKKVKLDWEARMRIAVGTAEGLAYLHHDCNPRIIHRDIKSSNILLDENFEARLSDFGIAKCLSTARTHASTFVLGTIGYIDPEYARTSRLNEKSDVYSFGIVLLELLTGKKAVDNDSNLHHLILSKADNNTIMETVDPEVSITCMDLTHVKKTFQLALLCTKKNPSERPTMHEVARVLASLLPAPPSKNIFVPSSKTIDYAQFVIQKGKQNNLHPLQMDRLQPQQFSNDQWFVRFEDVVSNNSL

SEQ ID NO: 202510 - protein, 191 aa, Glycine max
  Coding DNA Sequence Number=SeqID_85732
  Gene Ontology: Mol. function=zinc ion binding
  Homolog annotation: Hit_ID=Q1S950; Match level="QueryCoverage=99%, HitCoverage=69%, E-value=2e-57, Identity=62%"; Hit description=Zinc finger, RING-type; RINGv
  Subcellular localization annotation: CTP_CleavageSite=52; ConfidenceScore=5.74e-01
MNSREYSIVTFSSNSATRDTPSSFLVRMVMRISRARWFNFLRRVFHYQNGSSSNLGSNPFNSSTWMMLEFITLVVQITIITFTLAISERERSIWPMRIWISGYDIGCILNFLLLIHLTQGNAQNLSDMEQQRNNEETRMSHLMNKWRLELFFAIWFVLGIVWVFESRFGSFHEAPKLHVHPPRLQHEHGFF

SEQ ID NO: 202511 - protein, 86 aa, Glycine max
  Coding DNA Sequence Number=SeqID_85733
  Gene Ontology: Mol. function=oxidoreductase activity; Biological process=amino acid metabolic process
  Homolog annotation: Hit_ID=Q9C8I0; Match level="QueryCoverage=89%, HitCoverage=21%, E-value=1e-18, Identity=69%"; Hit description=NADP -specific glutatamate dehydrogenase, putative
MHVLQKLIAYGALSISVSETIQRPMLGPDIMMKQNRGMKGCRILVEGSNMPFTPEGVQILRKASVLIAPSMAAGAGGMRLWLENLN

SEQ ID NO: 202512 - protein, 149 aa, Glycine max
  Coding DNA Sequence Number=SeqID_85734
  Gene Ontology: Mol. function=transferase activity, transferring nitrogenous groups; Cellular component=cytoplasm; Biological process= ethylene biosynthetic process
  Homolog annotation: Hit_ID=Q6U5H3; Match level="QueryCoverage=70%, HitCoverage=22%, E-value=3e-36, Identity=59%"; Hit description=1 -aminocyclopropane-1-carboxylate synthase
MLSDKRFIREYFETNQKRIRQVHDEFVGCLSKLGIKCAKSSAGMYCWADMSGLIRPYSEKGEIELWEKFLSVAKINITPGSACHCIEPGWFRICFTTITLEEIPLLRPDVAARSCCLEILERNVYIPSYQVQLSCGIQNLLLCGRNILL

SEQ ID NO: 202513 - protein, 92 aa, Glycine max
  Coding DNA Sequence Number=SeqID_85735
MEDESSEATIPEPFIAKEEAGHFRASCTSGGPILASVEEHAVDPSAPILEILEDSTTLVQTLNTSPLATPVLHLTDDEDVQTQDTQDQSQEF

SEQ ID NO: 202514 - protein, 166 aa, Glycine max
  Coding DNA Sequence Number=SeqID_85736
  Gene Ontology: Mol. function=protein serine/threonine kinase activity; Cellular component=cell surface; Biological process =protein amino acid phosphorylation
  Homolog annotation: Hit_ID=Q1S8T4; Match level="QueryCoverage=97%, HitCoverage=52%, E-value=2e-56, Identity=61%"; Hit description =Protein kinase
  Pfam annotation: Domain name=Pkinase; Domain location=1-157; Score= -83.6; E_value=0.0014; Accession=PF00069.15; Description=Protein kinase domain
  Pfam annotation: Domain name=Pkinase_Tyr; Domain location=1-153; Score=-135.2; E_value=0.00036; Accession=PF07714.7; Description =Protein tyrosine kinase
  Pfam module annotation: Pfam domain module=Pkinase::Pkinase_Tyr; Domain location=1-157::1-153
IHRALAYNLFPNGSLQSIIFPPDDKQDFLGWEKLQNIALGIAKGIEYLHQGCNHPIIHFDINPHNVLLDDNFTLKISDFGLAKLCSKNPSLVSMTAARGTFGYIAPEVFSRNFGNVSYKSDIYSYRILLDMSSPQDFHVLYPDWMHDLVHGDVHIHVEDDGDVKIA

SEQ ID NO: 202515 - protein, 56 aa, Glycine max
  Coding DNA Sequence Number=SeqID_85737
MEQRNANDGGGAATKMQRRRREEEGLLFDGFDGGVASNGRAKVEGGTQMMPISGIR

SEQ ID NO: 202516 - protein, 169 aa, Glycine max
  Coding DNA Sequence Number=SeqID_85738
  Gene Ontology: Mol. function=sugar porter activity; Cellular component=periplasmic space; Biological process=transport
  Homolog annotation: Hit_ID=Q48HK3; Match level="QueryCoverage=96%, HitCoverage=54%, E-value=9e-44, Identity=52%"; Hit description =Periplasmic substrate-binding protein
MEALAKLANYKGNVAIMIGNLTDAGALQRTKDVEQVVAKYPGMKVVQKQPANYARNEGMDLMLNWIGNGEAIDIVAANNDEMAIGAAMALAKSNKKILVGGIDATPDGLKALAQDKMQVTVFQDAIGQGKTSVDVAQKLIKGEKVASHVWIPFELVTKENMQKYVERSQ

SEQ ID NO: 202517 - protein, 87 aa, Glycine max
  Coding DNA Sequence Number=SeqID_85739
  Subcellular localization annotation: CTP_CleavageSite=74; ConfidenceScore=5.12e-01
MDPEKSNRALGFPGRVTGLCQSYRMPVPPSKGSHPQDTQWTRKSPTGSWASVAPNKVIRPPINRAFIKKYCTPRQAQGETPQQPGDG

SEQ ID NO: 202518 - protein, 71 aa, Glycine max
  Coding DNA Sequence Number=SeqID_85740
MYPQLAQASCYFILKQPCSPRRLDYFTMKLFGGLGEPGVRKSFQMTLLLSLLGIFRIPYRNVAKPFVLRNN

SEQ ID NO: 202519 - protein, 72 aa, Glycine max
  Coding DNA Sequence Number=SeqID_85741
  Subcellular localization annotation: CTP_CleavageSite=15; ConfidenceScore=5.21e-01
MTSLNCAQLTIWAQRASNAKRSFSVLSTTEEFGRALISTPCAKHEICSLSMMVVFSQAQRMTGTKLKSTNSR

SEQ ID NO: 202520 - protein, 61 aa, Glycine max
  Coding DNA Sequence Number=SeqID_85742
MDKPKCSSPREKTSEVVTNAYLRKMLEKPKREVSLQGINVNSLQFQAKRRKFEEVPKWMSR

SEQ ID NO: 202521 - protein, 85 aa, Glycine max
  Coding DNA Sequence Number=SeqID_85743
MVHVNPFIGKALDPLKEKFDTYLGIVAEIRKFDIPEVSNAKKKVISMVGTRWRQFKSYLSIKSVYAEKEGEHGIPCNKYGLDENI

SEQ ID NO: 202522 - protein, 91 aa, Glycine max
  Coding DNA Sequence Number=SeqID_85744
MGLKSALRLMRTLGPSLASLAQSTWSLLSNALPGGNIGGGIGNLDRFHAVAIEGEVKENDVVAVEVEESPSRMYKPLTRLNIKMIAWITPM

SEQ ID NO: 202523 - protein, 118 aa, Glycine max
  Coding DNA Sequence Number=SeqID_85745
MVLKEELAACSRSKRNLTQRLCETETNMLAIITKVVDEYAQVYAEKEARGRVIDSLHQEATMWMDRFSLTLNGSQELPRLLAKAKAMADTYSALEEIHGLLDYCQHMIDLMAHIIRNR

SEQ ID NO: 202524 - protein, 471 aa, Glycine max
  Coding DNA Sequence Number=SeqID_85746
  Gene Ontology: Mol. function=carbohydrate binding; Biological process= carbohydrate metabolic process
  Homolog annotation: Hit_ID=Q1XVJ3; Match level="QueryCoverage=95%, HitCoverage=48%, E-value=1e-113, Identity=45%"; Hit description =Alpha amylase, catalytic region precursor
  Pfam annotation: Domain name=Isoamylase_N; Domain location=236-318; Score=13.8; E_value=0.0059; Accession=PF02922.8; Description =Isoamylase N-terminal domain
MKKFYFFILLLINFFVFGQINYTITPGQFNETDQITLTVPGDQIDESTWNVSNHAIYIWAWSLDTNYMNSQNCPTNGNWNNSDDQNKLNYNSTTDTYSLTFTPTTFFGRTGIGRFGFLLKDKAGTHQTSPDIFVNVGVLNLTLTNPLPNSLTSVPSGGSVSISATTNVAANFQLKANGVVVNSTSTPSVSYSYTYMVSADADMELIATDNSGTKNAKFIIQIPRNVISQAIPSWIRQGINYHPTDNTKVGLALYAPHKNFVHVIGSFNSWTVNDNYLMKRDTTNPDLYWIELDGITPQQLYTFQYRTNDLKKVADPFSPQILSSYDDQWIPSSTYPNLPPFPAGQNFEVSMFKTGQPNYNWQVTNFQRPDKEDLIVYELLLRDFTQEKNWQSLINKITYLKNLKINAIELLPIMEFEGNLSWGYNTSFHYTLDKAYGTPEKFKEFVDLCHQNGIAVILDVAFNHATGRSPL

SEQ ID NO: 202525 - protein, 69 aa, Glycine max
  Coding DNA Sequence Number=SeqID_85747
  Subcellular localization annotation: CTP_CleavageSite=54; ConfidenceScore=5.21e-01
LILAHQWAKHASTTKRSYNMLSATEESGRASISRSRAKREIKALSATVVFSQAQCMTGAKRNVTNSEPI

SEQ ID NO: 202526 - protein, 241 aa, Glycine max
  Coding DNA Sequence Number=SeqID_85748
  Gene Ontology: Mol. function=helicase activity; Biological process =viral genome replication
  Homolog annotation: Hit_ID=Q2R1R7; Match level="QueryCoverage=95%, HitCoverage=14%, E-value=2e-61, Identity=51%"; Hit description=AT hook motif-containing protein, putative
  Pfam annotation: Domain name=DUF889; Domain location=1-209; Score =254.5; E_value=2.1e-73; Accession=PF05970.5; Description=Eukaryotic protein of unknown function (DUF889)
MCLQGNAQLIDDQETNKFAKWILDIGDGVIGNQNDGYATVEIPEYLLITKYNDPIDAIVKSTFPNLYQHHSNPDFFKSRAILASTNETVEEVNDYILSLIPGEQMEYLSSDYIEKSENIDSWHFQSITTEFLNSLNTSGLPNHRIKLKIGSPIMLLRNLDQMQGLCNGTRLVITRLVKHVIATEIISGKNLGDNVYIPRMSMSPSQSPWPFKLLRRQFPIMLSYAMTINKSQGQSLSIVEL

SEQ ID NO: 202527 - protein, 217 aa, Glycine max
  Coding DNA Sequence Number=SeqID_85749
  Gene Ontology: Mol. function=transporter activity; Cellular component= integral to membrane; Biological process=transport
  Homolog annotation: Hit_ID=Q3G1G0; Match level="QueryCoverage=94%, HitCoverage=42%, E-value=1e-49, Identity=46%"; Hit description =Sulphate transporter:Sulfate transporter/antisigma-factor antagonist STAS
MSLAGFVRWRFDDPRGGRLFAGRRSFADRRFAHRVYYRPGHGAVRRQAGHGFRRRRLYCGGADEPGGAVRHGLRAVGHAVCRGDSNPDRRLPAGQVHSSGAAAGDPRLRQRSGDRHHAGAAEDDRRAGAADVRPGGAGDCGGGAVPAPDQSHSVFAGGAAGGFGVGDRPQSAHAAGGRSGGHFRRAAALQPADGAVHPRNGAGGAALCGGDCPGRFD

SEQ ID NO: 202528 - protein, 78 aa, Glycine max
  Coding DNA Sequence Number=SeqID_85750
  Subcellular localization annotation: CTP_CleavageSite=47; ConfidenceScore=5.52e-01
MAVTARASPSSSPSSFAPVFSFVQARMTKFASFQTHIDPFTGKDQIRKALKVPLELLGSPPLGVFFERFVPPFFAHVL

SEQ ID NO: 202529 - protein, 153 aa, Glycine max
  Coding DNA Sequence Number=SeqID_85751
MKREKHASYSSHNSCKSLSEELRDYYEGRHRSHLRPHSHRREKGHITSQCPSTKTMIMRGQDIYSSQDEATTSPSSSESEKAKGEESSEEIYPQEEGQPLVVKEKCKEALASIATPLGLEFIPQVKKLLDEGLVRKSLNPCALLVPKIGIIRH

SEQ ID NO: 202530 - protein, 70 aa, Glycine max
  Coding DNA Sequence Number=SeqID_85752
MTSGSSYLAHTLELDQRFPGKTRQDFLDEFVTEEWRPCEAPKHSESKFCTYQDMHLREQCIYICPNVSRV

SEQ ID NO: 202531 - protein, 390 aa, Glycine max
  Coding DNA Sequence Number=SeqID_85753
  Gene Ontology: Mol. function=mannonate dehydratase activity; Biological process=glucuronate catabolic process
  Homolog annotation: Hit_ID=P24215; Match level="QueryCoverage=62%, HitCoverage=62%, E-value=1e-105, Identity=75%"; Hit description =Mannonate dehydratase
  Pfam annotation: Domain name=UxuA; Domain location=146-390; Score =341.8; E_value=1.2e-99; Accession=PF03786.4; Description=D-mannonate dehydratase (UxuA)
MEQTGQRPDGGADEEAEFEANDINQPAADRLKEVDSDAGEKQHQHPPAQMTDDAFRAGCGNPWVQTAVHRILHSLLTACVSNVCDCLAGGGVHTGQRITPWPLIAGRGVMRPPDAVFVIWLTKIIYQVDFRRALRVMLRPVGENDMKQTWRWYGPDDPVSLADARQAGATGIVTALHHIPNGEVWPVEEILQRKAMIEAAGLVWSVVESVPIHEEIKTGSGQCQQWISNYQQSLRNLAQCGIHTVCYNFMPILDWTRTDLAFELPDGAKALRFDQIEFAVFELHILQRQGAENDYSADEIAEAAARFASMSEEHKLRLTRNIIAGLPGAEEGYTLAQFRAQLARYDGIDKARLREHFATFLRGIIPVAEEVGIRMAVHPDDPPRPILGLP

SEQ ID NO: 202532 - protein, 62 aa, Glycine max
  Coding DNA Sequence Number=SeqID_85754
MPADVGQEKMTDRGLKKKHDRMTPIEHFQIDIVQPTLRNFFHKRWPIIFLSVKDAFVVGYRL

SEQ ID NO: 202533 - protein, 145 aa, Glycine max
  Coding DNA Sequence Number=SeqID_85755
  Subcellular localization annotation: CTP_CleavageSite=17; ConfidenceScore=5.37e-01
MVPVDNCATITGRQKKRFSLSASLPLVLAFFLLHPTIFSSSSSPELLLFFFLTHHLTSPAFLLLTSPSSQKSFTQRRHPPRRVCSPLSIVFFLCVGSPCSATAPPLVLSSPGKLRVVFSLRTSALSSLLIKVLSFSQGVSYTNSQ

SEQ ID NO: 202534 - protein, 68 aa, Glycine max
  Coding DNA Sequence Number=SeqID_85756
MLIIIDQYKEKVNLAASHGQMLEDEQAKVSTLRVEREAREGVIELLHKEAMKWMDRFALSLNESQELQ

SEQ ID NO: 202535 - protein, 180 aa, Glycine max
  Coding DNA Sequence Number=SeqID_85757
  Gene Ontology: Mol. function=oxidoreductase activity, acting on paired donors, with oxidation of a pair of donors resulting in the reduction of molecular oxygen to two molecules of water; Cellular component=endoplasmic ...
  Gene Ontology: Cellular component=reticulum; Biological process=fatty acid biosynthetic process
  Homolog annotation: Hit_ID=Q8PAZ4; Match level="QueryCoverage=93%, HitCoverage=48%, E-value=1e-54, Identity=66%"; Hit description=Delta 9 acyl-lipid fatty acid desaturase
MTAIRMSVPRLCQHPLGDGLESLDQPERRHHAQAVPGQVNFPPAEALAHGAREEVVVVVPAFTERQQSQPEIVAAVVSGLKAATTEAMSQRVDGDRGMEQHDGGNEESPHQQLRAGGVQARSPLLQCCTQCIQADGQQHGNGGIETVQPAQLREARQVRHPRQGRWRRLRGSGTNPCGCA

SEQ ID NO: 202536 - protein, 87 aa, Glycine max
  Coding DNA Sequence Number=SeqID_85758
  Gene Ontology: Mol. function=pyridoxal phosphate binding; Biological process=metabolic process
  Homolog annotation: Hit_ID=Q7CK24; Match level="QueryCoverage=97%, HitCoverage=24%, E-value=2e-24, Identity=59%"; Hit description =Putative cysteine synthase
MMKVPDGATVAAMLRLEQILGRRPGASTGTNFWGMLQVAKRLRAQGQSAALVTLLCDSGERYPDTYYNPQWVAEQVGDIQAWQRELQ

SEQ ID NO: 202537 - protein, 94 aa, Glycine max
  Coding DNA Sequence Number=SeqID_85759
MTLSSWQNKLDKYFTCKTLVMKGETEVTKAMVQLQNVSQRALSRASEGEAHGCTFQRRKGARSRHQRLFVENIWENRMVLGQNEHSKFGSRIYA

SEQ ID NO: 202538 - protein, 200 aa, Glycine max
  Coding DNA Sequence Number=SeqID_85760
  Gene Ontology: Mol. function=adenosylmethionine decarboxylase activity; Cellular component=cellular_component; Biological process =spermidine biosynthetic process
  Homolog annotation: Hit_ID=Q75KG4; Match level="QueryCoverage=95%, HitCoverage=55%, E-value=5e-42, Identity=46%"; Hit description =Putative S-adenosylmethionine decarboxylase
  Pfam annotation: Domain name=SAM_decarbox; Domain location=1-195; Score=-34.3; E_value=7.9e-10; Accession=PF01536.7; Description =Adenosylmethionine decarboxylase
MPSKSSSHSWHVFTATNIPHHSHAPYSQNHAYTMEICMTDLDPVLARKFFRRPGDGKTGDSAGKEMTELTGIGEINSHALVCDFAFDPCGYSMNGMDGEWYSTIHVTPEDGYSYASFECVGSMSDDVDIIHVLRKVVQIFRPGTMSVSTTSSLGSEVWREVAGAVEPMGLKLRSCAMDQFPDSGSVVFQTFTPLRRKSAQ

SEQ ID NO: 202539 - protein, 117 aa, Glycine max
  Coding DNA Sequence Number=SeqID_85761
MFGVHNDNFPLYIKQEHLSEIAHDGQCLSISVIQLWILHMTETSMRAGNIDVYGFLEPYSIQKFGQSQFESEDYIKKWMQNSLRDVYLGAYLNGALKGFNNSHGSKSKGVARWILVK

SEQ ID NO: 202540 - protein, 57 aa, Glycine max
  Coding DNA Sequence Number=SeqID_85762
MELMPFHLFVFSGSHQLFSGERELTKASRVMTIIGFLGEGERSRDSMAGAREKGRVK

SEQ ID NO: 202541 - protein, 90 aa, Glycine max
  Coding DNA Sequence Number=SeqID_85763
  Gene Ontology: Mol. function=oxidoreductase activity; Cellular component=membrane; Biological process=electron transport
  Homolog annotation: Hit_ID=Q8W228; Match level="QueryCoverage=95%, HitCoverage=21%, E-value=1e-20, Identity=58%"; Hit description =Cytochrome P450
MQDMLLGSMDTSATAIEWTLSELLKNPRVMKKVQMELETMVGKDEAPSSGTVTNATPIEGRLHGWRLFHTKKIKGGSKCMGNYERLKCME

SEQ ID NO: 202542 - protein, 150 aa, Glycine max
  Coding DNA Sequence Number=SeqID_85764
NHPHTYFSTPAVEPSSSTRPNEPEFTTESGLPNEELNPFSEDQDEVFHNQPQEEDHKEEAWPVSPITNVPPHIQNFEESYFQDFEYGHSLNCDEVNILWELSSFLMMLKYNQTRLLQETFKVKQTEIASRLNLDEENKDQEESYVLVYLC

SEQ ID NO: 202543 - protein, 82 aa, Glycine max
  Coding DNA Sequence Number=SeqID_85765
MKKSDKKNFKDKKEKKAYITWDDNDMDSSSDSENEIINLGLMAKDYESEEEVTSSNYDLFISFDELQDEFNDFHKESSNLPN

SEQ ID NO: 202544 - protein, 167 aa, Glycine max
  Coding DNA Sequence Number=SeqID_85766
  Gene Ontology: Mol. function=zinc ion binding
  Homolog annotation: Hit_ID=Q1SXA1; Match level="QueryCoverage=88%, HitCoverage=45%, E-value=1e-22, Identity=36%"; Hit description=Zinc finger, SWIM-type
MVVEKETLPMQPQGCQLVEGYVMFHHFFWSFKPCINEFQYCKPIVQVDGTWLYDKFKGTLLMAVAQDAYAKMEPMFNYYYNMLSEEANANRAINCLSKILNLPIGALVKSIYKVKALFNKKGRKAAIMLAFNQVYMEVLNKGIEDALRKANTHNILQFDRRDTQFLV

SEQ ID NO: 202545 - protein, 184 aa, Glycine max
  Coding DNA Sequence Number=SeqID_85767
MGRQRQEQHHHRFRRPSDPDSRPHRLGSRTARNRFSLPLKPLPPPQLHKAEHDDADDAVQKPWNQRPRKPTLLPKATIKIGTGPSRNHHHATNNGEFHDGGGGGGGDNNNPAPKSLWLRGFSVKSGNFFFVNCLSVGSFLFYLVLVLVSYVEVSFEGFKKGFRLREIVEASIKSWVYTLYKAYS

SEQ ID NO: 202546 - protein, 77 aa, Glycine max
  Coding DNA Sequence Number=SeqID_85768
MSQLLYMFLVARIMIGEIVKDVQELGVNPIEAQRMKDQESVTDYFTRILILTNQMKSYSEKLKDVMVIDKILRTLKG

SEQ ID NO: 202547 - protein, 57 aa, Glycine max
  Coding DNA Sequence Number=SeqID_85769
MVTPKEHVEEIRRNKFSIGKEPNPWLKICNKQLRISPLNFIPKTLTSLLPTHSGSIQ

SEQ ID NO: 202548 - protein, 71 aa, Glycine max
  Coding DNA Sequence Number=SeqID_85770
MGTGDSPRASIRDEDGVDVGTWDDPHAPIRDEYGLTSVEGEDGVGATSKDLISIDIVDGDMVDDGRLSLGG

SEQ ID NO: 202549 - protein, 105 aa, Glycine max
  Coding DNA Sequence Number=SeqID_85771
MAPKKLPAKRSRKDATGKGSSAAPQADMDFDRHRFRSAEHQQCFEAIKEEGVRDKHSWVRGQWIPFDENAINQFLGHPLVLEEGQHCEFSQWRSQALGFDKEAIS

SEQ ID NO: 202550 - protein, 136 aa, Glycine max
  Coding DNA Sequence Number=SeqID_85772
  Subcellular localization annotation: CTP_CleavageSite=65; ConfidenceScore=5.28e-01
MLLLSNIFPSDHNSDLPLLKCQLVYAIMTQFYGVSVAPPSSFGLLSAEPSLRSTTCPGKCRVSYRCATASSRGGTISESQDPNPFPWPTPEQFGAMVTWPGDETDFETRPGPVGALGDDGGVQEDEGMADMLDFFT

SEQ ID NO: 202551 - protein, 94 aa, Glycine max
  Coding DNA Sequence Number=SeqID_85773
MMMLIRSKCKLVKMCGVCVCGSLEMCMYSTESVVASLENRVFKVGDPVIPVSPILKQWVEEGREVTKLQLENLVYRLTQSRRFTHALQVVFGMR

SEQ ID NO: 202552 - protein, 120 aa, Glycine max
  Coding DNA Sequence Number=SeqID_85774
MKKYKGERNIEQIWKNPMSLSLAVVLQASGDGGSRDSRGHTRERRWWFNVWRRRVVTKRKRRKRGKKKKSMRKMKLERWEGEGRLWSWMGKWGKGEGSGEKKKRGGEVGKATWGRRKVLE

SEQ ID NO: 202553 - protein, 578 aa, Glycine max
  Coding DNA Sequence Number=SeqID_85775
  Gene Ontology: Mol. function=binding; Cellular component=mitochondrion
  Homolog annotation: Hit_ID=Q8LNF8; Match level="QueryCoverage=60%, HitCoverage=64%, E-value=9e-49, Identity=34%"; Hit description =Putative leaf protein
  Pfam annotation: Domain name=PPR; Domain location=114-147; Score=3.4; E_value=2.9; Accession=PF01535.11; Description=PPR repeat
  Pfam annotation: Domain name=PPR; Domain location=219-253; Score=9.2; E_value=0.6; Accession=PF01535.11; Description=PPR repeat
  Pfam annotation: Domain name=PPR; Domain location=254-288; Score =21.0; E_value=0.0042; Accession=PF01535.11; Description=PPR repeat
  Pfam annotation: Domain name=PPR; Domain location=45-78; Score=13.5; E_value=0.19; Accession=PF01535.11; Description=PPR repeat
  Pfam annotation: Domain name=PPR; Domain location=80-113; Score=16.6; E_value=0.08; Accession=PF01535.11; Description=PPR repeat
  Pfam annotation: Domain name=SATase_N; Domain location=468-548; Score= -32.6; E_value=0.0058; Accession=PF06426.4; Description=Serine acetyltransferase, N-terminal
  Pfam module annotation: Pfam domain module=PPR::PPR::PPR::PPR::PPR::SA Tase_N; Domain location=114-147::219-253::254-288::45-78::80-113::468- 548
MSNERNYELSPGNIAKQINLISKVRGLEQAEKYFRGIPDAKIEFKIYAALLRCYAEHKSVEEAEAVLKKIKELHPVNITACCNMMLELYAKKGKYEKLDRLMQEMKEKDICNAGTYTIRLNAYVIATDIKGMEKLLMQMEVDPMATVDWYTYMTAANGYRKVHNFEKVAAMLKKSEHVARGKTKRLAYESIQTMYAIIGNKDEVHRLWNMCTSPKKPNKSYIRMLSSLVKLDDIDGAEKILEEWESVHENFDVRIPNLMISAYCKWGQFDKAEAYIRRLLDGGKHLDGRTWDRLACGYNAGNDMENAVQAMKKAVSTNLAGRRPDPFTLVACVKYLKEKGDLDLALEILKLCIENSHISVTSYDGLPEARASSLICLPRHFVLSSMESSPSQLRNWIWVCYSIMHLLAKSLSPSCNLSSFTASSPVTTVNLESHCSGHPKIIKPSFNHNRINTLHTGSTVEHVEVDEEEAKLDVIVEPILSNYYNTSTLSHKSLQTALAIHLAIKHGNTRLPRIKNPNAYISKTFVPLRVVTKSELNNLSRTTQELEGKRGCLGGTGKRTTVQGNSHFEMGVFSVGVF

SEQ ID NO: 202554 - protein, 157 aa, Glycine max
  Coding DNA Sequence Number=SeqID_85776
  Pfam annotation: Domain name=DTW; Domain location=1-145; Score=-17.5; E_value=0.00011; Accession=PF03942.6; Description=DTW domain
MGPGAIQQQCLGAFRANGSDFFLRVWEDSKVEQPPKKNRLSYFMTTPLDHHKDLKDKAKSVWGDEDLACISLNPGASAMHKLRCGRPQPSWDRTCTAAAAAGLLSELQLLPQFSTVGLDEQEEAVEHALTVLLDALTNRRLRVGRSITRKMRHTNIQ

SEQ ID NO: 202555 - protein, 47 aa, Glycine max
  Coding DNA Sequence Number=SeqID_85777
RFPDYGKLNPLLDLPCRYLIGNWSDSKVLDSTGLSCCTVTRNRGTRT

SEQ ID NO: 202556 - protein, 109 aa, Glycine max
  Coding DNA Sequence Number=SeqID_85778
MAKEEEQGNSTEIYIPMYLCAYLRVYTYTHLGKCRKRKRKPLEENRFSALGFCEKHGHFAIDDNDIIEDGSWHFCIDYRALNVLAVKDCFPILTVDELLDELHRSSIGA

SEQ ID NO: 202557 - protein, 202 aa, Glycine max
  Coding DNA Sequence Number=SeqID_85779
  Homolog annotation: Hit_ID=Q1SQB0; Match level="QueryCoverage=26%, HitCoverage=13%, E-value=3e-18, Identity=90%"; Hit description =Carbamoyl-phosphate synthase, GATase region
MALLVNNANGSANGLLGKAKKLISILTMGLNHNYAVDPATLPEGVEVTHRNLNDGSCAGLAFPAQRIMSLQYHLRHPQDPMILIAVNYVVNNVIELELQGGPKHVKYAVVGGLSDQIRQLRESIELPLTNPEFFLRVGIGMKLPKGLLWKPPPEEEDSSSPLSSSALKSVVLPLSHDREVSVDENCLFTESLKAMGGENIDT

SEQ ID NO: 202558 - protein, 160 aa, Glycine max
  Coding DNA Sequence Number=SeqID_85780
MEMQRKAKEKRKGEAPPLGNKPWKKKLHHHECALNKNLEEDALMEEKKERRGEHKIEGIKEGEKWNFEVLKLQVRIEQENEVKIKLGVENRGHLPNLDGRMAQQHLVKLGRRRKIWSPLSTKASEKWENWPRLWLLKTTLIVGEMLGPMGLQGLILIFLI

SEQ ID NO: 202559 - protein, 125 aa, Glycine max
  Coding DNA Sequence Number=SeqID_85781
  Subcellular localization annotation: CTP_CleavageSite=58; ConfidenceScore=5.35e-01
MRGGGCTSARPGELVASSRSFLACPGQLNSPRRAGFFTPKFFGKSGLPESAPGRQLIRQALKSVVFHLLAKPICWLSEHPLSASLMGYARGRLWKKISCTGSLSAPLHLTKRTASVHPLSEKGAC

SEQ ID NO: 202560 - protein, 124 aa, Glycine max
  Coding DNA Sequence Number=SeqID_85782
  Gene Ontology: Biological process=lipid transport
  Homolog annotation: Hit_ID=O49116; Match level="QueryCoverage=94%, HitCoverage=90%, E-value=7e-09, Identity=31%"; Hit description=ATA7
  Pfam annotation: Domain name=Tryp_alpha_amyl; Domain location=32-120; Score=10.5; E_value=0.0076; Accession=PF00234.12; Description =Protease inhibitorseed storageLTP f
MAMTRILVLLCLVFVSHMGEAKVLVPSAISACERIFEYFPNCLEFLVGDPNYVRPSRRCCQHVVKLNILARHRTGPRTICWCIQVMVKGMTPALVPSKIQDLPLMCHTTLSFPISDSIDCSKVG

SEQ ID NO: 202561 - protein, 892 aa, Glycine max
  Coding DNA Sequence Number=SeqID_85783
  Homolog annotation: Hit_ID=Q9ZT82; Match level="QueryCoverage=39%, HitCoverage=21%, E-value=1e-169, Identity=76%"; Hit description =Putative glucan synthase component
  Pfam annotation: Domain name=DUF1421; Domain location=140-530; Score =134.8; E_value=2.4e-37; Accession=PF07223.2; Description=Protein of unknown function (DUF1421)
  Pfam annotation: Domain name=Glucan_synthase; Domain location=231 -892; Score=243.1; E_value=6.1e-70; Accession=PF02364.6; Description =1,3-beta-glucan synthase component
  Pfam module annotation: Pfam domain module=DUF1421::Glucan_synthase; Domain location=140-530::231-892
MASLPSSRSNGGSNGFDLGSGDILCSYEEDNTNHDSSDGTHIDPAKGSHASRMARTSVVPATAYSSSEDSLSQDVIAIVEKSMKTHADNLMRFLEGLSTRLSQLELYCYNLDKSIGAMQSDLTCDHEETDSKLKSLDKHLQEVHRSVLILRDKQELAETRKELAKLKHVRKESSSSSHLQSNEERSSPSSMDPKRIDNVSDTQNQELALALPHQVAPRQQPVASSYQVPAPNVSQATQRPHYYLMPTHLPNPQAVTQLPQNQYLPSDPQYRIPLSTSSSQVIQSPPVQQFSQYQQLQYQQQQWAPQLPPQQVQVPPPQPPSAVSQVRPPSTNVYTPYATSQATNPLPTETLPNSVPMQMPYSGIPPQGSSSGGGGSDAMPYGYSGAGRTVPQQPLLQHMRGSFSAQPGDVYGNSGTHTMRPPASSYNVYDGENARAHYPPEPSHYAQAGYPPTSASLHNPASHNLMVPSPSQSQFIRSHPYNDLIEKFVSMGFRGNHVASIIQRMEETQQPIDFNSVHDRLNVHNPQRGWSGLVSVETIGLGVREHIFTGSVSSLVWFMSGQETSFVTLGQRVLANPLKVQMHYGHPDVFDRFWFITRGGGISKASRVISISEDIFAGFNCTLRGGNVTHHEYIQVGKGRDVGLNQISMFEAKVASGNGEQVLSRNAYRLGHRLDFFRMLSFFYTTVGFFFNTMMVVLTVYVFLWGRLLLALSGIEDAMESNSNNNKALGFLQAVWDFLTMQLQLSSVFYTFSMGTCSHFFGRIILHGGAKYRVTGRVFVVEHKSFAENYRLYARSHFMKAIELGLIVTVYASHSTVATDTFVYITMTFSSWFLVASWIMAPFVFNPSGFDWLKTVYDFDDFINWIWHRQRVFAKAEQSWEKWWYEEQGHLK

SEQ ID NO: 202562 - protein, 86 aa, Glycine max
  Coding DNA Sequence Number=SeqID_85784
MKQSLLLRGESSDQSYQSRGIFRRSDAIAYGSNYEKAAAFIDLVVSSLILLFRNTRATKLRRIFVSTEMNRSRRCQSGEEDENFQK

SEQ ID NO: 202563 - protein, 129 aa, Glycine max
  Coding DNA Sequence Number=SeqID_85785
  Gene Ontology: Mol. function=voltage-gated ion channel activity; Cellular component=integral to membrane; Biological process=calcium ion transport
  Homolog annotation: Hit_ID=Q75VR0; Match level="QueryCoverage=90%, HitCoverage=16%, E-value=2e-33, Identity=60%"; Hit description=Two -pore calcium channel
MVHMELRETIIILVGMLDTYLNVLALWLLFLLFASWVAYVFFEDTIQGKTVFTSYGTTLYQLFLLFTTSNNPDVWVPAYKSSRWYCLFFILFVLVGVYFVTNLILAVVYDSFKSELTIPLSDIATSLPH

SEQ ID NO: 202564 - protein, 182 aa, Glycine max
  Coding DNA Sequence Number=SeqID_85786
MGSNNTVSKMGRFLLPLPLAWVLLKGKTQVLKVKGLEKGQKWSQFQLLLLPLLRVFLSAKEWTTSLWVKDFNPSTLIRSPWLSLLDHNMLREPSPYDMEIANFWVDEFMKVNVESQKAQIECAKFEWALIEATKANNSLLQSIENSKKSLEDTETKLKKAEIQEEALKTRLFSIENYAKAFK

SEQ ID NO: 202565 - protein, 208 aa, Glycine max
  Coding DNA Sequence Number=SeqID_85787
MVSVGPGKFYGTSLPRPRIYTDVKFNDHRIDPPTPVNGPLMSWAQEAHWSMGGLSFKRLRLQGKIEGNVERLRYQREKAQAQSPSPPPPPRSVLRGSKRTSSPSPPLAPFATKRRRCMDLILEEEVEAPSAGVRKSRLVKKLGDDFDRVASLENEGAETTSLKTRSKRLVKGGKPVKKMAVEESEKSKPKAKKSTAEAAGKSFVSVNA

SEQ ID NO: 202566 - protein, 261 aa, Glycine max
  Coding DNA Sequence Number=SeqID_85788
  Gene Ontology: Mol. function=hydrolase activity, hydrolyzing O -glycosyl compounds; Cellular component=beta-galactosidase complex; Biological process=carbohydrate metabolic process
  Homolog annotation: Hit_ID=Q9SKU9; Match level="QueryCoverage=89%, HitCoverage=58%, E-value=9e-96, Identity=68%"; Hit description=(1-4)- beta-mannan endohydrolase
MELTVLTRKNTITGIEYRNDPSIFGWELINEPRCMSDPSGDTLQGWIDEMSTFVKMIDKNHLLTVGLEGFYGPNDPKSSTVNPELWASRLGSDFIRNSKISHIDFASVHIYPDHWFHEQVFEDQLKFVYKWMLSHIEDGDEVLKKPVLFSEFGLSKTNQNFSLSDREKMHRAVLDIIYKSAKRNRSGAGALVWQFLVGGMKEFSDEYGMVPWESSSTPHVFIEQSCRLANAKGWTQLDILINKVQFKLCHTDKQNLQGRPM

SEQ ID NO: 202567 - protein, 176 aa, Glycine max
  Coding DNA Sequence Number=SeqID_85789
MDSAKVFLQRSLAILEENGQWHQEALHKVEKKDLDGKVESIAVERDGPSKVVIDLEAQLKESEYRLEESELWAAKERFFAKDLDMGLFDPFKDVKDGVLLDEEDIAAEEEAVDEAGCCRARRPCNYDNYFYFSSMHMLSFDDELRTVYACLVCMSCCHDDECGIFDGVGSKTFVDV

SEQ ID NO: 202568 - protein, 317 aa, Glycine max
  Coding DNA Sequence Number=SeqID_85790
  Subcellular localization annotation: CTP_CleavageSite=4; ConfidenceScore=5.25e-01
MTLKAAPKKPSLRIKKPKPISEKAPNFQPLERQPIPPRVVFPPSQPSHSHSLFNNHTLSSLNPCSRFHHLLRSSFRKATIVTIPNPNPNPSQTMVVSLGPGKFYGTSLPRPRIYTDVKFNDHRVDPPVPVNDPLMSWAQEAHWSMGGLSFKRLRLQGKIEGNVERLRSQREKFQAQSPSPSPPARADLRRSKRAASPLTPPAPVMAKRRRYMDLIQEEEEEEEEGVVVRRTSVRKSGLVKKLGDDFDRVALENDESNTVSSLKTTRGRKLVKNGELGNKTVVEVAEKSNTKGKKSASEAEKSPGVRTSSRLAKRVSN

SEQ ID NO: 202569 - protein, 60 aa, Glycine max
  Coding DNA Sequence Number=SeqID_85791
MNITCMTCGTSEDTTTVLKQHLCGNRRGTILRQLPRETIVVCHVKLTIQRRLPGKDYLCM

SEQ ID NO: 202570 - protein, 152 aa, Glycine max
  Coding DNA Sequence Number=SeqID_85792
  Homolog annotation: Hit_ID=Q2QTF1; Match level="QueryCoverage=41%, HitCoverage=43%, E-value=4e-10, Identity=47%"; Hit description =Expressed protein
MAKVEEEEQPTSPIHTSPSSYVLLLQIMSKRKTWVCIFVLVYGLLFTSSWNFLKSMVSWYKLRAAESSITSWWPALYASVLLGAVFGVLSMVAALAVVVPAVLVLLKEGNIVAAVCAVLGYFVLGRTNGKGVDRIGCVSLVINSDAMHLFRI

SEQ ID NO: 202571 - protein, 899 aa, Glycine max
  Coding DNA Sequence Number=SeqID_85793
  Gene Ontology: Mol. function=protein serine/threonine kinase activity; Cellular component=cell surface; Biological process =protein amino acid phosphorylation
  Homolog annotation: Hit_ID=O49445; Match level="QueryCoverage=91%, HitCoverage=97%, E-value=0.0, Identity=49%"; Hit description =Receptor protein kinase like protein
  Pfam annotation: Domain name=Lectin_legB; Domain location=230-468; Score=263.9; E_value=3.3e-76; Accession=PF00139.10; Description =Legume lectin domain
  Pfam annotation: Domain name=Pkinase; Domain location=555-824; Score =148.0; E_value=2.5e-41; Accession=PF00069.15; Description=Protein kinase domain
  Pfam annotation: Domain name=Pkinase_Tyr; Domain location=555-824; Score=94.7; E_value=2.7e-25; Accession=PF07714.7; Description =Protein tyrosine kinase
  Pfam module annotation: Pfam domain module=Lectin_legB::Pkinase::Pkina se_Tyr; Domain location=230-468::555-824::555-824
MNARLGDFGLARLHHHEHVAETTRVIGTLGYMAPELVRIGRPSAACDVYSFGVLVLEVVCGRRSIIADQPPLVDWVFSLVENGELSCAIDEHLKGQSGYNAEEAKRLLHLGLLCVSTDPGVRPTMRQVVKALEGIKCTECNKDCIHFALLGKINSAASWSKSSTSSANVNYPTFDEILQAKFYSTASLSVSCPSPQPESEFVSEGSPLPMSPLKLLVILLHTVTIFTSASTTEFVYNTNFNTTNIILYGNASIETSILTLTNQSFFSIGRAFYPHKIPTKLANSSTFLPFATSFIFSVVPIKNFITGHGFVFLFTPSSGVNGTTSAEYIGLFNRSNEGNPQNHVFGVEFDPVKNEEEFNDISDNHVGVDINSLRSSTSHEAGYWGGKGDKEFKVLDFKNGENYQVWIEFMHSQLNVTMARAGQKKPRVPLISSNVNLSGVLMDETYVGFTAATGRIIDSAKILAWSFSDSNFSIGDALVTENLPSFVHHKKWFPGAQAFAVGVTSIVFVLIISCGYVAFFVLRRRKTQEEVEDWELEYWPHRIGFHEIDAATRGFSEENVVAVGGTGKVYKGVLHGVEVAVKRIPQEREEGMREFLAEVSSLGRMKHRNLVGLRGWCKKEKGNLILVYDFMSNGSLDKWIFECEEGMMLTWEERIQVLKNVATGILYLHEGWEVKVLHRDIKANNVLLDKDMNARLGDFGLARMHDHQGQVVSTTRVIGTVGYIAPEVIQRGTASTLSDVFGFGILVLEVICGRRPIEEHKPGLIEWLMSLMVQGQLHSAVDERLKAKGGYTIEEAERLLHLGLLCSHTDPSIRPTMRQVVKILEVEIDSIESDEDNMEMSLLGKIRSATTWSRAECALPYSGYPSFDEVKMFSFNSRTSRSGSSTFLGSESEITRENI

SEQ ID NO: 202572 - protein, 90 aa, Glycine max
  Coding DNA Sequence Number=SeqID_85794
MCRGFIGSLCLVGYEIRCGEGEGTGVEHCGGRRRHSRYAEGGAAIGKMDEDEWMYESIMPEEAHMDYQNEEACGVNEPYVDYSDAFKTSQ

SEQ ID NO: 202573 - protein, 189 aa, Glycine max
  Coding DNA Sequence Number=SeqID_85795
  Gene Ontology: Mol. function=transition metal ion binding; Cellular component=nucleus; Biological process=cytoskeleton organization and biogenesis
  Pfam annotation: Domain name=Transposase_21; Domain location=125-189; Score=-115.9; E_value=0.0001; Accession=PF02992.5; Description =Transposase family tnp2
MGDRLDDMISDLGQELFQQAHAPMYDTLETDSKNPLYLGCKKTLTLLSVVLSLVNVKAKYEWNNKSFTLLLQYKKIHGCPNNCILYRYEFEEMHKCPKCGVSRYKMKDDDECSSDKSTKKGPQRKRNYDGMLYHPTDSSQWKKINRLYPNFSKKARNLRLGLAIDGMNPYNSLSTQHKRVIWMMIPYTK

SEQ ID NO: 202574 - protein, 696 aa, Glycine max
  Coding DNA Sequence Number=SeqID_85796
  Gene Ontology: Mol. function=protein serine/threonine kinase activity; Cellular component=nucleus; Biological process=protein amino acid phosphorylation
  Homolog annotation: Hit_ID=Q9FKV9; Match level="QueryCoverage=97%, HitCoverage=98%, E-value=1e-159, Identity=47%"; Hit description =Cyclin-dependent protein kinase-like protein
  Pfam annotation: Domain name=Pkinase; Domain location=136-420; Score =314.6; E_value=1.8e-91; Accession=PF00069.15; Description=Protein kinase domain
  Pfam annotation: Domain name=Pkinase_Tyr; Domain location=136-419; Score=45.1; E_value=3.1e-15; Accession=PF07714.7; Description =Protein tyrosine kinase
  Pfam module annotation: Pfam domain module=Pkinase::Pkinase_Tyr; Domain location=136-420::136-419
MGCIASKSAAVEDSREGVAREFTSSSKRATAKMKVSASNSEKRVDGVWGKDKVLDGVDMKASLIDKESSGSMRSSDNKNGRKKKQKRELAVLDHPGVGRVPKALEGEQVVAGWPTWLSSVAGEAIQGWIPRKADTFERFHKIGQGTYSTVYKARDLTDQKIVALKRVRFDNCDAESVKFMAREILVLRRLDHPNVIKLEGLITSQTSRSLYLVFEYMEHDLTGLASSPSINFSEPQVKCYMQQLLSGLDHCHSRGVLHRDIKGSNLLIDNNGILKIADFGLANFIDPHHKVPLTSRVVTLWYRPPELLLGASNYGVAVDLWSTGCILGELYCGRPILPGKTEVEQLHRIFKLCGSPSEDYWRKLRTPHSTVFRPPHHYRQCVAETFKECPSAATRLIETLLSLDPTLRGTATTALKSEFFSSEPLPCDPSSLPKYPPSKEIDTKLWKEASRHGADGGKEQKFRPGGRQEKEPQTFILSKDNADSHISMQQGKRLPNSRSRNEFFNPHREPAFGHLVFPQKQSEDHKETLNYFSGPLYQRPLHSGPLVPGYGYEMAGREAGGRPHVSSKVNLPKLSGLVASRTSLSGDQKENPVPLKPRETIQVQESTNGSESRRRHDKKRHSQTIDPRQIENGKFSTETLIQDGHGSMGNNIYHLSGPLLLSSNNMDQMLKERDRKIQEYSRRARMYKSGEIAHAK

SEQ ID NO: 202575 - protein, 445 aa, Glycine max
  Coding DNA Sequence Number=SeqID_85797
  Gene Ontology: Mol. function=GTP cyclohydrolase I activity; Cellular component=cytoplasm; Biological process=aromatic compound biosynthetic process
  Homolog annotation: Hit_ID=Q8VYU3; Match level="QueryCoverage=99%, HitCoverage=97%, E-value=1e-147, Identity=62%"; Hit description=GTP cyclohydrolase I
  Pfam annotation: Domain name=GTP_cyclohydroI; Domain location=104 -202; Score=36.1; E_value=1.2e-07; Accession=PF01227.12; Description =GTP cyclohydrolase I
  Pfam annotation: Domain name=GTP_cyclohydroI; Domain location=323 -428; Score=65.8; E_value=1.4e-16; Accession=PF01227.12; Description =GTP cyclohydrolase I
  Pfam module annotation: Pfam domain module=GTP_cyclohydroI::GTP _cyclohydroI; Domain location=104-202::323-428
MDCFDEANGELENVVSVGCSEEGSEKEAKTDIGAIEDAVKVLLLALGEDINREGLRKTPLRVAKALREGTRGYRQKVKDIVEGALFPEAGLENNRIGHAGGTGGLVVVRDLDLYSYCESCLLPFQFKCHVGYVPSGQRVVGLSKLSRVVDVFAKRLQEPQRLADEVCSALHQEILPAGVAIVLQCTHIPFPDIESIFLESNQQVWVKTLVLSGSGIFENKSEDAWSDFFCLLRFRGIKIENIHLRGSSDQCWCPSLTALSAKVSSKIVPVNPAMVTAGRLVDFVKWLLNFQSIDMDVKLNRSLCDGIDTLNLDREVNFNDRQIHSELNLPFWSQCEHHILPFHGVVHIGYFLSEGSNPIGKSLLQSVVHFYGFKLQVQERLTRQIAETIAPLLLGGHVIVVVEASHTCMISRGIEKFGSSTATIAVLGRFSTDLAARDAFLQCVA

SEQ ID NO: 202576 - protein, 208 aa, Glycine max
  Coding DNA Sequence Number=SeqID_85798
  Gene Ontology: Mol. function=metal ion binding; Cellular component =nucleus; Biological process=meristem determinacy
  Homolog annotation: Hit_ID=Q5EMN2; Match level="QueryCoverage=97%, HitCoverage=90%, E-value=8e-53, Identity=57%"; Hit description=CRABS CLAW
  Pfam annotation: Domain name=YABBY; Domain location=9-156; Score =179.5; E_value=8.3e-51; Accession=PF04690.4; Description=YABBY protein
MNHEDKLTMDLVPPSEHLCYVRCNFCNTVLAVGIPCKRLLDTVTVKCGHCSNLSFLSTRPPSSQSQSVDHTLSLQGFYSNAKKGQASSSSSSPTTSNESVSPKAASFVVKPPEKKHRLPSAYNRFMKEEIQRIKAANPEIPHREAFSAAAKNALGLALHILVTSLTFLETHKMFIHVPNLCSTTNSQWARFIPNSPTSSVSATKVNAD

SEQ ID NO: 202577 - protein, 120 aa, Glycine max
  Coding DNA Sequence Number=SeqID_85799
  Gene Ontology: Mol. function=protein binding; Biological process =protein metabolic process
  Homolog annotation: Hit_ID=Q10P51; Match level="QueryCoverage=91%, HitCoverage=47%, E-value=6e-37, Identity=66%"; Hit description=Clp amino terminal domain containing protein, expressed
  Pfam annotation: Domain name=Clp_N; Domain location=57-110; Score =16.2; E_value=0.018; Accession=PF02861.11; Description=Clp amino terminal domain
MAMVGTSKAAKFLRANGITLFKVREETVELLGKSDLYFFSPEHPPLTEPAQKALDWAIEEKLKSGEGGEINVTHLLLGIWSQKESAGQQILDTLGFNDEKAKELAKTIDGDVDLSFKRQA

SEQ ID NO: 202578 - protein, 115 aa, Glycine max
  Coding DNA Sequence Number=SeqID_85800
  Homolog annotation: Hit_ID=Q9FGR0; Match level="QueryCoverage=89%, HitCoverage=7%, E-value=6e-27, Identity=54%"; Hit description =Probable cleavage and polyadenylation specificity factor 160 kDa subunit
MSFAAYKMMQCPTGIDNCAAGFLTHSRSDFVPLQPDDLDAEWPSRPRHHVGSLPNLVVTAANVLEVYAVRLQEDQPPKAAADSRRGALLDGIAGASLELVCHYRFRLCPLTRSGI

SEQ ID NO: 202579 - protein, 662 aa, Glycine max
  Coding DNA Sequence Number=SeqID_85801
  Gene Ontology: Mol. function=nucleic acid binding; Cellular component= nucleus; Biological process=mRNA processing
  Homolog annotation: Hit_ID=Q9FGR0; Match level="QueryCoverage=88%, HitCoverage=37%, E-value=1e-120, Identity=71%"; Hit description =Probable cleavage and polyadenylation specificity factor 160 kDa subunit
MAVLSIGGGDVSRRRDSIMLTFADAKISVLEYDDSIHGLRTSSLHCFEGPEWLHLKRGREQFARGPVVKVDPQGRCGGVLIYDLQMIILKATQAGSGLVGEDDALGSSGAVAARIESSYMINLRDLDMRHVKDFTFVHGYIEPVMVILHERELTWAGRVSWKHHTCMISALSISTTLKQHPLIWSAVNLPHDAYKLLAVPSPIGGVLVISANTIHYHSQSASCALALNSYAVTLDSSQEIPRSSFNVELDAANATWLLSDVALLSTKTGELLLLTLVYDGRLRLHSNWHMIGMSFTLRKENLTIVSTPDNYFQHYFNVLFPVPHFLSLYHLMLLLWKWKVFLLKALSGLYRDLIFPSQKLQFCHLRLGDSMLVQFSCGSGVSMLSSNLKEEVGDIEADAPSKRLRRSPSDALQDMVSGEELSLYGSAPNRTESAQKSFSFAVRDSLINVGPLKDFSYGLRINADANATGIAKQSNYELVCCSGHGKNGSLCVLRQSIRPEVITEVELPGCKGIWTVYHKSTRSHNADSSKMADDDDEYHAYLIISLEARTMVLETADLLSEVTESVDYYVQGKTLAAGNLFGSHGLLPVAGETETTAESPVTYSADDPPSGAPAAHLPNAVNGATIRHQKRPHARFLGVSNSINFGSSTSMSCHHSGLAFGN

SEQ ID NO: 202580 - protein, 265 aa, Glycine max
  Coding DNA Sequence Number=SeqID_85802
  Gene Ontology: Mol. function=protein binding; Biological process =protein metabolic process
  Homolog annotation: Hit_ID=Q10P51; Match level="QueryCoverage=91%, HitCoverage=90%, E-value=4e-54, Identity=48%"; Hit description=Clp amino terminal domain containing protein, expressed
  Pfam annotation: Domain name=Clp_N; Domain location=210-262; Score =11.6; E_value=0.057; Accession=PF02861.11; Description=Clp amino terminal domain
  Subcellular localization annotation: CTP_CleavageSite=58; ConfidenceScore=5.84e-01
MASIPTLSSTLPTLSAHSLSHSNPNNHCTLPPTSLFGTRITLLRATSSSHSLPNTNCRATSATVSFSLPTPKPLSDTPEKTPKWSERGIKSYAMGELEARKLKYPNTGTEALLMGILVEVIAMKTSPSIRTWLPYFMVYTLPITNWMNAPCCIDMDIGTSNAAKFLRANGITLLKVREETVGLLGKSDLFFFSPEHPPLTEPAQKALDWAIEEKLKSGEGGEINATHLLLGIWSQKESAGQQILATLGFNDEKAKELAKTIGGDV

SEQ ID NO: 202581 - protein, 966 aa, Glycine max
  Coding DNA Sequence Number=SeqID_85803
  Homolog annotation: Hit_ID=UPI000065E8B3; Match level="QueryCoverage =23%, HitCoverage=15%, E-value=3e-12, Identity=29%"; Hit description =UPI000065E8B3 related cluster
MECWICLDDNHNSVVLACAKVVQCVLSYDANENYCNISEKIATCDMDICTAPVFRSRPDINDGFLQGGFWKYSAKPSNILPFSDDSMDNETEGKHTIQDDIVVAGQDFTVGLVRMGILPRLRYLLETDPTTALEECIISVLIAIARHSPTCANAVLKCERLVQTIANRYTAENFEIRSSMIRSVRLLKEVISASSARESFLMFHLILEKVLARSDRKSCLEFIKKGYFQAMTWNLYQSPSSIDHWLRLGKEKCKLTSALIVEQMRFWRVCIQYGYCVSYFSEMFPALCFWLNPPSFEKLVENNVLDESTSISREAYLVLESLAGKLPNLFSKQCLNNQLPESAGDTEVWSWNYVGPMVDLAIKWIASRNDPEVSKFFEGQEEGRYDFTFRDLSATPLLWVYAAVTHMLFRVLERMTWGDTIETEGHVPWLPEFVPKIGLEVIKYWFLGFSASFGAKCGRDSKGESFMKELVYLRQKDDIEMSLASTCCLNGMVKIITAIDNLIQSAKASICSLPCQEQSLSKEGKVLEDGIVKGCWVELRYMLDVFMFSVSSGWHRIQSIESFGRGGLVPGAGIGWGASGGGFWSATVLLAQADARFLVYLLEIFENASKGVVTEETTFTIQRVNAGLGLCLTAGPRDKVVVEKTLDFLFHVSVLKHLDLCIQSLLLNRRGKTFGWQHEEEDYMHLSRMLSSHFRSRWLSVKVKSKSVDGSSSSGIKTSPKVGACLETIYEDSDTSSVTTPCCNSIMIEWAHQKLPLPVHFYLSPISTIFHSKRAGTKIVDDVLHDPSNLLEVAKCGLFFVLGVEAMSIFHGTDIPSPVQQVSLTWKLHSLSVNFLVGMEILEQDWSRDIFEALQDLYGELLDNARLNQSKEVISDDKKHLEFLRFQTEIHESYSTFLEELVEQFSAVSYGDVIFGRQVSLYLHRCVETSIRLAAWNTLSNSRVLELLPPLEKCFSGAEGYLEPAE

SEQ ID NO: 202582 - protein, 386 aa, Glycine max
  Coding DNA Sequence Number=SeqID_85804
  Gene Ontology: Mol. function=microtubule binding; Cellular component =phragmoplast; Biological process=positive regulation of microtubule polymerization
  Homolog annotation: Hit_ID=Q6L4A9; Match level="QueryCoverage=87%, HitCoverage=57%, E-value=1e-74, Identity=43%"; Hit description =Putative microtubule-associated protein, identical
  Pfam annotation: Domain name=MAP65_ASE1; Domain location=1-386; Score= -165.6; E_value=0.00095; Accession=PF03999.3; Description=Microtubule associated protein (MAP65ASE1 family)
MEFKSVAGICSAMGERPVHVRQFDQKAVSLKEELARVCPELEEMQERKSERRNQFIEVQEQIQSITNEIYSPSITASVDETDLSLRKLEEFQTAFCISKGEVSASRSFKTDQLTTLNSLCSVLVLDLADTPRSSFNNVGALEFDGYTSGRATDGEAEVYTLEELKSSKMKELVLKKRAELEEICQKTHLIPEIDSAVKYVVEATESGSVDPAIVLEQIELQIAQVKEEAFVRKEILEKVEKWLSACDEEYWLEEYNSDENRYNAGRGSYLTLKRAKKACALVKKLPAMVDALTSKTVASEKDKGIEFTYDGNYSLSRQEKEQERCRQWELKKLQGQIIVEKEVEAKATSQLVDFPIISSQYIKHSFDLEEENIAGVPMRKYSTGAG

SEQ ID NO: 202583 - protein, 81 aa, Glycine max
  Coding DNA Sequence Number=SeqID_85805
MVKLGYLRLTMSEMMGTNGNNLHIWARRARARPAELPSTFVAPTPASTSEAPSIPAQSDSQCFEAMLWSIHQEQIMLLQSL

SEQ ID NO: 202584 - protein, 567 aa, Glycine max
  Coding DNA Sequence Number=SeqID_85806
  Pfam annotation: Domain name=RPAP1_C; Domain location=452-527; Score =32.2; E_value=3.9e-09; Accession=PF08620.1; Description=RPAP1-like, C-terminal
  Pfam annotation: Domain name=RPAP1_N; Domain location=332-380; Score =60.9; E_value=4.2e-15; Accession=PF08621.1; Description=RPAP1-like, N-terminal
  Pfam module annotation: Pfam domain module=RPAP1_C::RPAP1_N; Domain location=452-527::332-380
MNYDKEIRHRERKKGKGIEVGDESVKQMNKEKEKKMTAVCCAMDNQKKGKGGDQPKKLAKVLNTSSLQINEKDAFQLVGSIVEKGISDSHNNPTTTPPFHFFPKPTVLPFPVARHRSHGPHWRPLSSRGDDDGEDDDSDNNVKDEEDKNLQEFEKVSAFAKPVQRRRKKGLDFRKWKEITRDDSSSFGKESEKDVSSFSQTTGKKKNEKGSKSTYKKTSSLDDNVISPMKVDTKPLLDNSDGGFINSTTTMEVDTLNKVDHEEKVKHARIYDDKEQNESVPGLDQISSDWMPDYNFGSLDVQRPGQTDLNSSMLSCSSSNSIRSEQKSVSLDSEIDAENRARIQQMSAEEIAEAQTEIMEKMSPALLKLLQKRGQNKLKKLKLEVDIGSESVNGHAQSPQDAKHLHTEDGIAQTVIVPPSKEKLDDEKISTKTSTTASSSAWNAWSNRVEAVRELRFSLVGDVVDSERVSVYDNANERDYLRTEGDPGAAGYTIKEAVALTRSVIPGQRTLALHLLSSVLDKALHYICEDRTGHMTKIENKVDKSVDWEAVWAFALGPEPELVLSLR

SEQ ID NO: 202585 - protein, 240 aa, Glycine max
  Coding DNA Sequence Number=SeqID_85807
  Gene Ontology: Mol. function=DNA binding; Cellular component =mitochondrion
  Homolog annotation: Hit_ID=Q6ZJ55; Match level="QueryCoverage=75%, HitCoverage=37%, E-value=2e-34, Identity=49%"; Hit description =Putative AT-hook protein 1
  Pfam annotation: Domain name=DUF296; Domain location=1-109; Score =153.8; E_value=4.6e-43; Accession=PF03479.5; Description=Domain of unknown function (DUF296)
  Subcellular localization annotation: CTP_CleavageSite=53; ConfidenceScore=5.09e-01
DVTMKIMSFSQQGYRAICILSANGTISNVTLRQPTSSGGTLTYEGRFEILSLSGSYITTENGLTKSRSGGMSISLAGPDGRVMGGGLAGLLVAAGPVQSFDGLSCAISTKKKNKDRAHALKELNYMYEEHFTGHFSCHLLHQVVVASFLPGHQLEQQKPKKPRVEHIISMAAPMHVNPTSAAEEIRIGLGGVKPIMTPAAFQVDHIFGNGQSSGNSASDDSASFPENESNPSHADAGVAC

SEQ ID NO: 202586 - protein, 226 aa, Glycine max
  Coding DNA Sequence Number=SeqID_85808
  Subcellular localization annotation: CTP_CleavageSite=15; ConfidenceScore=5.17e-01
MAESNPHFSDDTPSPASSVDSPSPPPTFNGIVMVSQPDTQDVFHTPPEDSSLHSSDNGGVERCAVNLAVDVDAVSQGFVNFCDGSKFVDSGKDSDFLGFSEVQPTQEKNVGESIMGSSEGKLVSEVNDISVKNNCSGKVACTADGVVEASGMLKSRRSKNEAATGTERGGNNSEKWNVFDVLRVFSQNNDDVEENHDHLSLLDVAKAHGVTFPRPRWWPDDDKFEP

SEQ ID NO: 202587 - protein, 722 aa, Glycine max
  Coding DNA Sequence Number=SeqID_85809
  Homolog annotation: Hit_ID=Q1T192; Match level="QueryCoverage=16%, HitCoverage=30%, E-value=4e-11, Identity=32%"; Hit description =Polynucleotidyl transferase, Ribonuclease H fold
MSSFLSDSAIGLGNNDSRGSNEQPIMDREVISISGSSFKDTYQGASDSESSSSERPVPITVILPRSASGGVRRASSGGDNATNSTKVFLQRILTILEKNGLWYQEAVQKAIRVNHQMTSKVGGALAKLLRTRLDGDNLFRCCKSLYAEKMDLGGKVESMAVRLKELESKLEESLLRAAKEKEASNELEEELILYRKEANFFAKGLDLGLFDPFKDVNKGVLLDEDEIDAEEEAADETHGAAEQGDDAYHGGLVKSRMTWSHLSFSPDGCEELFLICPWLKVLPNQCRDRLLDLLSSSSDDYEEVDLLYLEFPWGWNLVLERASPRVNLGYVESWTRDVAELGFDKSCVQHKYRALAYTTLAMGDMYWRQTCLLLYTCLLQNGKYWRHGGVNQWDSPRVNLRFCEPFEGLTRELSNLGFGHRALAYMSLAVGGTHWRRGDMLLHICHSLWVTYTGVMIHQDDTLLRVCHSSWVAHTGVVVVICSCMYATCHGWYTLEAYYDAHAHMSLVVGDMWVVFHVRGIALPSNSCSRYAPLSRTFPVGAKLSCSGIFSGFILDSPYEVVGLNSSLLVNGSPTSTGIMASVPYALRLVKCSLQGPEDDSISCLFLLDFELGVVIGDNGVWEAVPGDELLGPLSVVPVCSFPTRRRAKGSIDGEGSCTTTVARERLPGCCLPSFEKFAIKDGVVADLLFEGVRLRPRLVHCGSLERLLDDDLEVLDLLGIG

SEQ ID NO: 202588 - protein, 156 aa, Glycine max
  Coding DNA Sequence Number=SeqID_85810
MKNQFVADFLVQCVGNNTTTPNWWTFYVDSASNVKGSRARIILEGLDNVTLEQALKPNFRALNNQAEYKALIACCQHIPDQGNSVAQVLSHSDEDMTKSNGKDPLEGLGGPMTRVRARKAKEALQQVLSTLFEYKPKFQGEKSKVVSCIMAQMEED

SEQ ID NO: 202589 - protein, 195 aa, Glycine max
  Coding DNA Sequence Number=SeqID_85811
  Gene Ontology: Mol. function=metal ion binding
MVAAERLKLFLCKRRRGLRILLRVAFWWWVVLLLVNPVAGLRPLRERTRSWDDEGLFTRKEESNLGPFSQWNITGTYKGTWKFLDITNGSSRFPDIRKTNGNSVIELVSTPTKMSGVHYVQGVVMFHDVFDNEYDVGGSQVRIEGVYIWPFRQLRMKISVCNEIGMLSEPAEGHGLRLLKVKYIEACWPSPHIYN

SEQ ID NO: 202590 - protein, 58 aa, Glycine max
  Coding DNA Sequence Number=SeqID_85812
MEPPKDSHDTTAHNHKREVTSFLVAPWHTTTEVVGEKRSTIDRGVCGSGVFGLEPMDE

SEQ ID NO: 202591 - protein, 591 aa, Glycine max
  Coding DNA Sequence Number=SeqID_85813
  Gene Ontology: Mol. function=zinc ion binding; Cellular component =cytoplasm; Biological process=protein amino acid methylation
  Homolog annotation: Hit_ID=Q0KIN0; Match level="QueryCoverage=43%, HitCoverage=18%, E-value=4e-60, Identity=44%"; Hit description =Integrase core domain containing protein
MPDSFLMPSPIKDSDLSSDLNWPIAMRKGTIDQFKARLVAKSYTQVYGQDYTGRGLYGATIRFCCSGRIIEHAIWYDSHEADHSVFYCHSPQGCIYLIVYVDDIGITDLGKLRYFLGIEVAQSKDDPSVKLSPDQREPFSDPGRYRRLVGKLNYLTVTRPDIALHVPGKGLIYEDKGHSQIIGYSDADWVGSPSDRWSTSGYCVLIGGNLISWKSKKKSVIARSSVEAEYRAMALVTCELIWLEQLLRELKNNECPACRTHCASRRSLRDDPNYDALIAALYPDIEKYEQEELEFREEEKNRNKQIQASIAKVVQRQSEALVKRRKDTPGAFVTRPQRNQRNIHSRRQTQAIEGSEDNEEENDNNEKDSSSADERSTEHRQRRRKRWARVRPSQPSSSMASPDGGCNDSDMDISKENRGISRQVSKHGKLTWGRGGFRSNTRHGSGGGSNNKSSRSSRLSKFVDHLRNLDENTDEFDVHLMLVSLDQLSTPSLQQPYLCCRPTLSVKHLYEHVARQTPLPVEGIEIVAVKGCCSTNCDKSADENSALAYDELSKLVIDPHKDELEILQGHETLAGLRSKCISKMGHLVSVK

SEQ ID NO: 202592 - protein, 217 aa, Glycine max
  Coding DNA Sequence Number=SeqID_85814
  Homolog annotation: Hit_ID=Q5SMM0; Match level="QueryCoverage=40%, HitCoverage=18%, E-value=7e-34, Identity=78%"; Hit description=LIM domain containing protein-like
MDFGAWLFLKYKGEGLFKIKVFDFILNEVHATAPWPFYHSYKNQLPTRVWFNDQWHYTLDEGAGLHVTYEARGRFKIKIEQQVPMLLVERQALNEAMEGEKNGHHHLPETRGLCLSEEQTVPTILRRPRIGAGYQLIDIITEPFRLVRRCEVTAILVLYGLPSVVATCPSRARLSGALSKGGKMRGVATNVYLWKTSEKPKETGQNENSKFGSCIYT

SEQ ID NO: 202593 - protein, 278 aa, Glycine max
  Coding DNA Sequence Number=SeqID_85815
  Homolog annotation: Hit_ID=Q0KIN0; Match level="QueryCoverage=17%, HitCoverage=2%, E-value=6e-08, Identity=59%"; Hit description =Integrase core domain containing protein
MEKSLSCFNKVPIFALRNPILLSVGTRCLTKDAFGCHKRLKLMRETADGDWEPFSKVSVDQDVQIEHESLTEKWWKSTLAASQRDNIGHVKWTISYKKDRLNSEGWKKVCGTNALGLCLRPIGRGPKEDEGKMQAIDLPVCATKSTTPVEWNHLKMFELHWQGEMVYHVASNTDQYYARTDVSTMVDSGTLDVGFDKIRSNTADVDCIVGAIGRQDHNWKHGRKGSRMCRHAPGIGVVWCVKGETRENSNGETSRTVGPSAGNVTGKVFPKATTVVGK

SEQ ID NO: 202594 - protein, 125 aa, Glycine max
  Coding DNA Sequence Number=SeqID_85816
MQTNYKSNGGIQKIQTQQLKWYEQASPLYTAKGNPSHPETEMAKFTRSHDPETEAWNQNVNPKKLNNKTQNKKFGNNARSRESKARRWGFVGICQEKRRNLEHTKKRKGKTKPNPVEKNQLGHRT

SEQ ID NO: 202595 - protein, 658 aa, Glycine max
  Coding DNA Sequence Number=SeqID_85817
  Gene Ontology: Mol. function=ATPase activity, coupled to transmembrane movement of ions, phosphorylative mechanism; Cellular component=integral to membrane; Biological process=phospholipid transport
  Homolog annotation: Hit_ID=P98205; Match level="QueryCoverage=98%, HitCoverage=69%, E-value=0.0, Identity=70%"; Hit description =Putative phospholipid-transporting ATPase 2
  Pfam annotation: Domain name=Hydrolase; Domain location=261-583; Score=2.1; E_value=0.032; Accession=PF00702.16; Description=haloacid dehalogenase-like hydrolase
DVHVGNIVWLRENDEVPCDLVLIGTSDPQGVCYIETAALDGETDLKTRVIPSACMGIDVDLLHKIKARSFLKYLCLGVIECPYPDKDIRRFDANMRLFPPFIDNDICPLTIKNTILQSCYLRNTEWACNETKMGMCRGIPEPKLTAMDAMIDKLTGAIFIFQIVVVLVLGIAGNVWKDTEAKKLWYVLYPHEGPWYELLVIPLRFELLCSIMIPISIKVSLDLVKSLYAKFIDWDHQMIDLETSIPSHATNTAISEDLGQVEYILTDKTGTLTENKMIFRRCCISGNFYGNENGDALKDVELLNAVSSGSSDVVRFLTVMAICNTVIPTQSKTGDILYKAQSQDEDALVHAASRLHMVYFNKSGNILEVKFSTSILQYEVLETLEFTSDRKRMSVVLKDCQNGKILLLSKGADEAILPYARAGQQTRHFIEAVEQYAHLGLRTLCLAWRELKRDEYREWSLMFKEASSTLVDREWRVAEVCQRVEHDLEILGVTAIEDRLQDVAFVVDGWALEIALTHYRKAFTELAVLSRTAICCRVTPSQKAQLVQILKSCDYRTLAIGDGGNDVRMIQQADIGVGISGREGLQAARAADYSIGSVSGTSLFNSVSLMAYNVFYTSVPVLVSVLDKDLSEETVMQHPQILFYCQAGRTIKKFISTE

SEQ ID NO: 202596 - protein, 67 aa, Glycine max
  Coding DNA Sequence Number=SeqID_85818
MHSSTPRIKLLLRKQDEIAVAAQCHLGEGFAGVVAAVATEVARERKEMLNGERVGGVRVSPGIDREQ

SEQ ID NO: 202597 - protein, 114 aa, Glycine max
  Coding DNA Sequence Number=SeqID_85819
MAMTRVMQGLVLCTLLLSAVLVQEVEARVISKEAMQRNTIPGCSKVHPNVAACHLPLVNINYRRGCTDVSKYTDIFGTEMREIATGLVDEGRQLNLSTLKEAMYTMKLRHWLRA

SEQ ID NO: 202598 - protein, 101 aa, Glycine max
  Coding DNA Sequence Number=SeqID_85820
  Gene Ontology: Mol. function=transition metal ion binding; Cellular component=cytoplasm; Biological process=cytoskeleton organization and biogenesis
MGMKYQKIHACPNDCILYIDEFEEMHKCPKCRVSWYKVKDDERSSDESTKEGPPTKVLWYLPIIPRFRRLFANKDDAKDLTWHADGRNYDGMLCHLADSSQ

SEQ ID NO: 202599 - protein, 91 aa, Glycine max
  Coding DNA Sequence Number=SeqID_85821
MKLVDDGSFQQTPQKDVEEEDRVDADISQAEKKTKNKMNAPLSKASPAPHRPSPTLVAPKATGAMAHVSKMVAPKKQQPFLDWVLSSFMDC

SEQ ID NO: 202600 - protein, 270 aa, Glycine max
  Coding DNA Sequence Number=SeqID_85822
  Gene Ontology: Cellular component=endoplasmic reticulum
  Homolog annotation: Hit_ID=Q1RY25; Match level="QueryCoverage=97%, HitCoverage=74%, E-value=2e-51, Identity=44%"; Hit description =Reticulon
  Subcellular localization annotation: CTP_CleavageSite=61; ConfidenceScore=5.25e-01
MDSSSHQQNPCLLIADKQTQHQDHPLPLSPLATPTKSPSPAVPRNTSPPPEFPDSAGVRRRCKTRAPQTASPRNPRKSRRRSELEIREEKDSIFLEEVGKPRKRRQTARTKKEKPNSAPPSTPSPKSEEENGGDFDRVGQVVSDLIMWKNSSKSTFWFGFGSLCLVSSCFTQGLNFRNEVEEKREIKLKEDDISRLAKLILPALNFALSRMRALFSGEPSMTLKVVPFLLLGAEYGHLITIWRLISCQLQCPQALFLLHCSDKPERHEST

SEQ ID NO: 202601 - protein, 176 aa, Glycine max
  Coding DNA Sequence Number=SeqID_85823
  Gene Ontology: Mol. function=DNA binding
  Homolog annotation: Hit_ID=Q5JML8; Match level="QueryCoverage=89%, HitCoverage=87%, E-value=5e-31, Identity=51%"; Hit description=DNA -binding protein-related-like
  Subcellular localization annotation: CTP_CleavageSite=51; ConfidenceScore=5.53e-01
MATPATTKRKPVFVKVDQLKPGTNGHTLTVKVVSSKPVKTVSTRVGRPTVLAAHPARIAECLVGDKTGTIIFTARNEQEKIIRLKHGNQVPVGYVDCALNGIHVINSNITSGQVDHMNAGATVILRNAKIDMFKGSMRLAVDKWGRIEPTDPANFDVKEDNNLSLVEYELVNVVEE

SEQ ID NO: 202602 - protein, 106 aa, Glycine max
  Coding DNA Sequence Number=SeqID_85824
MLGFTRNSPQISASPYQLDFTLYASGSYNAQWNAPGLLHDKHTLRSSRILRKVKVDEPWLGLWLPLNYQVDMGASFLAAKFTSWLVFLVCAKGGVRHWKYGRQTLW

SEQ ID NO: 202603 - protein, 96 aa, Glycine max
  Coding DNA Sequence Number=SeqID_85825
MDKVDIFVPHPLTNACLLIQLSPECGYKPLVCLLKQPALLSVDFQDRSIRDYSSCTLVGINNAHRDNPFPCVQESSTTRDPRSLNPFSEIRRRNLS

SEQ ID NO: 202604 - protein, 115 aa, Glycine max
  Coding DNA Sequence Number=SeqID_85826
MDQLGSCPQDAQSTRRSPTGPWGFQLWLRAFVVLQGARFPPADGLVGLCRHDIGIAPTKTPSGPEEVQQGPGVSSSGYGPLSVLQGARSPSEESHPQRHPVDPEKSNRALGFPAL

SEQ ID NO: 202605 - protein, 172 aa, Glycine max
  Coding DNA Sequence Number=SeqID_85827
  Gene Ontology: Mol. function=chitin binding; Cellular component =extracellular region; Biological process=chitin metabolic process
  Homolog annotation: Hit_ID=UPI00006A17C9; Match level="QueryCoverage =88%, HitCoverage=100%, E-value=2e-22, Identity=33%"; Hit description= UPI00006A17C9 related cluster
TLTFRGLYVLTFRGLHVLPFGGLHALVFRGLHVLTIRGLHALTFRGLHVLAIRGMHILIFRGPNILIFRGLHVLTFIGLHALTFIGLHVLTFIGLHALTFIGLHVLTFIGLHALTFRGLHVLSFRGLHVLHFRGLHILHFRGLHVLAFRGLHALAFSGLHIRTLSEFKVLFP

SEQ ID NO: 202606 - protein, 122 aa, Glycine max
  Coding DNA Sequence Number=SeqID_85828
  Subcellular localization annotation: CTP_CleavageSite=69; ConfidenceScore=5.75e-01
MASTAGAAARSIFRSCSARRAAFRLGSDAKAARSPFRVASNKPLSQSTLRCPVELSFCVESMLPYHSATASALMTSMLSVSRHSYGWLPEGIVCAPTALQREDYLKIKKQGWDDMDLFDVGL

SEQ ID NO: 202607 - protein, 220 aa, Glycine max
  Coding DNA Sequence Number=SeqID_85829
  Homolog annotation: Hit_ID=Q9XFD1; Match level="QueryCoverage=16%, HitCoverage=14%, E-value=6e-09, Identity=77%"; Hit description =Nuclear cap-binding protein
MRFINDLSGQGGYGKLVQKELEVQRQLVDYGTGSLGSFPPVIPTSSPTVRILLSSLSVVHSCILKLCSNLQYEEIAQIDTFNSQYLLHCMFSYLNQKFKLSLCITKFNGRHGGGHGHGGSHRHGRGSFILSSHDKDNITIGRDTEMMTATYTSPQKEILIMNLGGTLTTNPDRKKIHGFVRVVILMMTRKMIEKDGLNQNFMLDQVVLNLNISTDIIKGG

SEQ ID NO: 202608 - protein, 299 aa, Glycine max
  Coding DNA Sequence Number=SeqID_85830
MASFGNQLSFFLLLVLVISPQIQAREGKLFSLFSHFRTIYNVRDPLDKTKAESPALAPEPALEPASAAPTPEPETAPTPAPSAEQEIGSTIPSGPAPEPEFFDSGEAYGLYGRGSYSQYPPTKETPTATTTFQNALLNEDVNEESYKTGYPKSNFYNNNNEEYNNNHNTREEYRNSYIGGYSNNNYNEKENYYNNNNNYNGKENYYYYNNNNNNNNNNNYNGNGYEEKREGMSDTRSLENRNYYYHVNSVNENYNLNGYESGRGRTTENEGYYEKSQYPNEFDTMEEYEKQQEEQGYTP

SEQ ID NO: 202609 - protein, 108 aa, Glycine max
  Coding DNA Sequence Number=SeqID_85831
MQKKKECKKRETNDDDDDELREAFSSMYDKSGGSGDNNSCGGCGSNGGGDGSSSSNTDNNNDNDYNNNDEDGVKRVTRKGRAQGGGGGRTLPKEGVIIGPIVDPIKVS

SEQ ID NO: 202610 - protein, 290 aa, Glycine max
  Coding DNA Sequence Number=SeqID_85832
  Subcellular localization annotation: CTP_CleavageSite=36; ConfidenceScore=5.71e-01
MLPVVSGLARPTRSTNHPFTSRLSVPFALSPNLSLMASKKKRASSSCPQESYDSSHFVSEEAWDRYQTNVHLWNILPKRNIELAYLNYDEFLHKLVRRHWHRHLTYQMENRIDVALVKEFYTNLYDPEDLSPRQCKTWSVLSYSKLAPTFHTSDLNMDRARLVYGLVIKMNMDVGTMISSQISQIDQSNSSRLGFSTLIIALCEARGVVSNFLTFESLSLTINLAYIHKNCWNPADPSITFLRSRKARTTTLAEAPPVAPPPPRPSASSFSSTPPDQLVPMLQSIHDGSA

SEQ ID NO: 202611 - protein, 137 aa, Glycine max
  Coding DNA Sequence Number=SeqID_85833
MYNYYVKGRAPDLESVLADFMTYQASSKGDCYSMQQQGTQFERDYSFVDYQWESEWQPYYHNEAEGLSNLNDLLMQFIDDMTKVMDRREEEYAKIEAHQENILQVTTIHHQLINEEEKDEVSSTPKYPCMEIAGYVI

SEQ ID NO: 202612 - protein, 114 aa, Glycine max
  Coding DNA Sequence Number=SeqID_85834
MENPVTTRWKPLRGTECVLPVKERPNDLQMDVLMLCPYENHMDVRSLAQQSLFSSFIICETNVRPYHSEKELILDSVKSYTKLAGSQRYARRHDSSSTHATSSKIVAGGISNLV

SEQ ID NO: 202613 - protein, 91 aa, Glycine max
  Coding DNA Sequence Number=SeqID_85835
MGCYNKGHSGTRGGFGSHEKTVGFMGKRLEIPRHVNPQVAALIELCWATVGVVAQAKQVLIDQAGHKQHRQRGPKEESQLLEGSRISCERC

SEQ ID NO: 202614 - protein, 111 aa, Glycine max
  Coding DNA Sequence Number=SeqID_85836
  Homolog annotation: Hit_ID=Q93XL9; Match level="QueryCoverage=60%, HitCoverage=8%, E-value=4e-10, Identity=46%"; Hit description=CTR1 -like protein kinase
MTGPAVNHSGRMDLQQIEALGANYAGGNNHLITLICGAEEYESFNEVDRSIMDYPSHEVDLDEEDLDIPWSELILKENIGTGSFGTFLRADWRGSIRISLFNSLHIHLSIF

SEQ ID NO: 202615 - protein, 615 aa, Glycine max
  Coding DNA Sequence Number=SeqID_85837
  Gene Ontology: Mol. function=protein serine/threonine kinase activity; Cellular component=integral to membrane; Biological process=protein amino acid phosphorylation
  Homolog annotation: Hit_ID=O82432; Match level="QueryCoverage=98%, HitCoverage=92%, E-value=0.0, Identity=47%"; Hit description=Leucine- rich receptor-like protein kinase
  Pfam annotation: Domain name=LRR_1; Domain location=122-144; Score =9.2; E_value=5.5; Accession=PF00560.23; Description=Leucine Rich Repeat
  Pfam annotation: Domain name=LRR_1; Domain location=146-169; Score =15.8; E_value=0.16; Accession=PF00560.23; Description=Leucine Rich Repeat
  Pfam annotation: Domain name=LRR_1; Domain location=171-193; Score =15.7; E_value=0.17; Accession=PF00560.23; Description=Leucine Rich Repeat
  Pfam annotation: Domain name=LRR_1; Domain location=194-215; Score =14.3; E_value=0.45; Accession=PF00560.23; Description=Leucine Rich Repeat
  Pfam annotation: Domain name=LRR_1; Domain location=2-24; Score=8.4; E_value=7.7; Accession=PF00560.23; Description=Leucine Rich Repeat
  Pfam annotation: Domain name=LRR_1; Domain location=26-48; Score =13.7; E_value=0.66; Accession=PF00560.23; Description=Leucine Rich Repeat
  Pfam annotation: Domain name=LRR_1; Domain location=50-72; Score=5.2; E_value=31; Accession=PF00560.23; Description=Leucine Rich Repeat
  Pfam annotation: Domain name=LRR_1; Domain location=74-96; Score =14.0; E_value=0.54; Accession=PF00560.23; Description=Leucine Rich Repeat
  Pfam annotation: Domain name=LRR_1; Domain location=98-120; Score =8.7; E_value=6.7; Accession=PF00560.23; Description=Leucine Rich Repeat
  Pfam annotation: Domain name=Pkinase; Domain location=308-582; Score =140.9; E_value=3.3e-39; Accession=PF00069.15; Description=Protein kinase domain
  Pfam annotation: Domain name=Pkinase_Tyr; Domain location=308-582; Score=74.3; E_value=4e-19; Accession=PF07714.7; Description=Protein tyrosine kinase
  Pfam module annotation: Pfam domain module=LRR_1::LRR_1::LRR_1::LRR _1::LRR_1::LRR_1::LRR_1::LRR_1::LRR_1::Pkinase::Pkinase_Tyr; Domain location=122-144::146-169::171-193::194-215::2-24::26-48::50-72::74 -96::98-120::308-582::308-582
GALEELILIDNSFSGRISESLGECKSLRRVRLRNNNFSGVVPEGLWGLPHLYLLEFVENSLSGSISNSISGAWNLSILLISGNKFSGSIPEGVGELGNLEAFVADHNSLTGRIPKSVVRLSQLDRLVLRDNQLFGEIPVGVGGWRKLNELDLANNNRLNGSIPKELGDLPVLNYLDLSGNRFSGEIPIKLQNLKLNLLNLSNNQLSGVIPPLYDNENYRKSFLGNPGLCKPLSGLCPNLGGESEGKSRKYAWIFRFMFVLAGIVLIVGMAWFYFKFRDFKKMEKGFHFSKWRSFHKLGFSEFEIVKLLSEDNVIGSGASGKVYKVALSSEVVAVKKLWGATKKGNGSVDSEKDGFEVEVETLGKIRHKNIVKLWCCCNSKDSKLLVYEYMPKGSLADLLHSSKKSLMDWPTRYKIAIDAAEGLSYLHHDCVPSIVHRDVKSSNILLDDEFGAKVADFGVAKIFKGANQGAESMSIIAGSYGYIAPEYAYTLRVNEKSDIYSFGVVILELVTGKPPLDAEYGEKDLVKWVHSTLDQKGQDEVIDPTLDIQYREEICKVLSVGLHCTNSLPITRPSMRSVVKMLKEVTELPKSFSGKLSSPYFQEETSDIDHQGSLV

SEQ ID NO: 202616 - protein, 45 aa, Glycine max
  Coding DNA Sequence Number=SeqID_85838
MTQCSYPENNHSIIVERHKDSLIRTCPTCGHHVKCQEQFEFNDLR

SEQ ID NO: 202617 - protein, 65 aa, Glycine max
  Coding DNA Sequence Number=SeqID_85839
MVGYAPSSFADLVFIGERIEVEDENEEGTHVEVVIPTWPNFPPAQQCHYSANNLKMDRLRMQKKQ

SEQ ID NO: 202618 - protein, 71 aa, Glycine max
  Coding DNA Sequence Number=SeqID_85840
MDFILGILNRIAGERKPKYLVKKENHNFGNLDDDESELIVVPVEVEDDDESELIVVPVEVEDESELMVAVV

SEQ ID NO: 202619 - protein, 215 aa, Glycine max
  Coding DNA Sequence Number=SeqID_85841
MPKDTLYTEGHRRSTAFVDFHVLVFFLKNHNLLTIPKMSITSPAPLGMVRNRIMSQHYTLQFIATFHNDKWPPYYPDFARFDYDRASYQIRLRQDQGRLFFADGLKHLRKHLGIYESVTINFMACEHRRIFNLHFTPPLEQQACDRPLLAARMHVWTLELTQSLLGDPKPLVLPPLAAIHLPSCGFHMTILRKFDPPLQWPVLPVGPGFHDKRVA

SEQ ID NO: 202620 - protein, 440 aa, Glycine max
  Coding DNA Sequence Number=SeqID_85842
  Gene Ontology: Mol. function=nucleic acid binding; Cellular component= intracellular; Biological process=regulation of transcription
  Homolog annotation: Hit_ID=Q9FFH3; Match level="QueryCoverage=98%, HitCoverage=90%, E-value=1e-104, Identity=50%"; Hit description =Similarity to zinc finger protein ID1
  Pfam annotation: Domain name=RS4NT; Domain location=84-121; Score =12.7; E_value=0.062; Accession=PF08071.2; Description=RS4NT (NUC023) domain
  Pfam annotation: Domain name=zf-C2H2; Domain location=126-147; Score =17.5; E_value=0.05; Accession=PF00096.16; Description=Zinc finger, C2H2 type
  Pfam annotation: Domain name=zf-C2H2; Domain location=23-45; Score =23.9; E_value=0.00056; Accession=PF00096.16; Description=Zinc finger, C2H2 type
  Pfam annotation: Domain name=zf-C2H2; Domain location=99-121; Score =21.4; E_value=0.0033; Accession=PF00096.16; Description=Zinc finger, C2H2 type
  Pfam module annotation: Pfam domain module=RS4NT::zf-C2H2::zf -C2H2::zf-C2H2; Domain location=84-121::126-147::23-45::99-121
MVNDPDAEVITLSPKTLMATNRFVCEICLKGFQRDQNLQLHRRGHNLPWKLKQRTSKEVRKRVYVCPEKTCVHHHPSRALGDLTGIKKHFCRKHGEKKWRCEKCSKRYAVQSDWKAHSKTCGTREYKCDCGTIFSRRDSFITHRAFCDALAEQTARVNAASNISNYSIMQNPVGSDMATHFSSFFKPNSCPDQEPAPGNQTSNKGLSLWMTQTSQAHHETMVNNNNLHEFYQLGSVTSPTAIYGTSGNPLASCSNPPPSNYQLNWVLGNKLSTNGSHQELTSTASLPLVNNIVKDNPNLQLISVPSLYSSQHQSHQTTSANMSATALLQKAAQIGTTSSDPSSLFLASIGLKCNSPGQDGNKFCGMYGSSSVLTSHWSEAENNNNNNNNHNHSGDLSQMPPTKRLHVQNEESAWGQTRDFLGVGAANHLPPFINQRMDLS

SEQ ID NO: 202621 - protein, 156 aa, Glycine max
  Coding DNA Sequence Number=SeqID_85843
  Homolog annotation: Hit_ID=Q9FFH2; Match level="QueryCoverage=100%, HitCoverage=92%, E-value=8e-45, Identity=46%"; Hit description =Arabidopsis thaliana genomic DNA, chromosome 5, P1 clone:MLN1
MKLTDSPGIELPVNDAVLSLQQDNGSMHVGTSVWPCSLVLANGPWNSARAAALRPILRKTLKHSVLYWNNPQQIAALNPPFDFAVATDFVYIRESVPSLVSAMETLVYDNGVVLLGYRLRSPEAHELFWELCERVFHVEKVPHEHLHPDYAYEETD

SEQ ID NO: 202622 - protein, 123 aa, Glycine max
  Coding DNA Sequence Number=SeqID_85844
MGSWWLLIFYKNPLKFQQERHSSGKGAKPFRPPNPTSDLGPITCGEDNADGDRASQIQICLFVSRDGKRKEELVKFVDAVIIVLSSSRISQTTFIGVSCCFTLMIIPEVGAANLGREEVTMEM

SEQ ID NO: 202623 - protein, 229 aa, Glycine max
  Coding DNA Sequence Number=SeqID_85845
MQERYVHYDAMKRCLCVKKVIWTFRLPVTKDEINIQRVRDDMMQTCKSATGGCIIPFNKHIVAIRTTSNNMLSKRKTLDEGSLLSSKSETQHDHRFTSTPYVPMDPGEKREVVAAQLAQTSRVASTRRHHLLLEPSGRPKWARRSSKGPMPTNNDPQTKLGGTETIKEKELVGLNDEGDVGARKEGDGVTKLGMGNTSCGIGNLIEYPHGATTDGEVLHWGVCSEVYEE

SEQ ID NO: 202624 - protein, 373 aa, Glycine max
  Coding DNA Sequence Number=SeqID_85846
  Gene Ontology: Mol. function=transcription factor binding; Cellular component=intracellular; Biological process=regulation of transcription, DNA-dependent
  Homolog annotation: Hit_ID=Q9FJH0; Match level="QueryCoverage=54%, HitCoverage=92%, E-value=9e-89, Identity=81%"; Hit description=GTP -binding protein, ras-like
  Pfam annotation: Domain name=Arf; Domain location=2-171; Score=-59.7; E_value=3.6e-05; Accession=PF00025.11; Description=ADP-ribosylation factor family
  Pfam annotation: Domain name=MMR_HSR1; Domain location=11-126; Score =7.9; E_value=0.00019; Accession=PF01926.13; Description=GTPase of unknown function
  Pfam annotation: Domain name=Miro; Domain location=12-126; Score =75.8; E_value=1.4e-19; Accession=PF08477.3; Description=Miro-like protein
  Pfam annotation: Domain name=Ras; Domain location=12-173; Score =323.2; E_value=4.5e-94; Accession=PF00071.12; Description=Ras family
  Pfam module annotation: Pfam domain module=Arf::MMR_HSR1::Miro::Ras; Domain location=2-171::11-126::12-126::12-173
MGADEDYDYLFKLVLIGDSGVGKSNLLSRFTRNEFSLETKSTIGVEFATRSVPVDSKLVKAQIWDTAGQERYRAITSAYYRGAVGALVVYDVTRHVTFENVERWLKELRDHTEAYVVVMLVGNKADLRHLRAVSTEEATEFAEKESIYFMETSALESLNVDNAFIEVLTQIYNVVSRKTLETVDDDPSTKALPKGETIVIGTKDDDVSAPPPWERTRAEGVAVRTCPSWAAEERARASPCRGWKQRGATRAVNRFRFGPGVGARSRPILVRTGGGCAGSGSAVVVVAVADEDAAMGFVGGGDGGIGSGRRRERRILVVWVGGVGFFVDVVEVNRGGCVDLGMDVDIGGLRAVEEGGVMCSCGGQGGVIRFEVA

SEQ ID NO: 202625 - protein, 265 aa, Glycine max
  Coding DNA Sequence Number=SeqID_85847
MRIANSHTQLIVDFIFLWRKPFFDLLVCFLERWWMAKNNKYASINFNHIYEKTNTTNPHNKNPSLSSSSASYSAVSAPNKPHGRILVLTRPTPKPITPSTPQPQQQQPPPPTPIQHNHPRSEPGSDAISLRPLGRTGTGSPLLSLPVVSSPDKDLPLLSPQPPKTDKFVPPHLRPGFVPREEAPPPGPELRPNGRPKSGGGPDRMRRVGPGGVSDAGSLDVVQSNENALGPVWIKFSIGDESNQHALEEEPKLLFFMVLRFVDVH

SEQ ID NO: 202626 - protein, 58 aa, Glycine max
  Coding DNA Sequence Number=SeqID_85848
MEEKEYREIHSGSNVNQDLSKRWGQTQNSNAAMTKPNRKVNKNDEEYKWAHDSHLSCN

SEQ ID NO: 202627 - protein, 311 aa, Glycine max
  Coding DNA Sequence Number=SeqID_85849
  Gene Ontology: Mol. function=specific transcriptional repressor activity; Cellular component=mitochondrion; Biological process =negative regulation of proteolysis
  Homolog annotation: Hit_ID=Q45Q23; Match level="QueryCoverage=99%, HitCoverage=99%, E-value=1e-126, Identity=77%"; Hit description=PHB2
  Pfam annotation: Domain name=Band_7; Domain location=37-226; Score =90.5; E_value=5e-24; Accession=PF01145.15; Description=SPFH domain Band 7 family
MNLKNMKIPNVPGGGASSALLKLGLLGGIGLYAAANSLYNVEGGHRAIVFNRLVGVKDKVYPEGTHFMIPWFERPVIYDVRARPHLVESTSGSRDLQMVKIGLRVLTRPLPNQLPTVYRTLGENYNERVLPSIIHETLKAVVAQYNASQLITQREAVSREIRKILTERAANFNIALDDVSITSLTFGKEFTAAIEAKQVAAQEAERAKFVVEKAEQDKRSAVIRAQITFASQVCSVLPDLSYESFNDQGEAKSAQLIGQAIANNPAFITLRKIEAAREIAHTISNAANKVYLNSDDLLLNLQEMKLEPGRK

SEQ ID NO: 202628 - protein, 118 aa, Glycine max
  Coding DNA Sequence Number=SeqID_85850
  Gene Ontology: Mol. function=nucleic acid binding
  Homolog annotation: Hit_ID=Q1S1G2; Match level="QueryCoverage=92%, HitCoverage=5%, E-value=2e-10, Identity=41%"; Hit description =Integrase, catalytic region; Zinc finger, CCHC-type; Peptidase aspartic, catalytic
MQQAYFHQNHVPTVVRIITQWIDVTGKMVFLQIILIVKEEVAKEALTKGVLMRDEARKHGYPPRHKLYRPQGSNVSNVNAMKEEGDDLALERSQEVQNDEVKLTSQQYKALMTPLQQQ

SEQ ID NO: 202629 - protein, 314 aa, Glycine max
  Coding DNA Sequence Number=SeqID_85851
  Gene Ontology: Mol. function=protein binding; Cellular component =cytoplasm; Biological process=isoprenoid biosynthetic process
  Homolog annotation: Hit_ID=Q7CL98; Match level="QueryCoverage=34%, HitCoverage=13%, E-value=3e-53, Identity=93%"; Hit description =Aerobic respiration sensor-response protein; histidine protein kinase/phosphatase
  Pfam annotation: Domain name=DJ-1_PfpI; Domain location=146-304; Score=61.0; E_value=3.9e-15; Accession=PF01965.14; Description=DJ -1PfpI family
  Pfam annotation: Domain name=Hpt; Domain location=24-100; Score=63.2; E_value=8.2e-16; Accession=PF01627.13; Description=Hpt domain
  Pfam module annotation: Pfam domain module=DJ-1_PfpI::Hpt; Domain location=146-304::24-100
YESLLDTAMLEQYMDLVGPQLIHQSLEMFEQMMPGYLAVLDSNMTARDQKGITEEGHKIKGAAGSVGLRHLQQLAQQIQTPTLPAWWDNVQDWVDELKQEWRNDVQCLSTPSTNQLTAATGVRVMKKVGVVLSGSGVYDGTEIHEAVLTLLALDRAGAQAVCFAPDNHNAMLLITYRAEAAQLDALIVPGGFGAAKNLSNFAEAGAECWVDEDLARLTREMHKANKPIGLMCIAPALLPKLLDQQARLTIGNDPDLGEVIDAMGGEPVICPVDDIVVDSDHKIVTTPAYMLAPSIAQAALGIDKLVARVLELAE

SEQ ID NO: 202630 - protein, 92 aa, Glycine max
  Coding DNA Sequence Number=SeqID_85852
MGLSRRCGCFTSLTPSSKSILCMQQQLLLLLSSKGGRDDHWKFFLVLQRENKVMQSYRPRALDRRLQEDWAKDARECPRVLMSLTVDFGPMG

SEQ ID NO: 202631 - protein, 80 aa, Glycine max
  Coding DNA Sequence Number=SeqID_85853
MATKGWSFVEASMVEEEEENGNVRERGRKASEILGLIPRVSLRPSGPVFESRQYIYQNAQDKTPSVVQRLILLNFKLHAK

SEQ ID NO: 202632 - protein, 175 aa, Glycine max
  Coding DNA Sequence Number=SeqID_85854
  Gene Ontology: Mol. function=protein binding
  Homolog annotation: Hit_ID=P75746; Match level="QueryCoverage=98%, HitCoverage=71%, E-value=4e-47, Identity=57%"; Hit description =UPF0271 protein ybgL
  Pfam annotation: Domain name=LamB_YcsF; Domain location=1-168; Score =205.2; E_value=1.5e-58; Accession=PF03746.7; Description=LamBYcsF family
MQLPPETVYAQVIYQIGALKSLAESEGAKLVHVKPHGMLYNQAAADAALADAIARAVKAVDPALILVGLAGSASIAAAAHHGLRTREEVFADRGYLASGALVPRSQPGALIEEAEQALTQTLTMVQQRQVRSVSGEWVAVNAQTVCLHGDGAHALEFARTLRAAFATNQIAVTSA

SEQ ID NO: 202633 - protein, 526 aa, Glycine max
  Coding DNA Sequence Number=SeqID_85855
  Gene Ontology: Cellular component=integral to membrane
  Homolog annotation: Hit_ID=Q7MZI4; Match level="QueryCoverage=58%, HitCoverage=91%, E-value=1e-129, Identity=74%"; Hit description =Similar to putative membrane protein
  Pfam annotation: Domain name=CitMHS; Domain location=10-498; Score= -140.0; E_value=0.068; Accession=PF03600.6; Description=Citrate transporter
  Pfam annotation: Domain name=DUF969; Domain location=1-228; Score =488.4; E_value=8.5e-144; Accession=PF06149.2; Description=Protein of unknown function (DUF969)
  Pfam annotation: Domain name=DUF979; Domain location=218-525; Score =393.2; E_value=4e-115; Accession=PF06166.2; Description=Protein of unknown function (DUF979)
  Pfam annotation: Domain name=MFS_1; Domain location=110-465; Score= -38.6; E_value=0.019; Accession=PF07690.6; Description=Major Facilitator Superfamily
  Pfam annotation: Domain name=SNARE_assoc; Domain location=334-426; Score=-27.0; E_value=0.032; Accession=PF09335.1; Description=SNARE associated Golgi protein
  Pfam module annotation: Pfam domain module=CitMHS::DUF969::DUF979::MFS _1::SNARE_assoc; Domain location=10-498::1-228::218-525::110-465::334- 426
MDNVVNLWPLLGIAAIVLGFVLRFNPVLVVIVAGFVTGLAAHMPLGDILEKLGSGFLNTRNLPLILLLPLAVIGLLERHGLKERAQTWIARIKTATAGRLLIVYLFVRELTAALGLTSLGGHPQMVRPLLAPMAEGATENRYGSVSPEIRQRLRAMSAATDNVGLFFGEDIFVAFGAIIFMHNFMQESAGISTEPLHIALWGIPTALCAFLIHAARLQQYLMWLAGAILLIVALLSWRDSANPRRFTTGLFWALYGVIFLIGDGAYQLMGQWAGDAELGRRWLHIAVGAAVVVMALIAGFGGVRLGRYHQRSDEQKQQSAQRLGNKLFLPALAIPLVTVIGVLAFNHIPGLQDKVFGPGNHSTLVTLFSMMIGCVLGWLIALKFTHEKPLQSMQETRRLLDAVGWAFILPQILATLGLLFTSAGVGTAISHLTEHYLAVDNRLIAVAVYALGMALLTMVMGNAFAAFPIVTAGIGIPILVLQHGGNPAVMAAIGMFCGYCGTLMTPMAANFNIVPARLLELPDRNA

SEQ ID NO: 202634 - protein, 74 aa, Glycine max
  Coding DNA Sequence Number=SeqID_85856
MGKARGHLRAVRAHPGELKLNLEAVSSPRRASPLALKFFGGPGELNAVLGKLVPRKNKENTLLPFFLGIFCLLD

SEQ ID NO: 202635 - protein, 92 aa, Glycine max
  Coding DNA Sequence Number=SeqID_85857
  Homolog annotation: Hit_ID=Q9CAQ2; Match level="QueryCoverage=73%, HitCoverage=57%, E-value=3e-22, Identity=72%"; Hit description =Uncharacterized protein At1g77540
MATRSKREAEGVGDGDAEVRDAGQGGVRRVRPERKREGHGHGFDPHFRAPFQERPWLGFPPLRRRLSARPISLAIHHPHLLLCLCKDQHFCA

SEQ ID NO: 202636 - protein, 64 aa, Glycine max
  Coding DNA Sequence Number=SeqID_85858
MASCGEANDSIDEEDLRPTSSTWSYIMSRRSLAAREGAWKARKRGRGENPNSKMVSVSRVRWRD

SEQ ID NO: 202637 - protein, 58 aa, Glycine max
  Coding DNA Sequence Number=SeqID_85859
MKPSLGCNLQHSRESRWRVTGTQQKSEENMVQLVIRWQGSHDNQLSNDETKNKELRPA

SEQ ID NO: 202638 - protein, 44 aa, Glycine max
  Coding DNA Sequence Number=SeqID_85860
KKVIWTFQPPVTKDETHIQRMCDGMMQMRKSATGGCTEYDNIHK

SEQ ID NO: 202639 - protein, 102 aa, Glycine max
  Coding DNA Sequence Number=SeqID_85861
MALVFVAYLLQRGITYWNDLPFHQGLMYGAPRIASTHAYSRIQNKRHGGKEECTLITIGGKKKCKGKIDNSRDEEHAHPREFRGYNANNVCPGWKAWQTCNS

SEQ ID NO: 202640 - protein, 950 aa, Glycine max
  Coding DNA Sequence Number=SeqID_85862
  Gene Ontology: Mol. function=phosphotransferase activity, alcohol group as acceptor; Cellular component=cytoplasm; Biological process =metabolic process
  Homolog annotation: Hit_ID=O23461; Match level="QueryCoverage=96%, HitCoverage=94%, E-value=0.0, Identity=71%"; Hit description =Galactokinase like protein
  Pfam annotation: Domain name=GHMP_kinases_C; Domain location=790-893; Score=24.3; E_value=0.00044; Accession=PF08544.3; Description=GHMP kinases C terminal
  Pfam annotation: Domain name=GHMP_kinases_N; Domain location=564-632; Score=70.9; E_value=3.9e-18; Accession=PF00288.16; Description=GHMP kinases N terminal domain
  Pfam module annotation: Pfam domain module=GHMP_kinases_C::GHMP _kinases_N; Domain location=790-893::564-632
MRIEQESDGVSASTKHLVFAYYVTGHGFGHATRVTEVVRHLILAGHDVHVVTGAPDFVFTSEIQSPRLIIRKVLLDCGAVQADALTVDRLASLEKYSETAVKPRAQILAQETEWLNSVKADLVISDVVPVACRAAADAGIRSVCVTNFSWDFIYAEYVMAAGLHHRSIVWQIAEDYSHCEFLIRLPGYCPMPAFRDVIDVPLVVRRLHKSAKEVKKELGVTDDVKLVILNFGGQPSELKLKEEFLPPGWLCLVCGASETADLPSNFVKLAKDAYTPDIIAASDCMLGKIGYGTVSEALAYKCPFVFVRRDYFNEEPFLRNMLEFYQGGVEMIRRDLLTGHWRPYLERAISLKPCYEAGINGGELSGARRLRDAIVLGYQLQRAPGRDITIPEWYATAENQLGRSTPGSPMDDGRSAFSLDIENFDILHGDIQGLPDTVAFLQNLSELQDKHTRRERKAAANLFNWEEEIFVTRAPGRLDVMGGIADYSGSLVLQVSYGSELSNRGPTFDMDLSDFMDEEDKPISYEKAKKYFAQDPSQKWAAYVAGAVLVLMTEMGVQFEDSISMLVSSAVPEGKGVSSSASVEVASMYAIAAAHGLNISPRDLAILCQKVENHIVGAPCGVMDQMASSCGEANKLLAMICQPAEIVGLVDIPSHIRFWGIDSGIRHSVGGADYGSVRIGAFMGMKMIKAKASEELSESWAANGLNYDEVEQDDIELLKQETSLDYLCNLPPHRFVTLYAKTIPESIVGETFLEQYQNHNDPVTTIDPKRTYGVRAPTMHPIFENFRVVTLKALLTSAASTYQLTALGELLYQCHHSYGTCGLGSDGTDRLVNLVQELQHSAASKAEGGTLYGAKITGGGSGGTVCVVGRNCLKSSEHIFEVQHRYKKATGYLPFIFEGSSPGAGKFGYLKIRRRATPKKANAIKDDGALTSEKANASKDDGAVTMKNNS

SEQ ID NO: 202641 - protein, 43 aa, Glycine max
  Coding DNA Sequence Number=SeqID_85863
MPRAQNSTAHHSAYFGKRALEAARGATFAEIPRFLLKFCMLLV

SEQ ID NO: 202642 - protein, 80 aa, Glycine max
  Coding DNA Sequence Number=SeqID_85864
  Subcellular localization annotation: CTP_CleavageSite=58; ConfidenceScore=5.09e-01
MTVSKHHSVHDIQLSLAHQWAKHASTAKRRFIVLCVIEESGRASSSRSCAKREINALSATVVFSQAQRTTGAKLKSTYSH

SEQ ID NO: 202643 - protein, 382 aa, Glycine max
  Coding DNA Sequence Number=SeqID_85865
MSLWYVAPTFFNPRGMTMKLDIRKSDAPSTIDAKQGICILRACLVDVGVVNAHTSFPISLPYHDNGFFIHTHDLTVTAIRGGMRLSWLSNGRIRSYLQAFSVALSRLLLVYLDNYDFSCQDQEFHYKDLRHHQIRDVYGDDHGVILVDGVDAFEIFVGECYERKASRLLCVDVNIFDSVEMTFSGLDGQPFIKKSSRNDVDYTSNLLGGISHLAMVIMVPPELASNSVCLVLFIPDFKGGMGPTTWSVKPLKIKIPDLDSDSTEPVHKFVKVSKLLMDQGGSPLYHVNVSPLKDLVKTQHRIASSCCRVVHPSWRCTCEIVATYPFAGERGEAHGCLFQRRKMHGVATNEGISTSHVDKSGALAPMYPPSKRKSDLHISFLR

SEQ ID NO: 202644 - protein, 139 aa, Glycine max
  Coding DNA Sequence Number=SeqID_85866
MALTGVGQIGRLPQDDCPPFFYVYRYMFEVLNLTLPLNTFQCARLRHLNVAPSQFHPNSWTMVRAFEVLSPFFTIRSNVPDLFYKVKAINIVVDGLPLMHDGNREPCFHFYCQSDPTRFKSFDESLMSLEERANKAILE

SEQ ID NO: 202645 - protein, 204 aa, Glycine max
  Coding DNA Sequence Number=SeqID_85867
MLPNKQIDVALVKEFYSNVYDPKDRSSTTCIVRGRIIQFDTETLKEFLGTPITIVEGEQLTTYAHYLHSHPNYKAIAAKLCTPGGRFQLNIEEAPVLSYFNIALTSYTSDINLDRARLIYGLMMKIEMNGVDSETLAYESLSPVINLVYIKKSYWNPADSSITFPSLRRVRAHTTQDAPPPPPSPVVSPPAAPSTIGPSSSSSA

SEQ ID NO: 202646 - protein, 79 aa, Glycine max
  Coding DNA Sequence Number=SeqID_85868
MTIDHPPLPMAHTDPSIGPNISMPRAKREISVLKAAVVFSQAQCMNDAKLKSTYSAHHNAYFGKRALEAARGVAFVERP

SEQ ID NO: 202647 - protein, 75 aa, Glycine max
  Coding DNA Sequence Number=SeqID_85869
MLEKPKRGQGILKRRVRELFMHREGINSPRRAGCLRMTTFHGPGAGDAVDAGADIDHVVDLTTAQGEWDPWPTQD

SEQ ID NO: 202648 - protein, 88 aa, Glycine max
  Coding DNA Sequence Number=SeqID_85870
MVQLSAHHCAKPNIFTKALSTACHAMMQSYLPRVLDRRLQEDRARAAKEVPGVLMNLRGILSSLCSRDFYCIFMYFGMGVSLAIIGGV

SEQ ID NO: 202649 - protein, 99 aa, Glycine max
  Coding DNA Sequence Number=SeqID_85871
  Gene Ontology: Mol. function=transferase activity, transferring phosphorus-containing groups; Cellular component=membrane; Biological process=regulation of transcription, DNA-dependent
  Homolog annotation: Hit_ID=Q08VD2; Match level="QueryCoverage=99%, HitCoverage=9%, E-value=6e-30, Identity=62%"; Hit description=Multi -sensor Hybrid Histidine Kinase
MAADDAAYIGQADARAFELFDVMQALEHAEQLVDVAHVEAAAVVAHEEVVFVVAAFVTDLDNSLVALAGELDRVGQQVLPDQAQHRRIGFDLRQRCERP

SEQ ID NO: 202650 - protein, 367 aa, Glycine max
  Coding DNA Sequence Number=SeqID_85872
  Gene Ontology: Mol. function=transferase activity, transferring phosphorus-containing groups; Cellular component=membrane; Biological process=two-component signal transduction system (phosphorelay)
  Homolog annotation: Hit_ID=Q1IQN6; Match level="QueryCoverage=28%, HitCoverage=66%, E-value=4e-20, Identity=56%"; Hit description =Response regulator receiver protein
  Pfam annotation: Domain name=Response_reg; Domain location=5-130; Score=23.0; E_value=5.9e-05; Accession=PF00072.14; Description =Response regulator receiver domain
MRDLRPILLVEDSPKDAELTLAALSRCQLLNDVIHVRDGAEALDYLRCEGKFAGAMHGGPVVVLLDLKLPKVNGLEVLEQVRSDPDLSSTPVVMLTSSREEQDLRAPAHPHAGGQRAGCGADQRTVAARRPRLLGRAPVDPQCVHRGHRLPSCPGTRTRAADAFHLCFRHADRGTGSTGTLARCARLRGEATPATLARCDPPRPPGGARAYPAGLCAGRAERRPGPAAAGNRCRPGADRPVGQGPSLPVCQQGVSGLARIQPCRTVGSRGTGCQRDFCLQARPAQPGAGIAGRTHQLPRRTDPPQRRITRCFTVAESPTGAALGQPGTRTTGAGAHHRTEGQQAAPAGDLRIQLPSSGAAGSVRTRG

SEQ ID NO: 202651 - protein, 78 aa, Glycine max
  Coding DNA Sequence Number=SeqID_85873
MYRSPTGNLVPLDLEIEATLRRNTTKRRRKLLQDKTVASILEEEAHSSDSTSSDSPSSRESMTYLPEVVIMADEHQQR

SEQ ID NO: 202652 - protein, 114 aa, Glycine max
  Coding DNA Sequence Number=SeqID_85874
  Gene Ontology: Mol. function=nucleoside-triphosphatase activity; Cellular component=microtubule; Biological process=cell division
  Homolog annotation: Hit_ID=Q7XJI8; Match level="QueryCoverage=99%, HitCoverage=21%, E-value=3e-53, Identity=91%"; Hit description =Katanin
  Pfam annotation: Domain name=AAA; Domain location=1-114; Score=12.5; E_value=2.4e-05; Accession=PF00004.19; Description=ATPase family associated with various cellular activities (AAA)
MVRCLFDLARAYAPSTIFIDEIDSLCNARGASGEHESSRRVKSELLVQVDGVNNSSTNEDGTRKIVMVLAATNCPWDIDEALRRRLEKRIYIPLPNFESRKELIRINLRTVEAS

SEQ ID NO: 202653 - protein, 51 aa, Glycine max
  Coding DNA Sequence Number=SeqID_85875
KSTVEELEELDSLLSVQPRLSVQLSLSGQSQAQRKVQTKREKAMRKSPGHA

SEQ ID NO: 202654 - protein, 56 aa, Glycine max
  Coding DNA Sequence Number=SeqID_85876
MAPEGLPTKSSNAASFGLPFIKIQMIIHHEMPLNNILVSMPHSLISKCETTVISRT

SEQ ID NO: 202655 - protein, 471 aa, Glycine max
  Coding DNA Sequence Number=SeqID_85877
  Homolog annotation: Hit_ID=Q13ML3; Match level="QueryCoverage=22%, HitCoverage=7%, E-value=2e-25, Identity=55%"; Hit description=YD repeat protein
TSFEGRALPDSTLTKPFSTYEVLKPYDVDAGPAIPWFGKTGMGTQYETHDFIEDLISDGVEGINNAWGKLLRETHQQLPGYDQNLRMQGQYLDRETGLHYNLFRYYDPDSARFTQQDPIGLAGGLNLYQYAPNSFSWIDPLGLNRCKPDFYVGPDGPSATMPSTAYRYMNSSDSYAAKTMASKSAPLSYFGYTKYKTGSEARDAYQIFYEKGNIKSWSDARLLGEFDTLQLYKNGVPQVKVPLANGGDGPGYELFTSAYPQYGKGGAVQLLPIEKGTPVIFNKVSVLPDRPPSGSDNPVQPAWLTSDRPRTRPHAAATPGKSKWSTDREGHGWAVAWAGQKHASIPPYDQIGLAGGLNLYQYAPTSLGWVDPWGVRKCSNNGNKSKPDFYVGPDGPSATMRATAYRFVRYKNDDGSLNAWGQKLLSDKSALFTYFGFDKFNSGKATRDAFQIKGIDKVNPLNPDDMSWSDG

SEQ ID NO: 202656 - protein, 45 aa, Glycine max
  Coding DNA Sequence Number=SeqID_85878
MSSRRSRQQSASTRISDDQIIDLVSKLRQLVPEIRDRRSDKFHVG

SEQ ID NO: 202657 - protein, 171 aa, Glycine max
  Coding DNA Sequence Number=SeqID_85879
MAKSSYVRVRLALQVETREGKTRQRKVQVSATHIRKECTELREENAATARALEQETKRAHKEEHGRVKFRGALWGSNNELKLRRELAACARSKRSLAQHLEATEQSMLAIIGQYKEELNQSVTHEQKLVEDFAQVYAEKEARGRAIDALHQEATMWMDRFALTLNGSQDLP

SEQ ID NO: 202658 - protein, 138 aa, Glycine max
  Coding DNA Sequence Number=SeqID_85880
MVDTLPVFYYEKLVGYMPSSFVDLVFARERIEVGLKRGKFNYVSSTSTNARRIGATGAKRKERDTHAVTSAPAWIKPLQTSHGPPSSGSNPDSPDRQRQLWRRFQRDKELPLRPTPEFTLIPMTYEDLLPSLIANQMA

SEQ ID NO: 202659 - protein, 158 aa, Glycine max
  Coding DNA Sequence Number=SeqID_85881
MGRFSKKFTQGDSFGRKTHAWCKQTANGTGGFAVGEGLATTSGDMHMQPEELTIRSGDMHSKGNRQLGARGTGHAAGHAGAAEGAVQQAGIAILIGGMRFTGIAKLDGELLYFKFLHYKRRRWMWNSASLALLSSSSSYYSSSSYYFNTLRFFLFSFW

SEQ ID NO: 202660 - protein, 38 aa, Glycine max
  Coding DNA Sequence Number=SeqID_85882
MHTQALSFLENRLIAQTSLERPRAFRRCVLRLTGDQSG

SEQ ID NO: 202661 - protein, 199 aa, Glycine max
  Coding DNA Sequence Number=SeqID_85883
MEYAREDVLKSIEENPSAAFGHLNFLKKLHNPLTSDEILGKVIQIEAIIDQFASTVQKKRENSARLDAQKQAHILLLEKARVAQHEVERLTKEAKEGSSEIKACDDNISSWEATITNLLSQVDDLRQRIVTEQAKCQELQEKAANSIQKLVAEKGREGLKAFSASQVVADEARAMESADQVLTKEMATLKKLYEDLVMH

SEQ ID NO: 202662 - protein, 57 aa, Glycine max
  Coding DNA Sequence Number=SeqID_85884
MRVWLKGSDGDYKEITMESHALELSNYAIANSYKVELFVKCAGGNEGVVDENFYEDN

SEQ ID NO: 202663 - protein, 98 aa, Glycine max
  Coding DNA Sequence Number=SeqID_85885
  Pfam annotation: Domain name=zf-GRF; Domain location=20-65; Score =26.2; E_value=2e-05; Accession=PF06839.3; Description=GRF zinc finger
  Subcellular localization annotation: CTP_CleavageSite=30; ConfidenceScore=5.32e-01
MSQRSNASSSRTRVSSQVVLFCGCGRRAVRRVAGTNIKRGRTFFTCSIHKDEVGYCAYFIWVDQLIEALGVDNSLGTFSMEQRRQFGREEDKTMWKAQ

SEQ ID NO: 202664 - protein, 45 aa, Glycine max
  Coding DNA Sequence Number=SeqID_85886
MEVSISSPSLTFENSIGTVEGIMKEFPGTTRDVAIWLKTRESAQR

SEQ ID NO: 202665 - protein, 70 aa, Glycine max
  Coding DNA Sequence Number=SeqID_85887
MGITTAFEEVTKIHRLRKIPPFDFRHITEFSRIAQACFLLISDTSRDFIYCATKDAKYLKAANQRLHVIK

SEQ ID NO: 202666 - protein, 56 aa, Glycine max
  Coding DNA Sequence Number=SeqID_85888
MVIEVVCSGNYKVDIKLLSNLSHWQVNKKDMDMALTGTGTPKQAKASDFRKNLQIT

SEQ ID NO: 202667 - protein, 208 aa, Glycine max
  Coding DNA Sequence Number=SeqID_85889
  Homolog annotation: Hit_ID=Q64EX4; Match level="QueryCoverage=98%, HitCoverage=56%, E-value=2e-58, Identity=53%"; Hit description=MtN19- like protein
  Pfam annotation: Domain name=SURNod19; Domain location=3-208; Score =2.9; E_value=6.4e-13; Accession=PF07712.3; Description=Stress up -regulated Nod 19
MDMRRNGCSTSWSLIHVVHKIRKPALNDNLQCKQIEGFQGSRRMVSLRYKISWVDWNIYQIPVKVYILDSTDKVRSNGSKILHDCLAEYTIPAGGGGDSPHVQKANIPMENGGYLIYGTAHMHSGVVNATLYGQDGRTLCTSTPKYGTGKKAGNEKGYLIGMSVCYPQPGSIKIHDGEILTLESRYKNEFRTGAMGHFYIYLAEELPQ

SEQ ID NO: 202668 - protein, 59 aa, Glycine max
  Coding DNA Sequence Number=SeqID_85890
MTSSLGTPHCFAIASAMAPAPTLILSETSSSTAREIAVFFHSAATVGGGGGGGGGGGVP

SEQ ID NO: 202669 - protein, 221 aa, Glycine max
  Coding DNA Sequence Number=SeqID_85891
MANPISETEIPDETLSPNAIPDPNQDQDSTMQAPIPTILTVIDDDPEPDSSTGAATCGGGTTTRRTTKRKKGPKRTALERRSRKKLQVIVTTLNPIPFTPAKTLDFERHQSLLRRLGLWYFVHVEFDSALRGDLLAQLITSYVPTNRCSYVNGVRINVNRADLGRTLKLPVKKTGCGGGATADSIDSAESIAFAEEVVYSWMLLHDGYIRKPNLESLHTYN

SEQ ID NO: 202670 - protein, 126 aa, Glycine max
  Coding DNA Sequence Number=SeqID_85892
MMLGLSHPRIIIQKKLRIQSSILFPTLPLLQRKNELPFLPSSSSALICLHHHNGMAFLHPQTSLFWGKTNTRWRDMLSVAALVKNQIKPIFPFNNFYHHHQTPSLLPPSVTSLPPPPPLSCGFNQI

SEQ ID NO: 202671 - protein, 389 aa, Glycine max
  Coding DNA Sequence Number=SeqID_85893
  Homolog annotation: Hit_ID=Q10RR9; Match level="QueryCoverage=84%, HitCoverage=90%, E-value=2e-27, Identity=27%"; Hit description =Expressed protein
  Pfam annotation: Domain name=DUF677; Domain location=61-379; Score= -118.7; E_value=7e-05; Accession=PF05055.3; Description=Protein of unknown function (DUF677)
MLANNLENFLFRLKFQHEVNSKDQPSMLSKLRACKACQDWKPPRDAPKSVNFHEEYHKALRTKSYVDFFDKAQLLANQPSIYSNHNKFSEILLEPGQETIHSVIDHISKTPELNNLMLSYFDISAEASFICSHLLQSINQVQCNYQFIERALGIMDDDDSLEKFKLISFELNSFIFSKNPLSNLNINHDLFKLISDENSSVLLHRLKSMRKKLGRKVKLMTYLKKTSEICVAMYDLVAITANVTEAHTLSTLIMGPTILNFPCKSLNKRELPHLRFSRRMFLSNVCDQLDIAAKGTYILNKDFDTMTRVVARLYDEIEHKRTMVQFFLDKKDDKFSLQMVKELKKSGDGFRKQVEELKEHVYLCLVTINQARCLVTEEMTKMCTEGIGV

SEQ ID NO: 202672 - protein, 69 aa, Glycine max
  Coding DNA Sequence Number=SeqID_85894
MGVFRVQSTSKTFWKVEQWDNALNKTTFNMTPPEPMCQKHFMPSVPKGQRCKSDYICGTIRIIKKGSKT

SEQ ID NO: 202673 - protein, 106 aa, Glycine max
  Coding DNA Sequence Number=SeqID_85895
MVMNFFLTHLLLEVASPIIFLPSSFHCHSSSRRKDSIHEEDPRPNGSTWSYLLKEFPKDLVSLKRARVICFYMGLPGLYSSLIQKHRLQHKHQTRHRHRHRDMAKF

SEQ ID NO: 202674 - protein, 101 aa, Glycine max
  Coding DNA Sequence Number=SeqID_85896
MRPQLSPSQHERLLACAAGGGAAAAASRSAGGGVGLGVVVEHIPATLMVEEGHAIVVSVDRIHDRRGRGRREWRWRMKGGSFFLWRRGSVGKRRWIEGFLE

SEQ ID NO: 202675 - protein, 56 aa, Glycine max
  Coding DNA Sequence Number=SeqID_85897
MVEPIVVDEEYRKEREMARRELGVFITNNKLLLSCGMMLQPTMPRAEEEAPTVLSD

SEQ ID NO: 202676 - protein, 59 aa, Glycine max
  Coding DNA Sequence Number=SeqID_85898
AEFQILEAFDSRTKKRILQIVGERWRQFKSDLTKKWALVADQDGVDDTVCEKYGISKEK

SEQ ID NO: 202677 - protein, 79 aa, Glycine max
  Coding DNA Sequence Number=SeqID_85899
MARTKKTGQMMSEAAKEIADKIGSFVPHGHQEVLTAAIGRAEHPGRVRAAGIGITIKKYFGSAPRMSCNSSSLPPEDLQ

SEQ ID NO: 202678 - protein, 133 aa, Glycine max
  Coding DNA Sequence Number=SeqID_85900
  Homolog annotation: Hit_ID=Q218A5; Match level="QueryCoverage=97%, HitCoverage=72%, E-value=2e-12, Identity=36%"; Hit description =Hypothetical protein precursor
  Pfam annotation: Domain name=DUF336; Domain location=1-132; Score =106.6; E_value=7e-29; Accession=PF03928.5; Description=Domain of unknown function (DUF336)
MNITYHEATKALNESIKKAETLGIPVSIAVVDTGGHLVSFARLDSVYGVIDFAIKKARTAVMFGVDTEVMGTIIAGTDIHGYGMLNSNGGLLTIAGGVVIRNEKGNIIGAIASSGGTVEQDREIALEGASSIF

SEQ ID NO: 202679 - protein, 262 aa, Glycine max
  Coding DNA Sequence Number=SeqID_85901
  Gene Ontology: Mol. function=oxidoreductase activity; Cellular component=membrane; Biological process=metabolic process
  Homolog annotation: Hit_ID=Q2B3T3; Match level="QueryCoverage=98%, HitCoverage=83%, E-value=2e-73, Identity=51%"; Hit description=Short chain dehydrogenase
  Pfam annotation: Domain name=DUF1776; Domain location=2-248; Score= -110.6; E_value=0.077; Accession=PF08643.1; Description=Fungal family of unknown function (DUF177
  Pfam annotation: Domain name=KR; Domain location=4-164; Score=-57.7; E_value=0.00052; Accession=PF08659.1; Description=KR domain
  Pfam annotation: Domain name=adh_short; Domain location=3-165; Score =104.1; E_value=4e-28; Accession=PF00106.15; Description=short chain dehydrogenase
  Pfam module annotation: Pfam domain module=DUF1776::KR::adh_short; Domain location=2-248::4-164::3-165
MSKTILITGAASGFGKIAAFDLARKGHHVIATTQVYPQMSDMIREAKEQGVEMTVDKLDVTNSRDIAYILKKYDIDILISNAGIMEGGPIAEQPLDLIRSMFEVNVFGALELAQGFIKKFVQKKSGKIVFTSSMGGLWTVPYVAAYCASKHALEAIAEGLKTELAPFNIKIATCNPGVFGTGFNDRGVDSIRHWYDPKENFTPESAFAGAEESLAHQLDPQSMADVIVNVTLDDHSNFRNLHPKETEDFVKQLQTEAWSAKS

SEQ ID NO: 202680 - protein, 211 aa, Glycine max
  Coding DNA Sequence Number=SeqID_85902
  Gene Ontology: Mol. function=kinase activity; Cellular component =cytoplasm; Biological process=D-ribose metabolic process
  Homolog annotation: Hit_ID=Q9M394; Match level="QueryCoverage=68%, HitCoverage=30%, E-value=1e-60, Identity=69%"; Hit description =Fructokinase-like protein
STVESPTPKRRGRKKKPETQTPPSNDTPPPQDADPKKEEDEVYDYDDGVDFPYSDPPLICCFGAARREFIPAVRVQDYPMHPDIYSEWKMLQWKPPEFARAPGGPPSNVAVAHTRLGGRAAFLGKVGDDDFGEEMVLMMNEERVQTRGVRIDPGRRTGCAYMKVRFEEGRMKMETVREAAEDSLLATELNLAVLKEVFVGLITRLVVSIHA

SEQ ID NO: 202681 - protein, 130 aa, Glycine max
  Coding DNA Sequence Number=SeqID_85903
  Homolog annotation: Hit_ID=Q1RXS1; Match level="QueryCoverage=66%, HitCoverage=22%, E-value=2e-08, Identity=34%"; Hit description=Zinc finger, CCHC-type; Peptidase aspartic, catalytic
  Pfam annotation: Domain name=zf-CCHC; Domain location=69-86; Score =22.8; E_value=0.00017; Accession=PF00098.13; Description=Zinc knuckle
MKKGVGHILDLTPKGEKRKESLKSSHSYPKKDKGQGFLEAAPSKPKDDKGKTIEKQPPKASMQEKTSSIKCFKCLGRGHITSQCPTKKTMIMRGQDIYSSQDEATTSPSSSESEEEKGKEFSVEIYPQKE

SEQ ID NO: 202682 - protein, 67 aa, Glycine max
  Coding DNA Sequence Number=SeqID_85904
MAAIDFDDAKGESNKVDSTSIQRLSIALRLIQGCFNKHSKVKHCFKINSRSSTQDQEKDKASNNLIG

SEQ ID NO: 202683 - protein, 306 aa, Glycine max
  Coding DNA Sequence Number=SeqID_85905
MEVETLEDRITWELGYNVRTKFLGDDMVLLPGMSDDKAQLLIQSETESDDSLFYSLEKWTPKCRPNNRVVWLQLWGFLIQVWEMKNLRRDVAAIGDVIESDDDTEDRRRLDRARVLVRTPLPPLIRSEVIVRVGELEYRVWIVEETGFEGGSNRKGSSPSDGWSEMITSDDEGEVGDVLDDTNTNFSFSPELPNQKLSPSRTQRAEGGTDVRCCDLRPLGNIQADVTPKEKSKGTVEGMLGSSFGKLNLGDSFAGTEEEAANTKEVTCYNTLQDDRRHRNHIEGKYLNGGAKVAADQTFIGEEEGH

SEQ ID NO: 202684 - protein, 70 aa, Glycine max
  Coding DNA Sequence Number=SeqID_85906
  Gene Ontology: Mol. function=sequence-specific DNA binding; Cellular component=nucleus; Biological process=regulation of transcription, DNA-dependent
  Homolog annotation: Hit_ID=Q1SG97; Match level="QueryCoverage=85%, HitCoverage=28%, E-value=4e-25, Identity=96%"; Hit description =Transcription factor, MADS-box
  Pfam annotation: Domain name=SRF-TF; Domain location=9-59; Score =99.2; E_value=1.2e-26; Accession=PF00319.9; Description=SRF-type transcription factor (DNA-binding and dimerisation domain)
MTRKRIQIKKIDNISSRQVTFSKRRKGLFKKAQELSTLCDADIALIVFSATSKLFEYASSRSSGESHGFF

SEQ ID NO: 202685 - protein, 90 aa, Glycine max
  Coding DNA Sequence Number=SeqID_85907
DADEAPLDVSICLHAFGIVGFGSFSGVKSCEREDPFHPGLFVGDAGGFQSPTREPLNVGGLVPPHCSLKSVVSDDACPGACFVQRDATTL

SEQ ID NO: 202686 - protein, 164 aa, Glycine max
  Coding DNA Sequence Number=SeqID_85908
MVMPSLRGCLVSHCLSFSMCPVVGFGPWLGLGKPLVEILPPGQLRGFCPLLAWLGSAVLGYGPVLSFGLVGPLLPPRDQFCCQDFANFGLRPGRIKATRAESQWIVAARPLCHLQYPVAYLSRLQRILPAARWELRFKASRRANPPHEGHQRHVPLGGRCPLLL

SEQ ID NO: 202687 - protein, 561 aa, Glycine max
  Coding DNA Sequence Number=SeqID_85909
  Gene Ontology: Mol. function=serine carboxypeptidase activity; Cellular component=cellulose and pectin-containing cell wall; Biological process=proteolysis
  Homolog annotation: Hit_ID=Q6W6R6; Match level="QueryCoverage=78%, HitCoverage=89%, E-value=1e-179, Identity=68%"; Hit description =Putative serine carboxypeptidase
  Pfam annotation: Domain name=Peptidase_S10; Domain location=78-463; Score=453.7; E_value=2.4e-133; Accession=PF00450.12; Description =Serine carboxypeptidase
MKKFSLYACMLNLSILILLPYSKASQADKLQELILSKSSQKPPVTLSWAEEDAVKTPSPAYVAPQEGQKEADRIVALPGQPYGVNFDQYSGYVTVDPKAGRALFYYFVESPYNPSTKPLVLWLNGGPGCSSLGYGAFEELGPFRINSDGETLYRNKYAWNEVANVLFLESPAGVGFSYSNTTSDYGHSGDKSTAKDAYVFLINWLERFPEYKTRDFYITGESYAGHYVPQLAYTILVNNKFSQQKIKLKGIAVCSKTLTENYAYVIRYHLPSHLSNFLICTDENFQIGNAWIDDVASIKGIYDYIWTHALSSDQTHELIEKYCDVTSENVSAMCVNATRTAAIEIGNIDDYNIYAPLCHDSSLKNGSAGSVYDFDPCSDYYGEAYLNRPEVQLALHAKPTNWAHCSGDTDSVVPVTSSRYSINTLKLPIQVPWRPWYSGNESIAEYNVIVRSSSWKMWIFLANQLCLACNDFNLLFILINYGCTTLALWSQAKQLVNGIPLPLDLGSNIDDVKVKVTTAADSLSKKAKENSRMIHKVIDGVRLALVTVAVVMIFVAFLGLC

SEQ ID NO: 202688 - protein, 53 aa, Glycine max
  Coding DNA Sequence Number=SeqID_85910
ALSTTGVFSQAQRMIGAKLKPTYSAQNSTAHHSAYFGKRALEVARGAAFAEIP

SEQ ID NO: 202689 - protein, 277 aa, Glycine max
  Coding DNA Sequence Number=SeqID_85911
  Gene Ontology: Mol. function=DNA-directed RNA polymerase activity; Cellular component=chloroplast; Biological process=transcription, DNA-dependent
  Homolog annotation: Hit_ID=Q8HVY3; Match level="QueryCoverage=100%, HitCoverage=23%, E-value=1e-143, Identity=82%"; Hit description=DNA -directed RNA polymerase beta'' chain
  Pfam annotation: Domain name=RNA_pol_Rpb1_4; Domain location=60-133; Score=18.7; E_value=0.00015; Accession=PF05000.7; Description=RNA polymerase Rpb1, domain 4
  Pfam annotation: Domain name=RNA_pol_Rpb1_5; Domain location=115-276; Score=-151.4; E_value=0.075; Accession=PF04998.8; Description=RNA polymerase Rpb1, domain 5
  Pfam module annotation: Pfam domain module=RNA_pol_Rpb1_4::RNA_pol _Rpb1_5; Domain location=60-133::115-276
MAYTSHILDQVKTLGFRQATDTSISLGIDDLLTIPSKGWLVQDAEQQSFILEQHHHYGNVHAVEKLRQSIEIWYATSEYFRQEMNPNFRMTDPFNPVHIMSFSGARGNASQVHQLVDTAVRTSDAGYLTRRLVEVVQHIVVRRTDCGTIQGISVNTQNGMMPERIWIQTLIGRVLADDIYRGSRCIAVRNQDIGIGLINRFKTLQTQPISIRTPFTCRNTSWICRLCYGQSPTHGHLVELGEAVGIIAGQSIGEPGTQLTLRTFHTGGVFTGGTAEQ

SEQ ID NO: 202690 - protein, 99 aa, Glycine max
  Coding DNA Sequence Number=SeqID_85912
  Subcellular localization annotation: CTP_CleavageSite=45; ConfidenceScore=5.50e-01
MNLLPSAVHVSSTIESGAPRIYFLVLFANSPFSIFIRRPMNSLPSAVHVSSTNESEAPRIYCLALFANSPFSTFIRSPMNLLPSAVHASSVIKRGAFDD

SEQ ID NO: 202691 - protein, 313 aa, Glycine max
  Coding DNA Sequence Number=SeqID_85913
MRAKTNRKSKNRVAIPPPAKSESIIETYRRDLQEFGTGLKKEIEVAHRSLETVGHVIDQFGNTVAKGTAHITSYLDSDNNNNRNNPGTKEKKSFISKRYSRFDSQVRAIQSDVSTYTEVPEDSDEYNEWKSRVYRLKKAEDVRARLVRRMSRDEEELSWDVEEEDENKGKEGDSVLHGDGTNRLNVEEMHKSAEEGSKEEKRGDLLQSKGDESVEESKAGKNKEIVIMESKLNDGKDSLVANKHSKNEKEEEEDLEWDEIEDLSRIDEEKATRMGSHTKVDLRKRRLSAAQEQEEEDLSREIEEDDEPANAKA

SEQ ID NO: 202692 - protein, 64 aa, Glycine max
  Coding DNA Sequence Number=SeqID_85914
MWYEGCASDVVERFKRTGQRVKEPMVLFPSMRRDSLECSGQRSKNLGELESGDYPVFGALIWRE

SEQ ID NO: 202693 - protein, 97 aa, Glycine max
  Coding DNA Sequence Number=SeqID_85915
MEVNLDACLLALEVELQSEYMEILKHKELFGSKNQERIGLDLFPKLSEDARLALTATTGKSVFHDDFATYSKTVLNCFRSQHHGKSRLSTMVLKKPS

SEQ ID NO: 202694 - protein, 535 aa, Glycine max
  Coding DNA Sequence Number=SeqID_85916
  Homolog annotation: Hit_ID=Q7XH72; Match level="QueryCoverage=63%, HitCoverage=59%, E-value=1e-23, Identity=26%"; Hit description =Hydroxyproline-rich glycoprotein family protein, putative, expressed
MAAVPASRTDPPPAMVQPPLLVSDPFAKDAILAWFHGEFAAANAIIDALCGHLAHLAAASSDYDAAFAAIHRRRLNWIPVIQMQKYHSIADVTLELRRVAEKKSEHEAAKKSESSFEEEGKLEKETAENGGNDGDDDAAPEYDSPDSEITDSGSQEMQPSVMNNNICSNHEECEGRSSQIKLTKGFTAKESVKGHMASSFVYNFNSQYVNVVKGLKLYEDVFSESEICKLTDFVKEIHAAAQNGELSGNIEPIPALLHDVIDHLIQWKLIPEYKRPNGCIINFFEEGEFSQPFLKPPHLDQPLSTLLLSESTMAFGRILMSENDGNYKGPLMLSLKEGASPGAAVKLCLGDLLVMGSNPETASLHMQGVSITFFRVRPDSNQCQSPTPTMTTAMTLWQPSIASPFTLPNGPLSGYEAMNMMPQLGILSAPMVMGQPENMQGIFHRVLKKDALWNYPPQLNHTRESPFLNPALLLKDRYDFCLKAVMGLKRCESRKRGFHASSDCLLAVEAATRQMSIRKWFRTSKALLTGEWEGE

SEQ ID NO: 202695 - protein, 82 aa, Glycine max
  Coding DNA Sequence Number=SeqID_85917
MGVQIETRPTWAFRKFLQKGVPSGGGNLARMGELGCKLLPLFPINRGRREEQKRSTLLVSEDALKLVRKIISMKKIRAEALP

SEQ ID NO: 202696 - protein, 87 aa, Glycine max
  Coding DNA Sequence Number=SeqID_85918
MASNLKSKTAKSTEELCLKFSVLDMLQNRENTCCFCLNLVLAEIANCSYSIASLYDSNQACMSLNKLTLKQCDSMEEGMTSTGCQPK

SEQ ID NO: 202697 - protein, 289 aa, Glycine max
  Coding DNA Sequence Number=SeqID_85919
  Homolog annotation: Hit_ID=Q9SXF7; Match level="QueryCoverage=34%, HitCoverage=18%, E-value=1e-25, Identity=60%"; Hit description=Amino acid transporter-like protein 1
TVAIIMEEVVEVKVSGRPRETQSSPGISTPKSPFATRFMSTPLASPMKKAIENMQGYLGEVGRFTKLDPQDDWLPITESRKGNAYYAAFHVLSSGIGFQALVLPLAFTSLGWTNQQNVATSAQHSKAIRAIHRIKHYYQEPRPATAHSNSPSLTPNLPQNMMKAKNTKGEGEIPIKFDNSIPISTPRVHVQVSKVASPQVGISAKIEPEPEPWHVQGSRVGLFKDEHNNGKDTITGPLKEQHGLGMQQGKKTLDINDTFTDYIERARHRIRTVSNVGRGQSHSAPDETS

SEQ ID NO: 202698 - protein, 137 aa, Glycine max
  Coding DNA Sequence Number=SeqID_85920
  Gene Ontology: Mol. function=zinc ion binding
  Homolog annotation: Hit_ID=Q1RSJ8; Match level="QueryCoverage=90%, HitCoverage=50%, E-value=1e-10, Identity=37%"; Hit description=Zinc finger, RING-type
MQEGPMMILGGVCCCLGAALYFFGRSNGRYAQLLDAVKSPLGEQHFLKQEKVTIYEEKREKKKVTRGWTPDYVSTSSNSKEVPWYLEDESSRVHVIGARNAMHFELPVRREVFGVNKTEWVYTSNRHLLDCCWKGMS

SEQ ID NO: 202699 - protein, 302 aa, Glycine max
  Coding DNA Sequence Number=SeqID_85921
  Homolog annotation: Hit_ID=Q1RSI8; Match level="QueryCoverage=87%, HitCoverage=71%, E-value=1e-83, Identity=58%"; Hit description=IMP dehydrogenase/GMP reductase
NCSNAVLLGFGIVDQCTKRDEIINLLMSETAEAGIDGANLSLLSDLMKLQLSGIDETQQPLSSLIYPTSKFNILKPLLYFVQGSALSSKITVHPDGQMTFMGTAIELKDLLSVVAESYLSKCSRKGEKQSMLVPHFSCPEKVKLKPSPRKNKKVGRERDLYKNSSHACETLLSLMVDKKQRRKTAILSLKKSGPELPELLTQFSAGIAGTGLAVLLSVMCNLACGRATFCAYSLFNTGFGFGLVWLSGAVNKLRATIVNISKNAGNLASSGSAKACLSNISNDVVISGWLDVTVMAFGEADS

SEQ ID NO: 202700 - protein, 149 aa, Glycine max
  Coding DNA Sequence Number=SeqID_85922
MGNRNSSSKSKVHGQVTRAASSEPGYDFDYDPIMGMPVTKFRDEYIGKSKGETPGKLKGTGMYSYQQGNAALDSDETFNSFIRRAKCKIRTVSHIDREQSNVAPATPPVYEANAMDNQNDQFSNFIQSTKKKLRTTSSMRKNGSFNNGY

SEQ ID NO: 202701 - protein, 143 aa, Glycine max
  Coding DNA Sequence Number=SeqID_85923
MGNTSSSNSKVHGQVTRVASTEPGYDPRMRMPVAKFRDEYIGKSTAEIRGTLKGQHGSGVYSDNTPLDNDETFNSFIRHAKYKIRTVSHIGREHSNVASASLPDEEANARDNQNDQFSNFIQSAKNKLRATSSMRKNGTFKRG

SEQ ID NO: 202702 - protein, 110 aa, Glycine max
  Coding DNA Sequence Number=SeqID_85924
MMEREMIIVMVDTLPVFYYEKMVGYTASSFADFVFADERIKVGLKRGKFNHLAWTNEKTGANEEGENEGETHAATIIPTWKLPHQLNNIITQPISALLITHHPVIHKGHP

SEQ ID NO: 202703 - protein, 61 aa, Glycine max
  Coding DNA Sequence Number=SeqID_85925
MGHLSDQRVPTNPKRIKIIPEWPTPPSVEGRSPEFQEPLDLRSNPFQGGRNDVILPSKGIG

SEQ ID NO: 202704 - protein, 123 aa, Glycine max
  Coding DNA Sequence Number=SeqID_85926
MSIMVVGEGLDLSGGVLHLRLGRMLTISEREVEGQVLPLPHGGLPIWHVGLRVPFVRRTRGGTYKTKDSDAQVLEITHWPNSLAAKGNASMFLFQGWHRGLTCVLEWHVICYMYFVDHGQCRL

SEQ ID NO: 202705 - protein, 305 aa, Glycine max
  Coding DNA Sequence Number=SeqID_85927
  Pfam annotation: Domain name=MFS_1; Domain location=2-275; Score= -53.9; E_value=0.092; Accession=PF07690.6; Description=Major Facilitator Superfamily
  Subcellular localization annotation: CTP_CleavageSite=64; ConfidenceScore=5.59e-01
MIVFSLFFKLLSLAVLFTGQTFMVCMIVMLTNGLASSFFSTASKIYVRATSKNISESFSARMTLSNAGAAISPMVISALVFFAVPFRPALLILIALFTMGVLVATGLKPCQRVATPEVSATGLTGLFSKETATVATLSIVFAMLYYTFETIVPLELVQSDLKSLIGPVMLFNTGVIILGQIPVYKYFTEKFGVVNALLIATALCIVLFIPWFLQWAKLSGLLLIVVGVTFLEMFYGAGIDTVIASADSDKKIALLDGVSSVALSAGAALAAAIYGDPVMFIPFVMTLFVLSFFFVRGEKTGLIRP

SEQ ID NO: 202706 - protein, 217 aa, Glycine max
  Coding DNA Sequence Number=SeqID_85928
  Gene Ontology: Mol. function=chitin binding; Cellular component =extracellular region; Biological process=chitin metabolic process
  Homolog annotation: Hit_ID=UPI000044A8F0; Match level="QueryCoverage =82%, HitCoverage=99%, E-value=1e-29, Identity=31%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
GQHVLAFRRLHVLAIRGLHVLAIRGLQALAYRGLHVLLAFRGLHVFSFRGLHVLAFRGLHALAFRGLHVLAFRGLHALTFRGLHVLTFRGLHALPIRGLHILAIRGLHTLAFRGLHILTFRGLHILTFRGLHVLTFRGLHVLTFRGLHVLAVRRLHVLAFSGLHVLTFRGLHALASRGKVIRTPTNRAFIKKYCAPRQAQGETPQQPGDGRQWATDA

SEQ ID NO: 202707 - protein, 45 aa, Glycine max
  Coding DNA Sequence Number=SeqID_85929
SSSSSTRVEHLFLDNRYGHALDFCNEGHGDHILTPSSLILFRYSR

SEQ ID NO: 202708 - protein, 128 aa, Glycine max
  Coding DNA Sequence Number=SeqID_85930
  Pfam annotation: Domain name=Transposase_23; Domain location=37-107; Score=-3.8; E_value=0.003; Accession=PF03017.5; Description =TNP1ENSPM transposase
MQSQGLTVPPEPEVGPSAARVSTKESWVDPSGNDPDTGDSDKCGLYIEENPPRLVALGRLSEGSTTVHNIPLLHDQVKVGVEEVRDTDAPIPVPTKEVKLVGQTLFLLGRHILSSVYQNRELWDWGNL

SEQ ID NO: 202709 - protein, 66 aa, Glycine max
  Coding DNA Sequence Number=SeqID_85931
MTRTKKTRKMTSEATKEIVEKTDSLKEQSSQGSFVAHGRQDVLTASIGRPEHPGHVCAAGAGVTIK

SEQ ID NO: 202710 - protein, 99 aa, Glycine max
  Coding DNA Sequence Number=SeqID_85932
  Homolog annotation: Hit_ID=Q1RSI8; Match level="QueryCoverage=92%, HitCoverage=19%, E-value=5e-10, Identity=41%"; Hit description=IMP dehydrogenase/GMP reductase
MVQSLCLMASHGYPPGLVLHPQVLGLPCATMKGYQTFFPSPVAKADLIRYQSRCLEPSPCEESMKSQNEWFDYNKFVNVDFSVERPMLIDDQGIGKKCR

SEQ ID NO: 202711 - protein, 68 aa, Glycine max
  Coding DNA Sequence Number=SeqID_85933
  Gene Ontology: Mol. function=U6 snRNA binding; Cellular component =ribonucleoprotein complex; Biological process=mRNA metabolic process
  Homolog annotation: Hit_ID=Q7F193; Match level="QueryCoverage=86%, HitCoverage=20%, E-value=2e-18, Identity=75%"; Hit description =Putative snRNP core protein SMX5d
  Pfam annotation: Domain name=LSM; Domain location=1-66; Score=42.2; E_ value=1.8e-09; Accession=PF01423.12; Description=LSM domain
SYFKDLVGREVIVELKNDLAIKGTLHSVDQYLNIKLENTSVVNQEKYPHMYSNLSIGVNGVPVVTGQF

SEQ ID NO: 202712 - protein, 196 aa, Glycine max
  Coding DNA Sequence Number=SeqID_85934
MYEYLEEERVPDLESILADFMTYQAISKRSCYGMQQQGTQFQRNQSSAGYHWESCWQLDYDDKAEGVINLDDLLMQFKDTVESMQQAFRRTTTHISKLVDDMANTAAREEEERIEIETYQESIFQVTSIHNQMTTEEETSIISSTPEYSCSAFAGYVRGTEKGRLKLTVEDQKESFDLFEAMKHSDMGDACSEEEE

SEQ ID NO: 202713 - protein, 905 aa, Glycine max
  Coding DNA Sequence Number=SeqID_85935
  Gene Ontology: Mol. function=hydrolase activity, hydrolyzing O -glycosyl compounds; Biological process=carbohydrate metabolic process
  Homolog annotation: Hit_ID=Q105A1; Match level="QueryCoverage=94%, HitCoverage=98%, E-value=0.0, Identity=65%"; Hit description =Isoamylase isoform 2
  Pfam annotation: Domain name=Alpha-amylase; Domain location=359-733; Score=-87.0; E_value=0.0086; Accession=PF00128.14; Description=Alpha amylase, catalytic domain
  Pfam annotation: Domain name=Isoamylase_N; Domain location=221-314; Score=65.5; E_value=1.7e-16; Accession=PF02922.8; Description =Isoamylase N-terminal domain
  Pfam module annotation: Pfam domain module=Alpha-amylase::Isoamylase _N; Domain location=359-733::221-314
  Subcellular localization annotation: CTP_CleavageSite=58; ConfidenceScore=5.48e-01
MAILAPRFSFSVIPRNHHKLKRSFSHKPFIQRKQLWHQLGLQSLVSPFSLNPTSSKLCATSRLSIEETEQQIGTLTRPEDLKGSLAYLFRTETGGGLVKVHVTRRNDRYSVYIEISSLDISGGVGEALLLCWGVYRSDSSCFVDLDTIGLSENAAMGMNVSPLVQNSDGKFAIELEFDAKHVPLYLSFFLMSSLDSGLEIRSHRRTNFCMPVGSLPGYPCPLGVSYSPDGSVNFSIFSRHAESVVLCLYDENGVEKPALELDLDPYVNRTGDIWHVSFESAKGFVSYGYRCRRGVLKKNKDDGFAEHVVLDPYAKIVGNSYPDGVGLVKNLGCLRKEPFFDWGGDRHPDLSMEKLVVYRLNVKRFTQHESSQLPSGLAGTFTGLAKKVQHFKDLGVNAVLLEPVFTFDEKKGPYFPCHFFSLMHIYGPSGGPVSAIAAMKEMVKTMHANGIEVLVEVVFSNTAEIGAIQGIDDSSYYYANGVGGLKVQSALNCNYPIVQNLILDSLRHWVTEFHIDGFSFINASHLLRGFHGEYLSRPPLVEAIAFDPVLSKTKIIADCWDPHGMVAKEIRFPHWMRWAEMNTHFCNDVRNFLRGQNLLSDLATRLCGSGDIFSGGRGPGFSFNYIARNFGVSLVDLVSFSSVDELSWNCGAEGPTNNTAVLERRLKQIRNFLFILFVSLGVPVLNMGDECGQSSGGFTAYDGIKPFSWSALKTGFGKQTSEFIFFLSSLRKRRSYLLQRRSFLKEENIEWYGSDGDPPRWEDPSCKFLAMILKAEVTEFLESSVSSDISGDLFIAFNATDHPETAVLPLPPEGMSWYRLVDTALPFPGFFSTSGEVVPEQTEAMHSPPLQSPSLTDCHQLGQRKKKSFSQCDGDDNGGSRQCGGCKCSGCQRRLEKAADCNGSF

SEQ ID NO: 202714 - protein, 649 aa, Glycine max
  Coding DNA Sequence Number=SeqID_85936
  Gene Ontology: Mol. function=amylo-alpha-1,6-glucosidase activity; Cellular component=membrane; Biological process=Golgi to plasma membrane transport
  Homolog annotation: Hit_ID=Q5JLH8; Match level="QueryCoverage=99%, HitCoverage=88%, E-value=0.0, Identity=59%"; Hit description =Putative ERD4 protein
  Pfam annotation: Domain name=DUF221; Domain location=304-649; Score =354.4; E_value=1.8e-103; Accession=PF02714.6; Description=Domain of unknown function DUF221
MATIGDICVSASINLLSALAFLLAFGILRLQPFNDRVYFPKWYLKGIRGSPTGSNAVKKFVNLDFATYIRFLNWMPAALHIQEPELIDHAGLDSTVYIRIYLLGVKIFAPITLLAFMVLVPVNWFGKTLEAPGAKDLTFSSIDKISISNIPFGSDRFWAHIVMSYVFSSWTCYSLYKEYGIIAEMRLRFLAAERRRPDQFTVLVRNVPTDPDESVSEHIEHFFCVNHPDHYLMHQVVYNANKLASIAAKKKKLINWHVYYQNKYERNPSKRPTIRTGFLGFLGNKVDAIDHYTAIIDNLSKQEAQERENIINNPTAVIPAAFVSFKTRWAAAVCAQTQQTSNPTIWLTEWAPEPRDVFWENLAIPYFDLNMRRLLMTVSLFFLTFCFMIPIALVQSLANIEAIEKVLPFLKPIIEKSSIKSVIQGFLPGLALKIFLIMLPKILMTMSKMEGFTSLSGLDRRFTKTVGSTIPMKATFFITYIMIDGWAGIAAEILRLSPLITFHMKNTFLVKTEQDRQNAMDPGSLEFATSEPRIQLYFMLGHVYAPVTPFLLPFIVVFFAFAYMIFRHQIINVYAQQYESGGAFWPDVHGRVVMGLIISQILLMGLLTTRGTDKSTLVLIAQPILTFWFHRYCKGRFESAFVKFPLEVG

SEQ ID NO: 202715 - protein, 310 aa, Glycine max
  Coding DNA Sequence Number=SeqID_85937
DAYIVYMTALSELNCGAKQDVYGSAINCEQARTITGGPQWEGRWLLDTTTEGLKDLADFLPASLVTIASYFSAEDTRDIWKPAFMDGTDWISPAANLALVEQQIKKILAATGVDVPSLDIDGNSPATLPLPLAAFVSLTITYKLDKATERFLALIAPAGSALASGCSWPSLPIVTSLWIQMVKRWSNYFVLSASSTVFHHNKDAIVQLLKSCFTSTLGLGYGSIYNNSGASALLDIASSDLMPKRVVRKPSLGTNKFLLVALKQGFGLPYPWVGPELDGGSSSIMGPGGVQGDVTVANMDIVEVPGDGDR

SEQ ID NO: 202716 - protein, 60 aa, Glycine max
  Coding DNA Sequence Number=SeqID_85938
VREIEQEVYTEPETAQKKDTKLTAAVDLSKRLKDFRSLNDAASLKVPSYLELRIIIVMQQ

SEQ ID NO: 202717 - protein, 46 aa, Glycine max
  Coding DNA Sequence Number=SeqID_85939
EMAPRKLPAKRSGKDKAAEGTSAAPEYDNHRFWSAEHQQRFEAIKG

SEQ ID NO: 202718 - protein, 218 aa, Glycine max
  Coding DNA Sequence Number=SeqID_85940
EVQEQMKADMEAMKEQMATMMEAMMSMKKMMEVNMAIVVATSIAIEVDPTHPSGLNPVNPPVSDIVGQRGEVLGSAGGPHFVQVQNKHSFPPYGLPPNYTPPDVAHAPDENVNNSTPIFIESQQPQSEHAHHLGGPQYRPQPQPLHFELERLPPAMVEREKIDHIEERLRVSNFDKYKGTTCPKNHLNMYSRKMGAYSKDEKLLMHFFQERLIGAVLT

SEQ ID NO: 202719 - protein, 142 aa, Glycine max
  Coding DNA Sequence Number=SeqID_85941
  Subcellular localization annotation: CTP_CleavageSite=33; ConfidenceScore=5.26e-01
MNIGALISGQMTSIAQSNTSRLGFPALITALCRARGVVSDSLTFERLSPVINLAYIRKNCWNPEDLTVSIRGARGARARLAELPSTSAAPTPASTSVAPSVPVQIDSQHLEAMLQSIHQGHIILLQSLQMMAPLNSSFSKAI

SEQ ID NO: 202720 - protein, 161 aa, Glycine max
  Coding DNA Sequence Number=SeqID_85942
MAPKHMEQLTQKIRDQLEESITEKVTRQVLTLPPEPVDGRSATHVSTKENVVIWFCSLHNRLDFLKGIIIRSDIFFNTFTLALFGNINILIVQFTSMFVLNNALKGFDDTPQSKSKATARWIVVKCNRQKGSTACEYYVMHRMSTIILGSFKNNWKMVNLG

SEQ ID NO: 202721 - protein, 241 aa, Glycine max
  Coding DNA Sequence Number=SeqID_85943
  Gene Ontology: Mol. function=nucleic acid binding; Biological process= DNA integration
MIEFQMIDGKSISNQIHEFENIVYDMKLKGIVLPDIMLVAFMISKLPPSWTDFARSLKHKHESFTFDDLLVCLHIEDKHRSSQKHLQKSDSHSKAYLVESSSKPFSKSFKRHGFNKNKFGRKPSFSKNKNNAFNNNNKPKDKNLGNEIFCFVSGRANHLAKNCFQRHRQPTSFPKPQANVVTTNATSDSPSDKLRGSCSLIKHTYCEHGEWEYGTCVRRRSSEARAIFGKGYCFRWCLSYF

SEQ ID NO: 202722 - protein, 152 aa, Glycine max
  Coding DNA Sequence Number=SeqID_85944
  Gene Ontology: Mol. function=transcription corepressor activity; Cellular component=nucleus; Biological process=regulation of transcription, DNA-dependent
  Homolog annotation: Hit_ID=Q1EPA1; Match level="QueryCoverage=92%, HitCoverage=10%, E-value=5e-36, Identity=51%"; Hit description =Paired amphipathic helix repeat-containing protein / transcription regulator-related
  Pfam annotation: Domain name=PAH; Domain location=18-64; Score=56.6; E_value=8.3e-14; Accession=PF02671.11; Description=Paired amphipathic helix repeat
  Pfam annotation: Domain name=PAH; Domain location=97-143; Score=32.5; E_value=1.5e-06; Accession=PF02671.11; Description=Paired amphipathic helix repeat
  Pfam module annotation: Pfam domain module=PAH::PAH; Domain location =18-64::97-143
MDALQYIKEVQCAFHDSREKFDKFMDVMKDYKFHRIDVGIVVEKMEEILKDHGDLILGFNKFLPKGYEILLLDEGEDGFGNASKYLKKIQDRFENKDHVYKSFLNILLKYKNNGVTLYDTYHEVATIFEGHRDLVRDFTKFLPSVHLRGKST

SEQ ID NO: 202723 - protein, 107 aa, Glycine max
  Coding DNA Sequence Number=SeqID_85945
MEPIASLAQYYDQPLRCFIFGDFQLSPMVEEFEEILGCPLGGRKPYLFSGFYPHWPEFLKKVQISAQELDRQRQVENGVVGIPRKYLERSTFFSPIITTRKVRLPLC

SEQ ID NO: 202724 - protein, 94 aa, Glycine max
  Coding DNA Sequence Number=SeqID_85946
MASYGVASPLSLPFSIPLPFIFQEAKESIDEEDPRPTSSNGACINFLLQGHAIWTKECWGNIPKSDVNQRGIEVDHDKVRAILDMPPPSSKKDV

SEQ ID NO: 202725 - protein, 82 aa, Glycine max
  Coding DNA Sequence Number=SeqID_85947
  Homolog annotation: Hit_ID=Q7X9F2; Match level="QueryCoverage=59%, HitCoverage=61%, E-value=4e-14, Identity=79%"; Hit description =Centromere protein
MVEKKEGSEIFPFTKNGEIGNQSKILERLHCDAQKLRNLQITIKDLMKKVDINEKSTKGKSVEFGEVKGHQSKLTWVHLIPT

SEQ ID NO: 202726 - protein, 139 aa, Glycine max
  Coding DNA Sequence Number=SeqID_85948
  Gene Ontology: Mol. function=single-stranded DNA binding; Cellular component=chromosome; Biological process=DNA metabolic process
  Homolog annotation: Hit_ID=Q1XR71; Match level="QueryCoverage=98%, HitCoverage=38%, E-value=5e-33, Identity=51%"; Hit description=RecF protein
MVSVIYESHLLESSFENLLKESLERDRMLTYTSRGIHKDDLLFEMDAALIKKIGSQGQQKSFLISLKLAQMSLVKELTGKTPILLLDDIFDKLDDHRVAQLIELVNKENFGQIFITDTHRERTESVVKKINEESIIFEI

SEQ ID NO: 202727 - protein, 60 aa, Glycine max
  Coding DNA Sequence Number=SeqID_85949
MEEREWKIFRPNKFSARLPFSTGDIPPHMNKEEKTETPSFLSKNTSLEKIILVRDRTFDL

SEQ ID NO: 202728 - protein, 100 aa, Glycine max
  Coding DNA Sequence Number=SeqID_85950
MTATQQLDLLRHPPVTHDASFVEPHIPQVPKPPAATPTHARSDVDQPRHEVDACHAIAERLECLLNLRIVMAGIETHKVMEECIKIARGVIEDDNVYVRS

SEQ ID NO: 202729 - protein, 58 aa, Glycine max
  Coding DNA Sequence Number=SeqID_85951
MKLRGDNDGHNTGNDTNERQRQHHKERHRGLAMKRVSRKPVVDAARSTSVLNKTDVKA

SEQ ID NO: 202730 - protein, 335 aa, Glycine max
  Coding DNA Sequence Number=SeqID_85952
  Gene Ontology: Mol. function=endonuclease activity; Cellular component=nucleus
  Homolog annotation: Hit_ID=Q2HUP4; Match level="QueryCoverage=40%, HitCoverage=46%, E-value=3e-47, Identity=66%"; Hit description =Endonuclease/exonuclease/phosphatase
RHHDSLDCAAATSNKSEIYKEEAGNAAQKPKAKRVESVNVDAEAFGDHLESSDCSIHSEVEALEHMMKRDRGHQNVSLENKTGDSTVVKMSEKNNNADVGDCMILDDHEGEENCCGKGTNARSDMKGGEHKYGFSNNKREKPEKCLQETKWTGEKAKELDNSGFKLWYTGKIRSRNGVGIIVDKEWKKDVVDVRRVGERIIALKLVVGQDTFNVISGYAPQVGLAEHFKVKVWEDLEGVLQDIPQGEKVFLGGDLNGHVGSVARGFEGVHGGFGLWEMNAEGKSILEFSEALDLSIANTWFKKREEHLITYKSGGTCSQIDFFLIRKSDRKYCLN

SEQ ID NO: 202731 - protein, 114 aa, Glycine max
  Coding DNA Sequence Number=SeqID_85953
  Subcellular localization annotation: CTP_CleavageSite=36; ConfidenceScore=5.21e-01
MTIYRKEPRGVDKFAQANFLLSVEGTNSPRRVVHVSQTRVATCPFAGERRRGSRVRFPKEERCAESPPTFICGKRRKNRRKPVKMKILSSGVVFTLEEGINTSHVCLKGQQPIF

SEQ ID NO: 202732 - protein, 104 aa, Glycine max
  Coding DNA Sequence Number=SeqID_85954
  Subcellular localization annotation: CTP_CleavageSite=77; ConfidenceScore=5.09e-01
MTSTLASAGQVSQYLPSMIPTFVLSRWVMARCGAGELVTHLCVELNLVFGGSSVLGILIILKVGFEYFGLARGVVPGCAIKGSNGSVVCWANNGQFSMAPCISK

SEQ ID NO: 202733 - protein, 62 aa, Glycine max
  Coding DNA Sequence Number=SeqID_85955
MDNESQFFYQSDFLCGAYGMGDNNDENVGGEDSDMQTQPSYLDFSSYFMTDKIFQEHDDLLN

SEQ ID NO: 202734 - protein, 84 aa, Glycine max
  Coding DNA Sequence Number=SeqID_85956
MESPYVATYPSAGRRRGVHMCVFQGRKARGVATNVYLRKTSEKPERCSLRTLIAKGSRVDFTQGEGCFPHSYVFLNCDEEIRPT

SEQ ID NO: 202735 - protein, 51 aa, Glycine max
  Coding DNA Sequence Number=SeqID_85957
  Gene Ontology: Mol. function=sequence-specific DNA binding; Cellular component=nucleus; Biological process=regulation of transcription
  Homolog annotation: Hit_ID=Q2QMN5; Match level="QueryCoverage=81%, HitCoverage=11%, E-value=3e-15, Identity=88%"; Hit description=WRKY DNA binding domain containing protein, expressed
  Pfam annotation: Domain name=WRKY; Domain location=31-51; Score= -14.7; E_value=0.044; Accession=PF03106.6; Description=WRKY DNA -binding domain
MGTEGVRYMRKLRLKRVIRVPAISSKNADIPPDEYSWRKYGQKPIKGSPHP

SEQ ID NO: 202736 - protein, 155 aa, Glycine max
  Coding DNA Sequence Number=SeqID_85958
  Gene Ontology: Mol. function=protein serine/threonine kinase activity; Cellular component=integral to membrane; Biological process=protein amino acid phosphorylation
  Homolog annotation: Hit_ID=Q9FEU2; Match level="QueryCoverage=95%, HitCoverage=12%, E-value=8e-32, Identity=48%"; Hit description =Receptor protein kinase
YGYSLRITEKSDVYSFGVVLIEVLTGMEPIDSRIPEGSHVVPWVIREIREKKTEFASILDQKLTLQCGTQIPEMLQVLGVALLCVNPSPEERPTMKDVTAMLKEIRHESVDFDFEKSHLLHKGAVTNPKAAVQCPSFSRSCKPLTESPSSSVSPH

SEQ ID NO: 202737 - protein, 94 aa, Glycine max
  Coding DNA Sequence Number=SeqID_85959
  Subcellular localization annotation: CTP_CleavageSite=28; ConfidenceScore=5.02e-01
MTATSTMNSSTATNSGELNTNLELQIILASPDSNRTWTHWMQLVWQQSSGSSFSGSSGISCDGSKFLSLSMLGLGRIGSRAVRCSVSVFTVHAP

SEQ ID NO: 202738 - protein, 96 aa, Glycine max
  Coding DNA Sequence Number=SeqID_85960
MAHLLAMVVEGVGGFVKTLWALQERRWSYTFDAVASAAVSVTMALVLCLLSIRTSYRHRRDYFLLFKLHLSLAKNLKSNKVHQTTSTPVHHTLDAP

SEQ ID NO: 202739 - protein, 168 aa, Glycine max
  Coding DNA Sequence Number=SeqID_85961
  Gene Ontology: Mol. function=nucleic acid binding; Cellular component= integral to membrane; Biological process=DNA integration
  Homolog annotation: Hit_ID=Q1SJY4; Match level="QueryCoverage=89%, HitCoverage=31%, E-value=3e-20, Identity=36%"; Hit description=Zinc finger, CCHC-type
  Pfam annotation: Domain name=Occludin_ELL; Domain location=63-159; Score=-28.3; E_value=0.03; Accession=PF07303.3; Description=Occludin and RNA polymerase II elongat
VDGKTIVKPFESWSVEELKRVEYDSKAMNIIHPFLNCDEFFRVSTCTTMKEIWNLIQVTHEGTLKVRRARKNYVIQEYETFRMLQGETIGNVQKRFTRIVNHLKDLGKVFEEKELNVKILKSFNKTRQLKVMTISESKDLTSITHVELFKKLRESEMDMTRMAEEEAK

SEQ ID NO: 202740 - protein, 86 aa, Glycine max
  Coding DNA Sequence Number=SeqID_85962
  Subcellular localization annotation: CTP_CleavageSite=40; ConfidenceScore=5.22e-01
MPHNMDGLTGSKSNSLPRLRRRPPCPILKFRGGVLQGSQRVMKLSGSQRHITNHSYKLLRAIREPIMVLAQLLVISEKTNPTTLEN

SEQ ID NO: 202741 - protein, 62 aa, Glycine max
  Coding DNA Sequence Number=SeqID_85963
MRGGGCIAARPGELLASSKSNLPRPGELEKETVIVSKKMKADNNDCLRMPTDLIVSGRQMRL

SEQ ID NO: 202742 - protein, 204 aa, Glycine max
  Coding DNA Sequence Number=SeqID_85964
MAFLGETSSQTIVNSRLAFIFPNGSIIHNDTGVYFQTLIPVPIRVPNNYDFASLKIRIHNTLQLSNKQFLDEIHYRKPFTHTGNQIRFQCMKLINDDDVNTMLMCNDQFSCVGPIKLLCTVGRTPDGVINLLQCTMPRTHDAILYYNGKWNMPPQNKFVGCVFTGKNPKKFQIPSTCTIDELKNLIKQVAPKGIPPLGIHESQT

SEQ ID NO: 202743 - protein, 55 aa, Glycine max
  Coding DNA Sequence Number=SeqID_85965
MAMIEVSVEAMASLTKMLHLVPIVEEFEEILGCLLGGRKLYLFGGFYPSMARIAK

SEQ ID NO: 202744 - protein, 93 aa, Glycine max
  Coding DNA Sequence Number=SeqID_85966
MLIDVGNALACACCVCSWGALCTDLLGALCTDFPGSLALAFGHDHTSYGVYVMGGGLSRGREHLWAPRLITYGKRAVTFTPGWFRQSTAQFPK

SEQ ID NO: 202745 - protein, 105 aa, Glycine max
  Coding DNA Sequence Number=SeqID_85967
MAVPKLEKMQRQAETNKKQRRTMSKGSSQCGVATANNDGLWWLMVVVGDGESAWDVRNGFGRKKEEEMVFFLSYTKARAENAQVRNGLGHGNITHTPDIFSKIPT

SEQ ID NO: 202746 - protein, 146 aa, Glycine max
  Coding DNA Sequence Number=SeqID_85968
MRVVCQRKSSRLVALGRLYEGSTTVHNILFHNDQVKVGVEEVRDADAPIPTPIQEVQLGVVGLIKLADRPNHDVDDPLYLMTLTIPQLFLKSLQNSKRDVYLGAYLNEPDNYLKGITNSALKGFDNTPQSKSKATARWIVVKVNLG

SEQ ID NO: 202747 - protein, 810 aa, Glycine max
  Coding DNA Sequence Number=SeqID_85969
  Gene Ontology: Mol. function=actin binding; Cellular component =phragmoplast; Biological process=actin cytoskeleton organization and biogenesis
  Homolog annotation: Hit_ID=Q1S7L8; Match level="QueryCoverage=94%, HitCoverage=87%, E-value=0.0, Identity=57%"; Hit description=Actin -binding FH2
  Pfam annotation: Domain name=FH2; Domain location=330-728; Score =526.7; E_value=2.6e-155; Accession=PF02181.13; Description=Formin Homology 2 Domain
  Subcellular localization annotation: CTP_CleavageSite=35; ConfidenceScore=5.08e-01
PTKPAKKVAIVISVGIVTLGMFSALGFFLYRHRVRHPAETQKLVSRKVLEDSPRAPPPPPPSSFLYIGTVEPTRTSLSEPNGITVNTSPYRKLDSIKLSSNHRYRPSPELQPLPPPHKPPDESHSPAAEFSDSSSSSEEESCETAFHSPHGSSLGCEENFFTPVSRHSCLSAAAAAPVVPHSKRTSPKSRFSAPTPEIRNIVVPPVKPSPAPAPVPAASTKYHHVEKELTLGPSRRPKFSSHPPAPNLTHLHSNEFTTSLKPPPPPPPPPPPPQTLPLRKVWSLSISTSSSSVSRKNGESWSPNEGGSSGNRVSVRKGSFEEVYQRREGDDVDGAKPKLKALHWDKVSTTSDRATVWDQLKFSSFQLNEDMMETLFGCKSTGSASKENVTRRSVLPPAEPENRVLDPKKSQNIAILLRALNVTRDEVCEALLDGNPEGLGSELLETLVKMALTKEEEIKLKNYDGDLSRLGSAERFLKAVLDIPLAFKRIEAMLYRANFETEVNYLRKSFQTLDVASEELKNSRLFLKLLEAVLRTGNRMNVGTNRGGAISFKLDTLLKLVDIKGTDGKTTLLHFVVQEIIRSEGTGGESANCNVQNQTNSQFNEDEFRKKGLQVVAGLSRDLGNVKKAAGMDSDVLSSYVSKLEIGLDKVRLVLQCRKPDMHGNFFNSTALFLKDAEEEIVRIKADERKALFLVKEVTEYFHGDAAKEEAHPFRIFMVVRDFLNSLDQVCKEVGRMQDRTVIGSARSFRIAASASLPVLNKYHARQDRSINFNRISTITKRIQFISNSEGGQLFLRLNIKHLQAWWGRE

SEQ ID NO: 202748 - protein, 1030 aa, Glycine max
  Coding DNA Sequence Number=SeqID_85970
  Gene Ontology: Mol. function=hydrolase activity, acting on acid anhydrides, catalyzing transmembrane movement of substances; Cellular component=membrane; Biological process=calcium ion transport
  Homolog annotation: Hit_ID=Q1S6T2; Match level="QueryCoverage=99%, HitCoverage=100%, E-value=0.0, Identity=86%"; Hit description=Cation transporting ATPase, C-terminal
  Pfam annotation: Domain name=Cation_ATPase_C; Domain location=888 -1030; Score=26.6; E_value=2e-06; Accession=PF00689.11; Description =Cation transporting ATPase, C-terminus
  Pfam annotation: Domain name=Cation_ATPase_N; Domain location=125 -206; Score=59.3; E_value=1.3e-14; Accession=PF00690.16; Description =Cation transporterATPase, N-terminus
  Pfam annotation: Domain name=E1-E2_ATPase; Domain location=220-461; Score=229.0; E_value=1.1e-65; Accession=PF00122.10; Description=E1 -E2 ATPase
  Pfam annotation: Domain name=Hydrolase; Domain location=465-792; Score=55.7; E_value=1.5e-13; Accession=PF00702.16; Description =haloacid dehalogenase-like hydrolase
  Pfam module annotation: Pfam domain module=Cation_ATPase_C::Cation _ATPase_N::E1-E2_ATPase::Hydrolase; Domain location=888-1030::125 -206::220-461::465-792
  Subcellular localization annotation: CTP_CleavageSite=52; ConfidenceScore=5.03e-01
MESYLHENFGGVKSKNTTEEALQKWRKVCGVVKNPKRRFRFTANISKRSEAAAMRRTNQTMGVPQPTGQKLTPFMEKLRVAVLVSKAAFQFIQGVQPSDYVVPDEVKAAGFQICAEELGSIVEGHDVKKLKFHGGVDGIAGKLSTSTTTGLSGDSESRHRRQELFGVNKFTESEVRSFWIFVYEALQDMTLMILGVCAFVSLIVGIATEGWPKGAHDGLGIVASILLVVFVTATSDYRQSLQFKDLDKEKKKISIQVTRNGYRQKMSIYSLLPGDIVHLSIGDQVPADGLFVSGFSVLIDESSLTGESEPVMVTSQNPFLLSGTKVQDGSCTMLITTVGMRTQWGKLMATLSEGGDDETPLQVKLNGVATIIGKIGLVFAVITFAVLVKGLMGRKLQEGRFWWWSADDAMEMLEFFAIAVTIVVVAVPEGLPLAVTLSLAFAMKKMMNDKALVRHLAACETMGSATTICSDKTGTLTTNRMTVVKTCIFMNIKEVTSNDSSLSTELPDSALKMLLQSIFNNTGGEVVVNKKGKREILGTPTESALLEFGLSLGGDFHAERQTCKVVKVEPFNSERKRMGVVLEIPDGGLRAHCKGASEIILAACDKVMNSNGDVVSIDEESSNYLNSTIDQFASEALRTLCLAYMELENGFSAEDPIPVSGYTCVGIVGIKDPVRPSVKESVEVCRSAGIVVRMVTGDNINTAKAIARECGILTDDGIAIEGPDFREKTQEELFELIPKIQVMARSSPLDKHTLVKHLRTTFGEVVAVTGDGTNDAPALHEADIGLAMGIAGTEVAKESADVIILDDNFSTIVTVAKWGRSVYINIQKFVQFQLTVNVVALLVNFSSACMTGSAPLTAVQLLWVNMIMDTLGALALATEPPTDDLMKRTPVGRKGEFISNVMWRNILGQALYQFVVIWFLQSVGKWVFFLRGPDAEVVLNTLIFNTFVFCQVFNEVNSREMEEVDVFKGIWDNHVFIAVLSATVFFQILIVEYLGTFANTTPLSLVQWIFCLGAGYVGMPLAVRLKQIPV

SEQ ID NO: 202749 - protein, 335 aa, Glycine max
  Coding DNA Sequence Number=SeqID_85971
  Gene Ontology: Mol. function=hydrogen ion transporting ATP synthase activity, rotational mechanism; Cellular component=proton -transporting two-sector ATPase complex; Biological process=ATP synthesis coupled proton transport
  Homolog annotation: Hit_ID=Q1S7U6; Match level="QueryCoverage=80%, HitCoverage=16%, E-value=3e-67, Identity=52%"; Hit description =Prefoldin
  Subcellular localization annotation: CTP_CleavageSite=37; ConfidenceScore=5.13e-01
MTRSARQIQRKWHPLSEAYSSLSGLGNPRRGSVKDVLAQRVPVSLNEPVSLSEPISLSEPLEAEKSKSLYNTEAKEGKVKVVDDSLSEADWLSDMDPLSEASNTHRYQSQSNDKASKAEIHTRLLKEALAQLKSEKEASQVQYNQCLESIAKLETMLSLAQLDAKEFDEKSSKAEIEAKILRQELGQLEAQKDAGFLRYKQYVENISVLEAKIILAEENSRMLSEQLEKAKLEVKTLRKNLVELNEEKESLVVLYHQCLEKISKMENEILLAQENSEKLNREIEKGAEKLKTVEEHCDMLEKSNQSLRLEAENMLQRIAMKDQALLEKHAEIERL

SEQ ID NO: 202750 - protein, 326 aa, Glycine max
  Coding DNA Sequence Number=SeqID_85972
  Gene Ontology: Mol. function=signal transducer activity; Cellular component=membrane; Biological process=response to light stimulus
  Pfam annotation: Domain name=BTB; Domain location=24-133; Score=4.0; E_value=0.0018; Accession=PF00651.21; Description=BTBPOZ domain
  Pfam annotation: Domain name=NPH3; Domain location=210-326; Score= -17.7; E_value=2.3e-09; Accession=PF03000.5; Description=NPH3 family
  Pfam module annotation: Pfam domain module=BTB::NPH3; Domain location= 24-133::210-326
MKFMKLGSKPDSFQNDGDNIRYVATELATDIVVNVGNVKFYLHKFPLLSRSTCFQKLITNANEENNDEVHIHDIPGGPAAFEICAKFCYGMTVTLNAYNVVAARCAAEYLEMYETVEKGNLIYKIEVFLNSSIFRSWKDSIIVLQTTKSLLPWSEELKLVSHGIDSIATKASIDTSKVEWSYTYNRKKLPSENSNDPHFNSVRKQQLVPKDWWVEDLCELQLDLYERVITTILTKGNVSGSVIGEALNAYASRRMPGFNKGVIQGGDNVKNRLLLETIIRILPLDVGSASFSFLGKLLRVAIQLECEELERSKLIRRIGMCLEEAK

SEQ ID NO: 202751 - protein, 132 aa, Glycine max
  Coding DNA Sequence Number=SeqID_85973
  Gene Ontology: Mol. function=RNA-directed DNA polymerase activity; Biological process=RNA-dependent DNA replication
MRVERVPMCDLQTSRVLVNEEIEDYLGLSPKLLRLVEQQTKEIQPHEELTEVINFGSKDEKKVKIGTLMKKPEWPPVKQKLWQMKLQLSLRIREEIKKQLDVGLLVIAKYSQWVAIVVPFPKKDGKVQMYVD

SEQ ID NO: 202752 - protein, 73 aa, Glycine max
  Coding DNA Sequence Number=SeqID_85974
MHGVQAVGPIGVTVVQALKATIGYSWSKNGFHSRKVIVWKKLTLEGRLLEFKCEGEVAHRVETLEGMIVGKQV

SEQ ID NO: 202753 - protein, 223 aa, Glycine max
  Coding DNA Sequence Number=SeqID_85975
  Gene Ontology: Mol. function=RNA-directed DNA polymerase activity; Cellular component=intracellular; Biological process=RNA-dependent DNA replication
MRNKKKKEEKVFDEEACEFLTLIRQSEYAVIDKLNRTSAKISHLSLMLNLEPPRKLLFKILNKGVGHNKALHILVKCMDHILSRVSVDDGSSMNVMLRMTLDKLPSDESHMKPSAMVVRAFDGSRRKIIGEISLPIHIGPVTFKVVFHVMDIIPDYIFYLGRPWIHCERVVPSTLQPKMKFIVDDKLVSISTKENLFVSKPLSTPYIEAAEQKRKRQLPNPNH

SEQ ID NO: 202754 - protein, 247 aa, Glycine max
  Coding DNA Sequence Number=SeqID_85976
  Gene Ontology: Mol. function=signal transducer activity; Cellular component=membrane; Biological process=response to light stimulus
  Pfam annotation: Domain name=NPH3; Domain location=2-86; Score=-25.7; E_value=7.7e-09; Accession=PF03000.5; Description=NPH3 family
MVSESSKAKVAKLVDGYLAEIARDPNLPLSKFVNLAELVSSFPRAFHDGLYRAIDMYLKEHPGISKSEKKRICRLMNCRKLSAEACMHAVQNERLPMRVVVQVLFFEQLRATTSSGGNGTPDHSGSIRASLPGGSHGSSRSEEEWEAVGTMEDIKSLKGELIALKLSGGTRGASSRSNNNDSSKGNSESVAASKMKGLVSKKIISKIWSSKERSGELSSSDTSESPASTVVEETKSTPSRSRRHSLS

SEQ ID NO: 202755 - protein, 223 aa, Glycine max
  Coding DNA Sequence Number=SeqID_85977
  Gene Ontology: Mol. function=electron transporter, transferring electrons within the cyclic electron transport pathway of photosynthesis activity; Cellular component=plasma membrane light -harvesting complex; Biological ...
  Gene Ontology: Cellular component=process=photosynthesis, light reaction
  Homolog annotation: Hit_ID=P56761; Match level="QueryCoverage=65%, HitCoverage=41%, E-value=7e-80, Identity=99%"; Hit description =Photosystem II D2 protein (Photosystem Q(A) protein)
  Pfam annotation: Domain name=Photo_RC; Domain location=1-129; Score= -32.2; E_value=3.4e-05; Accession=PF00124.9; Description =Photosynthetic reaction centre protei
MGVAGVLGTALLCAIHGATVENTLFEDGDGANTFRAFNPTQAEETYSMVTANRFWSQIFGVAFSNKRWLHFFMLFVPVTGLWMSALGVVGLALNLRAYDFVSQEIRAAEDPEFETFYTKNILLNEGIRAWMAAQDQPHENLIFPEEETTGFAWWAGNARLINLSGKLLGAHVAHAGLIVFWAGAMNLFEVAHFVPEKPMYEQGLILLPHLATLGWGVVLGGKL

SEQ ID NO: 202756 - protein, 118 aa, Glycine max
  Coding DNA Sequence Number=SeqID_85978
MIITQALCNRYVKIQSYVQCGTISVKNLVDPPEAHDKANHELEDQSESRCFARMLQPCRINTCLIKHSNGLYLPPRPKLQKVRQGLSFLIQIQPRKHFSTQTLSMNCTKHTIHQLFSK

SEQ ID NO: 202757 - protein, 180 aa, Glycine max
  Coding DNA Sequence Number=SeqID_85979
MNILTAHDQGWKLELERGSNQDKLLMQFIETTKSTQQALQSVEIQVGELAKAVTQFMSRQEKSFVEAEAQEKSPVKEHESREKDEEKDEEQAQQQWEKYSIVENQQENILQSNNLTHQLIDMKGRQEEHEETLSAILSLITNTFLEMIWNVLPDYMKFMEFLAKRRNFKEDVSFVTFMPP

SEQ ID NO: 202758 - protein, 98 aa, Glycine max
  Coding DNA Sequence Number=SeqID_85980
  Homolog annotation: Hit_ID=Q9FGQ4; Match level="QueryCoverage=39%, HitCoverage=23%, E-value=5e-08, Identity=69%"; Hit description =Arabidopsis thaliana genomic DNA, chromosome 3, TAC clone:K5K13
  Subcellular localization annotation: CTP_CleavageSite=77; ConfidenceScore=5.03e-01
MTFQSQSILTSFKWLDWAQNTLRVKNRQWSRLFLVDAKAIFWLTYARFFGRHQARLCHSLEGNASALTNFEVLDFLRAKGASKDPTRVIAKVAQSEYK

SEQ ID NO: 202759 - protein, 785 aa, Glycine max
  Coding DNA Sequence Number=SeqID_85981
  Homolog annotation: Hit_ID=Q6DAM0; Match level="QueryCoverage=46%, HitCoverage=54%, E-value=0.0, Identity=90%"; Hit description =Thiamine biosynthesis protein thiC
  Pfam annotation: Domain name=TMP-TENI; Domain location=343-532; Score= 257.7; E_value=2.4e-74; Accession=PF02581.7; Description=Thiamine monophosphate synthaseTENI
  Pfam annotation: Domain name=ThiC; Domain location=1-333; Score =732.6; E_value=2.6e-217; Accession=PF01964.9; Description=ThiC family
  Pfam module annotation: Pfam domain module=TMP-TENI::ThiC; Domain location=343-532::1-333
TVMDLSTGRYIHETREWILRNSPVPIGTVPIYQALEKVNGIAEDLNWDIFRDTLLEQAEQGVDYFTIHAGVLLRYVPMTAQRLTGIVSRGGSIMAKWCLSHHQENFLYQHFREICEICAAYDVALSLGDGLRPGSIQDANDEAQFAELRTLGELTQIAWQYDVQVMIEGPGHVPMQMIRRNMTEQLEHCHEAPFYTLGPLTTDIAPGYDHFTSGIGAAMIGWFGCAMLCYVTPKEHLGLPNKEDVKQGLITYKIAAHAADLAKGHPGAQIRDNAMSKARFEFRWEDQFNLALDPHTARAYHDETLPQESGKVAHFCSMCGPKFCSMKITQEVREFAARQQAEAQPIALGMAQMSDAFRSRSGELVLWIERLLAAGVRTLQLRIKDGDDRQIEAAVRDAIALGKQYGARLFINDYWRLAIKYNAYGVHLGQEDLDVADLDAIRHAGLRLGLSTHDDAELDRALALRPSYIALGHIFPTQTKEMPSAPQGIAELKRHLARLQHIPTVAIGGISLARVPEVLATGVGSIAVVSAITQAEDWQAATRQLLALSGLARPGTIAKVSLPAVACSGPGLASPTLCPALPFHRYSVREVIWRVSALQACMARSTAAPRLAIACSLRIQPHRIEGFRQLNPHQETALRPRDANAAGKIVAHPAAERLIVTLIHLTHAAQMRQYAIAIASRRDPAHAQAGRQGFGKRTAQQHAAIHIQRFDGDRTRILPRQLAVNIIFNDRRVKALRQRQQRALTRFRHDKSERVIAVGYHHHRFDWPLLKRQLQRLKTDPADRI

SEQ ID NO: 202760 - protein, 504 aa, Glycine max
  Coding DNA Sequence Number=SeqID_85982
  Gene Ontology: Mol. function=phosphoribosylamine-glycine ligase activity; Cellular component=phosphoribosylaminoimidazole carboxylase complex; Biological process=purine nucleotide biosynthetic process
  Homolog annotation: Hit_ID=Q6DAL3; Match level="QueryCoverage=59%, HitCoverage=70%, E-value=1e-137, Identity=81%"; Hit description =Phosphoribosylamine--glycine ligase
  Pfam annotation: Domain name=ATP-grasp_3; Domain location=4-171; Score=-53.8; E_value=0.077; Accession=PF02655.5; Description=ATP -grasp domain
  Pfam annotation: Domain name=GARS_A; Domain location=1-173; Score =375.4; E_value=8.6e-110; Accession=PF01071.10; Description =Phosphoribosylglycinamide synthetase,
  Pfam annotation: Domain name=GARS_C; Domain location=207-300; Score =179.6; E_value=7.8e-51; Accession=PF02843.7; Description =Phosphoribosylglycinamide synthetase, C domain
  Pfam module annotation: Pfam domain module=ATP-grasp_3::GARS_A::GARS _C; Domain location=4-171::1-173::207-300
NFTEVEPALAYLREKGAPIVIKADGLAAGKGVIVAMTLAEAEAAVQDMLAGNAFGDAGHRIVIEEFLDGEEASFIVMVDGDNVLPMATSQDHKRVGDGDTGPNTGGMGAYSPAPVVTDEIHQRVMDQIIWPTVNGMKAEGNTYTGFLYAGLMIDKAGQPKVIEFNCRFGDPETQPIMLRLQSDLVALCLAAVDGTLDQQQSQWDPRPSLGVVLAAGGYPGDYNTGDQIHGLPLEDVPDGKVFHAGTTLKDDLVVTSGGRVLCVTALGEDVAAAQKNAYALAQHISWNGSFCRNDIGYRAINRNLFRLPAALIFRRGTQQLNPLWRFQPRQGNRLLLPLLLSIQRRQRVSIERHIHLLPLTVTNLRTALPVPLPQQYPAIQQCIALRQHALRIKPVQLDAVGADGFTPASQLSLHKIKVALMVETQGYVVRLLASDVPFHAQQFIRLPDIVGGFPAIAIERGVDSTQMDGFVVAVFTPDSHRATVRKIAAGGESRKIGSGTAAGE

SEQ ID NO: 202761 - protein, 105 aa, Glycine max
  Coding DNA Sequence Number=SeqID_85983
MDNIRFTAPFKVQKNLLQVPFSYHRQWLRNYPKYVLFHCDGEIHFIRTLPAAASKFVYGSKKSITIHHGLPKSTKWPLSIHNDMPAITEPWFNLIHEKNLRPGDE

SEQ ID NO: 202762 - protein, 241 aa, Glycine max
  Coding DNA Sequence Number=SeqID_85984
MGEIEEGQERRKADMQAMKEKMATMMEAMMSIKRIMEVNAAAVAATSAIVEVDPTPPSSLNQINHLTSDVVGQEGKELGSIGDPHFVQVQNTHAFPPYGLPPNYTTPNVAHTPNENVNNSTTILVESRQPQSNHAHVSQPMGETHEIPHHNLADFEPCIGCATEGQAIGGVPLSNTLEGPRFCPQPQPFYFAVGRVPPAMAENGKLDQIEERLRAVEGGEDYAFADMEDLCLVPDKAKGLH

SEQ ID NO: 202763 - protein, 337 aa, Glycine max
  Coding DNA Sequence Number=SeqID_85985
  Gene Ontology: Mol. function=nucleic acid binding
  Homolog annotation: Hit_ID=Q1RVN3; Match level="QueryCoverage=88%, HitCoverage=49%, E-value=1e-12, Identity=22%"; Hit description =Nucleotide-binding, alpha-beta plait
  Pfam annotation: Domain name=RRM_1; Domain location=39-109; Score =8.6; E_value=0.023; Accession=PF00076.12; Description=RNA recognition motif. (a.k.a. RRM, R
MKVMQKSSLAGRQSQNLEIGDNNKHYRLNWRNNADITSFYFTHFPDEANAELLWRHFKKWGDVREVYIAKRLNKDGKRYRFMRFKGVSDAKGLEVRLDNIFINDCKLFVNLPRFDRPVRNTELLKKNPIGRKYTDEASKPCGVTTGALRRSYVDVVTKGGCQGDKRTDEAQTPTILINPDEGGEYWCNETWVGMLKKVMEVETLEDRITWELGYNVRTKFLGDDMVLLPGMSDDKAQLLIQSETESDDSLFYSLEKWTPKCRPNNRVVWLQLWGFPIQVWEMKNLRRAVAAIGDVIESDDDTEDRRRLDRARVLVQTPLPPLIRSEVIVRVGELEYR

SEQ ID NO: 202764 - protein, 60 aa, Glycine max
  Coding DNA Sequence Number=SeqID_85986
MPYYIVSVGDVKKRLSFELQKVAVGLSSVVGLSAYPSLSVASACLAQRRIWQSISIKAAR

SEQ ID NO: 202765 - protein, 102 aa, Glycine max
  Coding DNA Sequence Number=SeqID_85987
YMALMHGSVKKWHAACPLRAPIQGTCIILFEEHIAAVGTTSNNMLSKRKTLDEGSLLSQRALRRRAKARLNGKVDKSGALAPTYLPSKRKSDLRSSSLCVNQ

SEQ ID NO: 202766 - protein, 94 aa, Glycine max
  Coding DNA Sequence Number=SeqID_85988
MCWLCGIAGQAIGDVSFNKKFCGASWNGVAYKKAEQVGKLKGVDQSNFSDANSEVSVSESVATNRSNVSISEESETVGDKINMPFIDFLGVGAT

SEQ ID NO: 202767 - protein, 85 aa, Glycine max
  Coding DNA Sequence Number=SeqID_85989
MASSTCFQQISSQITIMKQKPSKTTHHISQNPIPTKIKDALHDSENAFLSRFGAEMATKGWSFVGASMVEEEEENGNVRERGKGF

SEQ ID NO: 202768 - protein, 101 aa, Glycine max
  Coding DNA Sequence Number=SeqID_85990
MVPIPLIAWNQLSIATKHLMELNMIEMIKLMKLETNQRIKSRMSYSFFLDQTVFIIIVKKSNLGIADFGVGCEHNKVDVRVDNKLGKTSEIVLGLSGGYIG

SEQ ID NO: 202769 - protein, 50 aa, Glycine max
  Coding DNA Sequence Number=SeqID_85991
MRYFEDMVTNGEWDEVEKYLFGFTKLKIEWEKYCRKQVWRNKICTRHNAG

SEQ ID NO: 202770 - protein, 280 aa, Glycine max
  Coding DNA Sequence Number=SeqID_85992
  Gene Ontology: Mol. function=sequence-specific DNA binding; Cellular component=nucleus; Biological process=regulation of transcription, DNA-dependent
  Homolog annotation: Hit_ID=Q6X7J3; Match level="QueryCoverage=86%, HitCoverage=80%, E-value=4e-30, Identity=39%"; Hit description =WUSCHEL-related homeobox 11
  Pfam annotation: Domain name=Homeobox; Domain location=29-90; Score =47.3; E_value=5e-11; Accession=PF00046.19; Description=Homeobox domain
MEDQGQQQQQQHQVEAKSPRQGTERSEAVRSRWTPKPEQILILESIFNSGMVNPPKDETVRIRKLLEKFGAVGDANVFYWFQNRRSRSRRRQRQMMQQQATATATATVTTFDHPQPQTQTLVNVGGAIPHDHHTLGNLVVATESSATSTMGFGCSSQSSYGFLGSSSSSSSCGGGVIGGQQQGMDGFFSSVSSHQMGFPDHHHTSPASSALYPPLDPNLTYQAGYGGPNISGFITVFINGIATELPKGPIDLKTVFGEDVMYQSQHKYENINLASMEASV

SEQ ID NO: 202771 - protein, 267 aa, Glycine max
  Coding DNA Sequence Number=SeqID_85993
  Gene Ontology: Mol. function=transferase activity; Cellular component= extracellular region; Biological process=RNA-dependent DNA replication
MDDAMYQFCSILSKGVSALIRLAQMLKTLHDEVKEPQNVLQVYEMASGQSINFGKSETFYSANTDEPRRKMMPDIIGVPVRIGGGMKWIKWEKLTVRKEDGGLNFRNLLGFNLAMLGKQGWKFISHPNAMVSRFFKAKYFRTMVFLNSNTGHSPSFIWRSIYCSWGLIKDGLRWQIGDGSRINMWQHQWLKGINNNSIGDAPHLSISQLNVKDLVVPNTRAWDINFTTALVPQQATDKIMKILLLEEMEDDSRIWRHTKDGCYSVKS

SEQ ID NO: 202772 - protein, 116 aa, Glycine max
  Coding DNA Sequence Number=SeqID_85994
MPSFLCDFAISIGGSDSGGSIQQPLMDWEVISIDGSSSEDTRRGASNNESSSSERLGASHCTGGCTFRLHRKVQPFAASLAREFVSFMVVLPSFSSGGPRRSGGDVKSSLLVDEYD

SEQ ID NO: 202773 - protein, 68 aa, Glycine max
  Coding DNA Sequence Number=SeqID_85995
MSVKNLVRHLRVNGKTDHTLEVKSLSLGKIIGKPVRVMLFSKNAHTIWDRHMLNGALKPGNLPPRPRF

SEQ ID NO: 202774 - protein, 63 aa, Glycine max
  Coding DNA Sequence Number=SeqID_85996
MHGSKLEGGGCMNENAIHGAPKRGKEWRIALSNLYPRLPTRGRRMHERKRSSLCIQPTYMTDP

SEQ ID NO: 202775 - protein, 67 aa, Glycine max
  Coding DNA Sequence Number=SeqID_85997
MTMNERSVNIHNLLPGRVPDNNTSAYIIWVNQTWQNMSNVVRKYMFLGSTLAHVIGHAMEKEKHRDV

SEQ ID NO: 202776 - protein, 92 aa, Glycine max
  Coding DNA Sequence Number=SeqID_85998
MFQYSNNTEYTMNSVITVLYFNGRVYEDNDGVIFEGSKKAIQIKRGISFNALKKKIGDKENILPCKFVMTKTLKRCWKVLNNKTKCQFWNCT

SEQ ID NO: 202777 - protein, 99 aa, Glycine max
  Coding DNA Sequence Number=SeqID_85999
MTNRLRILCPNTLEGTSFVVQVEVQVEGTSTWLFKENKGGYIPCGSLACKGFYKVEKKSQEPQVAWGLDDLRNSLFRWEEEKLYVTAWYIENHNILIAY

SEQ ID NO: 202778 - protein, 76 aa, Glycine max
  Coding DNA Sequence Number=SeqID_86000
MIVKAVFVCTTTKELKEADNKEFKGSSRSRSRSPISSDLSFDHSRYDGSYIDGTTVRARVNTGVEMAPAELLSTQQ

SEQ ID NO: 202779 - protein, 120 aa, Glycine max
  Coding DNA Sequence Number=SeqID_86001
  Gene Ontology: Mol. function=protein dimerization activity; Cellular component=nucleus; Biological process=regulation of transcription
  Homolog annotation: Hit_ID=Q45UB0; Match level="QueryCoverage=81%, HitCoverage=22%, E-value=8e-27, Identity=74%"; Hit description =AUX/IAA protein
  Pfam annotation: Domain name=AUX_IAA; Domain location=1-71; Score= -22.7; E_value=8e-08; Accession=PF02309.7; Description=AUXIAA family
QCGSYGVSSRENLSESRLMDLLHGSEYVLTYEDKDGDWMLVGDVPWEMFTESCKRLRIMKSFEAIGLGSCRIEKTGNSSIKLENRILHLEPWKSAKVVTSANAVCFCLLIRKDGRSHLSI

SEQ ID NO: 202780 - protein, 239 aa, Glycine max
  Coding DNA Sequence Number=SeqID_86002
MHSFSHSIPFPGFAFAYIHLPLWSLAIAQDMGSSYFGEPNFGNERASCSSSSRKGKKSHNSDKPKQPQRGLGVAQLEKIRLHGYHPSLHAPYPSNFSNEDPRVQIAYSSVPSSSFSYSSSYAASYGFQPNIMMGLSEYQKTNIRYGDSQPTNTARWETTSVILESQYSAPSNIARPFLNLNVRRFFKSACNSFDIPCRKYDTHQDIDTRKHRNGSVGSSSQNSESSDTQELDLELRLSL

SEQ ID NO: 202781 - protein, 218 aa, Glycine max
  Coding DNA Sequence Number=SeqID_86003
  Gene Ontology: Mol. function=galactose oxidase activity; Biological process=cell wall catabolic process
  Homolog annotation: Hit_ID=Q3HRQ2; Match level="QueryCoverage=79%, HitCoverage=37%, E-value=1e-27, Identity=37%"; Hit description =Glyoxal oxidase
  Pfam annotation: Domain name=DUF1929; Domain location=138-217; Score =19.5; E_value=9e-07; Accession=PF09118.1; Description=Domain of unknown function (DUF1929)
MVPEREALDTWVQIAKVVNGGNTTTYSDSNLLVLPNGHLLLINGATKGTSAWWNADLPNYTPVLYRPEDPKGLRFRVLKASQIARIYHSTSTVLPSGKIWVSGSNTHNTYRDVDRFPTETRVEAFSPPYLDANFDKYRPQINEDASEKELTYGGFFETSFSRLLFLKIDELIVEAQEGFYRVRVEAPPSNAIAPPGYYLLFVVPRGLPAAKGIWVHIQ

SEQ ID NO: 202782 - protein, 283 aa, Glycine max
  Coding DNA Sequence Number=SeqID_86004
  Gene Ontology: Mol. function=hydrolase activity, hydrolyzing O -glycosyl compounds; Cellular component=cell wall; Biological process= carbohydrate metabolic process
  Homolog annotation: Hit_ID=Q9SVV2; Match level="QueryCoverage=99%, HitCoverage=96%, E-value=1e-103, Identity=61%"; Hit description =Putative xyloglucan endotransglucosylase/hydrolase protein 26 precursor
  Pfam annotation: Domain name=Glyco_hydro_16; Domain location=21-200; Score=325.7; E_value=8e-95; Accession=PF00722.11; Description =Glycosyl hydrolases family 16
  Pfam annotation: Domain name=XET_C; Domain location=226-278; Score =86.7; E_value=7.1e-23; Accession=PF06955.3; Description=Xyloglucan endo-transglycosylase (XET)
  Pfam module annotation: Pfam domain module=Glyco_hydro_16::XET_C; Domain location=21-200::226-278
MWVALLMIAVVPNTIQVDANIYKSMHLTWGVQHASILGEDLHLVLDKTSGSAAQSKRSFLFGSIEMLIKLVPGNSAGTVTAYYLSSAGSQHDEIDFEFLGNSTGQPYTVHTNIYTQGKGSREQQFYLWFDPTADFHNYTIHWNPTAIVWYVDSVPIRVFRNYEKEGIAYPTKQGMRVYTTLWNADDWATRGGLVKTDWHSAPFTARFHHFRARACKWGGAKSINQCASNLPANWWTSRRYKQLSHSQMGQLNWVRNNYMIYDYCTDTKRFNGQIPPECFKPQF

SEQ ID NO: 202783 - protein, 77 aa, Glycine max
  Coding DNA Sequence Number=SeqID_86005
MGGNVKVENGGMKINATLIIFPPFVIFQNFQTNTKDEEKGNDLDLVRLRKEEGLQMAVREGEQSRETQRKEKKPNLS

SEQ ID NO: 202784 - protein, 44 aa, Glycine max
  Coding DNA Sequence Number=SeqID_86006
  Homolog annotation: Hit_ID=O49356; Match level="QueryCoverage=94%, HitCoverage=9%, E-value=6e-13, Identity=76%"; Hit description =Ferredoxin--NADP+ reductase - like protein
VSPGKQIAVGAGEFEDIKCGMALKSIGYRSVPVDGLPFDHKKGE

SEQ ID NO: 202785 - protein, 303 aa, Glycine max
  Coding DNA Sequence Number=SeqID_86007
  Gene Ontology: Mol. function=oxidoreductase activity; Cellular component=mitochondrion; Biological process=electron transport
  Homolog annotation: Hit_ID=Q6ERP0; Match level="QueryCoverage=91%, HitCoverage=42%, E-value=1e-73, Identity=57%"; Hit description =Putative NADPH:adrenodoxin oxidoreductase mitochondrial
MQKLELLGARRWLCRSISSNPLRVCVVGSGPAGFYTAEKAHQQAQVDIIDRLPTPFGLVRSGVAPDHPETKDLPCLLPIFSRMDFEVYLKKYFKTSIFTFLGAGGFSTFFGESNTVELSLPENLQQIVINQFSRVAHHERCSFLGNVTLGSSISLSELRELYHVVRLSGSGFYVLMVVLAYGAESDRSLGIPGENLKGIHSAREFVWWYNGHPDGRNLEPDLKSTDTAVILGQGNVALDVARILLRPTTELATTDIASHALATLEESSIRVVYLVGRRGPAQAACTAKELREILGNFCINSYT

SEQ ID NO: 202786 - protein, 60 aa, Glycine max
  Coding DNA Sequence Number=SeqID_86008
  Subcellular localization annotation: CTP_CleavageSite=39; ConfidenceScore=5.40e-01
FLASSKSKESLAQNLKEVSSYFNRKKKKNPPRRKSNHPRIMMTKKMIHSTRMRMTVLVYR

SEQ ID NO: 202787 - protein, 185 aa, Glycine max
  Coding DNA Sequence Number=SeqID_86009
  Homolog annotation: Hit_ID=Q9AVH2; Match level="QueryCoverage=25%, HitCoverage=16%, E-value=5e-20, Identity=97%"; Hit description =Putative senescence-associated protein
MCPVVGFGPWLGLGKPLVEILPPGQLRGFCPLLAWLGSAVLGYGPVLSFGLVGPLPPPLKREGRIKATRAESQWIVAARPLCHLQYPVAYLSRLQRILPAARWELRFKASRRANPPHEGHQRHVPLGGRGPLLLVGKRTAGARVASSPDSDLEAFSHNPTHGSFAPLAFQPSAMTNCANQRFLSY

SEQ ID NO: 202788 - protein, 183 aa, Glycine max
  Coding DNA Sequence Number=SeqID_86010
  Gene Ontology: Mol. function=lactoylglutathione lyase activity; Biological process=carbohydrate metabolic process
  Homolog annotation: Hit_ID=Q6ES23; Match level="QueryCoverage=48%, HitCoverage=75%, E-value=7e-31, Identity=66%"; Hit description =Putative glyoxalase I
  Subcellular localization annotation: CTP_CleavageSite=83; ConfidenceScore=5.92e-01
MVLVRVVPMASSSSIRPTLSSLRFLTPSSLSLSNPSSRISFSHLPSPSVSQSNSFGLKASRELRQHGNSTRIMASGDVSQSISAASPENVLEWVKQDKRRMLHVVYRVGDLDRTIKFYTECLGMKLLRKRDIPEEKYTNAFLGYGPEDSHFVIELTYSKDLTIMLTMTFLLKCAKSNLFDDLS

SEQ ID NO: 202789 - protein, 64 aa, Glycine max
  Coding DNA Sequence Number=SeqID_86011
MAENDIIHDCERNKIWSRKQSFVSKGDPVYKGIIQPQSGKNTVRQATQSVPPRQLPIGITVAVG

SEQ ID NO: 202790 - protein, 298 aa, Glycine max
  Coding DNA Sequence Number=SeqID_86012
  Gene Ontology: Mol. function=RNA binding; Cellular component =ribonucleoprotein complex; Biological process=mRNA processing
  Homolog annotation: Hit_ID=Q9SL79; Match level="QueryCoverage=64%, HitCoverage=27%, E-value=5e-09, Identity=28%"; Hit description =Expressed protein
MKAIYYMTLAFPLFQVKVEVSYPNENSHQSMYGVTEVPSLTKLYEVETTNSYADPEPRTSLSPSMTIPHYNSHAESPSKAMSESHGTEHIMDSRSCSDGLSASISGSHATLDGSDNSTDGMVDSHSDKLLDALGDVSPPPRSAAPSMKAILLLLEQAVEKGSALVLDKDSLDADNIYQNTVAFAKSASSGPVFRKNRKVEAQKSHKQEGSTLETEETTTVPMKRKKENRSTSDVRVGKVEGLEEGARLVEGAVIAEARNVRNTGETKAVFCLYWIKHRGVPSRAGFGGVMRDAFGNWI

SEQ ID NO: 202791 - protein, 643 aa, Glycine max
  Coding DNA Sequence Number=SeqID_86013
  Gene Ontology: Mol. function=transferase activity; Cellular component= membrane; Biological process=metabolic process
  Homolog annotation: Hit_ID=Q1SRU7; Match level="QueryCoverage=99%, HitCoverage=99%, E-value=0.0, Identity=73%"; Hit description =Exostosin-like
  Pfam annotation: Domain name=Exostosin; Domain location=316-606; Score=287.0; E_value=3.6e-83; Accession=PF03016.6; Description =Exostosin family
MGNRRLLFLLGVLAVNFLLFQSILVPYGNGNAPWSSVPQKYDNVRLSLHSTPKYFTVRNPPTGTVSGFSNSSAFIATVQKVHIPIVVDEVGHGKKKGMHNNVKGGLVSERNGSDDNVFEHGADRNDVRSLSEKKDVGKGDRLELESVGSKNFIADSAKGSKVDFSVKQFLETKRGASRLVKDNNMDSREHDGVGVHTSDSSTFSTNLENSPQKIVFSASDNSTAVSIPRRKMRCMMPPKSRTLIGEMNRILVRKRASARAMRPRWSSKRDLEILAARSEIEHAPTVTHDKELYAPLFRNLSMFKRSYELMERTLKVYIYKDGNKPIFHQPIMKGLYASEGWFMKLMEENKHFVLKDPAKAHLFYMPFSSRMLEHALYVRNSHNRTNLRQFLKDYTDKISAKYRYFNRTGGADHFLVACHDWAPYETRHHMEYCIKALCNADVTQGFKIGRDVSLPEAYVRSVRDPQRDLGGKPPHQRPILAFYAGNMHGYLRPILLKHWKDKDPDMKIYGPMPHGAASKMNYINHMKNSKYCICPKGYEVNSPRVVEAIFYECVPVIISDNFVPPFFEVLNWDAFSIILAEKDIPNLKQILLSVSQEKYLKLQLGVRKAQKHFFWHVKPLKYDLFHMTLHSIWYNRVFQIKVR

SEQ ID NO: 202792 - protein, 73 aa, Glycine max
  Coding DNA Sequence Number=SeqID_86014
MAGKRSARTTITFYHPRNLCGGVNEAEGRMVECNTNGGEDNGRTTNRATLPHDSQAQCDLVPGSWPSHDMMVL

SEQ ID NO: 202793 - protein, 1095 aa, Glycine max
  Coding DNA Sequence Number=SeqID_86015
  Gene Ontology: Mol. function=transmembrane receptor activity; Cellular component=membrane; Biological process=defense response
  Homolog annotation: Hit_ID=Q8W2C0; Match level="QueryCoverage=98%, HitCoverage=93%, E-value=0.0, Identity=47%"; Hit description =Functional candidate resistance protein KR1
  Pfam annotation: Domain name=LRR_1; Domain location=624-645; Score =4.4; E_value=43; Accession=PF00560.23; Description=Leucine Rich Repeat
  Pfam annotation: Domain name=LRR_1; Domain location=647-669; Score =0.8; E_value=2e+02; Accession=PF00560.23; Description=Leucine Rich Repeat
  Pfam annotation: Domain name=LRR_1; Domain location=671-692; Score =4.3; E_value=46; Accession=PF00560.23; Description=Leucine Rich Repeat
  Pfam annotation: Domain name=LRR_1; Domain location=693-715; Score =13.1; E_value=1; Accession=PF00560.23; Description=Leucine Rich Repeat
  Pfam annotation: Domain name=LRR_1; Domain location=717-738; Score =10.2; E_value=3.5; Accession=PF00560.23; Description=Leucine Rich Repeat
  Pfam annotation: Domain name=LRR_1; Domain location=740-761; Score =8.9; E_value=6.1; Accession=PF00560.23; Description=Leucine Rich Repeat
  Pfam annotation: Domain name=LRR_1; Domain location=820-841; Score =10.7; E_value=2.8; Accession=PF00560.23; Description=Leucine Rich Repeat
  Pfam annotation: Domain name=LRR_1; Domain location=843-868; Score =8.8; E_value=6.4; Accession=PF00560.23; Description=Leucine Rich Repeat
  Pfam annotation: Domain name=LRR_1; Domain location=893-918; Score =9.5; E_value=4.7; Accession=PF00560.23; Description=Leucine Rich Repeat
  Pfam annotation: Domain name=NACHT; Domain location=213-366; Score= -12.0; E_value=0.00049; Accession=PF05729.3; Description=NACHT domain
  Pfam annotation: Domain name=NB-ARC; Domain location=171-463; Score =126.9; E_value=5.8e-35; Accession=PF00931.13; Description=NB-ARC domain
  Pfam annotation: Domain name=TIR; Domain location=16-149; Score =144.1; E_value=3.8e-40; Accession=PF01582.10; Description=TIR domain
  Pfam module annotation: Pfam domain module=LRR_1::LRR_1::LRR_1::LRR _1::LRR_1::LRR_1::LRR_1::LRR_1::LRR_1::NACHT::NB-ARC::TIR; Domain location=624-645::647-669::671-692::693-715::717-738::740-761::820 -841::843-868::...
  Pfam module annotation: Domain location=893-918::213-366::171-463::16- 149
MSKAVSESTDIRVYDVFLSFRGEDTRRSFTGNLYNCLEKRGIHTFIGDYDFESGEEIKASLSEAIEHSRVFVIVFSENYASSSWCLDGLVRILDFTEDNHRPVIPVFFDVEPSHVRHQKGIYGEALAMHERRLNPESYKVMKWRNALRQAANLSGYAFKHGDGYEYKLIEKIVEDISNKIKISRPVVDRPVGLEYRMLEVDWLLDATSLAGVHMIGICGIGGIGKTTLARAVYHSAAGHFDTSCFLGNVRENAMKHGLVHLQQTLLAEIFRENNIRLTSVEQGISLIKKMLPRKRLLLVLDDVCELDDLRALVGSPDWFGPGSRVIITTRDRHLLKAHGVDKVYEVEVLANGEALELLCWKAFRTDRVHPDFINKLNRAITFASGIPLALELIGSSLYGRGIEEWESTLDQYEKNPPRDIHMALKISFDALGYLEKEVFLDIACFFNGFELAEIEHILGAHHGCCLKFHIGALVEKSLIMIDEHGRVQMHDLIQQMGREIVRQESPEHPGKRSRLWSTEDIVHVLEDNTGTCKIQSIILDFSKSEKVVQWDGMAFVKMISLRTLIIRKECFSKGPKKLPNSLRVLEWWGCPSKSLPSDFKPEKLAILKLPYSGFMSLELPNFLHMRVLNFDRCEFLTRTPDLSGFPILKELSFVFCENLVEIHDSVGFLDKLEIMNFEGCSKLETFPPIKLTSLESINLSHCSSLVSFPEILGKMENITHLSLEYTAISKLPNSIRELVRLQSLELHNCGMVQLPSSIVTLRELQVLSIRQCERLRFSKQDEDVKNKSLLMPSSYLKQVNLWSCSISDEFIDTGLAWFANVKSLDLSANNFTILPSCIQECRLLRKLYLDYCTHLQEIRGIPPNLETLSAIRCTSLKDLDLAVPLESTKAGCCLRELILDDCENLQEIRGIPPSIEFLSATNCRSLTASCRRMLLKQELHEAGNKRYSLPGTRIPEWFEHCSRGQSISFWFRNKFPVISLCLAGLMHKHPFGLKPIVSINGNKMKTEFQRRWFYFEFPVLTDHILTFGEGQIKFEDNVDEVVSENGWNHVGVFVDVDFKWNPTEPLVVRTGLHVIKPKSRVEDIRFTDPYKPTIL

SEQ ID NO: 202794 - protein, 161 aa, Glycine max
  Coding DNA Sequence Number=SeqID_86016
  Gene Ontology: Mol. function=transition metal ion binding; Cellular component=cytoplasm; Biological process=electron transport
MGDRLEDMIHDLGQECFQQAYPPMYDTLQNDSKKPLYSRCKNSLTLLSTVLSLVNVKARYGWSDKSFSSLLQAKKILCPIGMEYQKIHACPNDFILYIHEFEEMSKCPRCGVSWYKVKDYKECSIHENSKKGLAAKVLWYLPIVPRFKRLFANGDDAKDLT

SEQ ID NO: 202795 - protein, 51 aa, Glycine max
  Coding DNA Sequence Number=SeqID_86017
MKNAELSNASQESHILEVHFQNLISRVLCWNAIWIPVAFMLKKGANVCGQS

SEQ ID NO: 202796 - protein, 139 aa, Glycine max
  Coding DNA Sequence Number=SeqID_86018
MESRKNSKVLHTFSYDQQGQYTSPYLSFTMIHSNNLECNVLKNNSNTFLPAEASFDVPSIPKEHSIEMSESDSCSEEGGDSTDEEVMSLDELLNDGKAQKKIEQLAALVGVDTTEPAIVLTEVVRILKHLNHYHYTTTT

SEQ ID NO: 202797 - protein, 73 aa, Glycine max
  Coding DNA Sequence Number=SeqID_86019
  Gene Ontology: Mol. function=two-component response regulator activity; Cellular component=membrane; Biological process=negative regulation of ethylene mediated signaling pathway
  Homolog annotation: Hit_ID=Q9ZTP3; Match level="QueryCoverage=97%, HitCoverage=10%, E-value=4e-14, Identity=56%"; Hit description =Putative ethylene receptor
MMQGNIWISPNTLGLVQGMTLLKFQIRPSLEKSIFAPKDYSSSQFRGLKVVLAKDDGINRTVTKKLLEKLGFH

SEQ ID NO: 202798 - protein, 40 aa, Glycine max
  Coding DNA Sequence Number=SeqID_86020
MVETGMIKILESGDQAVQMKLSNVELFMMFEMGGETIITS

SEQ ID NO: 202799 - protein, 58 aa, Glycine max
  Coding DNA Sequence Number=SeqID_86021
MESPTPIILFNNQAKFFFFNQVAQLVVYFFKYISQLLLQVSGYIDQMRNVEQQPQDQV

SEQ ID NO: 202800 - protein, 331 aa, Glycine max
  Coding DNA Sequence Number=SeqID_86022
  Homolog annotation: Hit_ID=Q8TGM6; Match level="QueryCoverage=36%, HitCoverage=97%, E-value=3e-08, Identity=43%"; Hit description =Protein TAR1
  Subcellular localization annotation: CTP_CleavageSite=79; ConfidenceScore=5.43e-01
MTSPRAYQQPGLGPPSQSASVNVPSRSADRLSPFHIRPGHIAGPHPLPSRQFQALFDSLFKVLFIFPSRYLFAIGLSPVFSLGRNLPPDWGCIPKQPDSPTAPRGATGSGHDGALTLSGAPFQGTWARSATEDASPDYNSDAEGDRFSWWAFPGSLAVTKGILRACTQRVVDGSRTDRLARDWSRAWLIHHFITAKSAMNPDFNQTTRRVLAGGRRALGLMASGATCVQRLDGSRDSAIHTKYRISLRSSSMQEPRYPLPRVIDEEAGRTGRRGHPLPPDGSVDFSQRRGQRTAHVAAIRTLHRTIQSVGATGGVYKGQGRSQRELMTRAY

SEQ ID NO: 202801 - protein, 1449 aa, Glycine max
  Coding DNA Sequence Number=SeqID_86023
  Gene Ontology: Mol. function=RNA-directed DNA polymerase activity; Cellular component=chromatin; Biological process=RNA-dependent DNA replication
  Homolog annotation: Hit_ID=Q94I07; Match level="QueryCoverage=94%, HitCoverage=91%, E-value=0.0, Identity=41%"; Hit description =Putative retroelement
  Pfam annotation: Domain name=rve; Domain location=1139-1296; Score =113.5; E_value=6.3e-31; Accession=PF00665.16; Description=Integrase core domain
  Pfam annotation: Domain name=zf-CCHC; Domain location=310-327; Score =22.7; E_value=0.00018; Accession=PF00098.13; Description=Zinc knuckle
  Pfam annotation: Domain name=zf-H2C2; Domain location=1085-1122; Score=4.7; E_value=0.086; Accession=PF09337.1; Description=His(2) -Cys(2) zinc finger
  Pfam module annotation: Pfam domain module=RVT_1::Retrotrans _gag::rve::zf-CCHC::zf-H2C2; Domain location=634-803::117-216::1139 -1296::310-327::1085-1122
MGDQPVTKTEFDGAIAALTAAITTLTTQVTTLSNNNRINLNRGGGRGNNHTIDDSDSEEEEVVTEKRNDRDNHHDYRVKADIPLFYGTMGVEEFLDWQIDVDRFFDVMDVPEHKQVKMVAIRLKSTAAVWWDRLVVQRTRQRKNPIRTWRKMKQLMLERFLPEDYEQILYKMYIECVQGKRSVTEYTAEFLRFSERNELGESENQKVARYISGLKGSLQEKMGLQTVWTVAEASNLALKAELMEKSPRNFSSFRKSSPQNNTESSGDKEKSAAARDSTPGNKATGSSSSAPQGKAPAQKQNNPYVKPTMDTCFRCNGKGHRSNVCPSRRVAAVVGERDDDNETEQPDEGEYAEVEFAEEESDERVNFVLQRMLLATKEEGQRKNLFKTHCSVKNKVCDLIIDNGSTENLVSQKLVNYFKLPAEPHEKPYALGWVSKGSQVRVTLSCRVPISIGKHYKEEVSCDVIDMDVCHILLGRPWQFDNDITYRGRDNVMMFTWGTHKIAMAPILHFDKNPKDKKSSFLVMTQDERKLDKAVREANCFCPVVFKGVMSAVKEEVPIPREILEILRDFNELIADELPNDLPPMRDIQHQIDLIPGSSLPNLPHYRMSPKENEILREQIEDLLRKGFIRESMSPCAVPVLLVPKKGNQWRMCVDSRAINKITIKYRFPIPRLEDMLDELAGSKVFSKIDLRSGYHQIRIRPGDEWKTAFKSKDGLYEWLVMPFGLSNAPSTFMRLMNQVLRPFIGSFVVVYFDDILIYSKIKEEHLEHVRLVLQVLQENQLYINLKKCTFSTNKLLFLGFVVGEDGIQVDEEKVRAIRDWPAPTSVTEVRSFHGLATFYRRFIRDFSTITAPITECLKKGKYNWGFEQEQSFALIKEKLCTAPVLALPDFDKVFQVECDASGIGIGAVLSQEKKPIAFFSEKLSEARRKWSTYDQEFYAVFRALRQWEHYLIHREFILFTDHQALKFLHSQKLINKMHARWVSFLQKFPFIIQHKSGALNKVADALSRRDSLLVTLAQEVVGFECLKELYENDVEFQELWAKCREHPCDDFHVREGFLFKGNRLCIPCSSLREKLIRDLHGGGLSGHMGRDKTIASLEERFYWPHLRKDAGTIVKKCYTCQVSKGQSQNTGLYMPLPIPDDIWQDLAMDFVLGLPRTQRGVDSVFVVVDRFSKMSHFIACKKTADASNIAKLFFREVVRLHGVPKSITSDRDTKFLSHFWITLWKLFDTSLKRSSTAHPQTDGQTEVTNRTLGNMIRCVCGDKPKQWDLALPQVEFAYNSTMHSATGKTPFSLVYTSVPRHVVDLIKLPKAPGFSVAAENMAEEIIAVKDSVKSKLEATGLKNKIAADKCRRVKVFNVGDEVMVFLRKERFPVGTYSKLQPRKYGPFQVTRKINDNAYVVALPASMNISNTFNVADIYEYHADEVLYRDENSGSSSFEVEETDVGGFI

SEQ ID NO: 202802 - protein, 159 aa, Glycine max
  Coding DNA Sequence Number=SeqID_86024
  Gene Ontology: Mol. function=oxidoreductase activity, acting on CH-OH group of donors; Biological process=alcohol metabolic process
  Homolog annotation: Hit_ID=Q1PFE0; Match level="QueryCoverage=80%, HitCoverage=28%, E-value=2e-14, Identity=33%"; Hit description =Mandelonitrile lyase
  Pfam annotation: Domain name=GMC_oxred_C; Domain location=57-159; Score=-9.7; E_value=1e-05; Accession=PF05199.4; Description=GMC oxidoreductase
MATWMKHMKPTLNKSRIQVQRVMLPDPPQVAGITDDFKIIVEAGIAPVSSNSSRIIIAAKIAMPTSKGVLELNNTYPRLNPSVRFNYLSSENDMKECVKMIKLLNRIARSKSIAFFLGESWQEKLIGIGVDLRNFCKKNVRTFYHYHGGCTIGSVVDEH

SEQ ID NO: 202803 - protein, 53 aa, Glycine max
  Coding DNA Sequence Number=SeqID_86025
MGAHYSGLEPEKKPPSNGVHHKTNSSFGDESGDEFFCNVEEEEEANKQKGEKK

SEQ ID NO: 202804 - protein, 160 aa, Glycine max
  Coding DNA Sequence Number=SeqID_86026
  Homolog annotation: Hit_ID=Q1SEK8; Match level="QueryCoverage=75%, HitCoverage=39%, E-value=2e-07, Identity=34%"; Hit description=RNA -directed DNA polymerase
MALVWQGYYVYNVYNKSLFPYAVNGTHVALTPKCEILKDQSTFIHGHSILDNALIANEILHHMKCKVKALVECDHILNALNDYAKASDQVINLQNSKVFFSRNVDQILKQNILSKLGVKEGLLMGVIWGSPLLLGETRSQIPSLLRIGSRTSLTLGRVDI

SEQ ID NO: 202805 - protein, 69 aa, Glycine max
  Coding DNA Sequence Number=SeqID_86027
  Gene Ontology: Mol. function=RNA-directed DNA polymerase activity; Biological process=RNA-dependent DNA replication
MVRECNVLGHKVSSTSIEVDPAKMEVITKLPPPNCVKVVRSFLGHVGFYRRGSSRPNERQGVPHHLLCQ

SEQ ID NO: 202806 - protein, 128 aa, Glycine max
  Coding DNA Sequence Number=SeqID_86028
MGSGVVYAWERRVGYFIMKLSGDPGEPDAWGQKKLPNDPFVLPFRYFPCSFLKHRKTFQIARQLVSSSSIRLLIITNRDIPIPRPKAKWTNDNIAIMELYTKAKYTLTCALSNNEYKNICKLRTTKEI

SEQ ID NO: 202807 - protein, 141 aa, Glycine max
  Coding DNA Sequence Number=SeqID_86029
  Gene Ontology: Mol. function=RNA-directed DNA polymerase activity; Cellular component=intracellular; Biological process=RNA-dependent DNA replication
MVIEPISFATCNFIQAKDPTNTLVEASLPSVGNIDVPPSSKGFQNNEKSKVCRMLKKRSLYGSCERIKRPLGGLYITSREPRQLPQRRLNPDMMKVVKGEVLKLLNMDIIYPISDSEWGSPVQCVPKKGGGGTTVMENEQK

SEQ ID NO: 202808 - protein, 132 aa, Glycine max
  Coding DNA Sequence Number=SeqID_86030
GTSFVVQVEGTSTWVVVTENKRGYISCGSVQVEDTSTWLFKENKGGYIPCGSLLVKVFTRLKEISRTAGRLGTGCRHSDEVGRYTKHDIEVRKGHDAGLIKEVKRNHALHKRRQLVPYVIISLRAMVVEIAI

SEQ ID NO: 202809 - protein, 239 aa, Glycine max
  Coding DNA Sequence Number=SeqID_86031
  Subcellular localization annotation: CTP_CleavageSite=49; ConfidenceScore=5.18e-01
MTLAELLASWWSSSSLSCFRAGLLSYSCRGGYLKALTRRGAPSFQGWVMEEAVFECVRLKERGPSEFFEEYQLLEVIVWLLHESQYKETMCYAGGSNWSSVSSLASKISFAPQKMHQIEKRSLEAGFTNARLKQRGPSEFLEEYRLLEATLWLLHESQWILQCLDYLLSFELKHDIKVKGHGAGVIEEAKFSENPILGGSGSLLWGGGDGQGCDYRTLDNEIHDHGGSDNGSVARQRCQ

SEQ ID NO: 202810 - protein, 183 aa, Glycine max
  Coding DNA Sequence Number=SeqID_86032
  Gene Ontology: Mol. function=nucleic acid binding; Biological process= DNA integration
MVFSITSLHKNRSSLKDITSYALVSEIEPKTIEEALTDDDQIIGIEEELHQFTRNNVWTLVSKPTGKNIIGTRCVFKNKLDEQGKVEVYAKQPSGFEDHTLPDHLFKLGKALVLSKLGTSSLSEFEISMIGELKFFVGIQIKQDKKGIYIHQQKYTKELFKKFKREDAMPMKTPMHVSKPPMF

SEQ ID NO: 202811 - protein, 328 aa, Glycine max
  Coding DNA Sequence Number=SeqID_86033
MLYGLTTSKDWEKEITQETVDKLLYGKPHLDEVDKKAFTNLLEDIELYIHVNPKVKKNLIPYGMLFTQILRLARVEVSLMEPSSRATQLKEATFLKMGIVEKIPKYVQRHIKKKVKKKVTETPVSDVDQTNSEPFQPKPTTSSSEVEILETPTHVPSPSLALPSQPLPKSTSPLISKTVVATIAKAKQHSLAYAERKSKGEKAMKNKAKEEELRQATANDQVPNEVVLEVVKVTSKEELQKAEFDARVQLAFKQVLIHFMQRLLKETAKLQPTMTQPKPMPILDRNIRRYHGFKGYKLFEGKTSNQAWKKNIDIGTQCLDPQMQKAEL

SEQ ID NO: 202812 - protein, 166 aa, Glycine max
  Coding DNA Sequence Number=SeqID_86034
MEARKGIPILPILEIFPLPMPTKTIVPNSCDYRSRNINVSLAMSHEDRKKSSQQPSVERKTQREPARRRRKGKVEPRHYKVVVVNHILSLVLCAMMNKLPFDPEITKTERKNRKKKKQATTKTLGESSSSYYVSIDKPLVENNMADRGGEGNRPPRRTLGDYAYQQ

SEQ ID NO: 202813 - protein, 282 aa, Glycine max
  Coding DNA Sequence Number=SeqID_86035
MSMKKIIEVNADAVAATSVFAEVDPTPSSSLNQINRPTSDSVGHGGKELGSTDDPHFVQVQNKHAFPPYGLPPNYAPPNVVHTPDENANNSNPIPIESQQPQADHAHVSQPIGETHEIPHHNLADFEPRLGYAPEGQAVGGVPLPNTLEGPQFFSQPQPLHFAVGRAPPAMAEKGKLDQIEERLRVVERGGDYAFADMEDLCLVPDVVIPLNFTVSNFDKYKGTNFPKNHLKVYCKKMGAYVKDEKLLMHFFQESLTGVVSYPNFVRGPLLDDMRPFFGPCE

SEQ ID NO: 202814 - protein, 101 aa, Glycine max
  Coding DNA Sequence Number=SeqID_86036
  Subcellular localization annotation: CTP_CleavageSite=39; ConfidenceScore=5.24e-01
KHIPRLGLFPKYFSGGAFFARTQHGMRQFCWRLRAWRTRVERVRDAPVVLATSCMTDRWLDGRASTAGDFKQGRATAVGAFCQFCCEVPSASAGAEARCSS

SEQ ID NO: 202815 - protein, 76 aa, Glycine max
  Coding DNA Sequence Number=SeqID_86037
MDEGEGGYGESGDKGFLGEERHRRKKASAATIRGSECCRGFNDIGDLNTFDFDFDLLDKLHSNPTDVLPLFEAATT

SEQ ID NO: 202816 - protein, 1046 aa, Glycine max
  Coding DNA Sequence Number=SeqID_86038
  Gene Ontology: Mol. function=nucleic acid binding
  Homolog annotation: Hit_ID=Q6YXX3; Match level="QueryCoverage=52%, HitCoverage=83%, E-value=5e-40, Identity=28%"; Hit description=RNA recognition motif (RRM)-containing protein-like
MEDEAEETKSAARIFVGGLAEAGGRLRLEKAKEDYLVRLKREWEQGTLDDATQKPPTAASEEEMPNTAQSSKSNTKHLNIFFPRLRKLCILILWVGLVMVGYWEGKDDVKSIPFSGTGKHKYSFQNIKVPPLPVHFCDCEEHCKPFVPEREKLSIDRTAESGGINDEEISIMNAVMNKLFEKEQVSNAKNLGEEKDSFESPDALHSDECEDSATDEDDLIINVETKKNKTSLTEDKELQRILENQESWFNKRKIAKEEPNKSTLLVQKRSNSNPDKNKKRKSLPKLEVSTTPGSKSNMQTLPDEVGSDAQPTELEDDFGEKVSWSQKSSWRELLGDKGNTSFSASLILPKLDSGESQQRSDDQSAPVSTNNKTENMERDGHLGSKPADAPVIEEHAEAQPTNKQVIEDVANNKHNVAPNKTGRGASWLQKQSWTQMVGQNNNSFSISNILPGITFPEPMAKEAIMEPAISNDCKHNGVAKDTVNVVCDGFNSRETIPGKSQHTSANDIASASVGEEKGETSPREKSTENVEIGETCSFMRSAASLKEWAKAKAAMSGSLKRKHGEKGEKEDRKIPGRDVRLSSSVGIGALECGGMEEAVPAHTNIGRERASTGEQVPPKELEGCLGYYLVLLHQVPGGSNSGGAMEPLPTVGGGVEDKRRVERDLDNSFIRGLKLHVNIPKYGRGETAKEQTFNKRVHKEVAMVDKIRMEEASRRAAGNKPTHRTYAEVLSSPINRGNHSSKADNHFPSNRGSCSTLTLDISDDDKLRYENVWVGRLKKLEIFERLEEEMAWHLGPGVSAKYLGDDMTLLLRISYTRAATIIRDETKQGLSLFYSMVKWNPQLRTGNRLVWLRCWGIPLVSWKMENFRKLVALVGDLVDVDDNVEHMQRLDRARILIRTPWPPLIKHEVVVHIEGENHRVFMVEENGGAESNGDRYGRSAWGSSDEILSDEADTTTLQSWSNVAFSILDAGILAVDGELVADCHDTPPALLPTSHASVDDPVGNDRTDNEPASNLISNSKTSPKRKDFEFVKGQTSAYPAGFDEIA

SEQ ID NO: 202817 - protein, 496 aa, Glycine max
  Coding DNA Sequence Number=SeqID_86039
  Gene Ontology: Mol. function=amino acid transporter activity; Cellular component=integral to membrane; Biological process=amino acid transport
  Homolog annotation: Hit_ID=Q2QM92; Match level="QueryCoverage=90%, HitCoverage=75%, E-value=1e-145, Identity=60%"; Hit description =Amino acid permease family protein
  Pfam annotation: Domain name=AA_permease; Domain location=31-458; Score=-54.6; E_value=0.00028; Accession=PF00324.11; Description =Amino acid permease
MVSEEVHVPLALACDDEHPPFVVHTSSSRRFIISKAVVQGVTCGSFAYLRVELGDFVAFIAAGNILLEYVISCAAVSRSWTSYFATLCNKNPDDFRIVVHNMNPNYNHFDPIAVIVLAAICILAIYSTKGSSIFNYIASVVHVVIIAFIVIVGLIHVKPQNYVPFAPFGVRGVFQASAVLFFAYVGFDAVATMAEETKNPSRDIPIGLVGSMVVTTIAYCLLSATLCLMQPYTSIDVNAPFSVAFSAIGWDWAKYIVSLGALKGMTTVLLVSVVGQARYLTHIARTHMMPPWFALVDEHTGTPVNATIAMVVVSAVIAFFTDLQILSNLLSISTLFIFMLVAIALIVRRYYSSGVTTKRNQITLIVFIVFIIASSCGISCYWALSEGWIGYAIFVPIWALSTGGLCLFVPKAKEPKFWGVPLVPWIPSISIFINIFLLGSIDKDSFIRFGFWTVFLLVYYVFFGLHASYDTAKEFEAQRSMENSINKMEDGEMSST

SEQ ID NO: 202818 - protein, 93 aa, Glycine max
  Coding DNA Sequence Number=SeqID_86040
GVICKHFPPGGCFARKLHASPKQTGSQTGKFAGSEEAAIPIGDFAMHGGTASQTGGGRRGQLVAGLRAGVQVNVAGTQESPLVLARCRKNSPV

SEQ ID NO: 202819 - protein, 101 aa, Glycine max
  Coding DNA Sequence Number=SeqID_86041
MVKVGTSYVPINVSFSPKVGPGLPGINRDTRIYLFCEVIFRHRYLYSLHLMLVVIALIVRRYYSSGVTTKRNQIMLIVFIVFIIASSCGISCYWTLSEGWI

SEQ ID NO: 202820 - protein, 243 aa, Glycine max
  Coding DNA Sequence Number=SeqID_86042
  Homolog annotation: Hit_ID=Q9FJL0; Match level="QueryCoverage=24%, HitCoverage=4%, E-value=6e-14, Identity=68%"; Hit description =Chromosome condensation protein
METNLDYSKMLFLLLLGSTSLIFLSHLTSAATSKLNTQEVDLVELCAMKALKEIGTKIGNKDWNFGVDPCSGKGNWNVPDARKAFVMSSMICDCSFNHNSSCHVEKQVDLLPKLKKNVSTLEGVPRLFDLVKVQDERMKLAFFAALRNTVVTKDLDQGILIIYACMMGFKEQKPCHYYPFYIGHQSTDVETLPFNIGFNLRTDVENSHSTSVELHNRGRKVAFQRRSSNRCRYSTTLCYHHAS

SEQ ID NO: 202821 - protein, 219 aa, Glycine max
  Coding DNA Sequence Number=SeqID_86043
  Homolog annotation: Hit_ID=Q8L6H8; Match level="QueryCoverage=27%, HitCoverage=4%, E-value=9e-11, Identity=55%"; Hit description=SMC4 protein
MAIIGVIGGLLVSILCRLFIQPAYTLYYHLASKSSSQEREHGQDIAFMERLLWWSLHFVNLSVIGSLNHSFEFHYFTKMLAELLRREKHAKIKPDPDIDAYMKDVKNEAEAYMLKELSLLKWQEKATKFALDDTGGKMDELQGNVATLEENLKAERQDVKYREDFKHVNQKIKKLEDKVEKVLVFFLPLLILSLTDITVHPEDWIIGLISGYPLIWVGL

SEQ ID NO: 202822 - protein, 286 aa, Glycine max
  Coding DNA Sequence Number=SeqID_86044
  Homolog annotation: Hit_ID=Q1SP02; Match level="QueryCoverage=18%, HitCoverage=11%, E-value=5e-09, Identity=55%"; Hit description=IMP dehydrogenase/GMP reductase
  Pfam annotation: Domain name=DUF1723; Domain location=117-166; Score =49.7; E_value=9.5e-12; Accession=PF08330.1; Description=Protein of unknown function (DUF1723)
MVRTGGLRQALGRVLGRALGKYVTSDEEEVPRCRKSTTSMHRQRVVIVVAKDVEHVDHAADEVHEEPHEPVMDHEHTELKLTSYERKVEKFERLAHEIKGIMVATVLSYLISCSLETGDRGLLFTFAERWHKETSSFHLPIVELTITLDDVASLLHLPITGVFHTFDAIDIEEVVDLLVELLEYWIYKHFPTIVSIIVNEDYHERKSCACQWKCVKALTVMTYHPPVLPVHSATMPQPPALVAADANIPRHVVISQGSLSNTMFMFDLDEGGIHRIKMVVDDDDDS

SEQ ID NO: 202823 - protein, 415 aa, Glycine max
  Coding DNA Sequence Number=SeqID_86045
  Gene Ontology: Mol. function=UDP-glucose 4,6-dehydratase activity; Cellular component=cytoplasm; Biological process=UDP-rhamnose biosynthetic process
  Homolog annotation: Hit_ID=Q9SYM5; Match level="QueryCoverage=98%, HitCoverage=72%, E-value=1e-172, Identity=64%"; Hit description =Probable rhamnose biosynthetic enzyme 1
  Pfam annotation: Domain name=3Beta_HSD; Domain location=11-271; Score= -27.3; E_value=5.1e-11; Accession=PF01073.9; Description=3-beta hydroxysteroid dehydrogenaseisomerase family
  Pfam annotation: Domain name=Epimerase; Domain location=10-252; Score= 186.9; E_value=4.8e-53; Accession=PF01370.11; Description=NAD dependent epimerasedehydratase family
  Pfam annotation: Domain name=NAD_binding_4; Domain location=12-234; Score=28.8; E_value=1.6e-10; Accession=PF07993.2; Description=Male sterility protein
  Pfam annotation: Domain name=Polysacc_synt_2; Domain location=10-253; Score=-99.2; E_value=2.6e-07; Accession=PF02719.6; Description =Polysaccharide biosynthesis protein
  Pfam annotation: Domain name=RmlD_sub_bind; Domain location=9-280; Score=-154.2; E_value=0.00056; Accession=PF04321.7; Description=RmlD substrate binding domain
  Pfam module annotation: Pfam domain module=3Beta_HSD::Epimerase::NAD _binding_4::Polysacc_synt_2::RmlD_sub_bind; Domain location=11 -271::10-252::12-234::10-253::9-280
MANTYKPKNILITGAAGFIASHVCNRIVQNYPDYKIIVLDKLDYCSNLKNLIHLCSSPNFKFIKGDIGSADLVNYILLTESIDTIMHFAAQTHVDNSFGNSFEFTKNNIYGTHVLLEACKVSKGQVKRFIHVSTDEVYGETDEDAVVGNHELLPTNPYSATKAGAEMLVMAYGRSYGLPVITTRGNNVYGPNQFPEKLIPKFLILAMKGRSLPIHGDGSNVRSYLYCEDVAEAFEIILHRDRPFNDQRYFLDDEKLKNLGWCEGTTWEEGLRKTMDWYVKNPDWWGDVSGALLPHPRMLTMPGVEKYCYDDIDNVTQIASDGDVNHSNQNRMVVVSATRNNVSPHKASLKFLIYGGAGNIKPTHVFNASGVTGALNVKWFEDHIPESIRAVVVGVLTLADVCRDHGLPMMNYAFC

SEQ ID NO: 202824 - protein, 190 aa, Glycine max
  Coding DNA Sequence Number=SeqID_86046
  Subcellular localization annotation: CTP_CleavageSite=59; ConfidenceScore=5.75e-01
GSHSSTPPSHGHGSSPPSHHHSSPSTPSTPSGGNCGSSPPQHHDPTTPSTPSTPSNPPSGGYYGGSPPTPVTVSPPTTPVDPGTPSIPSPPLIPSPSPFTGTCNYWRNHPAIIWGILGWWGTLGSAFGVTGALYREGTASFLNSMVNNKFPYTTNQVRDRFVASLNSNKAAEAQAQLFKMANEGRMKPRP

SEQ ID NO: 202825 - protein, 82 aa, Glycine max
  Coding DNA Sequence Number=SeqID_86047
MDEDQWIYESIMSEEINMNEDNGEEFDVFENIHCSHVFNTSQVFVTREDVLQWAHNAAYDIGFVIVIMRSDTDTGKEGPHLF

SEQ ID NO: 202826 - protein, 66 aa, Glycine max
  Coding DNA Sequence Number=SeqID_86048
MAWKQLAKFIGVLVHIVTIVKPFGIGCLKLPNANIHILQNCYKTGIDDVNPSTKQAQSPMALTQCQ

SEQ ID NO: 202827 - protein, 75 aa, Glycine max
  Coding DNA Sequence Number=SeqID_86049
MEKNKSHDDNTSGGFNPFSVSLTFGNSIRAVRGKKLEESQGTARDAAIAGGRHMSPLRGVGPESGGRGPDGLFGV

SEQ ID NO: 202828 - protein, 157 aa, Glycine max
  Coding DNA Sequence Number=SeqID_86050
  Subcellular localization annotation: CTP_CleavageSite=57; ConfidenceScore=5.60e-01
MVRLLLPRDSLTSSTSSLSFVSIPVRPPDVAPTPSPPLIEARPSSSHVNARGPSLVLASTPSPSSVDARGPSPVPTSTPSPSLPVGNMPVDEDAINLAVEDPPLNDCPMVMLINGAFHPSKVTAKAITLSIRQQFGQPWPTWGAILKESWCEVVDIV

SEQ ID NO: 202829 - protein, 207 aa, Glycine max
  Coding DNA Sequence Number=SeqID_86051
MAFHVVLIYYVNIKASKLAILVDYMKKSINPIDPKVLNLISKLTKCLLSYRSILESARAKGKKYLRATTSSGDNSTPDHPGSLRAFLPGGSHGSSMSTITNTEEEWDAVGTMEDIKSLKGEVDALKLSGGTGRASGRKDNNGDKGNADNVAASKMKGFISKKILSKIWSSKEKSGDLSSSDTSESPASTVVEETKSTPSRSRRHSVS

SEQ ID NO: 202830 - protein, 110 aa, Glycine max
  Coding DNA Sequence Number=SeqID_86052
MKHQNGMGCKTYWTSNLPFLKPRYGWQQDRSGWLLWPRCVEKELVVRQCDKEVVAGERGSLAGWDQGRGWEVTCPPPPLLPQVRKNLAPTTVKVGWCQMGPTCEWSMFKS

SEQ ID NO: 202831 - protein, 139 aa, Glycine max
  Coding DNA Sequence Number=SeqID_86053
MRTRLLKKSNSQTDRNNTHFFSKESRHKDLASNIDGRPFPIPSCLDQATDKGYGPSDAGAVYTDRNSHSTAYGPYGWLPAGQPNATCMHASGAPSSVCELRWTLEVVADVEAVVVLMWPAAATGLAPTVVPALACNISQ

SEQ ID NO: 202832 - protein, 511 aa, Glycine max
  Coding DNA Sequence Number=SeqID_86054
  Gene Ontology: Mol. function=N-acetyltransferase activity; Biological process=metabolic process
  Homolog annotation: Hit_ID=Q42381; Match level="QueryCoverage=77%, HitCoverage=99%, E-value=1e-150, Identity=64%"; Hit description =Putative N-acetyltransferase hookless1
  Pfam annotation: Domain name=Acetyltransf_1; Domain location=164-269; Score=62.7; E_value=1.2e-15; Accession=PF00583.14; Description =Acetyltransferase (GNAT) family
MEVERVMESWKWCGERVSVIKKTTKEKAEKIDQTLVLWKASQVLSLGYILHLEKAAAIFAHSDKLYRPGPLYIKESFTYAIPSRHSLLFSSIDFDIIIVVMGEFEFAPTVLVSVREFDPNNDREGVEAVERICEVGPNGKLSLFTDLHGDPICRVRNSPTFLMLIAEIGQETVGMIRGCIKTVTCGKKLHRQGKSNTETEPKQVPIYTKLAYILGLRVSPHHRRMGIGFKLVQSMEEWFRDNGAEYAYMATEKDNVASVKLFTDKCGYSKFRTPCILANPVFAHHVRISNKVTIIELSPNDAELLYRSKLATTEFFPRDVDSVLGNRLSLGTFLAVPRVGSYQPDTWSGSARFLLDPPPSWAILSVWNCKDVFTLEVKGVSRVKKTLAKTTRVLDRVFPWLRLPSVPNFFEPFGFLFLYGLGGEGPQAQQMLRALCGFAHNLAKDRGCEVVATEVSSQEPLRCAIPHWKMLSCEEDLWCIKRLGEDYSDGSLGDWTKSPPGFSIFVDPREV

SEQ ID NO: 202833 - protein, 113 aa, Glycine max
  Coding DNA Sequence Number=SeqID_86055
MGGEKKEVKKKKVLDQRTRRNVQKGLLTGRYLNNTELSPNEQKRRKGNHDLKWSSPFNYQPKSRALATLFSRPALNKKTEKRKIQKNQKPKTHKSRKKKPPKEPIPKGSPIDP

SEQ ID NO: 202834 - protein, 274 aa, Glycine max
  Coding DNA Sequence Number=SeqID_86056
MEGGDVGHWVLEFLLRARYPVVSSNLLKKVLRIVPLSDFDSRLQKTLLLRTLQDHLFAVSVPESVLETLELLEELHRRDDGALITAAAMSAAYCAIAVDCTLKHLLVELHNNPAYLGAVNRIWRGRVRHMSGSREGSLLLSLELERWRTDIETSLLDSLVRERLASIDTRRDAVVKLRDYLMEAWTDLGPSFLELAALAQINKNALAVNYLEDSQQPERACPTEIEKCTAAPAEEVHTSTDAEVQKVGECGSVELQKLAEDSLLNSLEVNEQHL

SEQ ID NO: 202835 - protein, 99 aa, Glycine max
  Coding DNA Sequence Number=SeqID_86057
  Subcellular localization annotation: CTP_CleavageSite=12; ConfidenceScore=5.40e-01
MIFRQGAVLHVKCMHASSKPPVGLASSLSVKESPLGMAIFACKGNRQFDWRVPSRRLRARSQAMQRSAAGAGGNRHLHWRVAFCGNRQPGWRFVAERTH

SEQ ID NO: 202836 - protein, 95 aa, Glycine max
  Coding DNA Sequence Number=SeqID_86058
MALHVVTPWQLYSVPACSTGLSVEWSSLQQSSWELYEAFSKGMMKKLKHSKIVTSRARSPKVKDLIPKWNPSFEVKICILCSKTHILFFVGEDWT

SEQ ID NO: 202837 - protein, 261 aa, Glycine max
  Coding DNA Sequence Number=SeqID_86059
MEVSSEQSGEGVTLEKLQSSLKKNVPEASRRAAKTVAEPGGSVSAKRRVEPRTGSVTAATKRSGSIGGSSSVVTAPRRNSTGGLSQKASISDGRRKTGTESAAGARSGASSVGELVRSSLPELRLISVNSSRVAVKPAVASLAGSASRTSGASKAEVAKKPVTVSKPALSASSSASSVSRRIGSSSVDSTASSGGSARRTVSRVSSPTVSSGLKAGSLSTSQDRTSSSLSGRRKGGTADSRDSRFIVLPQVEIKANDDLVE

SEQ ID NO: 202838 - protein, 909 aa, Glycine max
  Coding DNA Sequence Number=SeqID_86060
  Gene Ontology: Mol. function=signal transducer activity; Cellular component=ribonucleoprotein complex; Biological process=signal transduction
  Homolog annotation: Hit_ID=Q5KDD4; Match level="QueryCoverage=98%, HitCoverage=97%, E-value=0.0, Identity=40%"; Hit description=WD repeat protein, putative
  Pfam annotation: Domain name=PWP2; Domain location=794-909; Score =204.6; E_value=2.2e-58; Accession=PF04047.4; Description=Periodic tryptophan protein 2 WD repeat associated presumed domain
  Pfam annotation: Domain name=WD40; Domain location=142-180; Score =25.1; E_value=0.00026; Accession=PF00400.22; Description=WD domain, G-beta repeat
  Pfam annotation: Domain name=WD40; Domain location=394-432; Score =42.2; E_value=1.8e-09; Accession=PF00400.22; Description=WD domain, G-beta repeat
  Pfam annotation: Domain name=WD40; Domain location=436-474; Score =44.5; E_value=3.7e-10; Accession=PF00400.22; Description=WD domain, G-beta repeat
  Pfam annotation: Domain name=WD40; Domain location=503-554; Score =12.0; E_value=1.4; Accession=PF00400.22; Description=WD domain, G -beta repeat
  Pfam annotation: Domain name=WD40; Domain location=558-596; Score =25.9; E_value=0.00014; Accession=PF00400.22; Description=WD domain, G-beta repeat
  Pfam annotation: Domain name=WD40; Domain location=620-658; Score =9.2; E_value=3.1; Accession=PF00400.22; Description=WD domain, G -beta repeat
  Pfam annotation: Domain name=WD40; Domain location=94-131; Score=6.8; E_value=5.8; Accession=PF00400.22; Description=WD domain, G-beta repeat
  Pfam module annotation: Pfam domain module=PWP2::WD40::WD40::WD40::WD4 0::WD40::WD40::WD40; Domain location=794-909::142-180::394-432::436 -474::503-554::558-596::620-658::94-131
  Subcellular localization annotation: CTP_CleavageSite=41; ConfidenceScore=5.54e-01
NAPNNTYFHKAMNFRFQNLLGAPYRGGNVVISSNTVLLSPVGNRVAVTDLLKSETTTLPLQSSSNVTRITVSPDATFLLAIDDRNRCLFINLRRRALLHRITFKHRVAASKFSPDGALIAVAAGKLVQIWRSPAFRREYFPFELVRTFADFDAKVTSLDWSPDSKYLIAGSKDLTARILCLKKLNSGGVKKRPFLLLGHRDSVVGSFFGVNSKTNRVCKAYTVSRDCYLFSWGFTSDDDGEGEEDGGEGLEPPSPGTPERDVEENFELSENDGVKKMKKISENDGVKKRKKIDIEDGDEGYLSRGKWELLRKDGFMQGWAKVTACDYHRGLDMVVVGFSNGVFGLYQMPDFVCIHLLSISREKITTAVFNEFGNWLTFGCAKLGQLLVWEWRSESYILKQQGHYFDVNCVAYSPDSQLLATGADDNKVKVWTLSSGFCFVTFSEHTNAVTALHFMPSNNVLLSASLDGTIRAWDLLRYRNFKTFTTPSPRQFVSLTADISGEVICAGTSDSFEVFVWSMKTGRLMDVLSGHEAPVHGLAVLASSSYDKTVRLWNVFDGKGAVETFPHTHDVLTVVYRPDGRQLACSTLDGQIHFWDPIDGLLMYTIEGSRDIAGGRLMTDRRSAANSTSGKFFTTLCFSADGSYILAGGSSRYICMYDVADQVLLRRFQITHNLSLDGVLDILNSKNMTEAGPLDLIDDDSSDIEEGVDKQTRGKLGLDLPGSMPNRGRPIIQTKSLRIASTGRSFVAATTEGVLVYSVDESFIFDPTDLDINVTPEAVEEALRENQPSKALILSLRLNEDSFVKKCIFAVSPADIPAVATSIPYKYIQRLVEALADLLENCPHLEFILRWSQELCKAHGNSIQQNSRNLLPSLKSLQKAITRIHQDLADTCSSNEYMLRYLCSSGAKK

SEQ ID NO: 202839 - protein, 542 aa, Glycine max
  Coding DNA Sequence Number=SeqID_86061
  Pfam annotation: Domain name=RRM_1; Domain location=76-146; Score =14.9; E_value=0.006; Accession=PF00076.12; Description=RNA recognition motif. (a.k.a. RRM, R
MVIIMPTTMLIQWLVNISQYSSQERETGDGRELGTEVRNSRGQGRDSPRVFIGHKPGQQQLYNQTNWRDRNEISTFYFTRFSDGINEKDLWYQFKKWGDVREVFISRQQNKSGRRYGFVHFKGIEDEHRMERQLDSLVIAGLKLYVNLPRFGRQGGGKVTSTDKQHEQQTMKEHVAHRYVPGGARTNQTSYTEVVARKKSAAHSCKGGRSSIHIEPSEEMLKWLSDAWVGRLTNPTTFDEVEDELRWDFEVDISTNYLGDDMFLLFGLDEVKAGKLIQEARHGTVPLFYSMQKWTPSLRPGYRLAWVQCWGIPIIAWDVVTIKKIAGVMREVVEVDNEADGRRCLDRARVLVKTPWQPDIQHTIEVHIGEEMYNVRILEECGYNTDTGQRRRSSGTPSSEEVDSDGSFMGLPGSQLLKDPSDKQEPMGKGMDRQTKGASLVLNAKINEEGKEAERATGKSRESPIKLLYKERTQEGDEICVGNSEKETGPEKGREFESRNGYEEGESSRQQGKSREDKGGKENPMDTGFTSHTPLEALYPKL

SEQ ID NO: 202840 - protein, 68 aa, Glycine max
  Coding DNA Sequence Number=SeqID_86062
MEEVQEEKGKRNWKNDNIKVGNDGVVCDSKSQMAQGVVVLRVAENREAEKSKLLQKNREFNREKELGD

SEQ ID NO: 202841 - protein, 484 aa, Glycine max
  Coding DNA Sequence Number=SeqID_86063
  Gene Ontology: Mol. function=RNA-directed DNA polymerase activity; Biological process=RNA-dependent DNA replication
MVSKLINMEERDKEEAQRLRNREVTKKEQLDKTVCQALWGDSDVGWELQLACNSAGGLLCLWSEQTFKLEKKFNGCGFIYLEGIWVADGSKVNIVNICLSCDVVLKRNLWEQIRQLRNANLGGLWCILGDFNNIRRSSERVGLCHRRQDERIVKEFNDWIAGVEVEDVPCVGRKFTWYRPNGTARKKIKRIKLRLKAWNKDQFEDTQKMLRSIEMELNKLKMEGDERQLNDQELKLQKQVQEDLWVARFEKSEWERPRLDEGSYASFLTLIPKVHDPQNLNEYRPISLIGGWISALDGLIGSPLAEFTPQRGLRQGDPLAPLLFNIVAKGLNGLMREATEKNLFEGFSVGRNKVELSLLQYVDDTILFGVASMKNVRAIKVILRSFELVSGLKINFAKSSFGTIGMSEQWMKSVASYLNCRLLSVPFSYLGIPIGENLRHSATWDPIGSEKSGGHVGEVTMMILVGRRPGAKGFVNEGLDEIQL

SEQ ID NO: 202842 - protein, 202 aa, Glycine max
  Coding DNA Sequence Number=SeqID_86064
MLEKWNPSLWTGYRLVCILCWGILLHTWDLENIKSISSAVGEVVELDDNAEELKRLDRARVLIKTPWHPTIQHAVAVTINGEEYMVHIVEETCYNPCRCKCLKGCLVGSSDKILSDESEFLTRAKTADAEGQQNGAGCEMQLSDGQYLLSGLVGITLGLLTRGPNHLRYRDESYGQSKIDKTVLGGKHRLTQQRQGGGMVTR

SEQ ID NO: 202843 - protein, 100 aa, Glycine max
  Coding DNA Sequence Number=SeqID_86065
MQTLQDVVLHRPIMLVEQFLEKVPQQVEDASSEATVLEPFVYEVDEAGGTQMRQETATLERTPQVTADPPSLVVDLSYPQQAADPHTPVNGCQMTLPHQF

SEQ ID NO: 202844 - protein, 627 aa, Glycine max
  Coding DNA Sequence Number=SeqID_86066
  Pfam annotation: Domain name=RRM_1; Domain location=87-157; Score =19.9; E_value=0.0021; Accession=PF00076.12; Description=RNA recognition motif. (a.k.a. RRM, R
MRDRERHRERTRDTEAELTCVRETLRVTVRDREWITVRNRKRERQRGWQHPKEGLGQRHGGRRQRRTGEQRNYHQVNWRDKPDVTTFYFTRFLEDASEQQLWYHFKQMGDVREIFIPKQRNKEGRRYGFMRYKGISSVSYMERKLDNMIVGGLKLHVSIPKYGRGKKEKESTAAKQKGYKVGDIPRCNMAPEQNSKRSYAKVVTSHVENKERRSGTFPLTMARGRTHSHLRLEISEETKKRYAHTWVGRLKRPQVFERVEEELSWTLGAEVSLKYFGDDLVLLIGLSDTKAQDLMNEESNHGTTAFYELKKWNPKTKPGNRLIWVQCWGIPLVAWSIEQMRKIVAELGDLVDVDDNFEDMQRLDRARVLVRTPWTPTVEHNVTAHIDGVDHTISIVEEHCNAGVACARHHRSVWGSLEEILSDVDDTGTLQSWPTDSSPLSTAFIMHGDNSFRQSLAKPNGQTGTDSPLGITRSRKDHGLGKAITPSTAENGKEIYLEDGNLDLPAEEIVELESQFVGAERQVMQKGKVCPQHLLATTGENQNGEFHTLDQGLVGENFQIYSNGSLEKLFNKSRDTVDLFGPNHNMGLHRPTTPMNQEITPQKKPANTLQKNPAITTTMLPHALRKK

SEQ ID NO: 202845 - protein, 107 aa, Glycine max
  Coding DNA Sequence Number=SeqID_86067
  Gene Ontology: Mol. function=protein binding
  Homolog annotation: Hit_ID=Q00NU6; Match level="QueryCoverage=88%, HitCoverage=8%, E-value=2e-19, Identity=42%"; Hit description=AIR9 protein
METSSDGTKKEIVGATTASYMPSIDDIGSFISVSCEPVRSDWARGPMVLSEKIGPIIPDFLDLTLEDVGVCIEIIYTPVRKDGIRGSPKSIVSDLISPGKIFFPPPP

SEQ ID NO: 202846 - protein, 145 aa, Glycine max
  Coding DNA Sequence Number=SeqID_86068
  Homolog annotation: Hit_ID=Q00NU6; Match level="QueryCoverage=99%, HitCoverage=8%, E-value=4e-39, Identity=64%"; Hit description=AIR9 protein
MELVIPDCCEDRELIPLRKYFGGHEGVGEYIWYQTKHKLEGSELLDISNASDVVICGTELTYKPLLKDVGDYLALYWVPTRADGKCGEPLIAICSTPVSPGSSICVHSLAPIHLMQGVLTVNILVDMKEKVSLAGIEKIMKEPLN

SEQ ID NO: 202847 - protein, 124 aa, Glycine max
  Coding DNA Sequence Number=SeqID_86069
MVVARNTRNSRQRWTQDNEPYSREGSLSLVHLDIPMDEKKWFSDAWVGRLKNLVLFDRVEDELSWDIGADIASKYIGDDLVLLLGLTDAIKSSHIEEMIGSGKQTQCLQSVDGGNNRGDKGWNF

SEQ ID NO: 202848 - protein, 252 aa, Glycine max
  Coding DNA Sequence Number=SeqID_86070
MEEVISKYRSGSMCTHILKCQTLKEIMGKIHGGVLLLLLVIIGVADCRKVKEVFVDIEEGDDHGGASIGFSGVFEECGGGGSNGGSTTCHSQGGGGGGVEGGAGHVGGNKTIIGFGGEVVFGGGNGGGIGGGVEGGAAIGHGGADGVGGGAALGFGGADGVGGGAALGHGGAGHGVGGGAALGHGGADGVGGGAALGFGGADGVGGGAALGHGGAGHGVGGGAALGHGGAGGVGGAAALGFGGAAAGFGGHP

SEQ ID NO: 202849 - protein, 497 aa, Glycine max
  Coding DNA Sequence Number=SeqID_86071
  Gene Ontology: Mol. function=nucleic acid binding; Biological process= DNA integration
  Pfam annotation: Domain name=zf-CCHC; Domain location=230-247; Score =8.8; E_value=0.035; Accession=PF00098.13; Description=Zinc knuckle
LQPFELSAMDDPYDPYIMNNANSPGLILVSKPLTLENWNSWKRAMLMALGRRNKLEFVDGTIPPPDPKDPLHHAWLRNNNIVASWLMNSISKEVVVSVTYSSNAAAIWKDLEDRFQQNNGPRILQLKQLSEYKPVHHCHCGGVQPLLDHFHFEYVLTFLLGLNESYNPIRGQILTMDPFSSIQRAFSLVIQKEKQREVGNVQTPLDSQLACVVQGSQNSKSGNKKDKGHPLCTHCGLLGHTKDKCFKIIKYPPGHKKHKSTVNLVNDNQGESSNSFNIAQCQQLLNFIQSQMARAMNSETSQSDQSNLGMIFSTHATIPAQRHKFTPRAIKCVFLRYLFGYKGYKLYDLDNHKFLISRDVTFQENSFPFATSTYTTSDMFPNLVVLRPFLDMLPNPNPTPQPPPEPKPQLEIEPDLAQPDVLPNAHVSRSTKVIRPPTHLHDYVSNVTYPIQNHLTYNNLSPTYRDYVFKVSKIYEPQFYHQAIRFAEWSQAMNEEI

SEQ ID NO: 202850 - protein, 115 aa, Glycine max
  Coding DNA Sequence Number=SeqID_86072
MTLLLSNIYANDQFVDLPCRISVGLCRHDIGLCQFYGVPVAPSKVIRPPANQAFIKKYCAPRQAHGETQQQPGNGQQRATDAPSPPPEPLSPSTKAGALPTTRGRLAGDQVQSQR

SEQ ID NO: 202851 - protein, 92 aa, Glycine max
  Coding DNA Sequence Number=SeqID_86073
MYKDKWTQPWPMGSEIYPEVHENPRAFFSSSSLILLEPLAHGSGNWSLPREDCIRSISTLGCHVSNLTTKITDNGVLIMNIDLTIISISKLI

SEQ ID NO: 202852 - protein, 74 aa, Glycine max
  Coding DNA Sequence Number=SeqID_86074
MVKGMEMVMKKKRKRRRVVLIWSAAMQLYRGIQNNKAKMRLQELRKKLNSVRESKQSAIEATKVVKEERSTKQQ

SEQ ID NO: 202853 - protein, 266 aa, Glycine max
  Coding DNA Sequence Number=SeqID_86075
  Gene Ontology: Cellular component=cytosol
  Homolog annotation: Hit_ID=Q5Z918; Match level="QueryCoverage=46%, HitCoverage=57%, E-value=2e-53, Identity=75%"; Hit description=EREBP- 4 like protein
  Pfam annotation: Domain name=DUF862; Domain location=28-165; Score =225.0; E_value=1.6e-64; Accession=PF05903.5; Description=Eukaryotic protein of unknown function (DUF862)
  Subcellular localization annotation: CTP_CleavageSite=12; ConfidenceScore=5.04e-01
MGTTKNNNNNFNSTSKSDNSANDNKNNTRVVLNVYDLTPLNNYLYWFGFGIFHSGIEVHGKEYGFGAHDFPASGVFEVEPRKCPGFVYRCSVTLGQVNMHPSEFRTFIEGIANEYHGDTYHLISKNCNHFTDDMSHRLSGKRIPGWVNRLAKLVVEVTTVKQLPEYHECSEDEITECLSTASPCGSQSTSGLDDDQEKRLLSPLARMPRARKFLIFQWLSAFLGSIVLRVFISGGIVGALSHDWGTRVDLRYISLPVSLALSLLGS

SEQ ID NO: 202854 - protein, 305 aa, Glycine max
  Coding DNA Sequence Number=SeqID_86076
  Gene Ontology: Mol. function=chitin binding; Cellular component =extracellular region; Biological process=chitin metabolic process
  Homolog annotation: Hit_ID=UPI000044A8F0; Match level="QueryCoverage =99%, HitCoverage=99%, E-value=4e-40, Identity=29%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
  Subcellular localization annotation: CTP_CleavageSite=41; ConfidenceScore=5.66e-01
MARTCSPLKARTYSPLKARTCSPLMVRACSPLKVKVRACSPLMARTCSPLKARTCSPLKARTCSPLKARACSPLKARTCSPLKVRACSPLMVRTCSPLKVRTCSPLEVRMCSPLKARVCIPLKVRMRSPLKVKTCSPLEVRTCSPLKARACSPLKARACSPLKVRLRSPLKARTCSPLEVRACNPLMARTCSPLKARTYSPLKARTCSPLKVRACSPLKVRVLVPKARACSPLKARTCSPLEVRACSLLMARTCSHLKVRTCSILMVRACNPLLARTCSPLKVRVLVLEARACSPLKARTCSPLE

SEQ ID NO: 202855 - protein, 163 aa, Glycine max
  Coding DNA Sequence Number=SeqID_86077
MSCRYYQWESNLDDLLIQFKDTVDSMQQAFKRTETKIGKLVDDMTKVVVRREEEYAKIEAHQERILQVTTIHHQLINEEEKDEVSSTPEYPCMATVGYVVGIDKGRLELSVEDKKISFDLFEAMKHSYMGDAYFEEEEVEQEITSSASTMILQIPLEKELVMW

SEQ ID NO: 202856 - protein, 121 aa, Glycine max
  Coding DNA Sequence Number=SeqID_86078
NSEPCLRYATEGQAVGDIPLQNTLEGPQYHPQPHPFHSTAIKNPHAMAEMGKVPDFDEYKGTTCPKNHLKMYCRKVGACAKDEKVLIHFSQESLTGTTVTWYTNLGTFPSPFLEGPNGFLR

SEQ ID NO: 202857 - protein, 35 aa, Glycine max
  Coding DNA Sequence Number=SeqID_86079
MSKGGTYRLKTEDRFTIFAKSPTETSRKHYGSASA

SEQ ID NO: 202858 - protein, 55 aa, Glycine max
  Coding DNA Sequence Number=SeqID_86080
MASEVRSSTSSLIDPNVIAKAIKKHFRVYLMPNDQLVWRKPYPKWIDKMTPLLRG

SEQ ID NO: 202859 - protein, 119 aa, Glycine max
  Coding DNA Sequence Number=SeqID_86081
MVLEINFGREVEKLQNTVFNKEKPYIGRPSSRGELQIIDGIDNGDDIGSGEGIIGDEEGIVDATIGDGENVSASIKMRMGAIYGCLWEGIGAIVGRIWKGIGVIVGLGRYQGNTWGWGR

SEQ ID NO: 202860 - protein, 211 aa, Glycine max
  Coding DNA Sequence Number=SeqID_86082
  Gene Ontology: Mol. function=protein binding; Biological process =retrograde transport, endosome to Golgi
MAREGGGTWQLRWRRRKVGLTDDEETSLMVLAVTASAQRNMVHRIRTLAGKVAGKQKQFAGRRATSGMESEEVGPGAVELLNPARVVDQIGVEEANGVLKVSNLLAALEDLRIKLLLQREILRHVGEGACSAERGAVLEAEVLLEVERRDLAEARHQRLALAAAAGAGGVGGGIGGGIDLFVGGVVADVLEAVEGVGDRGEVGEEVGSGDI

SEQ ID NO: 202861 - protein, 369 aa, Glycine max
  Coding DNA Sequence Number=SeqID_86083
  Gene Ontology: Mol. function=protein binding; Cellular component =Golgi apparatus; Biological process=retrograde transport, endosome to Golgi
  Homolog annotation: Hit_ID=UPI0000E7FFFD; Match level="QueryCoverage =56%, HitCoverage=22%, E-value=4e-24, Identity=32%"; Hit description =PREDICTED: similar to vacuolar sorting protein 54 long isoform 2
  Subcellular localization annotation: CTP_CleavageSite=58; ConfidenceScore=5.72e-01
MDSPPSQHTWGRSTTSLSSSLSKSNSDSIQSLSSILNNPHAADAASWAGWWSSSSSAVAVAVPEFAIIPASKAASDVSRSDFLPYLSPISDAFHRFEDIRNHASNEQINASADAATNSTGSGGGGQGEALVACLREVPALYFKEDFRLEDGATFRAACPFANVAENLALQEKLSHYLDVVELHLVKEISLRSSSFFEAQGQLQDLDAKILQGCEQIRHLKDTIRLLDADLVHDARRIQELNGTRTNLLALLQKLRLIFYVNQALSALKLLVASADCAGALDVTDDLQHLLDGDELSGLHCFRHLRDHVIGFIESINSILSAEFIRASLNDAAEKDVIILSKAKARASLPMNGKDDEAPVTFSALDMAQS

SEQ ID NO: 202862 - protein, 243 aa, Glycine max
  Coding DNA Sequence Number=SeqID_86084
  Gene Ontology: Mol. function=RNA-directed DNA polymerase activity; Cellular component=membrane; Biological process=RNA-dependent DNA replication
  Homolog annotation: Hit_ID=Q1T0R3; Match level="QueryCoverage=75%, HitCoverage=82%, E-value=7e-29, Identity=38%"; Hit description =Hypothetical mitochondrial protein atmg00310
MTWFPTKWVVLYCSERKDGMHPLLGFWKEDIVYLVPKKVVDKLARIQRKFLWEGALDHNKIAWVKWDIVCLPKDRGGLGIKDVNTFNLALLAKWKWHLFQHQGQLWARVLESKYGGWRGLDVVTTGSKESIWWKDLKLASHHPENGEALQRSTVWRVGCGDKIKFWENNWIGDSGALAAKYPRLYLISSQQNHTIQQMRVHNDSGWEWQFTWRRLLFDNEIDMATTFLKDIETQQIQPQRSDG

SEQ ID NO: 202863 - protein, 388 aa, Glycine max
  Coding DNA Sequence Number=SeqID_86085
  Gene Ontology: Mol. function=cystathionine beta-lyase activity; Cellular component=cytoplasm; Biological process=amino acid metabolic process
  Homolog annotation: Hit_ID=Q0MFZ3; Match level="QueryCoverage=96%, HitCoverage=96%, E-value=1e-107, Identity=51%"; Hit description =Cystathionine beta-lyase
  Pfam annotation: Domain name=Beta_elim_lyase; Domain location=35-317; Score=-89.5; E_value=0.00011; Accession=PF01212.11; Description=Beta -eliminating lyase
  Pfam annotation: Domain name=Cys_Met_Meta_PP; Domain location=10-383; Score=370.2; E_value=3.3e-108; Accession=PF01053.10; Description =CysMet metabolism PLP-dependent enzyme
  Pfam module annotation: Pfam domain module=Beta_elim_lyase::Cys_Met _Meta_PP; Domain location=35-317::10-383
MPNAKPIAQQTLLTHDQRHEQGAVTPPIYQSSLFTFSDYDSMIARFRGESDQPLYSRVDNPTVKALQDKVAALEGGDACLAFASGMAAISNAILSVVQPGAKVVCVNHVYPDTYRFLRGFCQRFGITTQFVDGDDEAAMAAALPGASLLYLESPSSWVMSEQNLRQLATLARDAGVVTLIDNSWASPIFQQPLLCGIDIVVHSASKYISGHSDVVAGLVIASHQHINNIARHISPFLGGKLSANEASLLMRGLRTLPLRMKQHQHSALQLAEKLRDHPQVSAVCHPGLNPPTWSTLRGYSGLFSFAVTEQVDIPQFCNALQLFHMGVSWGGFESLVMPAISVINQASEFNSAQDFGVSPRLIRISVGLEETDDLWTDLNQALAAATHR

SEQ ID NO: 202864 - protein, 292 aa, Glycine max
  Coding DNA Sequence Number=SeqID_86086
  Gene Ontology: Mol. function=transcription factor activity; Cellular component=intracellular; Biological process=regulation of transcription, DNA-dependent
  Homolog annotation: Hit_ID=Q98LV8; Match level="QueryCoverage=58%, HitCoverage=66%, E-value=2e-29, Identity=45%"; Hit description =Probable transcriptional regulator
MAVAGADGVKQFTRITGGAVNAGVESPILRPGGTDSQVHTLHLFQPPFDFQQVVGAGALRGQHAGFGLNDAAHFQRMKHVGGVVFKAQREKAVMQTDLCLQKGAAAFFAHNDAECFPALERLAHRITADAQFLRQLAFRRQATARLRAGMRHVARERIKNQRIAARGNNGMEFSRVMHRFALIGCTVVWRYSAVAQGTIVVRDQANQQQDVAALSRDTEHANDSISPIFDKEKEQKRLQTAQLLGESGSQVADIARTQGQIEATEAGKKELAKNNINQPDADAPAAKKKAYQ

SEQ ID NO: 202865 - protein, 310 aa, Glycine max
  Coding DNA Sequence Number=SeqID_86087
  Gene Ontology: Mol. function=chitin binding; Cellular component =extracellular region; Biological process=chitin metabolic process
  Homolog annotation: Hit_ID=UPI000044A8F0; Match level="QueryCoverage =83%, HitCoverage=99%, E-value=2e-48, Identity=31%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
  Subcellular localization annotation: CTP_CleavageSite=41; ConfidenceScore=5.17e-01
MSSLSDGYTSSISESYTSTPSKDYTSSPSEGYTPSPLEACTSSPSKDYTSSTFRGLHILAFRGLHVLTFKRIHVLAFRGLHALDIRGLQVLTFRGLHALTFRGLQFFAFRGLHILTFRGLHALAFRGLHILAFRGLHALAFRGLHVLAFRGLHTLAFRGLHVFAFRGLHVLTFRGLHTLAFRGLHALAIRGLHVPTFSGLQVLTFRGLHALTFRGLHVFAFRGLHALAFRGLHFLAFRGLHTLAFRGLHVLGFRELHVLAFRGLHVLAFRGLHTLAIRGLHVPTFSGLQVLTFRGLHALTFRGLHVLAFR

SEQ ID NO: 202866 - protein, 148 aa, Glycine max
  Coding DNA Sequence Number=SeqID_86088
  Subcellular localization annotation: CTP_CleavageSite=39; ConfidenceScore=5.32e-01
MPKFITSVSSRCGFTSLSSCSTILLKSGGSPQCSIECPRARMVAVPPWVSICIGVGIYTWSGLCREGILWVVLGRSLWLIGHARSDGRRARGRPDVDRVIVLVWGILIHVVVRGLLGIWPCGCCGYSMGVSLLFLYATCSSPLIASTC

SEQ ID NO: 202867 - protein, 472 aa, Glycine max
  Coding DNA Sequence Number=SeqID_86089
  Gene Ontology: Mol. function=RNA-directed DNA polymerase activity; Cellular component=chromatin; Biological process=chromatin assembly or disassembly
  Pfam annotation: Domain name=Chromo; Domain location=375-425; Score =22.6; E_value=0.0014; Accession=PF00385.14; Description='chromo' (CHRromatin Organisation MOdifier
  Pfam annotation: Domain name=zf-H2C2; Domain location=184-225; Score =12.4; E_value=0.0082; Accession=PF09337.1; Description=His(2)-Cys(2) zinc finger
  Pfam module annotation: Pfam domain module=Chromo::zf-H2C2; Domain location=375-425::184-225
MGAVLTHEGHPIAFFSKKFCPKLLNSSIYVCELAAITTVVKKWHQYFLGHHFVILTDHQSLRELMNQAVQTLEQHRYLARLLGFDYTIQYRSGKTNVVADALSRVQDDQTTFLYLLLMPQFIFLEDLCKELASLLAFIELRKQIQAKPTAYHDYTLTPEFILHKGRIWLPSNSSFIKLLLEEFHQSPTGGHMGLQKTLQRLQDNFRWSSIREYVCAFITSCLTCQHTKYDNQRAASLLCPLPVPAQPWEDLSMDFIMGLLAYRGNTCIFMVVDRFSKGLHLGMLPTHHTAHAVAALFMEMTSAVGNTYSKLAKCYYGPFQVTELMGKVAYKLQLPEHSRIHHVFHSSLLKPYIAPTTPTDVAELPPMAIDNHPVVTPLAIVASKIIPSESGPKHMVLVQWRGLPPKETFWEEWQTFKTLHHLEDKVLFDGHGSDMKTTEELQLAREVQEESEARPKRKKAIPLYLEDYVRSL

SEQ ID NO: 202868 - protein, 189 aa, Glycine max
  Coding DNA Sequence Number=SeqID_86090
MNSTSFQGLENQKTLESFWFTHAKSCLWLSEKRSSGQSVLENFWYELTKPPSRAQPQEGEPAGDSSRFSSEIVWHMYQDNVHLWNILPERNVELAPTMFDEFYGELQHQQWHHKLTCLLEKRINVALVYEFYTNAYNPEDGSPKYCRVQEQVIQFDVETLNDFLETPVIILEGEEYPTYSQYLHSYPNH

SEQ ID NO: 202869 - protein, 233 aa, Glycine max
  Coding DNA Sequence Number=SeqID_86091
  Gene Ontology: Mol. function=RNA-directed DNA polymerase activity; Cellular component=chromatin; Biological process=chromatin assembly or disassembly
MEGPALACFQWMQCKAQLSSWPTFLHAIHSHFASSTYEDPTSLLCKLHQRSSVSAYLSEFESLANRIVGLPTPFMLSCFISGLSPVIRREEEKLMDARRPPPYCLPTTTATTIATRSPSPYPTLPLLPTPQRTTTTSIPFKCLTLEELAVRHEKGLCFHYDEKFSRGHKCSSSLFLFVTKDEELTPQLAPPCSPSPTHDLLPEPPPAQLSLHALSGHSAPETLPVQGFIGDFS

SEQ ID NO: 202870 - protein, 136 aa, Glycine max
  Coding DNA Sequence Number=SeqID_86092
  Gene Ontology: Mol. function=ribonuclease H activity; Biological process=RNA-dependent DNA replication
MYKFMILILLYRICGIMVNGTCNSSTRLYLIRCETPLLRHLYQLNLLGTMLLLGWGTIRGFIQHSQPINGIFINLNLPISFGRKSGVLQRRKRSSSLFAKPFDLPCQPIASVMLVIYLPLLHAHGVMHKRRLSSML

SEQ ID NO: 202871 - protein, 69 aa, Glycine max
  Coding DNA Sequence Number=SeqID_86093
MEAFLRSLYGGWIFELHQGPSIVIFSHGVAIEDKRRRGEKRRHPLRNKPWKKKLHHQESVLDKKLREEA

SEQ ID NO: 202872 - protein, 149 aa, Glycine max
  Coding DNA Sequence Number=SeqID_86094
MASTPSNFLSQSFPNFITQKLDDSNYLHWRQHVESVIKSHKLQHLIINPVLLPRYLMEDDRIPDTGSYGRGGFPNRSVRCGGGGSSRGRGGVTFFDSTTLQPIPYSTGSIRASNTWINPNSKVVVPASNQPSALITNSSSHGNGPTSST

SEQ ID NO: 202873 - protein, 556 aa, Glycine max
  Coding DNA Sequence Number=SeqID_86095
  Homolog annotation: Hit_ID=Q4KWH4; Match level="QueryCoverage=47%, HitCoverage=14%, E-value=5e-12, Identity=27%"; Hit description=CAMP -like factor autotransporter
MTPSGVRINDSAQLPLNTHWAAQAAGRDVIYGIRPENISLAQPGEQHALPLEVSLVEPTGLSELIHANVRCCSTPHHSAACNCTFKRSKRPAHPGIVAPAFDAVAGNLFAIIRLGIQRHVVDKGRRAAEADVPHLAKFAAAEALAQVAVAGADPDLRRTAPAAIVVSAQIRRVLVLTAVLPAARHARAEPANGAHHPPASADSQTRLTPSSRALWVWRPLSAAQCRFRHAGGAVTVSGMRANARVAARIGDAATYAIFSAIGAQQIAAELYGAVVEVEIITPGVQPAIASILQIRTEVADKHLCAVRRLLAQFAETLMQIVSDCQRVVRQPDRCGDPGRHLRRDRRTHRLNRTARLRLAQRAIAADEVVCQTIVPCVAACAAARCKAVQTILPRPGCHIAIAQPEAVGAGAAGGTAGVTVNKQHVAVGGCRIEFQAALRGGQTTFDGQGICRHIATVGQVERAGIIHYQRIIAGPLQPRVDAIAGEQRGSGIDIDGAVRQFNVVAQRPLRIDEVQRAPARAEVGAFGEIVLPERTAARIELAEVQRAIRAAAGDMA

SEQ ID NO: 202874 - protein, 449 aa, Glycine max
  Coding DNA Sequence Number=SeqID_86096
  Homolog annotation: Hit_ID=UPI00005F9379; Match level="QueryCoverage =31%, HitCoverage=91%, E-value=3e-31, Identity=48%"; Hit description =COG0454: Histone acetyltransferase HPA2 and related acetyltransferase s
  Pfam annotation: Domain name=Acetyltransf_1; Domain location=235-315; Score=45.7; E_value=1.6e-10; Accession=PF00583.14; Description =Acetyltransferase (GNAT) family
  Pfam annotation: Domain name=Ribonuc_L-PSP; Domain location=338-449; Score=79.7; E_value=9.4e-21; Accession=PF01042.11; Description =Endoribonuclease L-PSP
  Pfam module annotation: Pfam domain module=Acetyltransf_1::Ribonuc_L -PSP; Domain location=235-315::338-449
MAIKENGKLRAIYIKDNEIALINQWLQEKYGDGIRVVNKGASSSQAMDLLNGKYFYKNNKSWREEMKKSPAKIILLNFATNDARHFHFRDIEKDYQEPHPICGRAEKWHVAPYVTKLDALAKAESVPLARQYQRILQMKDWQSLMSPDCIHPSEQLYRMKAEETFSVLVSHFNTELAAAGHGKNPDGEQCPQLLDTVATMLHQEWSGFSHWRDRSAIRQRLLMRNAQPAKTFTLVALNAENEVLATASTILHELDDIHERQFWMGEVLTVAAHRGKGVASALVLRLIEEARQRHMPELWLYTPDQQAFYRRYGWQEIEQRIVSSEQMLVRKNYPELGEVKAPYVHAVKHGDTLYVSGLTAFATTAQQADITAQAEVIFQQLHTLAAQENTSLKNLIKVTIFVTSFTDINALRDVLYRHYGEHLPASSLVQISQLFCPDLKIEIEAIIAL

SEQ ID NO: 202875 - protein, 224 aa, Glycine max
  Coding DNA Sequence Number=SeqID_86097
  Gene Ontology: Mol. function=sequence-specific DNA binding; Cellular component=intracellular; Biological process=regulation of transcription, DNA-dependent
  Homolog annotation: Hit_ID=Q0B7A1; Match level="QueryCoverage=82%, HitCoverage=56%, E-value=1e-54, Identity=60%"; Hit description =Transcriptional regulator, AraC family
  Pfam annotation: Domain name=HTH_AraC; Domain location=134-178; Score= 37.2; E_value=5.6e-08; Accession=PF00165.13; Description=Bacterial regulatory helix-turn-helix proteins, araC family
  Pfam annotation: Domain name=HTH_AraC; Domain location=82-128; Score =26.6; E_value=8.8e-05; Accession=PF00165.13; Description=Bacterial regulatory helix-turn-helix proteins, araC family
  Pfam annotation: Domain name=TetR_N; Domain location=80-125; Score =5.1; E_value=0.056; Accession=PF00440.13; Description=Bacterial regulatory proteins, tetR family
  Pfam module annotation: Pfam domain module=HTH_AraC::HTH_AraC::TetR _N; Domain location=134-178::82-128::80-125
FAAPDAGLIVSLLPQFIHVRGASRLTTLVQLVRDECRAQRPARQIVLERLLELLLIEALRAMPAANASPGVMRGLADERLAGAIRAIHARPAHGWTVPQLAKHAALSRSAFFVRFRDAVGMAPMAYLLTWRMALAKNLLRSSRLSVADVAERVGYRSASAFSIAFTRFTGQTPSGFAGAERRSGTAEAEPAITRFKNHPVNAGAHQCAPYKTVLYPVGSPFMAT

SEQ ID NO: 202876 - protein, 541 aa, Glycine max
  Coding DNA Sequence Number=SeqID_86098
  Gene Ontology: Mol. function=transferase activity, transferring groups other than amino-acyl groups
  Homolog annotation: Hit_ID=Q39JK6; Match level="QueryCoverage=38%, HitCoverage=11%, E-value=6e-21, Identity=34%"; Hit description=Outer membrane autotransporter barrel
  Pfam annotation: Domain name=Acyl_transf_3; Domain location=1-298; Score=-24.5; E_value=0.00039; Accession=PF01757.12; Description =Acyltransferase family
MVHTFRMEVFFFLSGMFSALIILRKGQKFFTDNRRKRVLIPLISAYLFIPPLMYFIAGQMNNTPLSLEGWLNSYTMMHHLWFLVSLSVMSLLVPGAFYQWSARQLGKMSLPMLIATLVILGNACFVLKFLVKGRGEFVELIPVTARFLVYYTAGFALYVNREKIARYANSKLMNGWLVAALVLAVWAACYVVAHNHITGVMKYVPVMLGSVLSVMLSYWLVFSFERINVKESRILTAIVDSALIIYLLHYPVVIIFSWLLDVWLPDNLSVLYVLIDFALGIALSAVCYAIVKRSRFASFMFGLKPKDKKVAVPGLMLPATPVSAVVLKPFTPERNDNKVGAYCLCNGSTQTLSGVPRFTAGESGMSSVTLGELQKVGRIINDNLIGEPRLQLGAQNYAIGIPDEETGSYRVYQVYNSAEMIAPAEINGATVVPDYYDVNDKQYIDARVATVTNGRLNINIGQQGAAANASTNRWSMAAKQSQLFASSNNGQINWDSNNRIRFTAATPPYGGDRLAFDAGGVVTYAGLFDVTLKDGSSNAYY

SEQ ID NO: 202877 - protein, 50 aa, Glycine max
  Coding DNA Sequence Number=SeqID_86099
  Subcellular localization annotation: CTP_CleavageSite=24; ConfidenceScore=5.08e-01
SSSSFLSKAILGGEAPSSLAYSLVDAQRSSLHRSPTSKLPSSGNQSTRAS

SEQ ID NO: 202878 - protein, 86 aa, Glycine max
  Coding DNA Sequence Number=SeqID_86100
MYHEINFSLQEFNQKLSSAKLIQTNPSFVCHKSRDLVDIVSKQANELQNNTSSKAMKAINECIEVDQINLDEVHAFVVATNSKFLN

SEQ ID NO: 202879 - protein, 180 aa, Glycine max
  Coding DNA Sequence Number=SeqID_86101
MATSDHAILHDGTHIPTKQSLLELSSQNTLLAQNKLLSKQFEALTETLTYESGCCIPTEDIAHEVDTQVSNMAKTTSSNKDNGELTLTINSTKTKVVYSAGVALSEAYALSEDHTLSEELSRLASKKNLEENLRSVCMLSASSTSHLSLPSLSAPSSPSGFSLTRVKCDFEDRKPFLSLK

SEQ ID NO: 202880 - protein, 49 aa, Glycine max
  Coding DNA Sequence Number=SeqID_86102
MHWMSTIILGSFKNNWETYFNEVRPLDAERFKALRIQWTQYYLKVRNQT

SEQ ID NO: 202881 - protein, 214 aa, Glycine max
  Coding DNA Sequence Number=SeqID_86103
MDIGPRSRRVIISSGDRRFKVGGGRGGGEREIGGGSNAGEGAGRGYGTSKIGGARLRKGGRVSKSFSSWRRASPVACTKLEEGAGGVVVVGRREAGLECLDESGPRSKLAIVGHPLEPREGIRKKVGMGGVAAEDEKEDGGRRSIRASNFWAIVWTVSPREAWRSVSLRMAASRLLEELAVEGGSDMVTRAPNDRNKLVMDFEDQSLLEKKERN

SEQ ID NO: 202882 - protein, 584 aa, Glycine max
  Coding DNA Sequence Number=SeqID_86104
  Gene Ontology: Mol. function=RNA-directed DNA polymerase activity; Cellular component=chromatin; Biological process=chromatin assembly or disassembly
  Pfam annotation: Domain name=rve; Domain location=400-522; Score=4.7; E_value=0.0024; Accession=PF00665.16; Description=Integrase core domain
  Pfam module annotation: Pfam domain module=RVT_1::rve; Domain location=130-315::400-522
MLRLIDTIVGHSVVVLVDDLGYKPTVSYGWKWPTLSLHSLLHKHFSHHPALYLCGGSVCAAHCRREHHSRCTMAKIAWAEAKSSNSSIPLPPRIQALVDYFGYLFQPPSSLPLERVESMLQKGLISPSTSHFSSLVLLIRKHDDSWRFCVDYRALNVVTVCDWFPILTIDELLDELGKACWISKLDLLQGYHQIRMHSPNIAKTAFRTHHGHYEFKVMPFGLCNSVILLGDYEYDFQEHVAHMEQAFQVLLDNQFVLKLSKCSFAQQQVEYLGHVVLQKGVEPVAAKVEVGYATIAALLVAATTVDPFRWTVPAQIAFDRWKQALSEAPVLTLPDFQLPFTVVTDASGVGMGSYLVAAVIALDQNTPSGVPCHIDRSCLDCQHAKCETKRVAGLLCPLPVPHRPWEDLSLDFIMGLPPFQGNTVILVVVDHFSKGIHLGMLPSSHTAHELFHLSGTQLRISSAYHPQSDGQTEVLNRVIEQYLQSFVHRRPSSWGKLILWVEWSHNMAWNAVTRSIPYKITFGRKPFNFPEYLTGTSKVDVVDEMLPNREETFLLIRKKLIKAQGLMKKHADRKCRDVVYQIGD

SEQ ID NO: 202883 - protein, 109 aa, Glycine max
  Coding DNA Sequence Number=SeqID_86105
MSSYAPVYAHFLNVMLHSSELAFVHLTIDHERRKQTNEVLKHRKDQKENIKKMLMQHDMACQHKALIVLVFMQRGKLYNCTIVVLYLRENEKKDEYSGGFLLLDVTLHG

SEQ ID NO: 202884 - protein, 260 aa, Glycine max
  Coding DNA Sequence Number=SeqID_86106
  Gene Ontology: Mol. function=protein dimerization activity; Cellular component=nucleus; Biological process=regulation of transcription, DNA-dependent
  Homolog annotation: Hit_ID=Q0GPH4; Match level="QueryCoverage=50%, HitCoverage=43%, E-value=3e-60, Identity=100%"; Hit description=BZIP transcription factor bZIP68
  Pfam annotation: Domain name=bZIP_1; Domain location=12-69; Score =19.0; E_value=0.0013; Accession=PF00170.11; Description=bZIP transcription factor
  Pfam annotation: Domain name=bZIP_2; Domain location=20-66; Score =8.6; E_value=0.09; Accession=PF07716.5; Description=Basic region leucine zipper
  Pfam module annotation: Pfam domain module=bZIP_1::bZIP_2; Domain location=12-69::20-66
MEFDGMIIVVLRVAFNVFFRQLRNRDAAVRSRERKKLYVKNLEMKSRYLEGECRRLGHLLQCCYAENNALRLCLQLRGTYGASMTMQESAVLLLGKACDCKLTSAVGFPAVVHGHHMPSQSASNAVGCSSTSKRKHRAEGPKKGNSKRIRKGELSYWRGVCFHGVSLAIGGIFLMQAPLELVGLGSSSSMDSFASWKINGSGMEKEERERRRHFKEKMSLEEAHHHRRPWIRAWRKKEMNEGRGREEHEILCSKRALKSE

SEQ ID NO: 202885 - protein, 535 aa, Glycine max
  Coding DNA Sequence Number=SeqID_86107
  Gene Ontology: Mol. function=shikimate 5-dehydrogenase activity; Cellular component=cytoplasm; Biological process=aromatic amino acid family biosynthetic process, shikimate pathway
  Homolog annotation: Hit_ID=Q1T3G3; Match level="QueryCoverage=94%, HitCoverage=94%, E-value=0.0, Identity=73%"; Hit description =Glutamyl-tRNA reductase; UBA/THIF-type NAD/FAD binding fold; Bacterial extracellular solute-binding family 1
  Pfam annotation: Domain name=GlutR_N; Domain location=92-243; Score =272.5; E_value=8.4e-79; Accession=PF05201.5; Description=Glutamyl -tRNAGlu reductase, N-terminal domain
  Pfam annotation: Domain name=GlutR_dimer; Domain location=410-516; Score=148.8; E_value=1.4e-41; Accession=PF00745.11; Description =Glutamyl-tRNAGlu reductase, dimerisation domain
  Pfam annotation: Domain name=Shikimate_DH; Domain location=247-397; Score=197.8; E_value=2.5e-56; Accession=PF01488.10; Description =Shikimate  quinate 5-dehydrogenase
  Pfam annotation: Domain name=TrkA_N; Domain location=273-378; Score= -7.8; E_value=0.06; Accession=PF02254.8; Description=TrkA-N domain
  Pfam module annotation: Pfam domain module=GlutR_N::GlutR _dimer::Shikimate_DH::TrkA_N; Domain location=92-243::410-516::247 -397::273-378
  Subcellular localization annotation: CTP_CleavageSite=64; ConfidenceScore=5.86e-01
MAALGRSSAAATTSLSSSSARFRRSLHLPPSQLSFPRARFSVNATCPFFSDNNGNKISLPQDVVASKPSPLELLKTSAADRYTKEKSSIICIGLNIHTAPVEMREKLSIPESHWAQVIKDLCALNHIEEAAVLSTCNRMEIYVVALSQHRGVKEVTDWMSKVSGISIPELREHQVLLYNAYAAQHLFEVASGLDSLVLGEGQILAQVKQVVKAGQGVPGFDKKISGLFKQAISVGKRVRTETNISSGSVSVSSAAVELALMKLPDSSFADSGVLVVGAGKMGKLVIKHLAAKGCRKMVVVNRTEEKVNAIRKELKDVEILFRPISDMLACAAEADVIFTSTTSESSLFSKENVQMLPLVSHGRRRLFVDISIPRNVEPSVSDLETALVYNVDDLKEVVAANKEDRLQKAEEARGIILEELNKFEAWKDSLETVPTIKKFRAYVERIRASEMEKCLSKMGPDVSKQHKDAIYALSMGIVNKLLHGPMQHLRCDGKNDSSLSEVLENMRALNRMYDLETETSLIEEKIRVKMERVQK

SEQ ID NO: 202886 - protein, 155 aa, Glycine max
  Coding DNA Sequence Number=SeqID_86108
  Subcellular localization annotation: CTP_CleavageSite=64; ConfidenceScore=5.05e-01
MFAHSIKGCRPLGRTCGVLIPSPCVNTTPELFHLKVRRSRLFRFFRRFPQINVGGDSARIPFVEHASRESRVALPPKGCKQQLGPLGPSKFFLQKAVASRGSNLARLGGKLLPYFAINRGRSEEEKGSAFLALRIHLKLLRKIVFVKKIQAETLP

SEQ ID NO: 202887 - protein, 102 aa, Glycine max
  Coding DNA Sequence Number=SeqID_86109
IVEIEDVQEQMKADIEALKDRMASMMEDMLSMKRMMESNSTAVAANSTSAEADLTHPFTINQVNQSIPNIVDQGGEVLGSTSGPHGQQPQPMGENREDPQDH

SEQ ID NO: 202888 - protein, 120 aa, Glycine max
  Coding DNA Sequence Number=SeqID_86110
  Gene Ontology: Mol. function=transporter activity; Cellular component= integral to membrane; Biological process=transport
  Homolog annotation: Hit_ID=Q1T3F8; Match level="QueryCoverage=78%, HitCoverage=18%, E-value=5e-40, Identity=84%"; Hit description=Major facilitator superfamily MFS_1
MAQQQEHEGKPESSSSQPESSLEPDMGTKSTMIPSTSWFTPKRLLAIFCVINLLNYLDRGAIASNGVNGSQRTCEGGTCKSGTGIQGDFNLNNFEDGVLSSAFMVGLLVASPIFASLAKR

SEQ ID NO: 202889 - protein, 80 aa, Glycine max
  Coding DNA Sequence Number=SeqID_86111
MASPMTCGGTLWLSAPFFIQRQRVRLHAGVPYGYPHLFSYRDGKSDDMQEASKPVDTKRLTSSSAPFINQGQASPLTRRD

SEQ ID NO: 202890 - protein, 67 aa, Glycine max
  Coding DNA Sequence Number=SeqID_86112
  Subcellular localization annotation: CTP_CleavageSite=24; ConfidenceScore=5.60e-01
MAPTAAMLLLSHNGKTPIPSSSSSSSATTYYFRLKDSALKWVSKYNPVPKSGSKNKRFEEALQLCSC

SEQ ID NO: 202891 - protein, 443 aa, Glycine max
  Coding DNA Sequence Number=SeqID_86113
  Gene Ontology: Mol. function=transporter activity; Cellular component= integral to membrane; Biological process=transport
  Homolog annotation: Hit_ID=Q1SYG1; Match level="QueryCoverage=99%, HitCoverage=82%, E-value=1e-166, Identity=66%"; Hit description =Major facilitator superfamily MFS_1
  Pfam annotation: Domain name=MFS_1; Domain location=1-372; Score =21.5; E_value=3.3e-05; Accession=PF07690.6; Description=Major Facilitator Superfamily
  Pfam annotation: Domain name=OATP; Domain location=1-383; Score= -268.6; E_value=0.0056; Accession=PF03137.10; Description=Organic Anion Transporter Polypeptide
  Pfam module annotation: Pfam domain module=MFS_1::OATP; Domain location=1-372::1-383
VNPFRLIGVGLSVWTLATLCCGFSFNFWSIAVCRMLVGVGEASFMSLAAPFIDDNAPVSQKTAWLAIFYMCIPAGYAIGYIYGGLVGNHFGWRYAFWVEAILMFPFAILGFFMKPLQLKGAHSSPALISCSSITSFPITKLLVHPGFAPTDSEKALILETVVSEVPDVGVSNGKDEALSLKEEFRDKSSHEPSRSKCAILDQFSRFLKDMKELLLDKVFVVNVLGYIAYNFVIGAYSYWGPKAGYSIYNMTNADMMFGGITVVCGILGTLAGGLVLDFMTNTISNAFKLLSLTTFIGGACCFGAFLFKSEYGFLALFAFGELLVFATQGPVNYVCLHCVKPSLRPLSMAMSTVAIHIFGDVPSSPLVGLIQDKINNWRTTALILTTIFFPAAAIWFIGIFLPSVDRFNEDSEHEVSSVERTSTAPLLEEGTAETSASGQSQEC

SEQ ID NO: 202892 - protein, 130 aa, Glycine max
  Coding DNA Sequence Number=SeqID_86114
  Homolog annotation: Hit_ID=Q1T3F6; Match level="QueryCoverage=48%, HitCoverage=11%, E-value=1e-20, Identity=78%"; Hit description=Zinc finger, DHHC-type
MASSEIEVVSSSSSVSKPNNDQPPILDVFTASAHGDFNKLRTFVEQDGASVSLPDFSGYYALQWASLNNFHDIAHYLIQKDFVFDCYNIYYYILYCAYLRTSPGTAVKLCLGDLLVMGSNPETASLHMQG

SEQ ID NO: 202893 - protein, 243 aa, Glycine max
  Coding DNA Sequence Number=SeqID_86115
  Gene Ontology: Mol. function=transferase activity, transferring phosphorus-containing groups; Cellular component=integral to membrane; Biological process=two-component signal transduction system (phosphorelay)
  Homolog annotation: Hit_ID=Q7WRD5; Match level="QueryCoverage=99%, HitCoverage=31%, E-value=4e-60, Identity=50%"; Hit description =Probable two-component sensor protein
  Pfam annotation: Domain name=CHASE2; Domain location=9-243; Score =85.0; E_value=2.4e-22; Accession=PF05226.2; Description=CHASE2 domain
LALLAALLGWFNGLGRVDQILYDRAVALTGRDISPDIVIVAIDDSSIDALGRWPWRRAVHAALLDRLQGARAVGLDLIFAEPDTTYPGDDVILADSIRRNGHTVLPVVLDRLIYPTSISAPIPALAQAAAGSGFINANLDADGVLRSAVLTARFAGQRWQHFALTMLDVGGQADLAQRLLRRARADGSILIPYAGPAAHTRAVSYLSVLRGDVPAEQLRGKYVLVGAWATGLGDAYTTPVSHE

SEQ ID NO: 202894 - protein, 309 aa, Glycine max
  Coding DNA Sequence Number=SeqID_86116
MEENKLRFMHFSRKRDELAKRAYRTKRVHLVRMNTHPPVEIPMAKQDAWSRYTDNVLGRNILPERKVELYHTEFDDFKTELERRNLHKRLTNLVDGSIDVALVKEFYANLYSSEGSSLKQARVRGHLVKIDAGSLNTFLETLVVLAEGPSWEDTEEGLEDFSPAGRVVSNNLTFERLSPSINLTYIRKNCWNPDNLTVSIRGARKARARPTDFPSTFAAPTLASTSAAPLVLAQIDSQRFEAMLQSIHQGQIILLQSLQVVAPPGSMLSIEQFLERVAWPGAQPSLHREDEGEEQARPETVATLERSLE

SEQ ID NO: 202895 - protein, 56 aa, Glycine max
  Coding DNA Sequence Number=SeqID_86117
MKFECECATMKFKCHYAVYASSRITQVPTSSVFLPFDVIHYFLSWMPWFIGNKFDQ

SEQ ID NO: 202896 - protein, 367 aa, Glycine max
  Coding DNA Sequence Number=SeqID_86118
  Gene Ontology: Mol. function=transferase activity; Cellular component= cytoplasm; Biological process=cell redox homeostasis
  Homolog annotation: Hit_ID=Q8PJS6; Match level="QueryCoverage=52%, HitCoverage=99%, E-value=1e-97, Identity=86%"; Hit description =Stringent starvation protein A
MDPPVTGLKIETPGSVDAGQYDQAVRDITNFLEYAGEPAALKRQQLGVRNTGRTFTESAAGHRTGLLAFVMVGCTLGEESIAGTVPAAPMRQAVSCRGRAFDGGERTHAQYTDAVFLERRCTVPPCTPGPGGQGPDRPQSVPLGADAGRTRTGALRRVGGQRVPGRALPASAADAGRPAVACAHPPGHAAHRARLGAAGAGHPAGQQDPGRGRPQAPEGVADRLAAAVQGQQVLPQPGNEPGRLRDGADHLAPAVAGRTAAEGRQGDRRLRQPHLPPSRFRPQPDRPGKEAARSAGLIRACVTRLHADRRAGDPPRQGAGRVHFTHDRRLLPHDQPPPVPAAGAGGMDQRQPADPAHPGRRRRSRRA

SEQ ID NO: 202897 - protein, 307 aa, Glycine max
  Coding DNA Sequence Number=SeqID_86119
  Gene Ontology: Mol. function=zinc ion binding; Cellular component =integral to membrane
  Homolog annotation: Hit_ID=Q1T3F6; Match level="QueryCoverage=64%, HitCoverage=36%, E-value=2e-98, Identity=85%"; Hit description=Zinc finger, DHHC-type
  Pfam annotation: Domain name=Ank; Domain location=32-64; Score=31.0; E_value=4.1e-06; Accession=PF00023.20; Description=Ankyrin repeat
  Pfam annotation: Domain name=Ank; Domain location=65-99; Score=28.8; E_value=1.9e-05; Accession=PF00023.20; Description=Ankyrin repeat
  Pfam module annotation: Pfam domain module=Ank::Ank; Domain location =32-64::65-99
MAVHVAAQFGQTAFLNHIVVKYHADFDVPDNDGRSPLHWAAYKGFADTVRLLLFRDASQGRQDKDGCTPLHWAALRGNAEACAVLVHAGTKEELMMKDNAGNTPVQLAYDKGHRHVAPFLSNQQRAHSNYWKGKLCSGIVTDIGYAPILFCTIIFLSILFINSVVAAPNLKKITAVVGLWAWTALSSAVGSLIMFYKCSRWWLMSQQAKVCHKSMVDGIETYDRSMTAIVKTYMYKNISSETKERNRVTQNTGIKRLRKHRETKRSAKEMQMKGMYRNKKMEKEGKTKKQGLMNRAYWDNHISCSQR

SEQ ID NO: 202898 - protein, 97 aa, Glycine max
  Coding DNA Sequence Number=SeqID_86120
  Subcellular localization annotation: CTP_CleavageSite=50; ConfidenceScore=5.47e-01
MDPSSPRLAFGLPGPPNSFIVKKPARLGELTTSGLSFSLPRRPGCFKGFQGSEGEGTERREKEEEERRGSEAETLPNHDCDHSLLRFLFRVLRATMG

SEQ ID NO: 202899 - protein, 128 aa, Glycine max
  Coding DNA Sequence Number=SeqID_86121
  Subcellular localization annotation: CTP_CleavageSite=60; ConfidenceScore=5.01e-01
MAMNFDSVGIEVYFCRPSIFSIVLTLNSTISLSLTGGIYTTRKSANLITCPWFVFSPCVPSSSSSPFKSEMSSIFPPELLHHYINGPMRKYFNTKLRCAHESTHSCCEARLGNPIIRTVMQRSSIVSS

SEQ ID NO: 202900 - protein, 97 aa, Glycine max
  Coding DNA Sequence Number=SeqID_86122
  Gene Ontology: Mol. function=oxidoreductase activity
  Homolog annotation: Hit_ID=Q1T3F5; Match level="QueryCoverage=87%, HitCoverage=27%, E-value=3e-35, Identity=87%"; Hit description =Aldo/keto reductase
MFTIRSESSEYSACQAAATHCKEKGKNISKLALQYSLLNKEITSVLVGMKSVEQVEENVAAARELATSGIDEETLSEVEAILKPVKNQSWPSGIQQS

SEQ ID NO: 202901 - protein, 588 aa, Glycine max
  Coding DNA Sequence Number=SeqID_86123
  Gene Ontology: Mol. function=zinc ion binding
  Homolog annotation: Hit_ID=Q338Y6; Match level="QueryCoverage=59%, HitCoverage=83%, E-value=3e-59, Identity=35%"; Hit description =Expressed protein
  Pfam annotation: Domain name=DUF641; Domain location=113-245; Score =160.4; E_value=4.7e-45; Accession=PF04859.3; Description=Plant protein of unknown function (DUF641)
MDGSSAKPPQISEMFQKFALAFKTKTFEFFSEEENNASPLLDDIDGFSLLDSTEEIITDQKVVVIKPDPDPSLKSPPSPPPESPPPPPPPPPPQITHPPPPPEFREPETPPPPPLTEAQIRETTHALISSVFAAVSAFEASYFQLQSAHVPFVEEHVTSADKVLVSHLQRLSELKKFYCNPEPRGFPFGSRLGAEVEENQSKLRTLGTVSNRLQWELEQKHDEVVALRAKLDEIHRGNVNLSKKLCARALNPSSDVLLTVKVFDSLLHDASRATHRFTKILIGLMRKAGWDLGLAANAVHPNVDYAKKGHNQYALLSYVCLGIFHGFDSMNFGMEDGEELVVSNGHGSLDLEDRDGCLKQLLEHVSSNPMELLGIHPGCEFSRFCEHKYERLIHPSMESSIFVNLEEKEAVLNSWRSLSMFYEAFVGMASAVWTLHKLSYTFDPTVEIFQVERGVEFSMIYMEDVTKRLTWPNKGRAKVGFTVLPGFRIGRKKASPLPISLLPFLFLLLAAAAATASAALTPLPPPMTIDDKVSRSDSLSLFPMTQPTTTDNDFPQTLGGEFICFGYRLTLQSDIPGAVMLGMFGTLN

SEQ ID NO: 202902 - protein, 66 aa, Glycine max
  Coding DNA Sequence Number=SeqID_86124
MGDLGAVGFVIPVSLSVLGVLGKKWGEEMASPPPLLKTNVRRARLRILKNKIKDTRLPPRSASLSS

SEQ ID NO: 202903 - protein, 72 aa, Glycine max
  Coding DNA Sequence Number=SeqID_86125
MVPRKLPAKRARKDATGEGSSVAPQVDVEFDRHRDEEYAEFQEEIAKRQWTQLAAPMVKYDPEIVMEFSANA

SEQ ID NO: 202904 - protein, 118 aa, Glycine max
  Coding DNA Sequence Number=SeqID_86126
  Gene Ontology: Mol. function=transcription regulator activity; Cellular component=nucleus; Biological process=regulation of transcription
  Homolog annotation: Hit_ID=O81348; Match level="QueryCoverage=82%, HitCoverage=27%, E-value=4e-31, Identity=75%"; Hit description =Symbiotic ammonium transporter
  Pfam annotation: Domain name=HLH; Domain location=50-99; Score=44.1; E_value=4.7e-10; Accession=PF00010.16; Description=Helix-loop-helix DNA-binding domain
MEISSIRGLPDMTTPPDSISQGTLLGNHNNYVFKACQEAKKTGKRYKHSQPQDHIIAERKRREKLSQRFIALSALVPGLQKTDKASVLGDAIKYLKQLPEKVKALEEEQIMKEILELC

SEQ ID NO: 202905 - protein, 120 aa, Glycine max
  Coding DNA Sequence Number=SeqID_86127
  Gene Ontology: Mol. function=oxidoreductase activity; Cellular component=integral to membrane; Biological process=electron transport
  Homolog annotation: Hit_ID=Q1T3E8; Match level="QueryCoverage=80%, HitCoverage=18%, E-value=7e-25, Identity=63%"; Hit description=Helix- turn-helix, AraC type; NAD-binding site; Fumarate lyase
MGNFGAKKVTDSSSIHVKSNECAKTSSEGGICSSDEDAGSADIIIVGAGVAGAALAYTLGKDGRRVHVIERDLSEPDRIVGELLQPGGYLRLIELGLQVCILVNNSPDSAGQIHGLALNR

SEQ ID NO: 202906 - protein, 121 aa, Glycine max
  Coding DNA Sequence Number=SeqID_86128
MHEFLLHVKALTDALASVGEPIALHRHIGVILEGLADEYSSVILVIQSLVNPNTALSYCFEGYIVPNKPKFDNFSNNSTRGGFNCGGGGHCGSDGRDCGGHFSNFNCQVRLKFKHTTSLCY

SEQ ID NO: 202907 - protein, 93 aa, Glycine max
  Coding DNA Sequence Number=SeqID_86129
MGCNRFNGSPRLMQMNLYLYIFERLRQERGLRTIGQIELAYGRIEVKATRFLDLAQFLTKLHKISSTSSNVGNRSKEQLCACKVYVAGHLALG

SEQ ID NO: 202908 - protein, 579 aa, Glycine max
  Coding DNA Sequence Number=SeqID_86130
  Gene Ontology: Mol. function=protein serine/threonine kinase activity; Cellular component=membrane; Biological process=protein amino acid phosphorylation
  Homolog annotation: Hit_ID=Q17U57; Match level="QueryCoverage=93%, HitCoverage=82%, E-value=7e-84, Identity=37%"; Hit description =Receptor protein kinase, putative
  Pfam annotation: Domain name=B_lectin; Domain location=80-194; Score =55.4; E_value=1.8e-13; Accession=PF01453.15; Description=D-mannose binding lectin
  Pfam annotation: Domain name=Pkinase_Tyr; Domain location=482-577; Score=-148.9; E_value=0.0025; Accession=PF07714.7; Description =Protein tyrosine kinase
  Pfam module annotation: Pfam domain module=B_lectin::Pkinase_Tyr; Domain location=80-194::482-577
MVCYKLGESHFLLVLTCLWLWLWWSTRIHVIAAYHSLRPGDTLNSTTELCSENDKYCLGFSQFSSAHNSTYLRIYAKGKGDWNMWIGNRNQPLDMDSAVLSLSHSGVLKIESKDMEPIILYSSTQPSNNTVATLMNTSNFVLQRLQPGGTESTVLWQSFDYPTDKLLPGMKLGVNHKTGRNWSLVSSMGYANPALGAFRLEWEPRRRELLIKQRGQLCWTSGELGKNIGFMHNTHYMIVSNDDESYFTITTLNEELTRWELLKTGQLINRNGDDNVARADMCYGYNTDGGCQKWEDIPFCRNPGDAFELKEVYLNLNLKNFLANSSYSPSDCRDTCWKNCSCDGFTDYYDDGTGCIFVYLNLTEGADFASGGEKFYILVKNTHHKGKSTNSGKESTKKWIWISILIVAALFSICAFILYLALKKRKLRFEDKNRKEMEINKMEDLATSNRFYDARDPEDEFKKRQDLKVFSYTSVLLASNDFSTENKLGQGGFGPVYKGIQPNGQEVAIKRLSKTSSQGTAEFKNELMLIGELQHMNLVQLLGYCIHGEERILIYEYMHNKSLDFYLFGKEYFKVDLIR

SEQ ID NO: 202909 - protein, 171 aa, Glycine max
  Coding DNA Sequence Number=SeqID_86131
  Gene Ontology: Mol. function=nucleic acid binding; Cellular component= membrane of vacuole with cell cycle-correlated morphology; Biological process=mitochondrion organization and biogenesis
  Homolog annotation: Hit_ID=Q1RSX3; Match level="QueryCoverage=89%, HitCoverage=36%, E-value=5e-70, Identity=87%"; Hit description=CBS
MEIIPQSVCSRYGLAIGASVAPFVRVLVCICFPVAYPISKLLDFLLGHRHEALFRRAELKTLVNLHGNEAGKGGELTHDETTIIAGALELSEKTASDAMTPISETFTVDINSKLDRELMNEILEKGHSRVPVYYEQPTNIIGLVLCMHELLCLAPVVWNIVTGRFSDAFWN

SEQ ID NO: 202910 - protein, 134 aa, Glycine max
  Coding DNA Sequence Number=SeqID_86132
MTGRLLAGSLAFDCRILHYLNVRIFLPRSSNLAQVSEEDLIIMWAFLTDRQINWAHLVRYRMNKALRSNAPLPYPYLISLFLHHFEVPFVQIKKPNLESQVDIRFGEMDSRITKIEGDITYIKDCFDLPPPPSP

SEQ ID NO: 202911 - protein, 124 aa, Glycine max
  Coding DNA Sequence Number=SeqID_86133
  Pfam annotation: Domain name=LysM; Domain location=52-97; Score=7.1; E_value=0.1; Accession=PF01476.10; Description=LysM domain
MTPMDLADISMIQPTSGQAWPINGELDQNEELTIHLPCGCSEKSDSQIVVTYTVQRNDTPVSIAALLNATLDDMVSMNEVLAQNPSFIDVTWVLQETKVGDNHWHLSGCDITFNYYLDYSQCRS

SEQ ID NO: 202912 - protein, 115 aa, Glycine max
  Coding DNA Sequence Number=SeqID_86134
  Gene Ontology: Mol. function=acetyl-CoA carboxylase activity; Cellular component=acetyl-CoA carboxylase complex; Biological process=fatty acid biosynthetic process
  Homolog annotation: Hit_ID=P49158; Match level="QueryCoverage=95%, HitCoverage=28%, E-value=2e-52, Identity=88%"; Hit description =Acetyl-coenzyme A carboxylase carboxyl transferase subunit beta
MGSSDRIELSIDSGTWNPMDEDMVSLDPIEFHSEEEPYKDRIDSYQRKTGLTEAVQTAIGIMDFQFMGGSMGSAVGEKITRLVEYATNQLLPLILVCASGGARMQERKFELDPNG

SEQ ID NO: 202913 - protein, 54 aa, Glycine max
  Coding DNA Sequence Number=SeqID_86135
MEIDFDKIQSVPTRKEGQISSKTLTCLNLRRSEYRQLPQQLHSLKGLQHKVLAL

SEQ ID NO: 202914 - protein, 98 aa, Glycine max
  Coding DNA Sequence Number=SeqID_86136
  Pfam annotation: Domain name=FBD; Domain location=13-63; Score=44.7; E_value=3.1e-10; Accession=PF08387.1; Description=FBD
DYEAPFVFNRKRFWSDNVGVYESLSLSLEVVEINGFSGTENELLVLMYFIANGDMLKRISINMLEDDSGRTMEPQIRENAEFLLTVPRASTNLEISIC

SEQ ID NO: 202915 - protein, 146 aa, Glycine max
  Coding DNA Sequence Number=SeqID_86137
  Gene Ontology: Mol. function=transporter activity; Cellular component= integral to membrane; Biological process=transport
  Homolog annotation: Hit_ID=UPI00005F7CB4; Match level="QueryCoverage =95%, HitCoverage=35%, E-value=1e-18, Identity=38%"; Hit description =COG0477: Permeases of the major facilitator superfamily
MSMQLAGFSFTLYATAVATLRLFGDRLINHYGSRRVLTWGGLVASGGLALAIFSVWLWSALLGFVLVGIGLANIVPILFNAAGNQRNVAAHYAIPAVTLCGYSGLLLGPALIGFSAQLTSLTTTLSAGIVMLLLVTFAARFALAAK

SEQ ID NO: 202916 - protein, 185 aa, Glycine max
  Coding DNA Sequence Number=SeqID_86138
  Gene Ontology: Mol. function=chitin binding; Cellular component =extracellular region; Biological process=chitin metabolic process
  Homolog annotation: Hit_ID=UPI000044A8F0; Match level="QueryCoverage =96%, HitCoverage=99%, E-value=1e-29, Identity=31%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
GGPLGTSTLAFRALHVLAFRGLQASVFRGLHVLALRGLHALAFRGLHVLDFKGLHILTFKELHVLAFRGLRVLAFRGLHILAIRGLHAFAFRGQHVLTFIGLHVLTFKGLHTLDFIGLHNLTFRGLRVLAFRGLHALAFNGLHALAFRGLHVFPFRGLHVLAFRGLHALAFNRLQALAFRGLHVL

SEQ ID NO: 202917 - protein, 560 aa, Glycine max
  Coding DNA Sequence Number=SeqID_86139
  Gene Ontology: Mol. function=cation transporter activity; Cellular component=integral to membrane; Biological process=cation transport
  Homolog annotation: Hit_ID=Q01V83; Match level="QueryCoverage=57%, HitCoverage=29%, E-value=2e-70, Identity=43%"; Hit description =Acriflavin resistance protein
  Pfam annotation: Domain name=HlyD; Domain location=1-241; Score= -32.7; E_value=0.084; Accession=PF00529.10; Description=HlyD family secretion protein
QYVHQGDVLFELDARSADEAVSKAEVAVEFAQKGFERKEALYANNDTSLKLYKDAEQQLETAKKDLSNARTQREILRIKAPLSGTISTIHYKIGESISVNTVMADLMDLKRLDVALKVPTTEVAAIHTGQQVEVFADDSSSAKPYTGKVDPTTDTVLVRASFASDDRIRPGQFVSARIQTVRLPDQLAVPQASVLHGDSGDYVMLVSGQIAKQYPVKIGIKDHGWVGLAGATLKPGMQVVTEGLYAALQMPSSIFPQTNFPRVVILLDNGVMPSNEMMATITRPVEESMKDIPGVENVRSKTGRGTAEVNVFFNWHTDMTQAELYVRGKMAMVQKTLPPTANYSVSRLTFSAFPVMGLSLTSDKHDVTQLWETARYTIQPKILRLKNVAKVGIVGGRVPEYHIVVDPLKLQALHFGISQVADLVARSNVIAPAGMLEEDYKLYLTVTDGRIHGTEELENLVIAAPNPASAPGSLGGNPAATGIADHPVRIKDFARVERNKEPAFYEVTADGKNAVLINVYSQPDGSTLDIAQAVKAELISINKSLPPGMKVQFFYDQSEL

SEQ ID NO: 202918 - protein, 191 aa, Glycine max
  Coding DNA Sequence Number=SeqID_86140
  Gene Ontology: Mol. function=nucleoside-triphosphatase activity; Cellular component=membrane; Biological process=DNA metabolic process
  Homolog annotation: Hit_ID=Q359M1; Match level="QueryCoverage=90%, HitCoverage=57%, E-value=7e-60, Identity=64%"; Hit description=ATPas
LFAHHRRQPFRGLVQDQQARIRQQRAADGQHLLLAARQVAAQVARAFGQPREQRVDAFQRPGLRQPLAIVRGGHQVLAHRQVGEHVPALGHQADAALRHLIGRQGGDVAAVERDGAAAGAVQAHDGLDRGRLAHAVAAQQRHELARGDIQVDAEQRLAGAVMRGHAAQRQQRAHAGAPCARRPAWPRSLPR

SEQ ID NO: 202919 - protein, 67 aa, Glycine max
  Coding DNA Sequence Number=SeqID_86141
  Gene Ontology: Biological process=response to biotic stimulus
  Homolog annotation: Hit_ID=O24248; Match level="QueryCoverage=89%, HitCoverage=38%, E-value=1e-13, Identity=60%"; Hit description=Major allergen Pru av 1
MVDMVDKENYMYLYTTNEGNVLLDTLEKVCYEYKLVASPVGGHIIKSIVKYYTKGDAQLLEEFLNDN

SEQ ID NO: 202920 - protein, 1105 aa, Glycine max
  Coding DNA Sequence Number=SeqID_86142
  Gene Ontology: Mol. function=RNA-directed DNA polymerase activity; Cellular component=chromatin; Biological process=chromatin assembly or disassembly
  Homolog annotation: Hit_ID=Q1T2D5; Match level="QueryCoverage=96%, HitCoverage=78%, E-value=0.0, Identity=50%"; Hit description=Chromo
  Pfam annotation: Domain name=RnaseH; Domain location=741-862; Score= -17.5; E_value=0.0024; Accession=PF00075.14; Description=RNase H
  Pfam annotation: Domain name=rve; Domain location=959-1095; Score =57.9; E_value=3.4e-14; Accession=PF00665.16; Description=Integrase core domain
  Pfam module annotation: Pfam domain module=RVT_1::Retrotrans _gag::RnaseH::rve; Domain location=483-652::73-163::741-862::959-1095
MDLLIANSVQHNDGSNSEGGPSHQTSPLNVVSLVKDISLGFPYFDGSTPVLEWIFKAEKFFSYHNTPDALHVDIAIMHFDKDVVPWFQMLQKLAAVSTWSELTKALESQFGPSLFDNPMAELFKLQQTGYVSEYYLQFMSLANRSIGLSEDAFFNCFISGLDPDIRRDVIVMTPSTLLRAVALAKLYEEKYNPTVKTIKINFVQRYSQLSSNTKYPTQAKSVTKTQLPPLLPTPPGPPLKTSNEERVDNPGDSLHHDNSVTDSIIHKDHHLSFNALKGGLGVGTIRFLAYVDKLPVIVLIDGGSSDSFLHPCIAKFLKLPVEPATKFKVMVGHGNYMTAEGLVKKLRVQAQGNVFHLPLKFLLDGKFTTLQWEHNLGPTHAQLHHIQRMISTKAIVEIYSMQVIEENSVTFPLPDLPADIEPELALLLHSYGEVLSTPSSLPPQRSHDHSIPLIEGYPHSQKEEIEKLVAGMIDEGIIQPSKSPFSLPIILVKKKDGSWRFCTDYRALNAITIKDTFPIPTVDELIDELYGASYFSKLDLRSGYHQILLKPEDRCKTAFRTHHGHYEWLVMPFGFTNAPATFQSLMNDIFAGLLRRFVLVFFDDILIYSSNWKDHLHHLEVVVHILKKQKLYARFSKCCFGVTKIEYLGHTLSGDRVSMDLSKLETVKNWLEPTNLKQLRGFLGLIGYYRRFIRSYANIAAPLTDLLKKDSFKWNTFAASAFLKLKEVMTSAPVLAIPNFQFPFTLETDASGIGIGAVLRQNNHPIAYFSKKLSPRMQKQSAYTREFFAITKAMAKFRHYLLGHKFVIKTDQRSLKEFLDQKLQTPEQQQWLPKFLGYDFIIQYKPGKDNILADALSRSFFMAISGHVPAWKEKVADLIQNDYKLAKLYKSCLIGTPPSSDYTIQHGLLFFRNKIFLPANLELLNLIMQEFHASKLGGHAGQAKVDHLLPTGLLQPLPIPQQIWEDLAIDFIVALPLSQGYSIIFVVIDRLSKFGYFIPLKSGFTSKVVADVFISNIVKVHGMPKTIVSDKDRVFIATFWQNLFKAQGTTLAMTSSYHPQSDGQTENLNKTLEMYLSMTPFQAVFGRHPPIVLRYEINPSDPVDL

SEQ ID NO: 202921 - protein, 100 aa, Glycine max
  Coding DNA Sequence Number=SeqID_86143
MGLKFHDDPTVNESEIIVLLRQVWWPQKSLGNLDLYTKEVFMEWIKRNTQDSLNFLGHPHRQPIQMVGLGTTLGRKLELGHKPFSGCINGVVRSPLRIHS

SEQ ID NO: 202922 - protein, 230 aa, Glycine max
  Coding DNA Sequence Number=SeqID_86144
  Pfam annotation: Domain name=zf-MYND; Domain location=106-145; Score =31.7; E_value=2.7e-06; Accession=PF01753.9; Description=MYND finger
MGPTIMEEDLYFQLSQKKTWNFQEHKRAALMLAYWVQYLNELNLKCVLMIILMMILPILGLLFSLENKLSLNSKWNEDVQISDEINSLFYEQEENITSTAHCACACCFCGRLSIIVTRCSLCKAAIYCSNACRVKHWTISHKYECVEIEGSENQHESPSNGTHFLLTEPENDKYSFCEVEPRKYEGHVYYIEGGENIVEISDETALKDGCAVCGNPSSKVCSRCKAIKYW

SEQ ID NO: 202923 - protein, 74 aa, Glycine max
  Coding DNA Sequence Number=SeqID_86145
MEKKKKEEKQRGREEKLLKFLKKEREDLAFCTKGPQRRKNWTFLDAEILPQFACHLSGSSSSRFSAPVGTCFRK

SEQ ID NO: 202924 - protein, 75 aa, Glycine max
  Coding DNA Sequence Number=SeqID_86146
METKRQRWKSAYIDNGDVLKKKKKKKKRTMAPRREKTTMEKGELRINLLGCTRSQKKEEEGVAGRRKANCWVQMF

SEQ ID NO: 202925 - protein, 274 aa, Glycine max
  Coding DNA Sequence Number=SeqID_86147
  Gene Ontology: Mol. function=RNA binding
  Homolog annotation: Hit_ID=Q6H512; Match level="QueryCoverage=45%, HitCoverage=36%, E-value=2e-45, Identity=67%"; Hit description=SAM -dependent methyltransferase-like
  Pfam annotation: Domain name=Cons_hypoth95; Domain location=68-232; Score=-67.7; E_value=0.039; Accession=PF03602.5; Description =Conserved hypothetical protein 95
  Pfam annotation: Domain name=Met_10; Domain location=48-218; Score= -106.6; E_value=0.0051; Accession=PF02475.7; Description=Met-10+ like- protein
  Pfam module annotation: Pfam domain module=Cons_hypoth95::Met_10; Domain location=68-232::48-218
MFPELKILKICPAYSLLQTFFVCQCGWVGAYYLLQLGWNYTRRNVKFTDLLILGHVVPICQIVENEIVYTISLKGQKTGFYADQRENRQFISRISDGQKVLDICCYSGGFALNAVRGGALNVTGIDTSPLALELAKENVVLNNIDPGRISFLREDATEFMKGALLRNESWDIVIIDPPKLAPTKKPGPRGPRRGPCTLVITRRTESEEDKVMDMLTAISARLFATNLDSLLSNSVIISVISLLANDWHRYPICIHYKYHSEECKKDRIFYLKLP

SEQ ID NO: 202926 - protein, 156 aa, Glycine max
  Coding DNA Sequence Number=SeqID_86148
MDFIKERLLDMRQIKELLLEFKKGKTPSDGRENLVNRYKKTEEENNDSNRSSEECEEEEPNSCGMEEEEEPIKKTIDGIKEVKQMLQLLIKKKGIRLEFEKGDKQPMQTVSTLQLGMWATTSQQDSVSVKTIEDKDSKTIEAKVVEEIRVEEDENL

SEQ ID NO: 202927 - protein, 72 aa, Glycine max
  Coding DNA Sequence Number=SeqID_86149
  Gene Ontology: Mol. function=RNA-directed DNA polymerase activity; Biological process=RNA-dependent DNA replication
  Homolog annotation: Hit_ID=Q1T2D5; Match level="QueryCoverage=71%, HitCoverage=3%, E-value=1e-11, Identity=59%"; Hit description=Chromo
MTLCGQGKSFENHEALPNSSRIVSCGPGKSIFECDCIQSPIVDAAAPAVIFRFDEKHQREKWAVTVPNEAGV

SEQ ID NO: 202928 - protein, 115 aa, Glycine max
  Coding DNA Sequence Number=SeqID_86150
  Subcellular localization annotation: CTP_CleavageSite=55; ConfidenceScore=5.89e-01
MAFLLSNLKPSLLPQTKSKPIPQTPSPSSAKPTSQSPSLFFFTSSAPLSALQSSTAQVAQGHTPTTGARDELQQQKDEFYLNLGLAVRTLREDMPFIFVKDLNYDIYRSISHLGI

SEQ ID NO: 202929 - protein, 105 aa, Glycine max
  Coding DNA Sequence Number=SeqID_86151
  Subcellular localization annotation: CTP_CleavageSite=69; ConfidenceScore=5.13e-01
MEANQLMPQRTGLQGSLLLQGFFIFHFVDSTKATTNRRDSSQLINSRSHLWKYRVSDGFVQMVQPNVLHASSRKSTKAMWDFLTDWCTMLLMADDGSWRKAKNPP

SEQ ID NO: 202930 - protein, 487 aa, Glycine max
  Coding DNA Sequence Number=SeqID_86152
  Gene Ontology: Mol. function=cyclin-dependent protein kinase regulator activity; Cellular component=nucleus; Biological process =regulation of progression through cell cycle
  Homolog annotation: Hit_ID=Q9ZRG1; Match level="QueryCoverage=52%, HitCoverage=99%, E-value=1e-127, Identity=86%"; Hit description =Cyclin
  Pfam annotation: Domain name=Cyclin_C; Domain location=316-437; Score= 172.3; E_value=1.2e-48; Accession=PF02984.9; Description=Cyclin, C -terminal domain
  Pfam annotation: Domain name=Cyclin_N; Domain location=188-314; Score= 202.3; E_value=1.1e-57; Accession=PF00134.13; Description=Cyclin, N -terminal domain
  Pfam module annotation: Pfam domain module=Cyclin_C::Cyclin_N; Domain location=316-437::188-314
MAMAAAIRNPQRHRYLVAFFPKICDARPPWRRHNRYLITLLPIVKTTIKAVTAQRTLKSKSRLSQNKLESTTATSSQNKSLSAQKNLESTTVTSSQDKESVSLSLPEKSLTVSDDTNQSCLPSGESNLTTNLLELIPRKKSFRRKSYTTSLIEGSKILKESGDVREQDNLPNIDNECNQLEVSEYIDDIYLYYWVTEAHNPLLANYMSIQTDISPHLRGILINWLIEVHFKFDLMPETLYLTVTLLDQYLSLVTIKKTDMQLVGLTALLLASKYEDFWHPRVKDLISISAESYTRDQMLGMEKLILRKLKFRLNAPTPYVFMVRFLKAAQSDKKLEHMAFFLVDLCLVEYEALAFKPSLLCASALYVARCTLQITPPWTPLLHKHARYEVSQIRDCADMILKFHKAAGVGKLKVIYEKYSRQELSRVAAVKPLDKLPWTPTTSQTSTDCADMILKFHKAAGVTYEKYSRLELSKGVAAVKPLDRLTL

SEQ ID NO: 202931 - protein, 183 aa, Glycine max
  Coding DNA Sequence Number=SeqID_86153
  Subcellular localization annotation: CTP_CleavageSite=14; ConfidenceScore=5.33e-01
MVSLTGKSRVGSTRASVGGGQSRPSVGGRNFKVFSEIDRTKVGDGNMTYARGAGASATARSTVVANKRVILNSTSSPKGGLKKSMDKSSGKYGTSGSTNVRKALADVSNAQEKFTTAVVANKGVILNSTSNPKGGLKKSMDRSSGKYGTSGPGNTNVRKTLADVSNVQENFTTAVGIASSKMK

SEQ ID NO: 202932 - protein, 164 aa, Glycine max
  Coding DNA Sequence Number=SeqID_86154
  Homolog annotation: Hit_ID=O82347; Match level="QueryCoverage=73%, HitCoverage=51%, E-value=4e-39, Identity=56%"; Hit description =Expressed protein
MRGVDDITFKDPLNTFTGIEKYKLIFWALRFHGKILFREIALDVYRIWQPSENVILIRWNLRGVPRVPWEAKGEFQGTSRYKLDRNGKIYEHKVDNLAFNFPQTLKPVSVLDLVTACPASPNLTFSWGPLDSNSSSWLEFYHAVKDTVDQEERLLPQDCMATCS

SEQ ID NO: 202933 - protein, 133 aa, Glycine max
  Coding DNA Sequence Number=SeqID_86155
  Gene Ontology: Mol. function=RNA-directed DNA polymerase activity; Biological process=RNA-dependent DNA replication
MGLSAEWTNSGCLLARNQCSFKKLIWVLSSIYASPNPAAIKLLWNQLRDISHLCTGPWLMLGAFNEILGPQEVSGGTFSMSRALTFANMIDKCNMLEIEMKGGRFTWRKNIQNGIHVRKKLDRCLSNPDWRMH

SEQ ID NO: 202934 - protein, 97 aa, Glycine max
  Coding DNA Sequence Number=SeqID_86156
MTTGGRSKPSLCAVEPSHQEEHFNRSRILKNPSQGFSGECSPNPPFRSFSEGYLTPNIVVNFTSEIYAKFPSIWYIETCVWTYEREQERPLSNVKRK

SEQ ID NO: 202935 - protein, 292 aa, Glycine max
  Coding DNA Sequence Number=SeqID_86157
MVTGKHNGGVTNKAALEATRITVSFFVNELRGNGNGNGKENNDNVNIPLSVVDTNGVVYELQVLVKTGSDSRSCIAKAGAILLLDRFLNAEENLSLQANIVMTTTMKVFSLSEGARRDALAAMLNLVADKETVARLVERGVVGISAMSEEGLTILEAVVKRGMGESEGERGGDASDSVEDSTAARLNGGEKERFTTTTTMVSSSTILKSILYSRYHVVIMFRNTRFGIRLLIKPLNEEEVSTMQEMLLRANVRDYGRFDPPPGHVQPPSKGIPAAAPDPNHPPPPPGNGGCK

SEQ ID NO: 202936 - protein, 198 aa, Glycine max
  Coding DNA Sequence Number=SeqID_86158
  Homolog annotation: Hit_ID=Q9LRW1; Match level="QueryCoverage=67%, HitCoverage=50%, E-value=4e-13, Identity=31%"; Hit description =Putative LOB domain-containing protein 22
  Pfam annotation: Domain name=DUF260; Domain location=10-109; Score =94.6; E_value=2.9e-25; Accession=PF03195.5; Description=Protein of unknown function DUF260
MSQGNRNYFSCPICRNQRRRHDDNCEFGQYFLGRSTDFESACRLFGFANLVRLMRSVEPSERQATADSILMEANIWDRDPINGAYGHVFNLVSQIQSFESELETINNWLAHIRDQQRQPSSFSPNIPNQSIQDEGSNTPIPSLIGADISTRSSEKGESSIVAPKEDANIVVRERDSKVDDNEEGTIPDKEQVDYFRDD

SEQ ID NO: 202937 - protein, 134 aa, Glycine max
  Coding DNA Sequence Number=SeqID_86159
MTKTSMRAENIDVYGFFEPQSIQRSGQSQFESESYIKNWMQNSKRDVYLGAYLNGAHWQMVVILPKENVVIWFCSLHNKPNNYLKGIINSALKGLEILNKYFTDSRPLEPERLKALRNQWAKYYLKVKNETYDV

SEQ ID NO: 202938 - protein, 42 aa, Glycine max
  Coding DNA Sequence Number=SeqID_86160
MSVKNLVGRLGVHDKTDHTLVSQVTFARLKGGLKSGVFNPKA

SEQ ID NO: 202939 - protein, 91 aa, Glycine max
  Coding DNA Sequence Number=SeqID_86161
  Gene Ontology: Mol. function=phospholipase A2 activity; Biological process=lipid metabolic process
  Homolog annotation: Hit_ID=Q9AQT8; Match level="QueryCoverage=98%, HitCoverage=33%, E-value=4e-23, Identity=46%"; Hit description =Patatin-like protein
MAEVTNRISHEGQCGSQQKEMKYSADEAAQWGIFSWVTTTNGGTPLLDAFNHASSDMDDTLTGDMPSIDLATEKNLNDLVKVGESLLKKPV

SEQ ID NO: 202940 - protein, 76 aa, Glycine max
  Coding DNA Sequence Number=SeqID_86162
MSSSPEISVCVWKSYLAKREIGRGNLNTENPNMFGLGLRLGMGEVRLRRKMIGRNMVGTPRLYALFQFFFLFLYFK

SEQ ID NO: 202941 - protein, 283 aa, Glycine max
  Coding DNA Sequence Number=SeqID_86163
KSLDKKELRRSDFLIAIEEYVGAKGNTLASRESRVALPPKDIRAPVAGLTWRVECVSKCHMGFVDPGQVTSLSSPQAWTCVVRAASVKWFMMDVSGDLIEQPIMDWEVISIGDSSSKDTHRGAFASESSAGSHQTASPSNCDPPPFSFWGVRKAGGGGDVRSSPCIRPSMSVGSLLSAPVVAGFERTRDDVLKYRSTLTISVIVLQRQDHFFKVLATDVMVDGRFKSYDEDLLTIVGRVDKAISEQLSTLLDAQAIFSLLSASDPLTALDEIMGDFAWRPLVK

SEQ ID NO: 202942 - protein, 103 aa, Glycine max
  Coding DNA Sequence Number=SeqID_86164
MKLLQTVGERWRQFKSDLTRKWTLAADQDGVEDTVCDKYGISKEKWTQFCQTRRDPSWEAQAIQKQNTAPHVLSRGGYDYLEQKLLAEKTKKKMQEAAQSGKR

SEQ ID NO: 202943 - protein, 336 aa, Glycine max
  Coding DNA Sequence Number=SeqID_86165
  Gene Ontology: Mol. function=nucleic acid binding; Cellular component= mitochondrial outer membrane translocase complex; Biological process =protein import into mitochondrial outer membrane
  Homolog annotation: Hit_ID=Q1S2B6; Match level="QueryCoverage=91%, HitCoverage=63%, E-value=5e-63, Identity=41%"; Hit description=RNA -binding region RNP-1
MVSHYSSSDFAQLHGKTIYVQYSKRQEFVVNKFTEGNILIVSMEGIQAGDISIDAIHLVFSAFGYVHKISTFEKSAGFQVHPDLNIKFQSNRSRDYTNPTLPVNQASIVRTLQPIPRPTENHVLWASFENMQYDVTVDVLHAIRVPSSLGILETKPNVNTLNVATATTTKKALEGHCIYDGGYCKLRLSYSRHTDINVKGFSKKSRYYTRPNHSVSVEQVPAIALENPHATSMYGSSSARALQDQVHAGQIPSWNPIYSYMPAPGTFPNQTYVVPPYPAYALGQSNNMVHNESYVEITPPGVPGYSPHMHACWFCGFFSSWCTTLLLWLLGYMSVE

SEQ ID NO: 202944 - protein, 148 aa, Glycine max
  Coding DNA Sequence Number=SeqID_86166
MAAEWRRKRERRRHFKEKMSLEEAHHHRRPWIRVWREKEMNEGRGREEHEILCSKRALKYKGRNSNYCDLMLNSTQFQAKEEKVKAADDSLNETDPLSEMNPLSETSNSLRGLETLEEDKSKICTPSVQPARLARTFVSSHAQCALTR

SEQ ID NO: 202945 - protein, 144 aa, Glycine max
  Coding DNA Sequence Number=SeqID_86167
MDRARLVYGLVVKMDMDMGLIISGQISQMAQPNSSRLGFPTLITTLCIARGVVPSSLTFESLSPTINLAYIRKNYWNPDDPMITFPGSCKARAQGPSDASTSTPAPTPAPAPAPVPPPAPIAPSGPSTSSTNMIVSMLQSLHHG

SEQ ID NO: 202946 - protein, 81 aa, Glycine max
  Coding DNA Sequence Number=SeqID_86168
MQYNEFRQELKRCRWHKALTRQSDNHIDVGLVKKFYANLFCHTHLDPHELTSKLCIPGRGFMLNAEGAPWKLLRKDLTTLA

SEQ ID NO: 202947 - protein, 148 aa, Glycine max
  Coding DNA Sequence Number=SeqID_86169
MKVSKKLKGKSTSLGSICKLFTNKGLFSNILPEGSVFICIAPKAGAQYNGELTCGIELLCQQICTMGCYSCSGATTFGQAFGSVCSVDQLERGWIMRATSSFVSDISSISVEAKLHDDDKGDDKKLKDQSKNNSSESKINQEQFKSSR

SEQ ID NO: 202948 - protein, 434 aa, Glycine max
  Coding DNA Sequence Number=SeqID_86170
  Gene Ontology: Mol. function=formate dehydrogenase activity; Cellular component=formate dehydrogenase complex; Biological process=formate metabolic process
  Homolog annotation: Hit_ID=Q8P7E7; Match level="QueryCoverage=99%, HitCoverage=43%, E-value=0.0, Identity=69%"; Hit description=Formate dehydrogenase related protein
  Pfam annotation: Domain name=Molybdopterin; Domain location=3-189; Score=-68.2; E_value=3.5e-06; Accession=PF00384.12; Description =Molybdopterin oxidoreductase
  Pfam annotation: Domain name=Molydop_binding; Domain location=273 -379; Score=108.6; E_value=1.8e-29; Accession=PF01568.11; Description= Molydopterin dinucleotide binding domain
  Pfam module annotation: Pfam domain module=Molybdopterin::Molydop _binding; Domain location=3-189::273-379
HSHGADTSTALSNLLLVTSNYGQPGTGGYLMRGHNNVQGASDFGCLRNVYPGYEKVTDAQVREKWARAWGVAPEALSSEAGLDNFMMVEDAHKQRVRAMYIIGEETAFSDADSTKVHEAFSRLDFMVVQDIFMSRTAQFADVLLPGCPSLEKEGTFVNTERRIQHFSPAFAPLGDSRPDWQILTEVAARLGHHWHYPNPGAIMAEAAGIATLFAGVSYENLVGWQSQLWPVNADGSSTPLLYTEAFAFPDGKARLYPLTWQPPMEAPDAQYDLLLNNGRMLEHFQSTNQTGQGGRIKSLSPNWFVEISPQLAQERQLQQGDWVELRSRRGSVEVPVVVTERMAGNVLFIPIHHGKPGVNGLTGEHHDPDVNTPAYKEIAVMMRKLAHAPQPHPIPLHNFRHGQRTPLDHLPVEQKWQQPEYRLPPEHVSHPEKS

SEQ ID NO: 202949 - protein, 112 aa, Glycine max
  Coding DNA Sequence Number=SeqID_86171
MSRQDDFVRYSFTGKTPKRFDIPSGCSIDRLKDVIKQVVPQGIPPYGHSEYSEKDIKFEIIELKTDDDMLKILVQSNYWKRFGPIKILVAFSKLITKMEDDMSWSQHDSMQN

SEQ ID NO: 202950 - protein, 129 aa, Glycine max
  Coding DNA Sequence Number=SeqID_86172
MDTCSNTNVVHDDNFISNLGRTFSESLHIQDAQKSLLASEGSDIYNVNEEKICKAMKDQATKVNMACLKKSATFPIPNTMLPSSSSDKEADTSVTEPLYEHSAHQTYSRSVSLPGNLVLEAPTYVSHMQ

SEQ ID NO: 202951 - protein, 37 aa, Glycine max
  Coding DNA Sequence Number=SeqID_86173
MSRSHSDIKCFDVNLTRSGSFDTGYGDLDDTTSSEGR

SEQ ID NO: 202952 - protein, 169 aa, Glycine max
  Coding DNA Sequence Number=SeqID_86174
  Gene Ontology: Mol. function=nucleic acid binding
  Homolog annotation: Hit_ID=Q1SUA1; Match level="QueryCoverage=58%, HitCoverage=70%, E-value=7e-34, Identity=73%"; Hit description=RNA -binding region RNP-1
  Pfam annotation: Domain name=RRM_1; Domain location=1-67; Score=66.3; E_value=9.8e-17; Accession=PF00076.12; Description=RNA recognition motif. (a.k.a. RRM, R
LSRLTKDENLKEAFSSFGQLVEAKVITDRASGRSKGFAFVTYTTIEEAERAREGMNAKFLDGWVIFVDPAKPREPRPPQQSQSQPSEIGFTVNKTVGWCINSTLMAKQRRGISTEEVWPMIPSDTWFGSTRPSQDHDDGGDGMAIQCSLCGVSKKKKHSNKEKDDDENI

SEQ ID NO: 202953 - protein, 541 aa, Glycine max
  Coding DNA Sequence Number=SeqID_86175
  Gene Ontology: Mol. function=translation initiation factor activity; Cellular component=protein complex; Biological process=translation
  Homolog annotation: Hit_ID=Q6ZNE1; Match level="QueryCoverage=98%, HitCoverage=53%, E-value=0.0, Identity=88%"; Hit description=CDNA FLJ16186 fis, clone BRTHA2007060, moderately similar to EUKARYOTIC TRANSLATION ...
  Homolog annotation: Hit description=INITIATION FACTOR 3 SUBUNIT 10
  Pfam annotation: Domain name=PCI; Domain location=395-533; Score =22.8; E_value=0.0012; Accession=PF01399.17; Description=PCI domain
MTSFLKPENALKRAEELINVGQKQDALQTLHDLITSKRYRAWQKTLERIMFKYVELCVDMRKGRFAKDGLIQYRIICQQVNVSSLEEVIKHFMQLSTEKAEQARSQAQALEEALDVDDLEADKRPEDLMLSYVSGEKGKDRSDRETVTPWFKFLWETYRTVLEILRNNSKLEALYAVIFLLMFLYNFLMLYMIHMYLLNMTAHRAFQFCKQYKRTTEFRRLCEIIRNHLANLNKYRDQRDRPDLSAPESLQLYLDTRFEQLKIATELGLWQEAFRSVEDIHGLMCLVKKTPKPSLMVVYYVKLTEIFWISSSHLYHAYAWFKLFLLQKSFNKNLSQKDLQLIASSVVLAALSVPPHDHTHGASHLELEHEKERNLRMANLIGFNLETKPESREMLSRSSLLAELASKGVMSCVTQEVKDIYHLLEHEFYPSDLALKALPLITKISKLGGKLSTASSVPEVQLAQYVPALERLATMRLLQQVSNVYQSMKIETLSGMIPFFDFSQVEKVSVDAVKQKFVSMRVDHMKNAVIFCKKYRYTNVI

SEQ ID NO: 202954 - protein, 100 aa, Glycine max
  Coding DNA Sequence Number=SeqID_86176
MEESLEMSFQGLEIVNNAYVESPLIQLSLSDASMVVARVILKDGLLEIAENHGRSGLGYKPTSADKRRIPLERKEKCFARLQGLEPQVERVPICHINESF

SEQ ID NO: 202955 - protein, 225 aa, Glycine max
  Coding DNA Sequence Number=SeqID_86177
  Gene Ontology: Mol. function=branched-chain-amino-acid transaminase activity; Cellular component=chloroplast; Biological process =branched chain family amino acid metabolic process
  Homolog annotation: Hit_ID=Q1RSX5; Match level="QueryCoverage=98%, HitCoverage=62%, E-value=6e-87, Identity=71%"; Hit description =Branched-chain amino acid aminotransferase II
  Pfam annotation: Domain name=Aminotran_4; Domain location=2-207; Score=57.1; E_value=5.7e-14; Accession=PF01063.9; Description =Aminotransferase class IV
MKQVPPPGKGSLYIRPLLMGTGASLNLSPAPEYTLLIYCSPVTNYHKGSLNLKVESKFYRAISGTGGTGGIKSVTNYAPVYAASIEAKASGFSDVLFLDSATGKNIEEVSACNVFVVKGNAICTPATNGAILPGITRKSIIEIALDMGYQVTERAISVEEMLDADEVFCTGTAVVVNSVSSVTYKETRTEYKTGPETLSQKLRKTLVGIQTGCIEDTKGWTVRID

SEQ ID NO: 202956 - protein, 206 aa, Glycine max
  Coding DNA Sequence Number=SeqID_86178
  Gene Ontology: Mol. function=branched-chain-amino-acid transaminase activity; Cellular component=chloroplast; Biological process =branched chain family amino acid metabolic process
  Homolog annotation: Hit_ID=Q1RSX5; Match level="QueryCoverage=74%, HitCoverage=42%, E-value=3e-51, Identity=67%"; Hit description =Branched-chain amino acid aminotransferase II
  Pfam annotation: Domain name=Aminotran_4; Domain location=54-205; Score=-82.0; E_value=4.9e-05; Accession=PF01063.9; Description =Aminotransferase class IV
MSLPSVLGNSEDNSKSSVAVENCAGINWDELGFNPVPTDFMYVMKCAKGEKFSEGSLIPYGNIEISPFAVILNYGQGIFEGLKAYRTEDGCILLFRPEENAQRMKIGADRLCMPSPSIDQFVAAVKQTVLANKRWVLISSCLSLKFNFYVPPILLSLLQEISFELVEHRSDVGVRGYVELHPSVSSCRYPSRSGGARQSGGHALRR

SEQ ID NO: 202957 - protein, 95 aa, Glycine max
  Coding DNA Sequence Number=SeqID_86179
MVELRGIPSNIEDNPNVRTNSLEIHGSSLISVLEDEDTWELKKRVEDVLTSKRFILKVLCKASMVDCEGNEEDRCPLHPKTLHDMEECLLFKELL

SEQ ID NO: 202958 - protein, 185 aa, Glycine max
  Coding DNA Sequence Number=SeqID_86180
  Gene Ontology: Mol. function=branched-chain-amino-acid transaminase activity; Cellular component=chloroplast; Biological process =branched chain family amino acid metabolic process
  Homolog annotation: Hit_ID=Q1RSX5; Match level="QueryCoverage=95%, HitCoverage=49%, E-value=1e-68, Identity=71%"; Hit description =Branched-chain amino acid aminotransferase II
  Pfam annotation: Domain name=Aminotran_4; Domain location=1-167; Score=-55.7; E_value=1.3e-06; Accession=PF01063.9; Description =Aminotransferase class IV
MGTGALLGALNLKVEDKLYKAISGSGGTGGIKSVTNYAPVYTAITDAKANGFSDVLFLDSATGKYIEEASACNVFVVKGNASFTPAIDGTILPGIMGKSIIEIAIDLGYRVLERAVSVEEMLGADEMFCTGTAMVVNSIASVTYKKTRMDYKTGPEALSAKLRTTLVGIQTGCVEDKKSWTVLVD

SEQ ID NO: 202959 - protein, 111 aa, Glycine max
  Coding DNA Sequence Number=SeqID_86181
  Gene Ontology: Mol. function=branched-chain-amino-acid transaminase activity; Cellular component=chloroplast; Biological process =branched chain family amino acid metabolic process
  Homolog annotation: Hit_ID=Q1RSX5; Match level="QueryCoverage=99%, HitCoverage=30%, E-value=3e-38, Identity=69%"; Hit description =Branched-chain amino acid aminotransferase II
MSPPSILGNCKTVLKCNTAGENYADINWDELGFSLVPTDYMYVMKCAKGDKFSQGSILPYGNLEINPSAGILNYGQGIFEGLKAHRTEDGCILLFRPDENAQRMKRSADRL

SEQ ID NO: 202960 - protein, 82 aa, Glycine max
  Coding DNA Sequence Number=SeqID_86182
  Gene Ontology: Mol. function=branched-chain-amino-acid transaminase activity; Cellular component=chloroplast; Biological process =branched chain family amino acid metabolic process
  Homolog annotation: Hit_ID=Q1RSX6; Match level="QueryCoverage=87%, HitCoverage=26%, E-value=2e-26, Identity=81%"; Hit description =Branched-chain amino acid aminotransferase II
MVSFKFMAEERKFSVDEFLEADEVFCTGTAVGISAVGSATYKNTRVEFKTGADTVTQKLFDMITGIHTGLLEDNNGWMVKID

SEQ ID NO: 202961 - protein, 71 aa, Glycine max
  Coding DNA Sequence Number=SeqID_86183
  Gene Ontology: Mol. function=branched-chain-amino-acid transaminase activity; Cellular component=chloroplast; Biological process =branched chain family amino acid metabolic process
  Homolog annotation: Hit_ID=Q1RSX6; Match level="QueryCoverage=100%, HitCoverage=25%, E-value=6e-27, Identity=81%"; Hit description =Branched-chain amino acid aminotransferase II
VFQVTKEAKAKGFFDVLFLDAEEHKYIEEVSSCNVFMVKGDVISTSPTLGTILPGITRNSIIQLARDLGYQ

SEQ ID NO: 202962 - protein, 133 aa, Glycine max
  Coding DNA Sequence Number=SeqID_86184
  Gene Ontology: Mol. function=branched-chain-amino-acid transaminase activity; Cellular component=chloroplast; Biological process =branched chain family amino acid metabolic process
  Homolog annotation: Hit_ID=Q1RSX6; Match level="QueryCoverage=98%, HitCoverage=46%, E-value=2e-53, Identity=76%"; Hit description =Branched-chain amino acid aminotransferase II
MKAYRRADGEVQIFRPEQNAMRMQMGAERLLMVAPSVEQYVDAVKQVVHANKRWVPPHGKGALYIRPLLFGSGSVMGIAPAPHCTFLIYTNPISNAYKGRHTNSTLSLLIEDTLPRAFPGGTGGVKNIGNYAP

SEQ ID NO: 202963 - protein, 123 aa, Glycine max
  Coding DNA Sequence Number=SeqID_86185
  Gene Ontology: Mol. function=transaminase activity; Cellular component=mitochondrion; Biological process=metabolic process
  Homolog annotation: Hit_ID=Q1RSX7; Match level="QueryCoverage=60%, HitCoverage=100%, E-value=7e-22, Identity=62%"; Hit description =Aminotransferase, class IV
MALSHQPAANGEAEDSYNKMDWDKLGFQVIPTDFMYIMKSNEEGTFSNGDLVPFGTVQIEPHSTVLNYGQWNEKEKIGKREEEMEKEFFIYLFEVLFKVKARKGDKTPNKRKGHKTSSPHGKC

SEQ ID NO: 202964 - protein, 113 aa, Glycine max
  Coding DNA Sequence Number=SeqID_86186
MKFNKVRDATDCFSIDNAIWNNVQGKNVSTLSSSTVIIWLKFEMFNQQSTVFIVCLNWIIGHYTCKRVREMEMKKSSVQKESGGGVEFKITLAISVGENQAQSKVICRKYSPR

SEQ ID NO: 202965 - protein, 288 aa, Glycine max
  Coding DNA Sequence Number=SeqID_86187
  Gene Ontology: Mol. function=protein-tyrosine kinase activity; Cellular component=integral to membrane; Biological process=protein amino acid phosphorylation
  Homolog annotation: Hit_ID=Q1RSY3; Match level="QueryCoverage=89%, HitCoverage=46%, E-value=4e-96, Identity=62%"; Hit description =Protein kinase
  Pfam annotation: Domain name=Pkinase; Domain location=20-256; Score= -27.1; E_value=6e-07; Accession=PF00069.15; Description=Protein kinase domain
  Pfam annotation: Domain name=Pkinase_Tyr; Domain location=20-256; Score=-51.5; E_value=2.6e-09; Accession=PF07714.7; Description =Protein tyrosine kinase
  Pfam module annotation: Pfam domain module=Pkinase::Pkinase_Tyr; Domain location=20-256::20-256
MERMKSTMSLTEIKDATDCFSLENAIGMGKIGIMYEGRLTDGSNLAIKRLFGSKQFKKEFLLEIRILERNERILVYQHMPNGRLSKWLHPLESEVTRLNWPQRIKIALGVARGLSWLHYTCNLHVVHRNISSECVLLDKNFEPKISNFGKAKFMNPNIEDGASTIFYASDGKKDVYDFGSLIFELITGKTFNELSRSSYNATNLSGNPSNFYDAIEESLIGEGFENEVYTLIKVACKCVKPFPDERPTMLEVYNYMIDIWGERHRISDGSDTLNVSSSSTSVDEIVEL

SEQ ID NO: 202966 - protein, 613 aa, Glycine max
  Coding DNA Sequence Number=SeqID_86188
  Gene Ontology: Mol. function=protein-tyrosine kinase activity; Cellular component=integral to membrane; Biological process=protein amino acid phosphorylation
  Homolog annotation: Hit_ID=Q1RSY3; Match level="QueryCoverage=91%, HitCoverage=94%, E-value=0.0, Identity=57%"; Hit description=Protein kinase
  Pfam annotation: Domain name=LRRNT_2; Domain location=31-75; Score =28.5; E_value=2.3e-05; Accession=PF08263.3; Description=Leucine rich repeat N-terminal domain
  Pfam annotation: Domain name=LRR_1; Domain location=105-127; Score =20.2; E_value=0.0073; Accession=PF00560.23; Description=Leucine Rich Repeat
  Pfam annotation: Domain name=LRR_1; Domain location=130-152; Score =13.6; E_value=0.74; Accession=PF00560.23; Description=Leucine Rich Repeat
  Pfam annotation: Domain name=LRR_1; Domain location=154-176; Score =15.5; E_value=0.19; Accession=PF00560.23; Description=Leucine Rich Repeat
  Pfam annotation: Domain name=LRR_1; Domain location=178-199; Score =4.0; E_value=50; Accession=PF00560.23; Description=Leucine Rich Repeat
  Pfam annotation: Domain name=LRR_1; Domain location=81-103; Score =5.3; E_value=29; Accession=PF00560.23; Description=Leucine Rich Repeat
  Pfam annotation: Domain name=Pkinase; Domain location=330-581; Score =28.1; E_value=3.1e-10; Accession=PF00069.15; Description=Protein kinase domain
  Pfam annotation: Domain name=Pkinase_Tyr; Domain location=330-581; Score=17.3; E_value=1.6e-13; Accession=PF07714.7; Description =Protein tyrosine kinase
  Pfam module annotation: Pfam domain module=LRRNT_2::LRR_1::LRR_1::LRR_ 1::LRR_1::LRR_1::Pkinase::Pkinase_Tyr; Domain location=31-75::105 -127::130-152::154-176::178-199::81-103::330-581::330-581
MVFQIKRDILMHAFWCSSLLSFYMVVVAHGVESDISCLKSIKNTLEDPHNKLSSWKNFNNKTNGFICDFVGVECWHPGENKVLHLNLTNMGLKGEFPRDLRDCPSLTSLNLSHNELTGPIPSDISTLLPYATSIDLSNNKFNGEIPPSLGNCSYLTSLRLDNNMLSGHIPQELGQLQRIRNISFANNNLSGPVPLFQPGLTCVDCYANNRELCGGPLPPCGSSDDFTETFKKGLAIGYAFSVTSVIVIYISYFAPWEQSESKHKTNYKAKEFRKYICSIAGRKTPTEPHTEQELQPLQLQEKAIKEISVVTDRMKSTMRLNEVRDATDCFSIDNAIGMGKIGIMYKGRLPNGWNLAIKRLFDSKLFKRQFLLEIRILGKYRHKNIVPLLGFCVEGKERILVYQYMSNGRLSKWLHPLESEVTLKWPQRIKIALGVARGLSWLHHICDLHVVHRNISSGCVLLDKNFEPKISNFGNAKFINPNIEDSASTTFYVSDGKKDVYDFGSLIFELITGKTFNELSRSSYNATNLSGNPSNFYDAIEESLIGEGFENEVYTLIKVACKCVKPFPDERPTMLEVYNYMIDIWGERHRISDGSDTLNVSSSSTSVDEIVEL

SEQ ID NO: 202967 - protein, 327 aa, Glycine max
  Coding DNA Sequence Number=SeqID_86189
  Gene Ontology: Mol. function=protein kinase activity; Cellular component=integral to membrane; Biological process=protein amino acid phosphorylation
  Homolog annotation: Hit_ID=Q1RSY0; Match level="QueryCoverage=95%, HitCoverage=71%, E-value=1e-116, Identity=65%"; Hit description =Protein kinase
  Pfam annotation: Domain name=Pkinase; Domain location=57-311; Score= -17.2; E_value=1.5e-07; Accession=PF00069.15; Description=Protein kinase domain
  Pfam annotation: Domain name=Pkinase_Tyr; Domain location=57-311; Score=-73.8; E_value=6.1e-08; Accession=PF07714.7; Description =Protein tyrosine kinase
  Pfam module annotation: Pfam domain module=Pkinase::Pkinase_Tyr; Domain location=57-311::57-311
MVICCRMHFHEQKRKRARQIDRDLPVELLERRIKINDIGWLTCRTSFAELYEATEHFSEDSVIGEGRTGTMYKATLPNGWFLLAVKKLYDSELCIRSFDLEIMMGRYSHRNIMVPISFCIEEEKNERILVYHYMSNGRVSDWLNDTTTLGWPAVIRIALGVARGLCCLHHSLHMVHLSIGPESILLGNNFEPRISNFGMAIFIDYDLDKNIGFDKKDVYDFGTLLFEVIRGKAFGQTSKCFSNANTNGPFTTYTYATNLFEDPFGFYDAVDKCLNEIEFEDEVSALLRVACDCVHPLPPKRPTMLEVYSKMSNIWERDGLFEDSSTF

SEQ ID NO: 202968 - protein, 72 aa, Glycine max
  Coding DNA Sequence Number=SeqID_86190
MALACDFCKETTHGIFWFRIGSKIPLAIYTLGMIAKYLDVLEIPRGAHVQFLVPQNALSMHVCEFSQGDVCD

SEQ ID NO: 202969 - protein, 233 aa, Glycine max
  Coding DNA Sequence Number=SeqID_86191
  Gene Ontology: Mol. function=molecular_function; Cellular component =integral to membrane; Biological process=biological_process
  Homolog annotation: Hit_ID=Q2HVT8; Match level="QueryCoverage=68%, HitCoverage=36%, E-value=3e-66, Identity=75%"; Hit description =PDZ/DHR/GLGF
  Pfam annotation: Domain name=DUF895; Domain location=36-190; Score =37.0; E_value=1.4e-10; Accession=PF05978.7; Description=Eukaryotic protein of unknown function (DUF895)
MASTLPAGDEETPLVPDDNSAIEARKSHHSTDIHILSLAFLLVFLAFGAAQNLQSTLNTEDDLGTTTLGILYLSFTFFSVVASLVVRVLGSKNALLIGTTGYVLYVAANLKPNWYTLVPASVYLGFCASIIWVGEGTYLTSAARSHSTDNNLHEGAVIGDFNGEFWAVYALHQFIGNLITFALLSDNQQFMILPMLIPTLLATKNEELPLVTLQKKEKNSTNFTIDGTLGPNC

SEQ ID NO: 202970 - protein, 231 aa, Glycine max
  Coding DNA Sequence Number=SeqID_86192
  Gene Ontology: Mol. function=oxidoreductase activity; Cellular component=integral to membrane; Biological process=metabolic process
  Homolog annotation: Hit_ID=Q9LGI8; Match level="QueryCoverage=95%, HitCoverage=61%, E-value=1e-68, Identity=59%"; Hit description =Putative pod-specific dehydrogenase SAC25
  Pfam annotation: Domain name=adh_short; Domain location=69-214; Score= -25.7; E_value=0.00027; Accession=PF00106.15; Description=short chain dehydrogenase
GERMVGVISLVTGMAGPSGFGSASTAEQVTEGVDASNLTAIITVRLVCVCGSFWSETRGPPAAHFEVQGGASGIGLETARVLALRKVHVIIAVRNMVSAKEAKQQILEENESARVDIMKLDLCSVNSIRSFVDNFIALDLPLNILINNAGVMFCPFKLSEDGIEMQFATNHIGHFHLSNLLLDKMKQTAKATGIEGRIINLSSIAHNYTYRKGIRFNKINERKGYFHFDSN

SEQ ID NO: 202971 - protein, 397 aa, Glycine max
  Coding DNA Sequence Number=SeqID_86193
  Gene Ontology: Cellular component=integral to membrane
  Homolog annotation: Hit_ID=Q2HVT8; Match level="QueryCoverage=64%, HitCoverage=58%, E-value=1e-77, Identity=61%"; Hit description =PDZ/DHR/GLGF
EGSTKGTTLLFIVFLFIMTFGAILMCFLRKRGANSKGQQELSGADAGACASLKSLSKSLASALSDVKMLLIIPLIAYSGLQQAFVWAEFTKYVVTPAIGISGVGSSMAAYGAFDGIFSLLAGRLTSGLTSITTIVSAGLFAQAVVLVLLLLNFSISSGLLGTVYILFLAGLLGIGDGVLMTQLNALIGILFKHDTEGAFAQLKIWQCATIAIVFFFAPLVSFKAVLVIMLALLCFSFCIFLLLALKVGKTSSPSTNKLPTRNTHDFNYLIELPKMSFFWFSNMVRMHLSWPVLTYAATWITLLMLMVAAASMSPQVAFVSAITPSSKFSQKCSSGGSIRMPLDVPGDILCFPAHMFVRSKVDLIVPPVFAAVIVAASACVVRAVGLWEHDQTPSDAN

SEQ ID NO: 202972 - protein, 244 aa, Glycine max
  Coding DNA Sequence Number=SeqID_86194
  Gene Ontology: Mol. function=solute:hydrogen antiporter activity; Cellular component=integral to membrane; Biological process =regulation of pH
  Homolog annotation: Hit_ID=Q2HVU5; Match level="QueryCoverage=99%, HitCoverage=27%, E-value=3e-67, Identity=57%"; Hit description =Na+/H+ antiporter-like protein
MHEDICHVAEKKGVAMIILPFHKRWGGEDEEVTEDLGQGLREVNQRVLQNAACSVAVLVNRGVARRYEQEPETSVAARKRVCIFFIGGPHDRKVLELGSRMAEHPAIRLLLVRFTSYTEVGDEGPKYNSPTSTTNWEKEKPITRSNLRMDILSRASHSHKFNSHDQELDEEAVNEFKVKWQETVEYIEKNATNITEEVLSIGKAKDHDLVIVGKQQLETTMLTNIDFRHGNEELGPIGDLFVSS

SEQ ID NO: 202973 - protein, 73 aa, Glycine max
  Coding DNA Sequence Number=SeqID_86195
MTLIHKEKSIDSYWKSLGNAVVDDHVRVSGGNKDWDRWRRHFEEIDKQERLLSIFKVYGFQFASSRMLLPMFL

SEQ ID NO: 202974 - protein, 451 aa, Glycine max
  Coding DNA Sequence Number=SeqID_86196
  Gene Ontology: Mol. function=ATP-dependent peptidase activity; Cellular component=integral to membrane; Biological process=ATP -dependent proteolysis
  Homolog annotation: Hit_ID=Q5ZAL4; Match level="QueryCoverage=92%, HitCoverage=98%, E-value=1e-42, Identity=45%"; Hit description =Membrane protein-like
  Pfam annotation: Domain name=DUF81; Domain location=33-425; Score= -16.1; E_value=9.2e-05; Accession=PF01925.9; Description=Domain of unknown function DUF81
SLSIDHVLQKIYEWGNGAQGLQEAHIQISGPIVVAGVLCFIASSISSAGGIGGGGLFIPILTIVASLDLKTASSLSAFMVTGGSIANVMCNLRATNPKLGGKSLIDYDIALLSEPCMLLGVSVGVICNLVFPEWLITMLFAVFLTWSTSKTCNSGVVFWKIESEERRKNDGFEGLEKGLLEDESSEEREEGVQVEKEKEKVKSIEEQVMVPEENIRVRIPWLKLVVLLLVWFSFFSLYLLRGNKYGQKAGEGWYKSIIPMEPCGVGYWIISSAQVPLALFFTAWIVYRKESHQDQNLMQEDSCLSSNGPSNKLIFPMMALLAGILGGVFGIGGGMLISPLLLHVGIAPEVTAATCSFMVFFSSTMSALQYLLLGMDHIETALILALICFVASLIGLLVVQKAIQSYGRPSLIVFSVSIVMTLSIVLMTSFGAIRTWKDYTSGRYMGFKLPC

SEQ ID NO: 202975 - protein, 123 aa, Glycine max
  Coding DNA Sequence Number=SeqID_86197
  Pfam annotation: Domain name=DUF1218; Domain location=44-123; Score= -7.9; E_value=0.014; Accession=PF06749.3; Description=Protein of unknown function (DUF1218)
MAKNYGFLVCIFVLVLDIVAGILGIQAEMAQNKVKDLKVWVLECRDPSYEAFKLGLAASICLVFAHAIAHLLGRCICMQSKEECQGATANGRLAVAFLILSWLPILIDIQIYSPVVLKTPLTQ

SEQ ID NO: 202976 - protein, 120 aa, Glycine max
  Coding DNA Sequence Number=SeqID_86198
  Gene Ontology: Mol. function=catalytic activity; Biological process =coenzyme M biosynthetic process
  Homolog annotation: Hit_ID=Q4VUC5; Match level="QueryCoverage=86%, HitCoverage=36%, E-value=3e-32, Identity=58%"; Hit description =Phosphosulfolactate synthase-related protein
  Pfam annotation: Domain name=ComA; Domain location=9-120; Score= -60.1; E_value=1.2e-06; Accession=PF02679.6; Description=(2R)-phospho- 3-sulfolactate synthase (ComA)
MAAFRWKSFEENEDRPAKPRHFGVTEIQSPHCTLFSHNLLQDIFESMGDYVDGLKFSGGSHSMMPKATIKQIIDMAHQHDVYVSTGDWAEHMISKSPSGFKEYVEVSLCPPDSILMLVLL

SEQ ID NO: 202977 - protein, 191 aa, Glycine max
  Coding DNA Sequence Number=SeqID_86199
  Subcellular localization annotation: CTP_CleavageSite=58; ConfidenceScore=5.33e-01
MSRNDDVVEQNAATTTTTSSTTIRNRADPFLVACRCFSFLTSLAAILCIAVNVLSAVRSFKHASDIFDGIFRCYAVLIAAFVVLAETEWSFIIKFSKVLEYWAARGMLQIFAAVMTRAFPGYIGDRRDLFLLQSIASYLLLACGVVYVVSGILCIGFLKRARQKQEITREQATKDLEHALHDWKNSHIDEL

SEQ ID NO: 202978 - protein, 382 aa, Glycine max
  Coding DNA Sequence Number=SeqID_86200
  Gene Ontology: Mol. function=Rab GDP-dissociation inhibitor activity; Cellular component=cytoplasm; Biological process=regulation of GTPase activity
  Homolog annotation: Hit_ID=Q1SG94; Match level="QueryCoverage=97%, HitCoverage=83%, E-value=0.0, Identity=93%"; Hit description=Rab GDI protein
  Pfam annotation: Domain name=GDI; Domain location=1-380; Score=788.5; E_value=3.8e-234; Accession=PF00996.9; Description=GDP dissociation inhibitor
MDRNDYYGGASTSLNLTQLWKRFRGDDTPAENLGSSREYNVDMIPKFMMANGALVRVLIHTNVTKYLNFKAVDGSFVYNKGKIYKVPATDVEALKSPLMGLFEKRRARKFFIYVQDYETNDPKSHEGLDLNQVTARQLISKYGLEDDTVDFIGHALALHRDDNYLDEPAKDFVDRVKIYAESLARFQGGSPYIYPLYGLGELPQAFARLSAVYGGTYMLNKPECKVEFDENGKAIGVTSEGETAKCKKIVCDPSYLSDKVQKVGKVARAICIMSHPIPDTKDSHSAQVILPQKQLGRKSDMYLFCCSYAHNVAAKGKYIAFVTTEAETDNPEVELKPGIDLLGPVDEIFYDTYDRFEPCNDHEADGCFISTSITNEQGQDMR

SEQ ID NO: 202979 - protein, 338 aa, Glycine max
  Coding DNA Sequence Number=SeqID_86201
  Gene Ontology: Mol. function=catalytic activity; Cellular component =cytosol; Biological process=cellular metabolic process
  Homolog annotation: Hit_ID=Q84XT1; Match level="QueryCoverage=98%, HitCoverage=99%, E-value=1e-144, Identity=75%"; Hit description =Anthocyanidin reductase
  Pfam annotation: Domain name=3Beta_HSD; Domain location=13-301; Score= -100.0; E_value=1.3e-05; Accession=PF01073.9; Description=3-beta hydroxysteroid dehydrogenaseisomerase family
  Pfam annotation: Domain name=Epimerase; Domain location=12-266; Score= 46.0; E_value=1.3e-10; Accession=PF01370.11; Description=NAD dependent epimerasedehydratase family
  Pfam annotation: Domain name=NAD_binding_4; Domain location=14-250; Score=-33.5; E_value=1.8e-06; Accession=PF07993.2; Description=Male sterility protein
  Pfam annotation: Domain name=RmlD_sub_bind; Domain location=14-328; Score=-192.9; E_value=0.1; Accession=PF04321.7; Description=RmlD substrate binding domain
  Pfam module annotation: Pfam domain module=3Beta_HSD::Epimerase::NAD _binding_4::RmlD_sub_bind; Domain location=13-301::12-266::14-250::14- 328
MANIKQIGKKQACVIGGSGFIASLLIKQLLQKGYAVNTTVRDLGSINKIAHLLVLKNLGELKIFRADLTVEGDFEAPISGCELVFQFATPMNFGSEDPENDMIKPAISGVLNVLKTCAQTKEVKRVILTSSTDAVTINQLNGKGHVMDESNWTDVEYLTTAKPHGWGYPASKTLAEKAAWKFAEENHIDLITVIPSLTAGPSITADIPFSVVLAASLMKGNDFYIKSLREMQLLSGSISITHVEDICRAHIFVAEKESASGRYIVCAHNTSVPELAKFLSERYPRYEIPTEFHDIPSKAKLVISSEKLIKEGFSFKYGIEEIINQSVEYLRSEGALLN

SEQ ID NO: 202980 - protein, 369 aa, Glycine max
  Coding DNA Sequence Number=SeqID_86202
  Gene Ontology: Mol. function=cytosol alanyl aminopeptidase activity; Cellular component=cytoplasm; Biological process=peptide metabolic process
  Homolog annotation: Hit_ID=Q6D3E2; Match level="QueryCoverage=97%, HitCoverage=88%, E-value=1e-152, Identity=76%"; Hit description =Peptidase
  Pfam annotation: Domain name=M20_dimer; Domain location=162-266; Score=79.6; E_value=9.7e-21; Accession=PF07687.4; Description =Peptidase dimerisation domain
  Pfam annotation: Domain name=Peptidase_M42; Domain location=14-200; Score=-169.3; E_value=0.016; Accession=PF05343.4; Description=M42 glutamyl aminopeptidase
  Pfam module annotation: Pfam domain module=M20_dimer::Peptidase_M42; Domain location=162-266::14-200
TQLGLDDIVIDEFATVTAVKKGNVPGAPRIGFITHIDTVDVGLSPDIHPQILTFTGEDLCLNKEKGIWLRVKEHPEILAYPNEEIIFSDGTSVLGADNKAAVTVVMTVLENLTAEHQHGDIVVAFVPDEEIGLNGAKALDLKRFDVDFAWTIDCCELGEIVYENFNAAAAEIRFTGVTAHPMSAKGVLVNPLLMATDYISHFDRQQTPECTEGREGYIWFNGLQAGQNEAVLKANIRDFDKENFAARKQQIADVAARIAAHYPTAKVDYRIEDTYSNISNAIGEDRRAIDLMFEAMESLGITPKPTPCAAVRTGRRSRQKAYSRRTSLPARITSTRSLNSCRCRRSRPLTTPPCSCVCWPPVKRACAPA

SEQ ID NO: 202981 - protein, 297 aa, Glycine max
  Coding DNA Sequence Number=SeqID_86203
  Gene Ontology: Mol. function=protein serine/threonine kinase activity; Cellular component=membrane; Biological process=protein amino acid phosphorylation
  Homolog annotation: Hit_ID=Q9FIU5; Match level="QueryCoverage=88%, HitCoverage=60%, E-value=3e-99, Identity=65%"; Hit description =Serine/threonine-specific protein kinase-like protein
  Pfam annotation: Domain name=Pkinase; Domain location=2-248; Score =95.8; E_value=1.3e-25; Accession=PF00069.15; Description=Protein kinase domain
  Pfam annotation: Domain name=Pkinase_Tyr; Domain location=1-248; Score=83.0; E_value=9.1e-22; Accession=PF07714.7; Description =Protein tyrosine kinase
  Pfam module annotation: Pfam domain module=Pkinase::Pkinase_Tyr; Domain location=2-248::1-248
MDTGETVAVKVLGTNSRQGEQEFLTEVLLLGRLHHKSLVDLVGYVAERGKHMLLYIYMSNGSLDSHLYADLGKNHKPLSWDLRLSIALDVARGLEYLHHGASPPVVHRDIKSCNILLDQSMRAKVTDFGLSRPEMIKPRTSNVRGTFGYVDPEYLSTRTFTKKSDVYSFGVLLFELITGRNPQQGLMEYVKLAVMESEGKVGWEEIVDPQLNGKYDVHNLHDMASLAFKCVNEVSKSRPSMCEIVQELSQICKRQIKDHGGTSPAALKEVSIEVGQTEIQDFSSIESSKMVRRLHSR

SEQ ID NO: 202982 - protein, 48 aa, Glycine max
  Coding DNA Sequence Number=SeqID_86204
MSMKQRHDRRCKGSGSEAKSGEKKKENDEKNGEFKRGEIASIAVHTDK

SEQ ID NO: 202983 - protein, 103 aa, Glycine max
  Coding DNA Sequence Number=SeqID_86205
MEENQRLKQVVPSLIHVHRQSSESILSNSSNLPEDGGSDTSLKLGLVYCNYHLKLMCEWQYALYIEGLGFNLLRNFYEDLKVLLSRRTVEDFRYLSNERKFMP

SEQ ID NO: 202984 - protein, 438 aa, Glycine max
  Coding DNA Sequence Number=SeqID_86206
  Subcellular localization annotation: CTP_CleavageSite=36; ConfidenceScore=5.24e-01
MSKKKVSGNTMTLKDFHGGSIPSDLPLPSAPGVTVRTSDRAGFDRPSAWGTPMGRSDHWSRPHTSPATRHYDDKTPFLSHTAPIGRNFDEDERKPLDGGSMPRRTISDESIRGGPPPRVEVRPPEFGLGGSSLGRQVAPVSQTPVGAGNSYSGRLTDAVHVGMNPPSLGGSKEQGTAAGGGGYPNAWSMRKEVASAVEPEQPAWSSAGAASKLAHASALEKVSSGRWQSKAVNYQTDAEVVRSPEVENRPHVNVNGVGAYNRTEAVGEKEYYDAMLARHAERGLGIDNPMQGGRNELPNYERSGVSRYSDVRPTSAPHHSGGVQLARNDGKIVGSDLQHPMPSELTERPKLKLLPRAKPVESSEPAVMDYAQGNRQVNDSGHVETVYQAHGHANFVKPVSAGNDNGKDAGQRPKLNLKPRSQPTEKLDGNSERDRSVA

SEQ ID NO: 202985 - protein, 117 aa, Glycine max
  Coding DNA Sequence Number=SeqID_86207
MALHFKLCILSFKPQIIITTKAQLSHSFNPAKLDSLHIAIKWKIVQEERSTALLTKIRLNIDYHFQEEIEAFLRRQYVNSSTIPGGYYGNDIHEIALCFRLLRQQGFFVPEGLFLIP

SEQ ID NO: 202986 - protein, 1236 aa, Glycine max
  Coding DNA Sequence Number=SeqID_86208
  Gene Ontology: Mol. function=zinc ion binding
  Homolog annotation: Hit_ID=Q5QEU0; Match level="QueryCoverage=5%, HitCoverage=98%, E-value=2e-16, Identity=69%"; Hit description=Auxin- induced putative tetratricopeptide-containing protein
  Pfam annotation: Domain name=TPR_1; Domain location=1004-1037; Score =8.4; E_value=0.53; Accession=PF00515.18; Description=Tetratricopeptid e repeat
  Pfam annotation: Domain name=TPR_1; Domain location=1091-1124; Score =6.1; E_value=1; Accession=PF00515.18; Description=Tetratricopeptide repeat
  Pfam annotation: Domain name=TPR_1; Domain location=247-280; Score =4.3; E_value=1.6; Accession=PF00515.18; Description=Tetratricopeptide repeat
  Pfam annotation: Domain name=TPR_1; Domain location=378-411; Score =5.5; E_value=1.2; Accession=PF00515.18; Description=Tetratricopeptide repeat
  Pfam annotation: Domain name=TPR_1; Domain location=472-505; Score =1.2; E_value=3.9; Accession=PF00515.18; Description=Tetratricopeptide repeat
  Pfam annotation: Domain name=TPR_1; Domain location=616-649; Score =6.7; E_value=0.85; Accession=PF00515.18; Description=Tetratricopeptid e repeat
  Pfam annotation: Domain name=TPR_1; Domain location=752-785; Score =13.2; E_value=0.14; Accession=PF00515.18; Description=Tetratricopepti de repeat
  Pfam annotation: Domain name=TPR_2; Domain location=1004-1037; Score =14.8; E_value=0.32; Accession=PF07719.7; Description=Tetratricopeptid e repeat
  Pfam annotation: Domain name=TPR_2; Domain location=1091-1124; Score =14.4; E_value=0.42; Accession=PF07719.7; Description=Tetratricopeptid e repeat
  Pfam annotation: Domain name=TPR_2; Domain location=1197-1230; Score =4.1; E_value=11; Accession=PF07719.7; Description=Tetratricopeptide repeat
  Pfam annotation: Domain name=TPR_2; Domain location=247-280; Score =10.8; E_value=1.8; Accession=PF07719.7; Description=Tetratricopeptide repeat
  Pfam annotation: Domain name=TPR_2; Domain location=378-411; Score =11.8; E_value=1.4; Accession=PF07719.7; Description=Tetratricopeptide repeat
  Pfam annotation: Domain name=TPR_2; Domain location=472-505; Score =7.7; E_value=4.2; Accession=PF07719.7; Description=Tetratricopeptide repeat
  Pfam annotation: Domain name=TPR_2; Domain location=616-649; Score =5.0; E_value=8.7; Accession=PF07719.7; Description=Tetratricopeptide repeat
  Pfam annotation: Domain name=TPR_2; Domain location=752-785; Score =12.4; E_value=1.2; Accession=PF07719.7; Description=Tetratricopeptide repeat
  Pfam module annotation: Pfam domain module=TPR_1::TPR_1::TPR_1::TPR _1::TPR_1::TPR_1::TPR_1::TPR_2::TPR_2::TPR_2::TPR_2::TPR_2::TPR _2::TPR_2::TPR_2; Domain location=1004-1037::1091-1124::247-280::378 -411::472-505::...
  Pfam module annotation: Domain location=616-649::752-785::1004 -1037::1091-1124::1197-1230::247-280::378-411::472-505::616-649::752 -785
MVLRGQGDSPVRICEPCKKLEEAARFELRHGRRPGRGSLKSAPRDEDEVLNQILGQTSDKVPSGQRSVGVASSSSNSNFDEDIQKIVSNDKPNVLGIDLGSTTPDELRKQALEEKKKHKILKGEGKSDEALRAFKRGKELERQADALEIQLRKSHKKSLPSGNLSDVLNKGIPAESDRKTKSLSHVGREKNDLTSELRDLGWSDMDLHKEDKKSSNLSLEGELSSIIGEVFTKSGEQKGSKIDKSQVVALKKNALMLKREGKLAEAKEELKRAKILEKQLEEQELLAEAEDSEDELSALIRGMDDGKELPNLHDRGHDFDFERLLAISDDLDGNFEVTEEDMMDPEIAGALESLGWTEPENTSSKSQTFDKEHLLSEIRFLKREALNQKRAGNTEEAMAFLKKAKLLERSLNSSEPEDYNSVSQKSTAIRKSVSSEVAGKGSDSIHERNTSATNNVSSTVAPKSRLMIQRELLSLKKKALTLRREGKMNEAEEETQKGAALEQQLMEMDKASNLKTSRTNTTDNVPHHNQADFHRNLSLEEGSEDDVTDRDMSDPTYLSLLRELGWNDDNNDNSPSKSLKKDDNHFAPVNDASLSKHSTNIRVQAPRSKTEIQRELLGLKRKALAFRREGKAEDAEEVLKMAKALEAQMEEMEAAKNKPQVEATVTKDGLFNPPVDEERYMAVSEEDLHDPTLNSMLTNLGWKDDEFESVAIKEDPVKEATATHTVDLSAHDSSSGIPATASRSKGEIQRELLTLKRKALAFRRKGEIEEAEEILRQAKTLEDQMEAFGNWNKDLSLNVSKDQQSVLSESSDYQERHGSLGVATEVDNASASSVIWSSKNSSESTFGLERINNETNIPILRMSDNLIHATSHFADGKHSLSAEGSTSSENLSKKMKAEKNIGRSSSAGHSTDMVDLLTGDGSNMSEILTKKHTEYKLGSANSSHADPAIHLNSSVNFNQDRGFKNSDTTQKREVTDAIEKPNINESNAVQDNVFQHHLPLRQEILAHKRKAVTLKREGKLTEAKEELRQAKLLEKGLEDGNMLPDTASSSASATVNYASHASNVVQKKQESSNVSAKPLSSRDRFKLQQESLGHKRQALKLRREGQIEEAEALFELAKAIETQLEELTAQDSNKSEGVDDVAVEDFLDPQLLSALKAVGLDDVSVVSKPHPERQETVKSNAKVENSNQERIQLEERIKEEKVKALNLKRSGKQAEALDALRRAKLYEKKLNSLTSG

SEQ ID NO: 202987 - protein, 211 aa, Glycine max
  Coding DNA Sequence Number=SeqID_86209
MPNAATGITFFPFLRAWLVFILIMLPIFPQVLKERGIDDVSINVVEHSNRVENNILRVQKHPDHSTQTRYGEKTEDAHLDQKTGRKPERKEQRADGDRAHAQRRNWRGDTRRNGKETDRQPHAPERQPSPETWRKPVEQQLKSAPGAASTRYSRAASAVELAQAFSRSVSDPKVNDRFSGQRGLNTGNSSRTQVPFSRLVGPTSRPQINGY

SEQ ID NO: 202988 - protein, 48 aa, Glycine max
  Coding DNA Sequence Number=SeqID_86210
MDVNIILNQALRRGSESANMHEMEGATSWAPSSPPSMKTHKLNYPKSN

SEQ ID NO: 202989 - protein, 80 aa, Glycine max
  Coding DNA Sequence Number=SeqID_86211
  Gene Ontology: Mol. function=transcription factor activity; Cellular component=nucleus; Biological process=regulation of transcription, DNA-dependent
  Homolog annotation: Hit_ID=Q1SG95; Match level="QueryCoverage=86%, HitCoverage=47%, E-value=4e-14, Identity=57%"; Hit description =Transcription factor, K-box
  Pfam annotation: Domain name=K-box; Domain location=4-79; Score=-3.4; E_value=0.00084; Accession=PF01486.8; Description=K-box region
MEKYKKKIENDSNEILRKKVEDKNRELRQMNGEDLQGLTLQELHKLEEHLKRGLINVSKVKDEKLMQEISTLKRKERKRD

SEQ ID NO: 202990 - protein, 167 aa, Glycine max
  Coding DNA Sequence Number=SeqID_86212
  Gene Ontology: Mol. function=magnesium ion binding; Biological process=metabolic process
  Homolog annotation: Hit_ID=Q5UB06; Match level="QueryCoverage=92%, HitCoverage=21%, E-value=3e-35, Identity=48%"; Hit description=Wound- inducible putative chloroplast terpene synthase 3
MVCLWERSLPSAEEYLKNGIVSSGVHIVMVHAFSLLGHGLTEENVQIIDRNPVIISSPATILRLWDDLGNAEAITKENVTIMDEFPNIISTTATILRLCDDLEGDRDVNGDGNYGLYMKCYMKEHPHVSIEQTREHVTRMISDAWKRLNQECLMSHDRCKSFTIIFH

SEQ ID NO: 202991 - protein, 144 aa, Glycine max
  Coding DNA Sequence Number=SeqID_86213
MLQPYEINIGLKEHSNPVTPKAYTPKSPSGPLPPDLVDPITILVALKGSYNCVIAQFIVHNSIHTSHLNTHITKIGMLQDAWGAYTFPACKQLPNPLSFKFVDNFLVFLTFSSNKRWWRLRAFSFLGRCTRESRVALPPKGRLR

SEQ ID NO: 202992 - protein, 176 aa, Glycine max
  Coding DNA Sequence Number=SeqID_86214
  Pfam annotation: Domain name=DUF538; Domain location=17-132; Score= -34.3; E_value=0.013; Accession=PF04398.3; Description=Protein of unknown function, DUF538
MLSLTPKSSVVPTHLLLLLILLSLAGSAVAAAEKEYSYSSDLHRVLHKHGLPAGLFPRTVKSYNLDQTGRLDVHLTDSVWLTSDTAQGVGRDVKGRAFLVATCERYHSHRSFVGLSLSRFEDPPICRSHSEKVNKLDYILRGQRLAETLESESYAQGWWKEGCWIYSSEMKGCSLG

SEQ ID NO: 202993 - protein, 97 aa, Glycine max
  Coding DNA Sequence Number=SeqID_86215
  Subcellular localization annotation: CTP_CleavageSite=56; ConfidenceScore=5.75e-01
MASLSRSYMIFKGRLFCSKTSNSSSPDASSNPSLLTRLPDPTKNTRRERRQGERVSAAATAAVMTFGGFDEAPLQGLRSTKLNDDINGFISDEGGSD

SEQ ID NO: 202994 - protein, 237 aa, Glycine max
  Coding DNA Sequence Number=SeqID_86216
  Homolog annotation: Hit_ID=Q1SU98; Match level="QueryCoverage=55%, HitCoverage=60%, E-value=3e-23, Identity=42%"; Hit description=H+ -transporting two-sector ATPase, alpha/beta subunit, central region
MSAFPNGSNSSLDNLLLQTMMGRLQLRAPINNPLVTQSLEDFLFNDLGDDDDDGGDNEDSEKAFEGKSELAREEAKLEREVIKIVLSGNGESVLKPNSGQAVSVRDHHICVGFQDEEDSGYRVWEWHGHIMSFDEEFGYNPEYIYGNYFQWFKARPSPVAAVADAVVEKEEEEEEDEEKQENQGLRELIDNKDSADARILHRNINAACPSKFYGISLFNGDFANMKMTWHFAKSMTV

SEQ ID NO: 202995 - protein, 193 aa, Glycine max
  Coding DNA Sequence Number=SeqID_86217
  Gene Ontology: Mol. function=inorganic diphosphatase activity; Cellular component=cytoplasm; Biological process=phosphate metabolic process
  Homolog annotation: Hit_ID=Q75L10; Match level="QueryCoverage=80%, HitCoverage=90%, E-value=5e-70, Identity=70%"; Hit description =Putative inorganic pyrophosphatase
  Pfam annotation: Domain name=Pyrophosphatase; Domain location=69-185; Score=150.0; E_value=6.1e-42; Accession=PF00719.9; Description =Inorganic pyrophosphatase
MVETDMDAETVANVVPPKETPNSVPISYHSSHSHPPLNERIISSMTRRSVAAHPWHDLEIGPGAPTIFNCVIEIGKGSKVKYELDKKSGLIKIDRVLYSSVVYPHNYGFIPRTICEDSDPLDVLIIMQEPVLPGCFLRAKAIGLMPMIDQDLDKKNENKEVAVNDFLPASAAFEAVNRSMSLYADYIVESLRR

SEQ ID NO: 202996 - protein, 819 aa, Glycine max
  Coding DNA Sequence Number=SeqID_86218
  Gene Ontology: Mol. function=protein serine/threonine kinase activity; Cellular component=membrane; Biological process=protein amino acid phosphorylation
  Homolog annotation: Hit_ID=Q40096; Match level="QueryCoverage=95%, HitCoverage=93%, E-value=1e-146, Identity=50%"; Hit description =Receptor protein kinase
  Pfam annotation: Domain name=B_lectin; Domain location=404-530; Score= 38.2; E_value=2.7e-08; Accession=PF01453.15; Description=D-mannose binding lectin
  Pfam annotation: Domain name=PAN_1; Domain location=650-732; Score =9.8; E_value=0.017; Accession=PF00024.16; Description=PAN domain
  Pfam annotation: Domain name=PAN_2; Domain location=645-711; Score =108.1; E_value=2.5e-29; Accession=PF08276.2; Description=PAN-like domain
  Pfam annotation: Domain name=Pkinase; Domain location=102-351; Score =112.3; E_value=1.4e-30; Accession=PF00069.15; Description=Protein kinase domain
  Pfam annotation: Domain name=Pkinase_Tyr; Domain location=102-351; Score=100.0; E_value=7.3e-27; Accession=PF07714.7; Description =Protein tyrosine kinase
  Pfam annotation: Domain name=S_locus_glycop; Domain location=536-626; Score=33.2; E_value=1.3e-07; Accession=PF00954.11; Description=S -locus glycoprotein family
  Pfam module annotation: Pfam domain module=B_lectin::PAN_1::PAN _2::Pkinase::Pkinase_Tyr::S_locus_glycop; Domain location=404 -530::650-732::645-711::102-351::102-351::536-626
DIGIEGGSHKTSDTIKAVGIIVGVAAFILLALAIFILWKKRKLQCILKWKTDKRGFSERSQDLLMNEGVFSSNREQTGESNMDDLELPLFDFNTITMATNNFSDENKLGQGGFGIVYKGRLMEGQNIAVKRLSKNSGQGIDEFKNEVKLIVKLQHRNLVRLLGCSIQMDEKMLVYEYMENRSLDAILFGLLYLHQDSRFRIIHRDLKASNILLDKEMNPKISDFGMARIFGTDQTEANTMRVVGTYGYMSPEYAMDGIFSVKSDVFSFGVLVLEIISGKKNRGFYSANKELNLLGHAWKLWKEENALELIDPSIDNSYSESEVLRCIQVGLLCVQERAEDRPTMASVVLMLSSDTASMSQPKNPGFCLGRNPMETDSSSSKQEESCTVNQVTVTMLDASPSKSNTRYVGIWYNNLPEKPWFGLQTETVPSITLLGFSQSTQRETNYSTIPIWSTNVSATKSNTTTINVIAQLSDVANLVLILNNTKTKTLIWQSFDHPTDTLIPYLRIGFDRRANQSWFLQSWKTDDDPGWNRTLPCGVVGSWNGELLMGIPNMKRDMLTFNQSGFFQVFTWDNQKSEWKRYWSEPTNQCDNYGTCGSNGNCDSLNFEDFRCTCLPGFEPKFPHDWYENRDGSGGCVRKPGVSLCGNGEGFAKVEGLKIPDTSVAIPTRGLSLEECEKECLRNCSCPAYSVLEVRNGGSGCLAWHGNLIDIQKLSDQGQDLFVRVDVVELGFLLTQYATTMLSALVLRCIQIGLLCVQENAINRPSMLEVVFMLGNETTLPPPKKPAFLFNENQDLPESSTSGGGSSINEVTTTIISAR

SEQ ID NO: 202997 - protein, 838 aa, Glycine max
  Coding DNA Sequence Number=SeqID_86219
  Gene Ontology: Mol. function=protein serine/threonine kinase activity; Cellular component=membrane; Biological process=protein amino acid phosphorylation
  Homolog annotation: Hit_ID=UPI000004822F; Match level="QueryCoverage =99%, HitCoverage=100%, E-value=0.0, Identity=53%"; Hit description =ATP binding / carbohydrate binding / kinase/ protein kinase/ protein ...
  Homolog annotation: Hit description=serine/threonine kinase/ protein -tyrosine kinase/ sugar binding
  Pfam annotation: Domain name=B_lectin; Domain location=74-188; Score =154.7; E_value=2.4e-43; Accession=PF01453.15; Description=D-mannose binding lectin
  Pfam annotation: Domain name=PAN_1; Domain location=347-434; Score =3.8; E_value=0.066; Accession=PF00024.16; Description=PAN domain
  Pfam annotation: Domain name=PAN_2; Domain location=347-412; Score =95.9; E_value=1.3e-25; Accession=PF08276.2; Description=PAN-like domain
  Pfam annotation: Domain name=Pkinase; Domain location=521-792; Score =130.4; E_value=4.9e-36; Accession=PF00069.15; Description=Protein kinase domain
  Pfam annotation: Domain name=Pkinase_Tyr; Domain location=521-792; Score=125.4; E_value=1.6e-34; Accession=PF07714.7; Description =Protein tyrosine kinase
  Pfam annotation: Domain name=S_locus_glycop; Domain location=202-329; Score=156.9; E_value=5.3e-44; Accession=PF00954.11; Description=S -locus glycoprotein family
  Pfam module annotation: Pfam domain module=B_lectin::PAN_1::PAN _2::Pkinase::Pkinase_Tyr::S_locus_glycop; Domain location=74-188::347- 434::347-412::521-792::521-792::202-329
MKFFSAIEFLSSFLVLMFFYPFCHSLDNTITINHPIRDGDVLVSNGLGNFALGFFSPRNSTNRYVGIWYNKISEQTVVWVANRDTPLNDTSGVLKISNNGNLVLHDNSTRSLNPVWSSNVSIESTNNISAKLLDTGNLVLIQTNNNNILWQSFDYPGNTMLPFMKLGLNRKTGLDRFLVSWKSPNDPGTGNMTYKIDPTGFPQLFLYKDKIPLWRVGSWTGQRWSGVPEMTPNFIFTVNYVNNESEVSIMYGVKDPSVFSRMVLDESGHVARSTWQAHEHRWFQIWDAPKEECDNFRRCGSNANCDPYHADKFECECLPGFEPKFEREWFLRDGSGGCVRKSNVSTCRSGEGFVEVTRVKVPDTSKARVAATIGMRECKERCLRDCSCVAYTSANESSGSGCVTWHGNMEDTRTYMQVGQSLFVRVDKLELAKYAKHPYGSLGKKGMVAVLTAAIFLFLLLAITFVYWFVKTRRQGIRRDRKYSFRLTFDDSTDLQEFDTTKNSDLPFFELSSIAAATDNFSDANKLGQGGFGSVYKGLLINGMEIAVKRLSKYSGQGIEEFKNEVVLISKLQHRNLVRILGCCIQGEEKMLIYEYLPNKSLDSLIFDESKRSQLDWKKRFDIICGVARGMLYLHQDSRLRIIHRDLKASNVLMDSSLNPKIADFGMARIFGGDQIAANTNRVVGTYGYMSPEYAMEGQFSVKSDVYSFGVLLLEIVTGRKNSGLYEDITATNLVGHIWDLWREGKTMEIVDQSLGESCSDHEVQRCIQIGLLCVQDYAADRPSMSAVVFMLGNDSTLPDPKQPAFVFKKTNYESSNPSTSEGIYSVNDVSITMIEAR

SEQ ID NO: 202998 - protein, 501 aa, Glycine max
  Coding DNA Sequence Number=SeqID_86220
  Gene Ontology: Mol. function=transcription regulator activity; Cellular component=nucleus; Biological process=regulation of transcription
  Homolog annotation: Hit_ID=Q9LHQ8; Match level="QueryCoverage=88%, HitCoverage=94%, E-value=2e-48, Identity=32%"; Hit description =Arabidopsis thaliana genomic DNA, chromosome 3, BAC clone: F3H11
  Subcellular localization annotation: CTP_CleavageSite=71; ConfidenceScore=5.37e-01
MAEEFQARICGENLWSSTTIDSTRSSVLFPLSSSSSSSISSSPCSVAANNNDAGNYSTRGTSDTDLKATKCCAEDTNGNNLVSDTTYLGFVDLQKPHNKSESAASGSGGMLIDSTLQMMGFGLTSSTSSSENWNQPLLFRCNGRAESNFHSLIQEETGMDSSNSQIHRDWIPKSFSSGGGNQQIDYNNFKPLLLNKQEFSLDHHSLSSLTTTGLSSNHGFPIGSASSYGNPSTLQSLYDPNYNPHPQHNSLFTNRPMFYSSKACYGTPCTELPQTWSKVSTFLKPTTTTIAKQQHPNIGLHFSNNTPFWNASAEALHDIRVGTFASSQSQYHRPTFDGEKPNCPSTLLNKFNSEKTLESASMMTKKNVCEPALKRPRIETSSPLPTFKVRKEKLGDRVTALQQLVSPFGKTDTASVLHEAIEYIKFLHDQVNVLSTSYMKNGAPIQHQQGCDDLKDSEGPQQDLKSKGLCLVPISSTFPVATEATSAELWTPTFRSGALLR

SEQ ID NO: 202999 - protein, 325 aa, Glycine max
  Coding DNA Sequence Number=SeqID_86221
MKHGLLGLAALLLSTHAFAENYRIVQSPAQKLDVWIDDVKDNQLASWCKRNVDLRIVTHGAKNVAALEDFLPRVAGLMASQCKALQQLNWTLNDDDGNPIASGSAAKAQQWQTVVTPPPAPVQQPETAAVAPAAPVLNSPQADTTPWLQFSLLDGCHFRTWWQHPAQTSALFVPSRQGLSCGQDGWLSGRSSLTQMGNGAAKSVVVTFLQGFPIAGLNNKQQSAELSITTVNSERMVLSNEKSPDSWLVLPFSSQFNGWQAPDQVVVQMPASDAADESALRARLQEVRKVWSPWLSASAPLKVQLVEQLHPELKDPAAAVYRTIN

SEQ ID NO: 203000 - protein, 34 aa, Glycine max
  Coding DNA Sequence Number=SeqID_86222
MKERIGMASTDTAPPKVDFDSHKAQMCANLISTK

SEQ ID NO: 203001 - protein, 83 aa, Glycine max
  Coding DNA Sequence Number=SeqID_86223
MEIGWCDSIEEIVSSTEEGDESDENEIIFQQLNCLKLIRLGKLRRFYKGSLSFPSLEEFTLKDCERMESLCAGNDSNIRVRGD

SEQ ID NO: 203002 - protein, 116 aa, Glycine max
  Coding DNA Sequence Number=SeqID_86224
  Gene Ontology: Mol. function=3-methyl-2-oxobutanoate hydroxymethyltran sferase activity; Cellular component=mitochondrion; Biological process=pantothenate biosynthetic process
  Homolog annotation: Hit_ID=Q9M315; Match level="QueryCoverage=99%, HitCoverage=33%, E-value=5e-50, Identity=93%"; Hit description=3 -methyl-2-oxobutanoate hydroxy-methyl-transferase-like protein
  Pfam annotation: Domain name=Pantoate_transf; Domain location=1-115; Score=-89.3; E_value=4.1e-09; Accession=PF02548.6; Description =Ketopantoate hydroxymethyltransferase
MLVHCRAVARGAKTPLLVGDLAFGTYESSSNQAVDTAVRMLKEGGMDAIKLEGGSPSRIVAAKAIVEAGIAVMGHVGLTPQAISVLGGFRPQGKNVASAVKRQRWLYKKQGAFPLF

SEQ ID NO: 203003 - protein, 80 aa, Glycine max
  Coding DNA Sequence Number=SeqID_86225
MSLMRRWPRQEPSLLLMEGPAATAEGEDELTLPEPFYFDVDAHMAQEEGTSTDQIHEPSSAPVPEETQPSTPIMETEQPI

SEQ ID NO: 203004 - protein, 72 aa, Glycine max
  Coding DNA Sequence Number=SeqID_86226
MFDTLHLSNVGNAFQWKWPRGSLPERDPRRIKWLKEPVPPPNMTATVLGALSTSSASRPSRDGHFSGSDASS

SEQ ID NO: 203005 - protein, 58 aa, Glycine max
  Coding DNA Sequence Number=SeqID_86227
  Subcellular localization annotation: CTP_CleavageSite=13; ConfidenceScore=5.31e-01
MASESSTDLTNTSTSSDSSTTTSKALFRACTMCFAGIVVSTWICQDTRRLQTHNKFHD

SEQ ID NO: 203006 - protein, 230 aa, Glycine max
  Coding DNA Sequence Number=SeqID_86228
MASHPSSATSKDRSNRLTTIRFSVAFRVSKNIIKVPLSYHRQWRPHYATYVLFQHNGTTHFIRLHRYGSRYFYSDGLKEFRRTHGIDDSVILRFFGGDKNTTFEVDVIGPIFGQRRPRSVLTTRRHIFTVDVTEHMMQQSLPLVLPPTASSFLFGSQKIIPVQRGYGKCQQWKITMHDAVPSVAQPWSQYLSENNLMPGDEVMFFFRFDKHVWEVVFRKEVIWDDEDLFR

SEQ ID NO: 203007 - protein, 227 aa, Glycine max
  Coding DNA Sequence Number=SeqID_86229
MKMENHRFIGKSDSAKARSKRKRVRQQKVHLDVQHSVHASFNPTSSHTEDDYNQPKTPPHSVHATANRAPHDAKDHFNICDSSENETSGSAEESETISSVGYPNCESSHHDSSMDTGAIPIKKILNGYGYGLISNVIIPKYFDLGDQLIQCRHCNAKMCHYNEIEAHIVSNLQKMLDENNAHAKSFRMARDRLTNTQVILMQIRTEILLLKLKMGNYRGYMNYIVVI

SEQ ID NO: 203008 - protein, 507 aa, Glycine max
  Coding DNA Sequence Number=SeqID_86230
  Gene Ontology: Mol. function=DNA binding; Cellular component=beta -galactosidase complex; Biological process=DNA integration
  Homolog annotation: Hit_ID=Q1SS72; Match level="QueryCoverage=97%, HitCoverage=33%, E-value=1e-164, Identity=58%"; Hit description =Integrase, catalytic region
MKAELQALQLNETWQLTPLPPHKTAIGCRWVYKVKHKADGSIERYKARLVAKGYTQMEGLDYLDTFSPVAKLTTVRLLLAVAAMNHWHLRQLDVNNAFLHGELEEEVYMQVPPGLTVTNPNLVCRLQRSLYGLKQASRQWFMKLSDFLTVHGFQQSHSDHSLFLRFNGSVTTILLVYVDDIILTGNSNTAIQEVLTLLDQAFKIKDLGNLKYFLGLEIARSSEGIHLSQRKYTLDILSDSGMLGCRPNTTPMDSSTKLHATTGTPLSAEASSSYRRLIGRLIYLNNTRPDIAYAVQQLSQYMSSPTNAHLQAAYRILRYLKGTPGSGIFFSATGTPQLRAFSDSDWAGCQDSRRSTTGFVVYFGSSLISWQSKKQSTVSRSSSEAEYRALASTTCELQWLTYLLHDFRMTFVEPATIYCDNHSAIRIATNPVFHERTKHIEIDCHVVRQQVTSGHLKLLPVSSSLQLADIFTKALPSTIFQPLCNKLGMLNIHSQLEGGILTASNKK

SEQ ID NO: 203009 - protein, 365 aa, Glycine max
  Coding DNA Sequence Number=SeqID_86231
  Gene Ontology: Mol. function=DNA binding; Cellular component=beta -galactosidase complex; Biological process=DNA integration
  Homolog annotation: Hit_ID=Q1SS72; Match level="QueryCoverage=90%, HitCoverage=26%, E-value=7e-75, Identity=37%"; Hit description =Integrase, catalytic region
MNEAAFNNVESYLYLHPSENPAAALVSPVLDSTNYHSWSHSMITALSAKNKLEFVDGSAPEPLKTDRTYGAWRRCNNMVVSWIVHSVAASIRQSVLWMDKAEDIWRDLKSRYSQGDLLRISDLQQEASTLKQGALSVTEYFTKLRVIWDEIENFRPDPACTCNSRCSCSAFAIIAQRKLEDRAMQFLRGLNEQYTNIRSHVLLMDPIPAISKIFSYVAQQERQLLGNSSSPNFNFESKEISINATKSICDYCGRMGLKVIGHTVDVCYRKHGYPPGYKPFNGRSTVNNMVTMDNKTMDDQTQHHESQDLVQFSPEQYKALLALIQRPSIGNTASEQTKQVASISSCTTDKLPNPGHEPSYEDWYS

SEQ ID NO: 203010 - protein, 34 aa, Glycine max
  Coding DNA Sequence Number=SeqID_86232
MDARTFSREIAAGTIADPGSLKAKDKTMGDVAAC

SEQ ID NO: 203011 - protein, 122 aa, Glycine max
  Coding DNA Sequence Number=SeqID_86233
MKVWMTKSSMPQIAGLGFHTKSLDLQQNTEDDLKLREGVHIYSANDITPSNFIEAAAQVTNSEYEDGTFWGKQMGETTYPEQMTSTLVLTRCWTDWRKPRRSGRGGKRDNSSKFFRGKGENI

SEQ ID NO: 203012 - protein, 519 aa, Glycine max
  Coding DNA Sequence Number=SeqID_86234
  Homolog annotation: Hit_ID=Q1SR88; Match level="QueryCoverage=27%, HitCoverage=33%, E-value=1e-08, Identity=29%"; Hit description=IMP dehydrogenase/GMP reductase
  Pfam annotation: Domain name=DUF674; Domain location=1-451; Score =149.4; E_value=9.4e-42; Accession=PF05056.3; Description=Protein of unknown function (DUF674)
MASDQAAAAVRWDLCQDNEKKRVVLAEASGDFIDVLFSFLTLPLGTIVRLLGNSVEMGNIKKLYDSVKRLGSDVFWNDICKQMLLNPRNPLEASCQRLKVKVDDTKPTEYFMCHSCSAEKNLLLSTFDGGRCYCGKLMRKNMDLLVESKEETAAENGVFVKGDAKFLIFDDLTVLRSTPSKSVQKFLEHRRKDLKIPTISKDVDMKEILSILKQALISKSPLSEVLFEKEGSKSCSCPYSCPCSRNTNPIHWKDSIKIKVMVNKSNNKILLAEADGDFVDFLFSFLTTPLGSILNLTNGKFPLGSIGNLYRSVKRLDPSWFKGSSKESLLNLRVAPHFGCKSSPFQEDHTPNYWYGTVAGNDNNEGRTMISKKKDMLQTAKELKLFDPRCSDGAKEPGVGFVKRPCLFVVMDDLEVKQMTTTSSIEYLNNLGDDVKLGDLEEHLVEIRSNEVMNLLRASLTSNEATLTRSLGCLLMKWKCQRCIPFWGTLQWMKKRHRKKKENGQNSCNILCCCSVCDK

SEQ ID NO: 203013 - protein, 54 aa, Glycine max
  Coding DNA Sequence Number=SeqID_86235
MKDGYFQSLMRGTACHGGDVALTALSPVVNAWNYGRLQSAWQRRRRERAFWSDA

SEQ ID NO: 203014 - protein, 110 aa, Glycine max
  Coding DNA Sequence Number=SeqID_86236
MANHALSDGEDERYSSVDDGRHRGAGKHGSVKCPGRENLHFHKNRIFGEKCYKKKVYEQGIKEVDLSVVRGINSGSKRASQAMTTDTTLREGSHINCSLLSLGTIIRKLR

SEQ ID NO: 203015 - protein, 144 aa, Glycine max
  Coding DNA Sequence Number=SeqID_86237
  Gene Ontology: Mol. function=4-hydroxybenzoate octaprenyltransferase activity; Cellular component=integral to membrane; Biological process=ubiquinone biosynthetic process
  Homolog annotation: Hit_ID=Q66FH0; Match level="QueryCoverage=100%, HitCoverage=50%, E-value=1e-36, Identity=54%"; Hit description=4 -hydroxybenzoate octaprenyltransferase
  Pfam annotation: Domain name=UbiA; Domain location=9-144; Score= -34.5; E_value=0.0078; Accession=PF01040.9; Description=UbiA prenyltransferase family
MRIDKPIGTLLLLWPTLWALWLAGKGVPPLSILLVFVLGVFLMRAAGCVVNDYADRAVDGYVKRTAGRPMPSGRVSAKEAKVLFVVLVLVSFCLVLTLNAMTIWLSLAALALAWAYPFMKRVTNLPQFVLGAAFGWGIPMGYAA

SEQ ID NO: 203016 - protein, 558 aa, Glycine max
  Coding DNA Sequence Number=SeqID_86238
  Gene Ontology: Mol. function=sugar porter activity; Cellular component=integral to membrane; Biological process=maltose transport
  Homolog annotation: Hit_ID=P31242; Match level="QueryCoverage=71%, HitCoverage=92%, E-value=0.0, Identity=77%"; Hit description =Maltoporin precursor
VPSRRSETSPPAADTGIAARVIRRRAQMLIQHQHARRVQRIVFGEAAQRHFQRTAIGRQRIGGDRPLNFALIELRADGVELHLLRHRRLQRLPRQALQRGGADGRRDGNVGRRVGVGRQRRADGQRQRQADAAADQARDPAAANAVGGEPIALPALSSLPPNFHLGAEGDFVILAAAEGMHAGVVVSGAGVIPGVVTGGVAPLLIPLGVGGEQTDGRTRPDAVARLPLLRQGHFILAVAIAGALGFDVVIAGFQQGAHDWRPFVHRAHAHGVPGGAVVVIAVDVLEHGDVHQRPLIVEVDGAVIQHADHLAVVIDGGAFVAAVVLRGHRVGGVLQHEFVVAVQDALRVFRSEHPAVFAGAVGQAIVILRIGAAVVHAQLQGAARVQLQAGQTQVEGVVDGWALFPFVIQVAVRAAGFGVAGHGGGQLAEAQIDVFQTGARAGDIPVVEVDHVNVMTLIEALTGPQRGARQPVDQVFTLHVDFAEARGHVFPVGTLRDRIGQVGVEIEALVAFFPHFLPQFQFGVGFAFVAETVFARGTGGLEALLLTAAAGPADAGTG

SEQ ID NO: 203017 - protein, 135 aa, Glycine max
  Coding DNA Sequence Number=SeqID_86239
  Subcellular localization annotation: CTP_CleavageSite=56; ConfidenceScore=5.71e-01
MAESSKKRKGSSTSAATTRTPRPGATGASPAPIPPSLSSSTLFSSDEQPIRILMPRSSNLAQASEEDLILMWAFLTGRPIDWAHLICYCMHKALWSGAPLPYPQLVTLFLRHFEIPLDLEPFLLVKRSFAIGAGA

SEQ ID NO: 203018 - protein, 361 aa, Glycine max
  Coding DNA Sequence Number=SeqID_86240
  Gene Ontology: Mol. function=helicase activity; Biological process =viral genome replication
  Homolog annotation: Hit_ID=Q1SRJ5; Match level="QueryCoverage=99%, HitCoverage=44%, E-value=1e-104, Identity=50%"; Hit description =Probable helicase [imported]-Arabidopsis thaliana-related
MYTVEFQKRGLPHVHLLLFLHANNKYPSPNDIDHIISVEIPSQKDDPELYILVQNHMIHGPCEILRPASPCMKEGKCSRFYPKKFQATTLTDGDGYPVYHRRNTGRTITKNGIIIDNRCIVPYNPKLLKKYQAHINIEWCNQSTSIKYLFKYINKGYDRVTTVMVHDDNETVSYANTPNDEIKEYLDCRYISPCESAWRIFGFPIHGRKSSVERLQFHLPGQHIVLYQDHDDIDDLLSNPSISESKFIAWMNTNQVFVEGKNLTYSEFVTKFVYHQKQRCWQLRKKGYTIGRLQWVPPTTGELFYLRMMLTVCRGPISFEDIRTVNSVEYSTYRKACFANKMIENSLLQSRKQKTGAQHLI

SEQ ID NO: 203019 - protein, 185 aa, Glycine max
  Coding DNA Sequence Number=SeqID_86241
  Gene Ontology: Mol. function=helicase activity
  Homolog annotation: Hit_ID=Q2R1R7; Match level="QueryCoverage=59%, HitCoverage=6%, E-value=1e-29, Identity=56%"; Hit description=AT hook motif-containing protein, putative
MDNHEHANHRDTTQARIKNKVNIRDSSEDESSESTQGCVSVSSPENQNYMSSANDPVINREVSKDIRTTNSRFSLCCGNGKVELPLLQNPPKYLYQLLYDHGTSDSKNYQQNIRTYNMMFAFTSAGIKFDKSINHSRGPPTIRIQGQPCHRIGSMLPMPGKEPKFAQLYIFDTENEVHNRINAIR

SEQ ID NO: 203020 - protein, 142 aa, Glycine max
  Coding DNA Sequence Number=SeqID_86242
  Gene Ontology: Mol. function=glutamate-tRNA ligase activity; Cellular component=aminoacyl-tRNA synthetase multienzyme complex; Biological process=tRNA aminoacylation for protein translation
  Homolog annotation: Hit_ID=Q6YUS0; Match level="QueryCoverage=55%, HitCoverage=14%, E-value=1e-31, Identity=83%"; Hit description =Putative glutamate-tRNA ligase
  Pfam annotation: Domain name=tRNA-synt_1c; Domain location=12-137; Score=-109.7; E_value=4.3e-07; Accession=PF00749.11; Description =tRNA synthetases class I (E and Q), catalytic domain
  Subcellular localization annotation: CTP_CleavageSite=39; ConfidenceScore=5.23e-01
SAAFSEQQPPPPVRVRFAPSPTGNLHVGGARTALFNYLFARSKGGKFVLRIEDTDLERSTRESEEAMLKDLSWLGLDWDEAAKNAIVAALLLTAVTCVVDLVEGQSFSVCSLGGSFRFKVGKEMTDLGLRVKGKLGSHALLN

SEQ ID NO: 203021 - protein, 186 aa, Glycine max
  Coding DNA Sequence Number=SeqID_86243
  Gene Ontology: Mol. function=hydrolase activity, acting on glycosyl bonds; Cellular component=cellulose and pectin-containing cell wall; Biological process=carbohydrate metabolic process
  Homolog annotation: Hit_ID=Q9LW07; Match level="QueryCoverage=99%, HitCoverage=41%, E-value=6e-48, Identity=51%"; Hit description =Putative polygalacturonase At3g15720 precursor
  Pfam annotation: Domain name=Glyco_hydro_28; Domain location=2-186; Score=-30.1; E_value=1.1e-07; Accession=PF00295.8; Description =Glycosyl hydrolases family 28
MQLRGKIVAPAKDAWVGGYKYTWILISNINGLTIEGNGGLLDGDGSTWWACKNCPRPAVLSFQSCNRLSVSYLNIINSPRAHIGINQCQGAIFSNINIHAPGNSPNTDGIDINSSQNIMIRDSFIASGDDCIAITGSSSYINVTGIDCGPGHGISLGRNYDTIQEVHVQNCKFTSTTNGARIKTFA

SEQ ID NO: 203022 - protein, 111 aa, Glycine max
  Coding DNA Sequence Number=SeqID_86244
  Gene Ontology: Mol. function=calcium ion binding
MTDGNHGKKDKEEKVLEHEQLHFALYTGKEWRQRQIRKITDRVFDKVKNQMETDKLNFEDLYIAVLLVYNDINKYIPGPHFDPPSKDKVREVKQEKLGDLEFGDEDDINMA

SEQ ID NO: 203023 - protein, 168 aa, Glycine max
  Coding DNA Sequence Number=SeqID_86245
MNEELRREIRKYPLTCQRLVPSYGHQPTETSIMTRSPDKIKSIDGSKETLKLSVRISDLWFIGTPNKSEQAEMVFVDSDGTSLLENTGLLDVVAGQFEPGLLVDVIGVVEEVVFRQVSGKASNCYLALCGMIIACSFFKFLDDYEGDGPITVLLSHCRIKEAQGISSS

SEQ ID NO: 203024 - protein, 107 aa, Glycine max
  Coding DNA Sequence Number=SeqID_86246
MVGVHCTRDPSLERFVFHLVVSCVPFRECSAQTHPSHLRNIAPVPYDDLGDSPCPRELLMEQEEEEVEGDKLKQCLGKNALEPSKQAQTCGLSRPTTGSGQAQKRQH

SEQ ID NO: 203025 - protein, 73 aa, Glycine max
  Coding DNA Sequence Number=SeqID_86247
  Gene Ontology: Mol. function=heat shock protein binding; Biological process=protein folding
  Homolog annotation: Hit_ID=Q8H812; Match level="QueryCoverage=78%, HitCoverage=11%, E-value=2e-20, Identity=68%"; Hit description =Putative DNAJ protein
MAMFFFFPWKFNWIVDGLWGWSCKSTVIARENCALRCLSPACYELIYESDPLEEGEKDFIRSQEYKYCMHKYV

SEQ ID NO: 203026 - protein, 290 aa, Glycine max
  Coding DNA Sequence Number=SeqID_86248
  Subcellular localization annotation: CTP_CleavageSite=50; ConfidenceScore=5.03e-01
MENEVHCEQQAFIQKLSVLVKLHFKQLVAPHRAHRTYSLPVIASSRSPTLASLRQAQGETPQQPGDGQQQATNAPPPPPEPLSSSTKWNNKLGGKRAETDSAPFIIQEQRVEWNNKLGGKRVETDFAPFIIQEQRVKWNSKLSDKRTETDSAPFVIQISQVELDHVQQNAKTNYGHSASCINQEEQIRQYQDDVSVLIIFKFLQVPLAGRFTGQMVFRLNEISVLSLLPFISNKRQVKRGNCHTLISSGDHPLLGCDPRLTTSRQLLGGSNLTRLGELSSPGRAEHAWAS

SEQ ID NO: 203027 - protein, 80 aa, Glycine max
  Coding DNA Sequence Number=SeqID_86249
  Gene Ontology: Biological process=sucrose metabolic process
  Homolog annotation: Hit_ID=Q9FHU4; Match level="QueryCoverage=90%, HitCoverage=8%, E-value=3e-21, Identity=60%"; Hit description =Sucrose synthase
MFNEWGFDKGWGNAARRVKETMKLFSKVLESADPVKSESLFSRLPNMFNIVILSIHGYFGQADVLGLSDTGGQVGISPIQ

SEQ ID NO: 203028 - protein, 138 aa, Glycine max
  Coding DNA Sequence Number=SeqID_86250
MERWKRLLIKVRSVNVGDGEDESTKEDSARSIYRVEMFILSLNMKGCNSQRGPSTAQYRGTKERHGQHPINNWRQDKEIQNRKGKYGEDEGDGPHMVTINIEKVEETKDQAGCFDDDKGSHASQSFIQDKEIKDIQDG

SEQ ID NO: 203029 - protein, 83 aa, Glycine max
  Coding DNA Sequence Number=SeqID_86251
  Gene Ontology: Mol. function=carboxypeptidase activity
  Pfam annotation: Domain name=Transposase_21; Domain location=14-82; Score=-85.3; E_value=2.5e-07; Accession=PF02992.5; Description =Transposase family tnp2
MVLMKCTIALGVGFHDGRNCDGMLRHLADSSYWKKINSLYLEFSKEPRNISLGLASDGMNPYGSLSTQHSSWHILLVIYNLPP

SEQ ID NO: 203030 - protein, 117 aa, Glycine max
  Coding DNA Sequence Number=SeqID_86252
  Subcellular localization annotation: CTP_CleavageSite=28; ConfidenceScore=5.75e-01
MASPPASPPLPPPPSPPPHPPSSDASVSPSTVKRTRKASLVNVDPATSKVDGPHRKKLRTYLGIVARDKVDVMYENWKEVPTAQKDLIWEDIQAEFEIPKASESRTKKKLLKTVGER

SEQ ID NO: 203031 - protein, 125 aa, Glycine max
  Coding DNA Sequence Number=SeqID_86253
MGVKHFEVDSLEEQGLALPSKPEVSPSAAYVSTKKSCVDPSGNDLETADSDKCELHIKENPPRLVALGRVYEGFTTVHNILLLHDQVKVDVEEVKDAAAPIPVPTDEVNLWDRHLTPSLLGRHIW

SEQ ID NO: 203032 - protein, 260 aa, Glycine max
  Coding DNA Sequence Number=SeqID_86254
  Gene Ontology: Mol. function=chitin binding; Cellular component =extracellular region; Biological process=chitin metabolic process
  Homolog annotation: Hit_ID=UPI00006A17C9; Match level="QueryCoverage =53%, HitCoverage=100%, E-value=6e-15, Identity=32%"; Hit description= UPI00006A17C9 related cluster
GLHVLTFRGLHALTFVGLHVLAIRGLHVLAFIGLHVLTFRGLHILTFRGLHVLAFIGLHVVTFKGLHVLAFRRGQQILSLKGLHVLAFRWLHVLDFRGLHVLAFRELHVLAFRGLHALAFRGLHVLAFRGLHICAFGGLKGGYRATTMHTRARLHPAATKRRVSMHVAQLISDAIHYFQGLCPHDTQWTRRIPTGPWGPSKVIRPPTNRAFIKKYYALRQAQGKTPQQPVDGRQRATDAPPPPPKPLSSSTKARALPTTR

SEQ ID NO: 203033 - protein, 113 aa, Glycine max; identical to SEQ ID NO: 154399
  Coding DNA Sequence Number=SeqID_86255

SEQ ID NO: 203034 - protein, 76 aa, Glycine max
  Coding DNA Sequence Number=SeqID_86256
  Gene Ontology: Cellular component=mitochondrion
  Homolog annotation: Hit_ID=Q2QMA7; Match level="QueryCoverage=77%, HitCoverage=34%, E-value=2e-17, Identity=70%"; Hit description =Expressed protein
MAGLLGYRSLPPKAKNLVVAGGLTAFVFGAYFYTMRAVGGTDELQVAIDKFEADKNKNAGDANMPSKVFLEDNTNL

SEQ ID NO: 203035 - protein, 60 aa, Glycine max
  Coding DNA Sequence Number=SeqID_86257
SPETTDAVTRNHRCSHQKPPPAAEQVWRFPAEAVARERTKDFERSCCKRMKEPENEGATE

SEQ ID NO: 203036 - protein, 207 aa, Glycine max
  Coding DNA Sequence Number=SeqID_86258
  Gene Ontology: Mol. function=oxidoreductase activity; Cellular component=cytosol; Biological process=leukotriene metabolic process
  Homolog annotation: Hit_ID=Q8S0M7; Match level="QueryCoverage=82%, HitCoverage=55%, E-value=6e-69, Identity=64%"; Hit description =Putative allyl alcohol dehydrogenase
  Pfam annotation: Domain name=ADH_zinc_N; Domain location=18-168; Score=75.6; E_value=1.6e-19; Accession=PF00107.16; Description=Zinc -binding dehydrogenase
MPGFTAYAGFYEVCTPSKGEYVFVSAASDAVGQLVGQLAKLHGCYVVGSAGSKEKIDLLQNKLGFDEAFNYKEELDLNAALQRYFRQGIDIYFDNVGEDMLNAALLNMRIHGRIAVCGMGFLRSDYLHLYPHFVEDVSSYYKQGKIVYIEDMNEGLENAPAAFVGLFHGKNVDNNFTITDDQDKERLNVVTATIIDNSLAILNALLR

SEQ ID NO: 203037 - protein, 362 aa, Glycine max
  Coding DNA Sequence Number=SeqID_86259
  Gene Ontology: Mol. function=carboxylesterase activity; Cellular component=nucleus; Biological process=metabolic process
  Homolog annotation: Hit_ID=Q0ZPV5; Match level="QueryCoverage=87%, HitCoverage=95%, E-value=1e-109, Identity=62%"; Hit description=CXE carboxylesterase
  Pfam annotation: Domain name=Abhydrolase_3; Domain location=109-338; Score=264.9; E_value=1.7e-76; Accession=PF07859.3; Description =alphabeta hydrolase fold
MASHRLKENSNFHSSQYLYMAAISLRHNPQANNTNQQREIITEEIQGLIRVHRDGRVERPSIVPSVSSTVASERGVTAKDVMINKETNLWARVYVPISACHYSKLLPLLVYFHGGGFCVGSAAWSCYHEFLTNLASKANCVILSVDYHLAPENRLPMAYDDGCNALMWVKREALNGSCVQKWWLSHCNMSSLFLAGDSAGANIAYNVATRMHMGSTSNTPLLSLKGVILIQPFFGGEERTFSEKHSLQPPNSALTLSVSDTYWRLALPLGATRDHSYCNLLADGSVKLRDLRLPSTMVCVAEMDILRDRNLEFSNALAKAGKRVETVVYKGVGHAFHVLHNYQLSHSRTQDMISHIRNFLNQ

SEQ ID NO: 203038 - protein, 448 aa, Glycine max
  Coding DNA Sequence Number=SeqID_86260
  Homolog annotation: Hit_ID=Q5XM22; Match level="QueryCoverage=21%, HitCoverage=84%, E-value=1e-19, Identity=40%"; Hit description =Resistance-like protein HAAS-2
MVSADSVRAETAQCRGPYVRLQWVRDIYERRSQAGHWTAATRTYLLHLLGCTLFANKSATNVHVVYLEALRDLSMTERYAWGVTALCWIYEHFPSVADSTADQEYDECHTLISSGDLCLMTCDLSLVLVRCLAPIIRQFVKFQDMPENQKILMHNPKIESKCFCNASVSDSVENLHRSSSFFTVLHPFFVRSSFFNGLPSLVTDVWGANTFPARKYNSRTFHLKVRRSRLFRFFRRFPQINVGGDSARIPFVEHASHESCVALPPKDRLRQRGFSVECLNRLRIPDVCWIPYGEHRSVRDFHVRSCYSGLLRWGPVAVYYQPERVVRQFGYTQTIPAPPVDSWVSYDDIHDRWMHYSDHIVPTGEVCVDVSSIGASRPRIFFINGFLCFLEDEWQRNGERKRERRRHFKEKMSLEEAHHHRRPWIRAWRKMEMNEGRGREEHEILYSK

SEQ ID NO: 203039 - protein, 421 aa, Glycine max
  Coding DNA Sequence Number=SeqID_86261
  Gene Ontology: Mol. function=signal transducer activity; Cellular component=integral to membrane
  Homolog annotation: Hit_ID=UPI0000D9DFFD; Match level="QueryCoverage =72%, HitCoverage=74%, E-value=3e-43, Identity=33%"; Hit description =PREDICTED: similar to Protein C9orf126 homolog, partial
MAATSTKKKKKKSSEAQRMKKKQEEESGRRSRSGNAGERESPALKARQAETTSFVVGKKMSSQQMQMQMQNSGGSSSISSNIPVSEVFWTLVDKADKKFSKIRDLPFYQRSRHDTYFYKVFKVYTQLWKFQQENRQKLIEAGLRRWEIGEIASRIGQLYFGQYMRTSDANYLSESYIFYEAILTREYFKEGEMVQQLVNQLKVLVDECKRTFQESDFKEWKLVVQEIVRFLKADTAFINIRPLRYSLVLDSHPDTLPHVAAAITKRHLKLQDAVLSSFHPNEVKYSELTIDTFRMLQCLEWEPSGSFFQSSSSKLSQNGATGTSRISYIQDIADPTLPANPRKAVLYRPSLTHFIAVLATICEELPSDGILLVYLSASGYCGSAQNESGCIHFGPRGDRGGKEKNRKIEKEGKREETELTG

SEQ ID NO: 203040 - protein, 108 aa, Glycine max
  Coding DNA Sequence Number=SeqID_86262
MDLLPDVEDLVEDQDTTRHQVPLSNNEDDSFQYETQSLFWTSDHNPEVTMAATPTKKVVDEVPKHDLQAEMPVTLAKHDSVEVFSYDNLSKQFLSAQLSATKKHFKNE

SEQ ID NO: 203041 - protein, 59 aa, Glycine max
  Coding DNA Sequence Number=SeqID_86263
MQVVNGTESRRRRRVEESTSAEEEKVFATAQKKKKRRTSSEKIKCLVAPNMLARFRMTL

SEQ ID NO: 203042 - protein, 526 aa, Glycine max
  Coding DNA Sequence Number=SeqID_86264
  Gene Ontology: Mol. function=glutamate-tRNA ligase activity; Cellular component=aminoacyl-tRNA synthetase multienzyme complex; Biological process=tRNA aminoacylation for protein translation
  Homolog annotation: Hit_ID=Q43794; Match level="QueryCoverage=85%, HitCoverage=76%, E-value=0.0, Identity=70%"; Hit description =Glutamyl-tRNA synthetase
  Pfam annotation: Domain name=tRNA-synt_1c; Domain location=41-329; Score=165.9; E_value=1e-46; Accession=PF00749.11; Description=tRNA synthetases class I (E and Q), catalytic domain
MGAVWFVKERAHETPDGEAVARNMQIGNRPDEGGGRKRRKKRWIRYNENKCPPEEGWRAKGLTRDRPGVGGDYGPYRQSDRNSLYKQFADNLHQSGHVYRCFCSNEELEKMKEDAKLKQLPPVYTGKWASATNEEVEEELAKGTPYTYREGCCTQPYPCICKEAVSGFEPMTNKSPRHNFTAAPGLRWKIDLGGLGMSNGQPVYNFCVTVDDATMAISHVIRAEEHLPNTLRQALIYKALGFPMPYFAHVSLILAPDRSKLSKRHGATSVGQFREMGYLPEAMVNYLALLGWGDGTENEFFTLDQLVEKFTIERVNKSGAIFDSTKLRWMNGQHLRARPSEELTKLIGEYWKTSGLLTVSDGSFIDEAVQLLKDGIDLINDADKALANLLSYPVYSTLQSDEAESVLQDNLSEFAASLLAAYDSGDLVAALEEGHAGWQKWVKGFGKLLKRKGKSLFMPLRLLLTGKIHGPDMGASVVLLYKAGTSNAVAPDAGFVTLDERFKILGQINWETLSKDQTVKETADPV

SEQ ID NO: 203043 - protein, 1382 aa, Glycine max
  Coding DNA Sequence Number=SeqID_86265
  Pfam annotation: Domain name=Exo_endo_phos; Domain location=732-977; Score=39.1; E_value=1.6e-08; Accession=PF03372.13; Description =EndonucleaseExonucleasephosphatase family
  Pfam annotation: Domain name=RRM_1; Domain location=71-141; Score =33.5; E_value=7.4e-07; Accession=PF00076.12; Description=RNA recognition motif. (a.k.a. RRM, R
  Pfam module annotation: Pfam domain module=Exo_endo_phos::RRM_1; Domain location=732-977::71-141
MRDRARGRGRGSERERERNIGWERVRYRHQPAENNRERSKGNFRRVDPGNSGRNQQNSISNWRDKKDITSFYFTRFSDDITKKELWHHFRKWGDVREVFIPNRRNNNGRRYGFVRFKGVKDAYHLAKQLDSLIIGGLKLYVNIPRYNRERPGQRASGNKLQDQDENIQAAAVRLEKPQHTNQGSYAEVLRRNIGPKGPRLPYNSQSQAHPTPISSIYLSIEPDDTNWLKDAWVGRLTNPAMFNRVEEELLWETGLDVSPKYIGDDLILLLGLTDSGAEQLMNSGQHGGESMFYSMEKWNPSIRTGFRLTWVQVWGIPLQAWHTKHLRQILAALGDMVDVDDDTEEKRRLDRARVLLKTPSRPTINCTVDVYISGECFKVVVVEETGGGSHDCRRRCCSFNGSSDEVASDASSLGNVTPRTTVSGDHEDNAWLLPAQACGTDGHDRAGTTEPETRGTCADDRQTLLLPSGHRECSYPLDKAAILRVTGLDTAASAEPYPTAIDDHDTQTRNGVVQCLGDGTAAGEGKDYPSKGKCGEGENIGTANVMKEKAKVFAEVAVISNVASAQQLDITNIKEAHMAVTEIEGHQEMDMYNIKEGGPNNKERFTNCTPLKQNQITGPLLHNNKGEYDTSCKVYSRKKWHQKKGVVGQPVPITASPIRLDTSQTQHSQGTLQEEHATSNQKESTAEKALLNEGTDKILELLNAQEAVDIWNRATKLGTTGGDVSYPVIAKLKEMEVRDKKEAERLGDSRGGLGRGVKWASIRRLIKKENVDMICIQETKRELIDKTMCQSLWGDTDVGWEAQPAVNTAGGILCLWSEQNFRLQMRIVGSGFIFLRGEWLREAQQVSILTIYSPCEIQHKRILWEQVRQLKQSLSGDLWCILGDFNSIREPAERFGICQRGVGLNDIKEFNDWIDDLELVEASWLGRNFTWFRPNGTARSKLDRFLLSPEWLHRWPASIRFTLPRNFSDHCPVMLRSSSIDWGPKPFRILDCWLSEKSFKETVISCWTSNQQPGWGSYVLKEKIKRLKQKLKTWNMEQFGDTLRKVKTIEEQLNKLEEDTSQRQPSIQEKQKLKQLQEALWTAAQAHESLLRQKARIKWIKQGDCNSRYFHLMLNANRRNNYLKGVMVGGTWCHDPPKVKEEVREFFSQRFQESDYHRPRLDGICFQKIGQHHNNRLNSRFQEGEIKQAVWDCGSDKSPGPDGLNFNFIKQFWQLLKPDILRFLDEFYVHGVFPRGCNASFIALIPKVADPQFLNDYRPISLIGCMYKIVAKLLANRMKKVMAAIVDETQSAFIEGRHLLHSVLIANEVIEEAKRTSKSCLIFKVDFEKAYDSVSWDFLLYMLDRTGFSPIWIKWIEGCLKSASISVLVNGSPRQSSSLKEG

SEQ ID NO: 203044 - protein, 234 aa, Glycine max
  Coding DNA Sequence Number=SeqID_86266
  Homolog annotation: Hit_ID=Q5N7G7; Match level="QueryCoverage=64%, HitCoverage=58%, E-value=5e-09, Identity=34%"; Hit description =Prolyl 4-hydroxylase alpha subunit-like
  Pfam annotation: Domain name=DUF584; Domain location=20-189; Score =148.0; E_value=2.5e-41; Accession=PF04520.4; Description=Protein of unknown function, DUF584
MADWNGFLNKSSGFGGGSMRNEDFDEGDVWGVAMERERNFLSPKLRVSKESSGSSSAWLLPTSPRKIPRTNSTTPNSLESDSSNVVQRSSAPMDIPDWSKIYGKRGVEEGVSNKKLDCGYGDHYGDDDDDDDDGEDEDDMIPPHEWIARKLARSQISSFSVCEGIGRTLKGRDLSKVRNAILTKTGPAAAELIIEHGKGGVAASEVLSGFVLDLGEWSALSVVTEFNSLQVFTS

SEQ ID NO: 203045 - protein, 168 aa, Glycine max
  Coding DNA Sequence Number=SeqID_86267
  Homolog annotation: Hit_ID=Q8S268; Match level="QueryCoverage=99%, HitCoverage=96%, E-value=1e-10, Identity=31%"; Hit description =Putative holocarboxylase synthetase
MAKKRKSIATSLHELDRTIYSSFSSAANSKRVDQELQLLIYSATFRLNELDYCGEEPCMSPRAPQHQQQSQPVMQVTGSGFPVTSGFSGQTIVGQGLRSEHCDKQSKNYVFSNASSNPVRQIGEGGYHPSGLSMGNVNRSIEPNLLHQQSRDSAAFSSNDSAMDMHAD

SEQ ID NO: 203046 - protein, 71 aa, Glycine max
  Coding DNA Sequence Number=SeqID_86268
RRMLKLKSKSISPASSYLNFAKRKNLHRKLQIEAIPTMKKWSLRKRSEETIKDATSKTRYALPLVIHFFCR

SEQ ID NO: 203047 - protein, 386 aa, Glycine max
  Coding DNA Sequence Number=SeqID_86269
  Gene Ontology: Mol. function=transferase activity, transferring glycosyl groups; Cellular component=chloroplast; Biological process =glucan biosynthetic process
  Homolog annotation: Hit_ID=Q9XGC0; Match level="QueryCoverage=85%, HitCoverage=28%, E-value=1e-166, Identity=84%"; Hit description =Starch synthase isoform SS III
  Pfam annotation: Domain name=Glyco_transf_5; Domain location=4-126; Score=-55.5; E_value=2.6e-07; Accession=PF08323.2; Description =Starch synthase catalytic domain
  Pfam annotation: Domain name=Glycos_transf_1; Domain location=169 -355; Score=-4.2; E_value=0.0033; Accession=PF00534.10; Description =Glycosyl transferases group 1
  Pfam module annotation: Pfam domain module=Glyco_transf_5::Glycos _transf_1; Domain location=4-126::169-355
MTAKVFSMVNKAGTGTIMVRLVLLLDSYRVIVITLIHSLRMQGCPTIPGKKLDVIHCHDWSSAPVAWLSKEQYRHCDLSKAGVVFTIHNLEFGAHFIGKAMEYTDKATTVSPSYSREVAGNPAIAPHLHKFQGIINGIDPDIWDPFNDEFIPVSYTSEYVVEGKKAAKEALQQRLGLRKADLPLLGVISRLTHQKGIHLIKHAISRTLERGGQVVLLGSAPDSSIQNDFVNLANQLHSLHHDRVRLCLVYDEPLSHLIYAGADFILVPSIFEPCGLTQLIAMRYGSVPIVRKTGGLYDTVFDVEHDRDRAQAQGLEPNGFSFDGADALGVDYALNRAISAWYENRHWFNTLCKTVMEQDWSWNRPALDYLELYHAAQKICKLVFDN

SEQ ID NO: 203048 - protein, 790 aa, Glycine max
  Coding DNA Sequence Number=SeqID_86270
  Subcellular localization annotation: CTP_CleavageSite=47; ConfidenceScore=5.73e-01
MPSNKPSSMPSNPNPRSSEIGNPMRRSFTGNPFSKPSIVPNHGAKTPANSPSADFSRRGSVGVRESGGSLRDSFDDKENGKDHILKPAKVRSPAVSSKGSKNFMSPTISASCKINESPRKKVLIERNEAVSSPADPKSHVRKVTFAEPLEENMIYGIIPNFEEGPRSSLSSEDLSGESETSEIHYMNVPLISKNDTDLSFESVNDVNVNVPLVLENDIYYTEPSFETEPDYDNLDPTFKLSPTSTHPVFKLSPTATPPVSLKATVVAPLDADPLMPPYDPKTNYLSPRPQFLHYKPKSRMELCRERELEDSFISGSFSDTEVTEDSQSEVSQKESEDASSDETVKEEEGEISELSPARRTLMPEESVEEKEVPKPRFTVRAKAVSLTLLLAVAFVSISVTVTDLPVIDRTVFEDFYKVYESSEFSGANFDLFNQFAKTNFDEIARNLQIWFTKLLSSTSEFISDVRGAHNLAKLQYYNLTIQHDYSMVDQYPIFGRGENEIGETHVPVWDADESDAASDIDSDEVVEGDILEEHYEVYEEQVQQDIATITGVENIMDAPESEEVLNMIESEQLAEAGNLEATIAQEAEANLNVENQPSLNSEVAEICVEAYESDTKQAQEKDAKLNVNEQSDISLDSDVAAVNDDVAKEKSVSIDAAIKGNEGRLGAIDIPPHVMLCLLLGAEKSSGPVEMDVLEDSSCPSEASSIQQSSFYSEKEVNEGHRLGPEKKRKNNYRRESLASSASDYSMGSPSYGSLTVYEKIPIKQGHGEEEIITPVRRSSRIRNQATSPS

SEQ ID NO: 203049 - protein, 1166 aa, Glycine max
  Coding DNA Sequence Number=SeqID_86271
  Gene Ontology: Mol. function=methyltransferase activity; Biological process=tRNA processing
  Homolog annotation: Hit_ID=Q8H4D4; Match level="QueryCoverage=88%, HitCoverage=99%, E-value=0.0, Identity=49%"; Hit description=MET -10+related protein-like
  Pfam annotation: Domain name=Kelch_1; Domain location=305-357; Score =0.2; E_value=3.6; Accession=PF01344.15; Description=Kelch motif
  Pfam annotation: Domain name=Kelch_1; Domain location=363-409; Score =39.2; E_value=1.4e-08; Accession=PF01344.15; Description=Kelch motif
  Pfam annotation: Domain name=Kelch_1; Domain location=414-459; Score =41.1; E_value=3.7e-09; Accession=PF01344.15; Description=Kelch motif
  Pfam annotation: Domain name=Kelch_1; Domain location=464-509; Score =36.4; E_value=1e-07; Accession=PF01344.15; Description=Kelch motif
  Pfam annotation: Domain name=Kelch_2; Domain location=305-357; Score =1.1; E_value=27; Accession=PF07646.5; Description=Kelch motif
  Pfam annotation: Domain name=Kelch_2; Domain location=363-409; Score =39.9; E_value=8.7e-09; Accession=PF07646.5; Description=Kelch motif
  Pfam annotation: Domain name=Kelch_2; Domain location=414-459; Score =44.9; E_value=2.7e-10; Accession=PF07646.5; Description=Kelch motif
  Pfam annotation: Domain name=Kelch_2; Domain location=464-509; Score =31.6; E_value=2.8e-06; Accession=PF07646.5; Description=Kelch motif
  Pfam annotation: Domain name=MTS; Domain location=886-1012; Score= -88.8; E_value=0.04; Accession=PF05175.4; Description=Methyltransferas e small domain
  Pfam annotation: Domain name=Met_10; Domain location=811-1013; Score =75.4; E_value=1.8e-19; Accession=PF02475.7; Description=Met-10+ like- protein
  Pfam annotation: Domain name=TYW3; Domain location=34-240; Score =104.8; E_value=2.6e-28; Accession=PF02676.5; Description=TYW3 like
  Pfam module annotation: Pfam domain module=Kelch_1::Kelch_1::Kelch _1::Kelch_1::Kelch_2::Kelch_2::Kelch_2::Kelch_2::MTS::Met_10::TYW3; Domain location=305-357::363-409::414-459::464-509::305-357::363 -409::414-459::...
  Pfam module annotation: Domain location=464-509::886-1012::811 -1013::34-240
MPLGQDFMRPMTRVQQNHLHLEERFWVGLEKKRMEFEKRKAATLASLSSTESDKSPKGSLDAAIVPLLNTLNQNPSYFTTSSCSGRISILAQPLSLSDSPNPKKKARGGTWLFVSHDPADPDSVLSLLFPSESTPSPFAPSELVFRFEPLIIALECRDLSSAHSLVSLAISCGFRESGITNAKKRFIIAIRCSIRMEVPLGDTRNVMVTPHYVRYLVQVANDKMEANRKRTQRFFQVLLSNGSVLADNSNHLSGTNEVCDHLELEGESQLENGNVGTSSGTVGSPGCGLSIGHFEIVGEPVEKLYRWGHSACGLGDADHKKVIVFGGFGGMGRHARRNDLLLLDPYSGNLDMVSTVGCASPSPRLGHTASLVGNRMFVIGGRTGPDKILSDVWILDTTKNSWNLLQCGDSGFPPRHRHAAAVMGSNIYVFGGLDNDIIFSSFYVFDTNNLHWKEIPVSGYWPCARHSHAMVASDSQIFMFGGYNGGKALGDLHSFDVQKGQWTKERTAGRNPHARFSHSIFLYKNYLGVLGGCPVRQHCQELALLDLKLRLWKHVTLNSVGKDLFVRSTANVVGDDLAIVGGGASCYAFGTKFSEPAKVSLLHLMHSHDEPVKTQRKRTSNQNEGTNRNNIENSCGPQLEHAPNISEDESSHSDDNIPCLNDQSQMIALHYVLQLEKKYAKLGKDILKKFGWLDLGRKAYSDEGGVHIGFPVHQEFFAVFHERNHNLGDAFDRQNEGLFSKPLKRDKFLLNELSCSEALILLHEYGAIVLGDKVVEERKAAKSPLKVMTEAITSLIEHKGLPARLLEELPTRWDQLGDIVLLPSTSFKDSMWDSIAEELWSIVAKSLKAHRLARQGPVAATGTRDSTLQILVGDNGWVNHRENGILYSFDATKCMFSWGNLSEKIRMARLDCKDEVVVDLFAGIGYFVLPFLVRAQAKLVYACEWNPHAVEALQHNLEANSVADRCIILEGDNRITAPKSVADRVCLGLIPSSELSWVTAVRALRREGGILHVHGNTRDSEESQWIDHVSKSIYDIARSEGYTWEVSIEHVERVKWYAPHIRHVVADYKEGGLQFLLHKAIQMTINASNLKQANLNSFVWTYKTLLYIYMWMMGHGIWGFHLGVYGVNPLLILSVGGDRGLHEPTRSQLQQPQPSSFLQDDTKSRN

SEQ ID NO: 203050 - protein, 170 aa, Glycine max
  Coding DNA Sequence Number=SeqID_86272
  Gene Ontology: Mol. function=DNA binding; Cellular component =membrane; Biological process=DNA integration
  Homolog annotation: Hit_ID=Q1SAZ0; Match level="QueryCoverage=33%, HitCoverage=3%, E-value=1e-13, Identity=59%"; Hit description =Integrase, catalytic region
MVIASNSETEKHVLREKLATQFEMKEFSMYFLGIEVAYSRKVPIEQNHKIGSEEKSPTVEKSQYQDRWEISSIYTTLDQTLLMLKRIVIQKRMYIIRGSVYTCTLSPVILDDLKIKYEDPIRLFCDNPAISIAHNPVQHEKTKHIEIDKHFIKEKLDNDHIATAYIPLWL

SEQ ID NO: 203051 - protein, 90 aa, Glycine max
  Coding DNA Sequence Number=SeqID_86273
MYRSPTGNLVPLDLEIEATLRRNTTKRRRKLLQDKTVASILEEEAHSSDSTSSDSPSSRESMTYLPEVVIMADEHQQRVTLEDYSSSSVP

SEQ ID NO: 203052 - protein, 117 aa, Glycine max
  Coding DNA Sequence Number=SeqID_86274
MKTLRFEHRSLVKHLKYKSIVALVMGYDEGGWWRLGHRQLHERLWMTSGVVGAKVVRRHAAMLVGVAPNLLKAQRCMCLEVESDLEVEAACNVRGGWWGWCVMSMEWGKLHHQLTEK

SEQ ID NO: 203053 - protein, 396 aa, Glycine max
  Coding DNA Sequence Number=SeqID_86275
GVSSLSSFSIPLPFIFQEAKESIDEEDPRPTSSNGACISSEDHPPKQSRVRGHLVKIDVDSLNTFLETLMVLAEGETLPAYSRYCRLPTDYREIEAALCIPGRGFILNSEGHLGNILRKDLTALAQVWSVLSYSNLASTSHTFDLTVDRARLIFGLVSRMDMNIGALISGQMTSIAQSYTSRLGFPALITALCRARGVVSDSLTFERLSPVINLVYIRKNYWNPEDLIVSIRGARRVRARPTELPSTLVAPAPASTSAAPSVAALPGSIPSFEQFRELVAWLGTQCSLHREDECPIAQVPHHMEDESSEATIPKLFTAEEEVGDTQKAQVATATPKRSSEAISEPPTLAVDPSSPQHAADPSTTVLEIPKDQTTPVLTLDTSPSATLVLHLTDEED

SEQ ID NO: 203054 - protein, 504 aa, Glycine max
  Coding DNA Sequence Number=SeqID_86276
  Gene Ontology: Mol. function=transferase activity, transferring phosphorus-containing groups; Cellular component=integral to membrane; Biological process=two-component signal transduction system (phosphorelay)
  Homolog annotation: Hit_ID=UPI00005F7CA6; Match level="QueryCoverage =89%, HitCoverage=94%, E-value=1e-171, Identity=67%"; Hit description= COG0642: Signal transduction histidine kinase
  Pfam annotation: Domain name=HAMP; Domain location=201-269; Score =48.6; E_value=2.1e-11; Accession=PF00672.15; Description=HAMP domain
  Pfam annotation: Domain name=HATPase_c; Domain location=381-490; Score=105.9; E_value=1.2e-28; Accession=PF02518.16; Description =Histidine kinase-, DNA gyrase B-, and HSP90-like ATPase
  Pfam annotation: Domain name=HisKA; Domain location=272-337; Score =62.3; E_value=1.6e-15; Accession=PF00512.15; Description=His Kinase A (phosphoacceptor) domain
  Pfam module annotation: Pfam domain module=HAMP::HATPase_c::HisKA; Domain location=201-269::381-490::272-337
MESVWAQAEESLDRTVDTHIKTLRAKLRAVEPAVAGYFVLSIFVQEVKPGVRRATEGTLVDTANLLAQIARQDMQRGDAAHGQLAQAFTQLNQRPIGANISGIRKDRSEYHVYLTDAQGRVIFDSAGRAQGQDYSRWNDVYRTLRGQYGARSTRSDPQDENSSVMYVAAPVIEQGRIIGVLTVGKPNSTMAPVIKRSERRILWAGALLLGIALLIGAVFVWWINRSIGRLVRYADGVAQGENAPLPKVGGRELTQLAQALESMRLKLEGKAYIEQYAHALTHELKSPLAAIRGAAELLQELPPPETARRFLTNIEQQSARIQQLVDKLLVQARLESRPEMETAPIAIAALIDQTVAGKEAQATQRGVRLRLEALAEVTLNGDALLISQALTNLLDNAIDFTPPGGCVSVRGERREQHYCISVCDDGSGIPDYAFDKVFERFYSLPRAERPKSSGLGLNFVQEVARLHHGGIHLRNRRPHGVEATSEHDEIGTFLENNHAAGIDG

SEQ ID NO: 203055 - protein, 43 aa, Glycine max
  Coding DNA Sequence Number=SeqID_86277
SHEEEYLYLRACHSVWNSLETQADHPGGGELPMHDRVTSTLTA

SEQ ID NO: 203056 - protein, 168 aa, Glycine max
  Coding DNA Sequence Number=SeqID_86278
  Gene Ontology: Mol. function=threonine-tRNA ligase activity; Cellular component=soluble fraction; Biological process=tRNA aminoacylation for protein translation
  Homolog annotation: Hit_ID=Q6ER90; Match level="QueryCoverage=96%, HitCoverage=40%, E-value=4e-44, Identity=71%"; Hit description =Putative threonyl-tRNA synthetase
  Pfam annotation: Domain name=tRNA-synt_2b; Domain location=1-117; Score=-48.9; E_value=0.045; Accession=PF00587.15; Description=tRNA synthetase class II core domain (G, H, P, S and T)
MLQRIYGTAWENAEQLKAYLHFKGEAKHRDHRCLGQDLDLFSMQDDAGRGLVFWHPKGAMDDAHIFCLDDQIKDEIRGVLDLIEEILLQFGFDKYEVNLSTRLEKAMGDDDIWEKATTALKDALDDKGWTYPNDDGGGAFYGPKIDIKIEDALGMKWQCSTIQTILYS

SEQ ID NO: 203057 - protein, 113 aa, Glycine max
  Coding DNA Sequence Number=SeqID_86279
  Gene Ontology: Mol. function=binding
  Homolog annotation: Hit_ID=Q44415; Match level="QueryCoverage=100%, HitCoverage=9%, E-value=4e-34, Identity=62%"; Hit description=CelE protein
MGLTDHAAVSATKSRMDRPRATELQVSILADRAVSAFQSKRYAETLLLLDQRARLADERADLMVLRGYSYLAMRRYGEAAQIFESLASIGNRDGIRGLAAVRAARPSNGPQGG

SEQ ID NO: 203058 - protein, 377 aa, Glycine max
  Coding DNA Sequence Number=SeqID_86280
  Gene Ontology: Mol. function=protein dimerization activity; Cellular component=endoplasmic reticulum; Biological process=proteolysis
  Homolog annotation: Hit_ID=Q44415; Match level="QueryCoverage=96%, HitCoverage=30%, E-value=1e-166, Identity=81%"; Hit description=CelE protein
  Pfam annotation: Domain name=M20_dimer; Domain location=169-276; Score=22.6; E_value=0.001; Accession=PF07687.4; Description =Peptidase dimerisation domain
  Pfam annotation: Domain name=Peptidase_M20; Domain location=63-372; Score=144.0; E_value=4.2e-40; Accession=PF01546.18; Description =Peptidase family M20M25M40
  Pfam module annotation: Pfam domain module=M20_dimer::Peptidase_M20; Domain location=169-276::63-372
MLDLIELRHDLHRHPEISGEEKETARRVRAFLEQAPPDRLLAGLGGHGVAAVYDSGRSGPSVLIRSEIDALPIREKGEVEYRSSVDGKGHLCGHDGHSTILTALALGLARQRPETGRVILLFQPAEETGAGAAAVIADPRFAEIKPDYSFSLHNLPGLPFGHVSVVEGPVNCASRGIKITLAGKTAHASSPEHGISPMRAIARLMPSLSDLGSGFPPAPDFSMVTITHAIMGEAAFGISPADAEIWATLRTLTDDRMENLCNAAETLAKRVADEEGLTLDITYDDIFLHCENAPDAVDHIRQALDDEKISHGSEGLPMRASEDFGRFRGVSSSAMFFLGAGRDYPNLHNPDYDFPDALIGIGARIFMRLIRNLTDGK

SEQ ID NO: 203059 - protein, 302 aa, Glycine max
  Coding DNA Sequence Number=SeqID_86281
MTRVREQEVRGDSANVVAEISAELERERKKNEELMERISMLEAQLRERNKESQENHQYAVVRSIKNFKRQKIQMVDDEKNTVKSEPASEYKPGTKGIVPKEIDPPKHLVNWMSMDDGQNLYAEKFKDCDSVADFNETYGDDVCDDNFDDDTNNNRRHEENDFTNETVSAQKDYLADHVDEESNATCMGTFSGDPASNVRQEDHENQKTGCILLAPLSKKSEVKAHQDQGKEIKETATFTAPLDVPSSGSVRISQNRKPLKVAFCPKEVKRIIESEALLQKKCSVPHYKENHSFCITWHKARM

SEQ ID NO: 203060 - protein, 73 aa, Glycine max
  Coding DNA Sequence Number=SeqID_86282
MQRRPEGRRVCCKEPLAREEEIVEAKRTRKKNRFSFISMDMDDEMDDIGLRQLRHQAKVVCFAPFYRYSMTLT

SEQ ID NO: 203061 - protein, 507 aa, Glycine max
  Coding DNA Sequence Number=SeqID_86283
  Gene Ontology: Mol. function=RNA-directed DNA polymerase activity; Cellular component=nucleus; Biological process=RNA-dependent DNA replication
  Subcellular localization annotation: CTP_CleavageSite=49; ConfidenceScore=5.06e-01
MTEFTLHSSLPCQNAAIPIVNIPFSHHSVNMMSRALWPYFYMANGANPRRSSMWEPIFRKFEAKLNIWNQRKVSMAGRTTLINSVLTALPLFYLSFFRAPPAVIKRLTSIQRNFLWGGGAERKKIAWVAWDQVCMPRDKGGLGIKAIKDFNRALLIKWKWHLFQQSDQFWNRILLSKYNGWRGLEEATHKQHHSFWWSDLKSVMLHSSMAGVLNQFQWRLGRGDQILFWEDSWLRDGRTLRDKYPDLYQITSHKSQLVGNMGFFGEEGWQWQFSWRRNLFDNELGSASEFIDQISAISPIADMKDCWVWGADPKGTFTTSSAYLCIKGDQPSLALNHDFNQLWEVKAPPRALTLVWRLLWDRLPTKENLLKRQVPLDNDLCPFCQNHVESASHLFFTCIKIMPLWWEFNSWVKEARVLHCRPVDNFTQHFSLAVSKASNRKWRVWWIAAIVSIWYYRNDMIFNNQQFSISKLVDIAILRSWSWLRGWEKGFAVPFQQWSSSMSLAFT

SEQ ID NO: 203062 - protein, 129 aa, Glycine max
  Coding DNA Sequence Number=SeqID_86284
  Gene Ontology: Mol. function=carboxypeptidase A activity; Biological process=proteolysis
  Homolog annotation: Hit_ID=Q1S2R2; Match level="QueryCoverage=79%, HitCoverage=21%, E-value=3e-48, Identity=89%"; Hit description =Peptidase M14, carboxypeptidase A; Carboxypeptidase regulatory region
MKKAGFGRGLPILWRYNKMSMLNLVASLVKTGVHGRIYSSGDGRPLPGSITVSGINYTVRAGKTFGDYHRILAPRDKYEVVATMPGYKSKNTTIWLDEGPVTLDFVLDPEKSKSQNFHKQTVSGGKKNC

SEQ ID NO: 203063 - protein, 95 aa, Glycine max
  Coding DNA Sequence Number=SeqID_86285
MGPLRASPDANGKATDVRISKKELAELLEKQQVHVNNKKQVGRASSEQVLLRLIKARRHHDSRHGFWRPDLESIPEDLLRISVNRLRRSFAPVIV

SEQ ID NO: 203064 - protein, 80 aa, Glycine max
  Coding DNA Sequence Number=SeqID_86286
MENEAQDMLILTLKIGQLAYPDKCIMLIRNIVELLKARKTNQLTPNVWRSFLSYPFVNLNSFVNIISKRNLEFANDKGGS

SEQ ID NO: 203065 - protein, 430 aa, Glycine max
  Coding DNA Sequence Number=SeqID_86287
  Homolog annotation: Hit_ID=Q9FLX2; Match level="QueryCoverage=79%, HitCoverage=86%, E-value=2e-23, Identity=27%"; Hit description =Arabidopsis thaliana genomic DNA, chromosome 5, P1 clone:MXC20
  Subcellular localization annotation: CTP_CleavageSite=55; ConfidenceScore=5.30e-01
MNQQNQGSGPPSNVPMKRKRGRPRKEESVVQRTNVPVMPGYNNVLNSNQTAGTTDDEMVGKEVTGVIDGTFKTGYLLSVKVADTDAFLKGLVFLPEQVPPLTVENDVAPHVKMIERKEIPIPVVNPQAEIHGSVPSTVQCNKQSFEPELQQVPMSEEQVLPTEIHSGISSLLENQSASTLIPNSISSEEIPQGTQEPGHVNQSTIMSELDHDKTVKQSETLHELDASTQVKESSADGGETKVSEATSELINLVPPIDNANKELGTGQQAVPYAHQLNEPNTSNIESNLIPVSAEPEALPCEQTAKTVFVEKQELPKTDVLEDTKTKLASETSSNVDTSNSNGKPSSVVNIPVVGSNHKLETSQPEAMPSEQIGKSVPSESKFSSDGHDLWGKSEDPQNCSSFGDINKVDFNQPTESLAKSMESEQIGSDT

SEQ ID NO: 203066 - protein, 149 aa, Glycine max
  Coding DNA Sequence Number=SeqID_86288
  Gene Ontology: Mol. function=nucleic acid binding; Cellular component= cytosol; Biological process=nuclear mRNA splicing, via spliceosome
  Homolog annotation: Hit_ID=Q2PEV8; Match level="QueryCoverage=91%, HitCoverage=32%, E-value=9e-44, Identity=64%"; Hit description =Putative DNA binding protein
  Pfam annotation: Domain name=RRM_1; Domain location=1-80; Score=53.0; E_value=9.8e-13; Accession=PF00076.12; Description=RNA recognition motif. (a.k.a. RRM, R
IFVGNLDPNVTDDHLRQVFGHYGELVHVKIPAGKRCGFVQFADRVLLLYHEVSFSCIRSCAEEALRVLNGTLLGGQNVRLSWGRSPSNKQAQPDANQWNGSGGGYYGYAQGGYENYGYAPAGQDPNMYGSYPGYANYQPPQQQQQIGYS

SEQ ID NO: 203067 - protein, 110 aa, Glycine max
  Coding DNA Sequence Number=SeqID_86289
MVFMGFLSAFDSDASLDVLDHPILDLIYFMEKQIKKKDPDKSLMAAVPMCVILSSCYLGRKIWIQVLYGIHAMTSLKNLSYSLQFGCCSVSGTSLSMTHLLQRHTKLIVS

SEQ ID NO: 203068 - protein, 1487 aa, Glycine max
  Coding DNA Sequence Number=SeqID_86290
  Gene Ontology: Mol. function=calmodulin binding; Cellular component =spindle pole; Biological process=negative regulation of asymmetric cell division
  Homolog annotation: Hit_ID=Q84Z28; Match level="QueryCoverage=93%, HitCoverage=93%, E-value=1e-129, Identity=34%"; Hit description =Abnormal spindle-like protein
  Pfam annotation: Domain name=Arm; Domain location=1325-1370; Score =34.4; E_value=4e-07; Accession=PF00514.13; Description=Armadillobeta- catenin-like repeat
  Pfam annotation: Domain name=CH; Domain location=393-504; Score=21.0; E_value=0.00084; Accession=PF00307.21; Description=Calponin homology (CH) domain
  Pfam annotation: Domain name=IQ; Domain location=1009-1029; Score =19.9; E_value=0.0094; Accession=PF00612.17; Description=IQ calmodulin-binding motif
  Pfam annotation: Domain name=IQ; Domain location=1032-1052; Score =15.5; E_value=0.2; Accession=PF00612.17; Description=IQ calmodulin -binding motif
  Pfam annotation: Domain name=IQ; Domain location=1058-1078; Score =21.0; E_value=0.0043; Accession=PF00612.17; Description=IQ calmodulin-binding motif
  Pfam annotation: Domain name=IQ; Domain location=1155-1175; Score =23.8; E_value=0.00061; Accession=PF00612.17; Description=IQ calmodulin-binding motif
  Pfam annotation: Domain name=IQ; Domain location=1205-1225; Score =11.3; E_value=2.6; Accession=PF00612.17; Description=IQ calmodulin -binding motif
  Pfam annotation: Domain name=IQ; Domain location=1226-1245; Score =17.4; E_value=0.053; Accession=PF00612.17; Description=IQ calmodulin- binding motif
  Pfam annotation: Domain name=IQ; Domain location=1248-1268; Score =27.5; E_value=4.6e-05; Accession=PF00612.17; Description=IQ calmodulin-binding motif
  Pfam annotation: Domain name=IQ; Domain location=751-771; Score=25.0; E_value=0.00027; Accession=PF00612.17; Description=IQ calmodulin -binding motif
  Pfam annotation: Domain name=IQ; Domain location=774-794; Score=5.7; E_value=10; Accession=PF00612.17; Description=IQ calmodulin-binding motif
  Pfam annotation: Domain name=IQ; Domain location=835-855; Score=12.1; E_value=2; Accession=PF00612.17; Description=IQ calmodulin-binding motif
  Pfam annotation: Domain name=IQ; Domain location=869-889; Score=19.0; E_value=0.017; Accession=PF00612.17; Description=IQ calmodulin -binding motif
  Pfam annotation: Domain name=IQ; Domain location=912-932; Score=11.7; E_value=2.4; Accession=PF00612.17; Description=IQ calmodulin-binding motif
  Pfam annotation: Domain name=IQ; Domain location=935-955; Score=17.1; E_value=0.065; Accession=PF00612.17; Description=IQ calmodulin -binding motif
  Pfam annotation: Domain name=IQ; Domain location=958-978; Score=21.5; E_value=0.0031; Accession=PF00612.17; Description=IQ calmodulin -binding motif
  Pfam annotation: Domain name=IQ; Domain location=984-1004; Score =22.3; E_value=0.0018; Accession=PF00612.17; Description=IQ calmodulin-binding motif
  Pfam module annotation: Pfam domain module=Arm::CH::IQ::IQ::IQ::IQ::IQ ::IQ::IQ::IQ::IQ::IQ::IQ::IQ::IQ::IQ::IQ; Domain location=1325 -1370::393-504::1009-1029::1032-1052::1058-1078::1155-1175::1205 -1225::1226-1245::...
  Pfam module annotation: Domain location=1248-1268::751-771::774 -794::835-855::869-889::912-932::935-955::958-978::984-1004
  Subcellular localization annotation: CTP_CleavageSite=66; ConfidenceScore=5.74e-01
MGCNEPPSPYPDSSSLLKDISNFTTPRRPPFSLTSAKSPATQFFTASKHSTSSSSSSFHRRPNKSSAAAAKKLKAFQLEQSQSSRKAQIKREHSLKSLAKSLSVWLNFLLQNPTSCGCHLSFSNAAPAPATNGKRDGPPGTSVVGVDSTWRTPKRQRKTWSTKENAATAEEVHDSSFSQLRDSLKDVCSFDDLKQRMRVYLSLTVCKEIFQQINRVTKTIDEGRLNMKAHCPIVTDVGLKEKATRILMCYNPIWLRIGLHILFGGESLVLNGDADSDQDVVFLKMVINKLFFSHENLAKAYAYNKMIEGVYRLGYYKNLGNVILKRILLLVLVLDKAKCQSYLPLEYGIDGLDGGSPLLFKPESWIKSSSQLIHEFLSSDVMHGEGNLLTHLVILGYKLSHQQEPIVEYDFRVKDLFVDLQDGLKLCRAIQLLQHNSSILMKIVVPSDTPKKKLANCGLVLQYIRHAGGSLLDEDGIMIVADDIVNGDKELTLSLLWNMFVHLQLPLLVDKTSLVGEISKIRGFGTDLINSTNSSSMELLLNWIQVVCNNYDFAIVNFHSLVDGKAIWCLLDYYFQKELHNSSSLKEVNKKSGKASIMSVNEYSDALYNFILSQKLTRLLGNFPEVLQVSELLQYNGACSDRSVVILLVFLANQLFVKKNLDHLNFHKLLGYDFQSPNHRHLRMLQCLSNSESIQKPDASDVHGNEDAASKFKAIQAWWQDMAERNCINKPAVSNLQRSTTTECSTNIRRENAAITIQLHFRGLVARRKFLKMVNAVTLLQTGFRAWLKVKQGSVCMILSTVQVCDSSCEILKQSETYKRYAMLFIHRHSFLKLKRSAQLIQQAVRSWLYRRHQQECSTSPDLMISDMVAAAITVQKFVHGWLARSRYIHQLDQKEKALNYSQQKVTFDLQTNAAIIIQLAWKKFICCKSTQKQHLFATKIQQNFRRWLLRKSFLNQIQAVIKIQSYFRMWRSVNAFQHFKIEYKAAVAIQSYLRGWFARKNACVRMNHLFATKIQRNFRTWLLRKSFLNQIQAIIKIQSYFRMRRCVIAFKHFKIEFKAAVVIQSFLRCWFARKDACARRNHIVEIQALPWLASEAGLLVPKRCCSKDPVCHSKLEVPEGPQLPERCRFGDSTLYKGAFNSESAISLSTAICQEDAALVIQRYIRGHLIRNRNLGGASNLSEVVPADYISRPFGCRSFQLELFLLSVVKLQRWWKGLLLQKLMTKSAIVIQSCTRGWIARRKATVQKHRIIVIQSYWKGYLARKEPKEQLLDLRLRMQKSARNVDDSKRLINRLLAALSELLNMKSLSNILHTCSTLDMATGHSQKCCEELVAAGAIDTLLQLIQTISRSIPDQEVLKHALSTLRNLARYPHLLQVLIQSRSSVQIIVLELLRNKNEGYFVASELLKKICSTRIGIERIFKSPALLKRLHGLVEDLTRKGIYEKRNPRAPSLAIRKDRERRLKEAAEILKLITTPDFFSSSSDVKL

SEQ ID NO: 203069 - protein, 298 aa, Glycine max
  Coding DNA Sequence Number=SeqID_86291
  Gene Ontology: Mol. function=hydrolase activity, hydrolyzing O -glycosyl compounds; Cellular component=cellulose and pectin -containing cell wall; Biological process=carbohydrate metabolic process
  Homolog annotation: Hit_ID=Q1RV93; Match level="QueryCoverage=88%, HitCoverage=57%, E-value=1e-104, Identity=60%"; Hit description =Glycoside hydrolase, family 1
  Pfam annotation: Domain name=Glyco_hydro_1; Domain location=1-262; Score=45.3; E_value=5.7e-21; Accession=PF00232.9; Description =Glycosyl hydrolase family 1
IFPPLRCSSKFGNCSEGDSEKEPFVAAHNMILSHAAAVDLYRNKYQTEQGGEIGIVLHCDSFEPLSNSTADKLATERAQSFSINWILDPILFGKYPKEMEMILGTTLPKFSSNDKAKLRQGLDFIGINHYASYYTPFDWLSVYPLGMKSILMYLKDRYNNTPMFITENGYGNLYDPDLTEEEYLNDFKRIEFMSGHLDNLMAAIREGADVRGYFAWSLLDNFEWLYGFSVRFGLHHVDFSTLKRTPKLSAIWYEHFIENYKLTDSIVPEHGREKGIWNKPTTQLRTLVSPEPRMNNLD

SEQ ID NO: 203070 - protein, 172 aa, Glycine max
  Coding DNA Sequence Number=SeqID_86292
  Gene Ontology: Cellular component=integral to membrane
  Homolog annotation: Hit_ID=Q402F0; Match level="QueryCoverage=76%, HitCoverage=56%, E-value=1e-52, Identity=63%"; Hit description =Tobamovirus multiplication 1 homolog 3
  Pfam annotation: Domain name=DUF1084; Domain location=6-172; Score =140.2; E_value=5.6e-39; Accession=PF06454.2; Description=Protein of unknown function (DUF1084)
MLQSKSGPQTHSVVDCLTQHGRCFLLPMRCLCSRLFHRFDSLVRIEVRVPEYGWTTQKIFHLMNFIVNGVRAVVFGLHKLVFLLHPKARGLPTDKLKIVYISVNAALYLIQVCIWIYLWINDNSVVEFIGESFIAVVSFMAALGFLIYGGRLFFMLRRFPIESKGRRKKLNE

SEQ ID NO: 203071 - protein, 96 aa, Glycine max
  Coding DNA Sequence Number=SeqID_86293
  Homolog annotation: Hit_ID=Q1SI42; Match level="QueryCoverage=70%, HitCoverage=18%, E-value=4e-07, Identity=36%"; Hit description=F-box associated, putative
MPFPAIFFTATPLDHDLVMKNGGQVTSSPIESFDTDYMFLRGFGYDPSTDDYLVIQAYCDDNDDDTVRAEIFSLRANAWKEIETNILSYTNTDKFF

SEQ ID NO: 203072 - protein, 432 aa, Glycine max
  Coding DNA Sequence Number=SeqID_86294
  Gene Ontology: Mol. function=monooxygenase activity; Cellular component=membrane; Biological process=electron transport
  Homolog annotation: Hit_ID=Q1RV95; Match level="QueryCoverage=99%, HitCoverage=85%, E-value=0.0, Identity=76%"; Hit description=E-class P450, group I
  Pfam annotation: Domain name=p450; Domain location=1-429; Score =188.0; E_value=2.4e-53; Accession=PF00067.12; Description=Cytochrome P450
MQMGQRTLIIVSSAELIHEALIQRGPLFASRPKDSPIRLIFSVGKCAINSAEYGPLWRTLRKNFVTEMITPLRIKQCSWIRKWAMEAHMRRIQQEAREQGFVQVMSNCRLTICSILICICFGAKIEEKRIKSIESILKDVMLITLPKLPDFLPVFTPLFRRQVKEAEELRRRQVELLAPLIRSRKAYVEGNNSDMASPVGAAYVDSLFGLEVPGRGRLGEEELVTLVSEIISAGTDTSATALEWALLHLVMDQEIQERLYREIVGCVGKDGVVTESHVEKMPYLSAVVKETFRRHPPSHFVLSHAATEETKLGGYTVPKEASVEFYTAWLTEDPSMWEDPNEFRPERFMSGDGVDVDVTGTKGVRMMPFGVGRRICPAWTMGILHINMLLAKMVHAFHWLPNPNSPPDPTETFAFTVVMNNPLKPLIVPRSI

SEQ ID NO: 203073 - protein, 1406 aa, Glycine max
  Coding DNA Sequence Number=SeqID_86295
  Gene Ontology: Mol. function=protein binding; Biological process =lipid metabolic process
  Homolog annotation: Hit_ID=Q1RV98; Match level="QueryCoverage=92%, HitCoverage=99%, E-value=0.0, Identity=77%"; Hit description =Phospholipase, patatin family, putative
  Pfam annotation: Domain name=Arm; Domain location=356-397; Score =34.1; E_value=4.9e-07; Accession=PF00514.13; Description =Armadillobeta-catenin-like repeat
  Pfam annotation: Domain name=Arm; Domain location=398-439; Score =13.8; E_value=0.23; Accession=PF00514.13; Description=Armadillobeta -catenin-like repeat
  Pfam annotation: Domain name=LRR_1; Domain location=175-196; Score =8.5; E_value=7.2; Accession=PF00560.23; Description=Leucine Rich Repeat
  Pfam annotation: Domain name=LRR_1; Domain location=198-219; Score =17.8; E_value=0.039; Accession=PF00560.23; Description=Leucine Rich Repeat
  Pfam annotation: Domain name=LRR_1; Domain location=221-242; Score =12.8; E_value=1.1; Accession=PF00560.23; Description=Leucine Rich Repeat
  Pfam annotation: Domain name=LRR_1; Domain location=244-265; Score =9.6; E_value=4.5; Accession=PF00560.23; Description=Leucine Rich Repeat
  Pfam annotation: Domain name=LRR_1; Domain location=267-287; Score =10.3; E_value=3.4; Accession=PF00560.23; Description=Leucine Rich Repeat
  Pfam annotation: Domain name=Patatin; Domain location=502-745; Score =205.6; E_value=1.1e-58; Accession=PF01734.12; Description=Patatin -like phospholipase
  Pfam module annotation: Pfam domain module=Arm::Arm::LRR_1::LRR _1::LRR_1::LRR_1::LRR_1::Patatin; Domain location=356-397::398 -439::175-196::198-219::221-242::244-265::267-287::502-745
  Subcellular localization annotation: CTP_CleavageSite=65; ConfidenceScore=5.38e-01
MSWGLGWKRPSEIFHLTLSYGIDDPPENLARTSTSSRSSSSSSSSSSSSGSISSILSQDQDLGFRIELDWSASDDEDQVALKLQSQLMVALPMPQDTVVVELRPRDDDESVVDLGMKVVKRREPLRAVTMAKAVASGQQSDGTGILIRLLRSDLPSSMPPNVGDAVAGSGHHWTSLAALSLCGCGLSVLPVELTQLPHLEKLYLDNNRLTVLPPELGELRSLKVLRIDNNMLVSVPAELRQCMQLVELSLEHNKLVRPLLDFRAMAELRVLRLFGNPLEFLPEILPLHKLRHLSLANIRIVADENLRSVNVQIEMENSSYFGASRHKLSAVFSLIFRFSSCHHPLLASALGKIMQDQGNRVFVGKDENAVRQLISMISSDNCHVVEQACSALSSLASDDSVALHLMKADIMQPIGTVLKSAGLEEVQRLALLAVGNLAFSLENRRILVSSESLRELLLRLAVATEPRVYKAAARALAILGENENLRRAIKGRQVGKQGLRILSMDGGGMKGLATVQMLKEIEKGTGKRIHELFDLICGTSTGGMLAVALGIKLMTLEECEDIYKNLGKLVFADPVPKDNEAATWREKLDQLYKSSSQSFRVVVHGSKHSAEQFERLLKEMCADEDGDLMIDSAVKNVPKVFVVSTLVSMMPAQPFVFRNYQYPAGTPEVALVATSDGSGINVLASPIGEQVGYKRSAFIGSCKHQVWKAIRASSAAPYYLDDFSDDVNRWQDGAIVANNPTIFAIREAQLLWPDTKIDCLVSVGCGSVRTRVRKGGWRYLDTGQVLIESSCSVDRVEEALSTLLPMLPEIQYFRFNPVDERCDMELDETDPTIWLKLESAIEEYIQKNHHAFENVCDRLLLPFQHEEKWSENLRSKLPKTKESLEGADGPTLGWRRNVLLVEASHNPDSGRVIHHARELESFCARNGIRLSLMQGLSGIVKTVPSTTFPTPFQSPLFTGSFPSSPRMFSPDLGQRIGRIDLVPPLSLDGQLGKTIASPPMSPRGLRQLSFPVKSLHEKLQNSPQVGVIHLALQNDSDGLIVSYFCPCGWKPDAIVLLFSWHNDVFVVAEPGELAEKFLQNVKFSLLSTMRSHRRRGASLLANISTISDLVAFKPYFQIGGIVHRYLGRQTLVMEDDQEIASYMFRRTVPSMHLSPEDVRWMVGAWRDRIIICTGTYGPTHALIKAFLDSGAKAIVCSSSEPPESLSTTVDGYIELNVMENGKFEIGEDEADDENIPASPVSDWEDSDAERNVDHTFSFWDDDEEELSHFVCQLYDSLFREGASINVALQHALASYRRMSLTTPRSLQVQQVYTTTTLSCYTVKVALTTSHSTFAPVASSCHTNIKLSLHNAVKVTLTTSPSTFVSMSLPRCYRCGVRSSLHNAVEVGLTFTRTERHQSPSPFTSPF

SEQ ID NO: 203074 - protein, 351 aa, Glycine max
  Coding DNA Sequence Number=SeqID_86296
  Gene Ontology: Mol. function=transporter activity; Cellular component= integral to membrane; Biological process=transport
  Homolog annotation: Hit_ID=Q1RV90; Match level="QueryCoverage=87%, HitCoverage=86%, E-value=1e-135, Identity=81%"; Hit description=Tpt phosphate/phosphoenolpyruvate translocator, putative
  Pfam annotation: Domain name=DUF6; Domain location=79-204; Score =34.9; E_value=2.8e-07; Accession=PF00892.11; Description=Integral membrane protein DUF6
  Pfam annotation: Domain name=TPT; Domain location=213-345; Score =77.6; E_value=4e-20; Accession=PF03151.7; Description=Triose -phosphate Transporter family
  Pfam module annotation: Pfam domain module=DUF6::TPT; Domain location= 79-204::213-345
MMSLVKYTPLPLTSLLPLVMFQGLNSARYLLSTIRRRVPECRAYEADRSQPLELNIDEQAGIEATQRIKIGLYFATWWALNVAFNIYNKKVLNAFPYPWLTSTLSLAAGSLIMLISWANKVAELPKLDFEFWKALFPVAVLHTIGHVAATVSMSKVAVSFTHIIKSAEPAFSVLVSRFLLGEAFPVQVYLSLVPIIGGCALAAVTELNFNMIGFVGAMISNLAFVLRNIFSKKGMKGMSVSGMNYYACLPILSLLILTPFAIAVEGPKMWAAGWQTALSEIGPNFVWWVAAQSVFYHLYNQVSYMSLDQISPLTFSIGNTMKRIRPSMLLEPPLQFLVASSVHSVLKECRK

SEQ ID NO: 203075 - protein, 492 aa, Glycine max
  Coding DNA Sequence Number=SeqID_86297
  Gene Ontology: Mol. function=glucose-1-phosphate adenylyltransferase activity; Cellular component=chloroplast; Biological process =glycogen biosynthetic process
  Homolog annotation: Hit_ID=Q1RV88; Match level="QueryCoverage=100%, HitCoverage=93%, E-value=0.0, Identity=80%"; Hit description=Glucose- 1-phosphate adenylyltransferase, putative
  Pfam annotation: Domain name=Hexapep; Domain location=420-437; Score =5.0; E_value=36; Accession=PF00132.14; Description=Bacterial transferase hexapeptide (three rep
  Pfam annotation: Domain name=Hexapep; Domain location=473-490; Score =17.9; E_value=0.036; Accession=PF00132.14; Description=Bacterial transferase hexapeptide (three rep
  Pfam annotation: Domain name=NTP_transferase; Domain location=104 -372; Score=396.3; E_value=4.5e-116; Accession=PF00483.13; Description=Nucleotidyl transferase
  Pfam module annotation: Pfam domain module=Hexapep::Hexapep::NTP _transferase; Domain location=420-437::473-490::104-372
  Subcellular localization annotation: CTP_CleavageSite=21; ConfidenceScore=5.09e-01
MAASAGGQITLSSTVQLHGVTCNRNWKLVKFCNGEVMGRKLLLKNGGGSTKDFKRQQQHICMSLTADVSTESKCMQRFPPDEWEYGVVQLRDLDMERRNPRTVLAVILGGGAGTRLFPLTKRRAKPAVPIGGAYRLIDVPMSNCINSGINKVYILTQFNSASLNRHIARAYNSGNGVTFGDGYVEVLAATQTPGEAGKKWFQGTADAVRQFHWLFEDPRSKDIEDVLILSGDHLYRMDYMDFVQNHRESGADITLSCLPMDDSRASDFGLMKIDNKGRVLSFSEKPKGEELKAMDEAQKKPYIASMGVYVFKKEILLNLLRWRFPTANDFGSEVIPASAREFYMKAYLFNDYWEDIGTIRSFFEANLALTEHPPRFSFYDAAKPMYTSRRNLPPSKIDNSKIVDSIISHGSFLNNSFIEHSVVGIRSRINSNIHLKDTVMLGADYYETDAEVAALLAEGRVPIGIGENTKIKDCIIDKNARIGKNVVIANSE

SEQ ID NO: 203076 - protein, 53 aa, Glycine max
  Coding DNA Sequence Number=SeqID_86298
MWSTTSVARKGNEDEAVAREKRLVTLELEDMLRSENSEKECENNNGQMSDVEN

SEQ ID NO: 203077 - protein, 309 aa, Glycine max
  Coding DNA Sequence Number=SeqID_86299
  Gene Ontology: Mol. function=4 iron, 4 sulfur cluster binding; Cellular component=integral to membrane; Biological process=protein -chromophore linkage
  Homolog annotation: Hit_ID=P56767; Match level="QueryCoverage=99%, HitCoverage=46%, E-value=1e-162, Identity=82%"; Hit description =Photosystem I P700 chlorophyll a apoprotein A2
  Pfam annotation: Domain name=PsaA_PsaB; Domain location=1-309; Score =193.0; E_value=7e-55; Accession=PF00223.9; Description=Photosystem I psaApsaB protein
LGPFFTGQWNLYAQNPDSNSHIFGTPQGAGTAILTLLGGFHPQRRSLWLTDIAHHHLAIAFLFLVAGHMYRTNFGIGHGLALASLGVITSLVAQHMYSLPAYAFIAQDFTTQAALYTHHQYIAGFIMTGAFAHGAIFFIRDYNPEQNEDNVLARMLDHKEAIISHLSWASLFLGFHTLGLYVHNDVMLAFGTPETQILIEPIFAQWIQSAHGKTSYGFDILLSSTNSPAFNAGRSIWLPGWLNAVNENSNSLFLTIGPGDFLVHHAIALGLHTTTLILVKGALDARGSKLMPDKKDFGYSFPCDGPGRG

SEQ ID NO: 203078 - protein, 97 aa, Glycine max
  Coding DNA Sequence Number=SeqID_86300
MPHGLFPYKSHTLMPLRHFTEHLVGARLGVNSKRTGTMWHSTKRRSKYTNEKLESLGIEHLLGGDEQKRKTESKNAKKDDPRAANSSIPWGWLAQAS

SEQ ID NO: 203079 - protein, 116 aa, Glycine max
  Coding DNA Sequence Number=SeqID_86301
NHLGISACHLTSQVRINRNRLCRQSLVYLRTPPNFTESAKDDVNIRVSTGSLAAIDEGCRRQQIICADNHLGIFACHLTSWVRMAKSSPPEDADISGKDADDHVGLYLSIGLGVSE

SEQ ID NO: 203080 - protein, 197 aa, Glycine max
  Coding DNA Sequence Number=SeqID_86302
  Gene Ontology: Mol. function=chitin binding; Cellular component =extracellular region; Biological process=chitin metabolic process
  Homolog annotation: Hit_ID=UPI0000612705; Match level="QueryCoverage =76%, HitCoverage=92%, E-value=3e-18, Identity=29%"; Hit description =UPI0000612705 related cluster
  Subcellular localization annotation: CTP_CleavageSite=2; ConfidenceScore=5.14e-01
FRAPHVLAFRGLHAFTFRGLHVLSFRGLQVLAFRGLHVLTFRGPHVVTFRGLHVLAFRGLHVLAFRGLDVLTFRGLHVLAFRGLHALAFIGLHVLAFRGLHVIAFRGLHVLAFRGLHICAFRELKAGAGRDTTTAWGWPTAGNRRTAATPRAPQLIYKSWSVAYDPWPTSTRPSPKPKLSKSTRPVTDKSSHVRLKT

SEQ ID NO: 203081 - protein, 48 aa, Glycine max
  Coding DNA Sequence Number=SeqID_86303
  Gene Ontology: Mol. function=subtilase activity; Biological process =proteolysis
  Homolog annotation: Hit_ID=Q1SHG8; Match level="QueryCoverage=99%, HitCoverage=6%, E-value=1e-12, Identity=75%"; Hit description =Protease-associated PA; Proteinase inhibitor I9, subtilisin propeptide
MACPHVAGVAALLRGAHPEWSVAAIRSAIMTTSDMFDNTMGLIKDIGD

SEQ ID NO: 203082 - protein, 75 aa, Glycine max
  Coding DNA Sequence Number=SeqID_86304
MTRAYIQSSSNLLRFPFHVKILNKQRATKDVPSHVLFEQPSRCTLYLKRTTKDVPSLVFTITTKKLPVSYTKFSD

SEQ ID NO: 203083 - protein, 135 aa, Glycine max
  Coding DNA Sequence Number=SeqID_86305
  Gene Ontology: Mol. function=nucleic acid binding
  Homolog annotation: Hit_ID=Q5N8W4; Match level="QueryCoverage=54%, HitCoverage=24%, E-value=5e-31, Identity=83%"; Hit description =Putative RRM-containing protein SEB-4
  Pfam annotation: Domain name=RRM_1; Domain location=1-57; Score=17.2; E_value=0.0036; Accession=PF00076.12; Description=RNA recognition motif. (a.k.a. RRM, R
MKKYFEQFGEILEAVVITDKATGRCKGYGFVTFREPEASMRACVDPAPIINGRSANCNLASLGVQRSKPSTPKHAYLEPNTDSGSKTQLFNRSTHVDETKRTCHGLQRNREQQALMLTEKESAIEYMKKKRARTK

SEQ ID NO: 203084 - protein, 122 aa, Glycine max
  Coding DNA Sequence Number=SeqID_86306
  Gene Ontology: Mol. function=sequence-specific DNA binding; Cellular component=nucleus; Biological process=regulation of transcription, DNA-dependent
  Homolog annotation: Hit_ID=Q3Y4G8; Match level="QueryCoverage=91%, HitCoverage=45%, E-value=1e-54, Identity=97%"; Hit description=MADS -box protein
  Pfam annotation: Domain name=K-box; Domain location=13-111; Score =149.9; E_value=6.8e-42; Accession=PF01486.8; Description=K-box region
MLKTLERYQKCSYGAVEVSKPGKELESSYREYLKLKARFESLQRTQRNLLGEDLGPLNTKDLEQLERQLDSSLKQVRSTKTQFMLDQLADLQNKEHMLVEANRSLTMKVTNIIPFPTKFIPQ

SEQ ID NO: 203085 - protein, 73 aa, Glycine max
  Coding DNA Sequence Number=SeqID_86307
MTAEVEQEMRRLFGSEVLISKVYEHPVLADSARMGQHVFEYDADSAAAQDYMALYFELQDVIKQLPRPELIAA

SEQ ID NO: 203086 - protein, 215 aa, Glycine max
  Coding DNA Sequence Number=SeqID_86308
  Gene Ontology: Mol. function=magnesium ion transporter activity; Cellular component=membrane; Biological process=magnesium ion transport
  Homolog annotation: Hit_ID=Q5P1Z0; Match level="QueryCoverage=94%, HitCoverage=60%, E-value=1e-45, Identity=51%"; Hit description =Magnesium Mg(2+)/cobalt Co(2+) transport protein
  Pfam annotation: Domain name=CorA; Domain location=2-209; Score=67.1; E_value=5.8e-17; Accession=PF01544.9; Description=CorA-like Mg2+ transporter protein
MASGSLSQCANDCAKSRHITPKWARLLCYALLDSLMERYFQVFEAINEDAEQLENHLLDRTSPEDLQNIHRLKHVTIQLRRAVWPLREVLNSLIRNEHGFFNPQTVPYLRDLYDHTVHFTESLEAIRDTLSGLMDIYMTSLSQRVNLEVRALTVVAMLFMPATLIAGIFGMNFEQMPWLKDPDGFWWAILMMAMIALAMLLVFWRRQWLSSRGES

SEQ ID NO: 203087 - protein, 447 aa, Glycine max
  Coding DNA Sequence Number=SeqID_86309
  Gene Ontology: Mol. function=identical protein binding; Cellular component=cytoplasm; Biological process=negative regulation of enzyme activity
  Homolog annotation: Hit_ID=Q1SHG8; Match level="QueryCoverage=99%, HitCoverage=59%, E-value=1e-142, Identity=58%"; Hit description =Protease-associated PA; Proteinase inhibitor I9, subtilisin propeptide
  Pfam annotation: Domain name=Peptidase_S8; Domain location=121-393; Score=-47.8; E_value=0.00032; Accession=PF00082.12; Description =Subtilase family
  Pfam annotation: Domain name=Subtilisin_N; Domain location=28-118; Score=68.9; E_value=1.6e-17; Accession=PF05922.7; Description =Subtilisin N-terminal Region
  Pfam module annotation: Pfam domain module=Peptidase_S8::Subtilisin _N; Domain location=121-393::28-118
MTNTIRVCFYFSYITFLQLVSRILAQSENYIIHMDTSSMPKPFSSKHNWYLSTLSSALENTHVTNNDNILNTASSKLIYTYANAMNGFSANLSPKELEALKTSPGYISSTPDLQAKLDTTHSPQFLGLNPNKGAWPASKFGEDVIVGFVDSGVWPESESFKDEGMTQIPSRWKGQCESSIKCNKKLIGAQFFNKGLVAKYHYPATVENSTRDTEGHGTHTSSTAAGSQVENASFFGYADGTAKGVASMARIAVYKAVWQGQLFSSDLIAAIDSAISDGVDVLSLSIGFGDVLLYKDPVAIATFAAMERGIFVSTSAGNAGPERGTLHNGIPWVINVAAGTLDREFQGTLALGNGVNISGLSLYLGNFSTHQVPIVFLDLCDNLKNLAGSCGKIVVCEDKKGTLLDLVHAVGLSNVAGAAFISSSTDTSFFRENGSAAIIINPGNRET

SEQ ID NO: 203088 - protein, 141 aa, Glycine max
  Coding DNA Sequence Number=SeqID_86310
  Gene Ontology: Mol. function=identical protein binding; Biological process=negative regulation of enzyme activity
  Homolog annotation: Hit_ID=Q1SHG8; Match level="QueryCoverage=55%, HitCoverage=11%, E-value=6e-13, Identity=51%"; Hit description =Protease-associated PA; Proteinase inhibitor I9, subtilisin propeptide
MRTVTNVEEGEIIYTDSVTPLQGFNVTVIPSKLVFKEKNEKLISDKLRIEGAKIEVFGYYTRCTGKEVQAKKLTYTKTPPKEIKTRCKLQCDANRAKVEQGGYSTKISLKRIKKESFDEEHDGAWSWSFQHTHGHSKTTMF

SEQ ID NO: 203089 - protein, 294 aa, Glycine max
  Coding DNA Sequence Number=SeqID_86311
  Gene Ontology: Mol. function=identical protein binding; Cellular component=cytoplasm; Biological process=negative regulation of enzyme activity
  Homolog annotation: Hit_ID=Q1SHG8; Match level="QueryCoverage=65%, HitCoverage=25%, E-value=1e-62, Identity=64%"; Hit description =Protease-associated PA; Proteinase inhibitor I9, subtilisin propeptide
MTHRDHFDNTKEHIKDIATDYRPASPLAMGSGNVNPNKALDPGLVYDVQVQDYVNLLCALNFTQQNITIITRSSSNNCSNPSLDLNYPSFIAFYSGNASSNHESRVNNWEFQRTVTNVGEGRTTYTASVTFIKGFNVSVIPGKLAFKKKSERLSYKLRIEGPRIEGFGHLTWTDMKHVGTRPFSKNSDIDGPFMKFGEPKGVLDEHYHALRSTTVLEESDVVPYLKIRTWLFWNDHECAGMTMTMLRREENLLGNLIRDTGGVVIQPSVRDSWSWNLEPGPFSGLNLLLEAFVG

SEQ ID NO: 203090 - protein, 579 aa, Glycine max
  Coding DNA Sequence Number=SeqID_86312
  Gene Ontology: Mol. function=nucleic acid binding; Cellular component= chromatin; Biological process=DNA integration
  Homolog annotation: Hit_ID=Q1T010; Match level="QueryCoverage=73%, HitCoverage=34%, E-value=1e-109, Identity=42%"; Hit description =Peptidase S8 and S53, subtilisin, kexin, sedolisin; Integrase, catalytic region; Zinc ...
  Homolog annotation: Hit description=finger, CCHC-type; Peptidase aspartic, catalytic
  Pfam annotation: Domain name=rve; Domain location=352-508; Score =93.8; E_value=5.1e-25; Accession=PF00665.16; Description=Integrase core domain
MEENEKIADFFARVKVVTNQMATQGEILTDGKICEKITQSLLEKYDYILCAIEESKEVSEMSLEELQSSLEARKLLNKSYWLNLVTRIMVTVTEEEMVLEEEAVVGTIEEEMAMFLVVEEAKIMLKRNLISHREAGAEATIEVVAMVEEEVCYAKKDSQGDEANLAKGDDEENELVMLMVTTADETCSIDEWYLGIGCSTYMTGHKEWFVNFDSSKKNRIKFADGRAMLAEGVGIKMPNGTQYCMSCVFYVPGLESNLLSLGQLVEKGHKVIMEDKKLKLFDSCDKNSLIFDVSMSRNRTFRANLEALCHKCLAAVVSEDDWVWHHRYGHLNFRDLHDLNTHNMVRGLPLINVPKELCKNYAESKQHREPFKKFVETKAKEKLEVIYSDRKSEVLGVFKKFKRMVERQTGFLIKTIVTDGGGEYTSNEFDEFYELEGIGHDVTPPYTPQHNGAAERRNRTVMNMVRCMLNGKKLPKFLWAEAVSTAVYVLNRSPTKRLNKITPEEAWSGRKPVVSHFKIFGSICYKHVPDQLRKKLDSKSEIMILLGYHAIGGYKLFNPVTKEVLVSRDVVVDESKDWN

SEQ ID NO: 203091 - protein, 195 aa, Glycine max
  Coding DNA Sequence Number=SeqID_86313
  Gene Ontology: Mol. function=monooxygenase activity
  Homolog annotation: Hit_ID=Q8XRE6; Match level="QueryCoverage=66%, HitCoverage=40%, E-value=1e-34, Identity=53%"; Hit description =Putative bacterial luciferase-like oxidoreductase protein
RKLRGPVARGDAHHQPAARQLVDGGGGLGQVDRMAQRENGAAGGQRDRTGSGRQERQVGEGIEHLSGIAEAQVHQGHVPYPDGGKAEPVDLGHELRLPRQHLHVAVVEAQRQEHAEGELAGREHAAITRMGGERWRGSAGGDGYGGRRGSGADGRRGQGDATLDRRPGGDAFMPRAQMGVGAEIEADDAGDMGPA

SEQ ID NO: 203092 - protein, 154 aa, Glycine max
  Coding DNA Sequence Number=SeqID_86314
  Subcellular localization annotation: CTP_CleavageSite=36; ConfidenceScore=5.09e-01
MTPLPSLQNGQVTKSNRTNTLREFPERFAKDRIRFPASNVQSFEFGMIGPLNESISCFLIRVDPWVLVPSSIRGLHALAFRGLHVLVLTFRGLHILTFRGMHILTFRGLHALAFKGRHVLNFRELHALAFSGLRVLAFSGLHIHTLREFKVLFP

SEQ ID NO: 203093 - protein, 87 aa, Glycine max
  Coding DNA Sequence Number=SeqID_86315
  Gene Ontology: Mol. function=phospholipid binding; Cellular component= coated pit; Biological process=endocytosis
  Homolog annotation: Hit_ID=Q8LF20; Match level="QueryCoverage=79%, HitCoverage=10%, E-value=4e-18, Identity=61%"; Hit description =Putative clathrin assembly protein At2g25430
MFSIGSIFADNLAPNLEVLIVKATSHEQVPVDEKYVREILTLTSISRSYINASLITISERLNKMHDWITAIKALLLVHNSGCGGGRD

SEQ ID NO: 203094 - protein, 58 aa, Glycine max
  Coding DNA Sequence Number=SeqID_86316
MADGGWRKAKIPPYKHTIAPYGTTMVGLPSQIAYGESVKDLRDSGTPKRVSWGLDVGN

SEQ ID NO: 203095 - protein, 141 aa, Glycine max
  Coding DNA Sequence Number=SeqID_86317
MEVAAEVVQKLQPREASTVFIKTTKERMKYNKIENNKQFPSLLRHAFVKWWNQFDTTKAEQDKVKIWFKAHPEFLKAADLETSMFLNQKSKLTTFLARSKSKEHLTKNLKEVLQLLQDHKEGYSSSKKEDAKSTSTLDVFY

SEQ ID NO: 203096 - protein, 76 aa, Glycine max
  Coding DNA Sequence Number=SeqID_86318
MRLGTFLTCSTLSFCYANTALRGGGGGRVGDADAGVWLGEEGERGSGTGAAGLGTLKKCLFLRAYQTFTVAINVTT

SEQ ID NO: 203097 - protein, 107 aa, Glycine max
  Coding DNA Sequence Number=SeqID_86319
  Homolog annotation: Hit_ID=Q1S5H4; Match level="QueryCoverage=46%, HitCoverage=11%, E-value=5e-12, Identity=64%"; Hit description =Glycosyl hydrolases family 17, putative
MMTVKQGFCSLRGSLRFFAILTLLSFTYLSLKYSTPTPQVTKLSVENLNDAPVSEKEEKEGDHVSVELGLCHGAILGDGGDHVVGDCEEEGGVAVEEAAGDGRVDVF

SEQ ID NO: 203098 - protein, 81 aa, Glycine max
  Coding DNA Sequence Number=SeqID_86320
MALEQSLFKLKESIIGSHAVLTMKDGRTWQNAEIPPYEHPIAPYGTTMAGLPSKDYGGWQKICHAIPPRWHHGRYLTTLES

SEQ ID NO: 203099 - protein, 496 aa, Glycine max
  Coding DNA Sequence Number=SeqID_86321
  Gene Ontology: Mol. function=protein dimerization activity; Cellular component=cytoplasm; Biological process=proteolysis
  Homolog annotation: Hit_ID=Q1XTK5; Match level="QueryCoverage=95%, HitCoverage=98%, E-value=1e-162, Identity=60%"; Hit description =Peptidase M20C, Xaa-His dipeptidase
  Pfam annotation: Domain name=M20_dimer; Domain location=218-306; Score=38.7; E_value=2e-08; Accession=PF07687.4; Description =Peptidase dimerisation domain
  Pfam annotation: Domain name=Peptidase_M20; Domain location=86-492; Score=0.2; E_value=0.0016; Accession=PF01546.18; Description =Peptidase family M20M25M40
  Pfam module annotation: Pfam domain module=M20_dimer::Peptidase_M20; Domain location=218-306::86-492
MEADELLTKEIENDDYKISVKEPQIIWKNFSKLNAVPRPSKKEEKVIAFIKGFGESLGLPTTVDEVGNVIIKKPATAGMENRKSIVLQSHLDMVCQKNSDVNFDFDTEGIKMEVDGDWVRAKGTTLGADNGLGVATIMSILESSDIPHPDLEALFTIDEETGMTGALGLKPGQLTGQILLNLDTEEDDEIDIGCAGGIDVTITQNYELEAAKGQIVRIEIKGLQGGHSGMDIHKGFGNSNIILGRLLYSGLPKENVQLISIDGGGLRNAIPREAVAIISVRNANEFIEELTNGLKKEILEEFATVEPGLQINIENSTSSDKALSEEDSKKVILVLKSLHNGVYRMSPDVKDLVETSNNVARVELKGGNLKILNLSRSSVDSTKYAVAEQLKSVSELAGMQVEFSGSYPGWKPKPGSEIVQLMEKIYTEKFTEKPHVVACHAGLECGIIGANYPEMEMVSFGPTIRGAHSPDEKANIPSTQKFWSFLKEILANIPQK

SEQ ID NO: 203100 - protein, 251 aa, Glycine max
  Coding DNA Sequence Number=SeqID_86322
  Homolog annotation: Hit_ID=P00722; Match level="QueryCoverage=20%, HitCoverage=5%, E-value=2e-16, Identity=83%"; Hit description=Beta -galactosidase
MEDSIGKITKITFPSQEGPLLTVKNTLENGGFNRENNKDHISQSRGSALDGEEHIGEWRNPIGKITNITFPTHEGSALDGEEHIGEWRNPIGKIIKITFPSQDGPLLTVKNTLENGPLLTVKNTLENGGFNRENNKDHISQSRGSALDGEEHIGEWRNPIGKIKKITFPSQEGPLLTSGRHRGGAPIRPIVSRITIHWPSFYNVVTGKTLALPNLIALQHIPLSSAGVIAKRPAPIALPTVAHPEWRMGRA

SEQ ID NO: 203101 - protein, 254 aa, Glycine max
  Coding DNA Sequence Number=SeqID_86323
  Gene Ontology: Cellular component=membrane
  Homolog annotation: Hit_ID=Q2XEN1; Match level="QueryCoverage=86%, HitCoverage=59%, E-value=8e-38, Identity=43%"; Hit description =Membrane protein, putative
MAQHRGGSGNFAEDRERAAEAGRKGGKNSGGNFRNDPQRAAEAGEKGGRSRAKKYKNVRQSSILVRYVCFHFPPQPAYYASGAGTYFYHYGLGWHLSGGASRHGALGAILFCRAAFRYRLSAAGLFLSPLFASHYLAGNQSGRADWRGDCRWLRIANLGYANHFQQPVGVSHGALRAGGAAVAVAVSAPAAGPDGVAGHFAGVHRSGAGGGAARWQPDAECRRDRHAAQHPRHCRRDHSYQSLRQAGRCAPRDA

SEQ ID NO: 203102 - protein, 126 aa, Glycine max
  Coding DNA Sequence Number=SeqID_86324
MVILHLLSSRGGEPDDRRRQIMVIRTPFRHLETIESDGTQRQIMVILHLLSSRGGEPDDRRRQIMVIRTPFRHPKTIESDGTQRQIMVIMHLLSSRGGEPDAMQRQIVVIRAPFRHPGTIEFDGTQ

SEQ ID NO: 203103 - protein, 103 aa, Glycine max
  Coding DNA Sequence Number=SeqID_86325
MPYTTLNTNQDTNQGGNIPAKKPVEFTPILVSYAYLLPYLLDNSILAITPAKVPQPLFFRGYDSNTTCVYHCRNLPFGGRATRGLTGASSMGGRCTESPPTFI

SEQ ID NO: 203104 - protein, 304 aa, Glycine max
  Coding DNA Sequence Number=SeqID_86326
  Homolog annotation: Hit_ID=Q8ZP19; Match level="QueryCoverage=48%, HitCoverage=61%, E-value=1e-33, Identity=48%"; Hit description =Putative inner membrane protein
MAIPPTPRLATSAVILIPILERIASSIITHTTTRSRMPRITVNQRQEPAVGDGDAPAVRQIDKFQRDQQREDQQQQLTGAAQNLHQNAGEAHVALFAVVGDAVRDKTNNGAQQPKASFPLGRISLLGAGEKNVQGESIDYAGVARDAGGLLETIGLVARQPLQRKNHLLQLTLLHRFDGGKTEAKPRRDAGFVLAGHGAALADVQQLCGHFELAIFAQLNAQLFEGIATVKTFRQRLIQQHADAAKRQILQAKARGAAVRPLAVAVEYWFERRVDAKELPALNLPHQVGQRGGKGGQAVIIDAG

SEQ ID NO: 203105 - protein, 68 aa, Glycine max
  Coding DNA Sequence Number=SeqID_86327
MLQPCGIGTCLKEHSNRVIPKAYTPKSPLGLLPLDSDIAHELYNTYDLTLVFETCLTQLCYNLTLVPK

SEQ ID NO: 203106 - protein, 111 aa, Glycine max
  Coding DNA Sequence Number=SeqID_86328
HRIIINTTPRPIKGTFGNPSHEHYTPANPSFHHGNQLMDTPIMPAKRLAGVSSKKGKCAESPPKFIRGKRRKNRKGEKREVVAAQLAQASWVASTRRHCLLLEHPGRSKWA

SEQ ID NO: 203107 - protein, 107 aa, Glycine max
  Coding DNA Sequence Number=SeqID_86329
MGMDFVGDVGEVFVVDWAFSVGWASSRGEIQYWPSNYIGVGDIGTWDCEGFVRNLSMWVLWSRHGRLPPFSLLHLFQSSYCQNLLKQHNQIFPSLGSFTRKYQIHKT

SEQ ID NO: 203108 - protein, 53 aa, Glycine max
  Coding DNA Sequence Number=SeqID_86330
MGNMNEGSFWVMVSTTPTWVPTGARSRIRFPHNQGKELGRIRWRSLDHNPAFG

SEQ ID NO: 203109 - protein, 181 aa, Glycine max
  Coding DNA Sequence Number=SeqID_86331
MSEIEEVQEQMKANIEAMKDQITTMMKAMMSMRKIMKVNAVAVATTSVAVEVDPTHPFGINQVNRPVPDMVGQGGKALGSMGDPHLVQVPRKHPFPPYALPPNYAPPNVVHLPDENVDHSAPIPLESQQPQSGHAHVFQPMWETPKVPRDHTLADFEPHLGCASEGQAFGGVPQPNTLGAP

SEQ ID NO: 203110 - protein, 181 aa, Glycine max
  Coding DNA Sequence Number=SeqID_86332
  Homolog annotation: Hit_ID=Q1T1F7; Match level="QueryCoverage=90%, HitCoverage=39%, E-value=1e-15, Identity=42%"; Hit description=IMP dehydrogenase/GMP reductase
MTERYAWGVAALVLMYDQLNDASMSHNRQLGGYITLLQYWIYEYFPSVGDSIADQDYDEDSLRAWSAWTDSGFWMSVGSRMGSTDRSGTPTSDHAIPVSCAGGLLLFIIDQRGSCDNLDTRRPFLLLLSIHGCRMMIYMTGGVFVVPGQCSSDYMDWFFRISHPFMTPGHALDPLPDGHAP

SEQ ID NO: 203111 - protein, 160 aa, Glycine max
  Coding DNA Sequence Number=SeqID_86333
MHMPNENTNHVVPIEGQQPQLGHAPFAQPMGEAREEPWGHALGDFEPYPMFATKGSTCSGMPQPNAAGAPQPRLLKPLHFSVGSLPLAVEGREKLDLIEERLRVIEGIGDYPFVYMAELCLVPDISIPSKFKVSDFDKYKGTTCPKNHLKIYCRKMGAYS

SEQ ID NO: 203112 - protein, 77 aa, Glycine max
  Coding DNA Sequence Number=SeqID_86334
  Gene Ontology: Mol. function=oxidoreductase activity; Biological process=electron transport
  Homolog annotation: Hit_ID=Q9ZPX5; Match level="QueryCoverage=70%, HitCoverage=8%, E-value=1e-13, Identity=67%"; Hit description =Succinate dehydrogenase [ubiquinone] flavoprotein subunit 2, mitochondrial precursor
MVDHTYDVVIIGAGGVVLRVAIGILENGSNTACITKLFPTCSHTVAPQSWITLTLSPLPFMIHSCSTLHHYFGYMIL

SEQ ID NO: 203113 - protein, 72 aa, Glycine max
  Coding DNA Sequence Number=SeqID_86335
MHVVRHGHKKERFKPSFAKHTKTEGDQTCEEEERSDNDNNRHDNSSSSDDDREGATTRSDLLRKRIEVVAVA

SEQ ID NO: 203114 - protein, 668 aa, Glycine max
  Coding DNA Sequence Number=SeqID_86336
  Gene Ontology: Mol. function=protein-tyrosine kinase activity; Cellular component=integral to membrane; Biological process=protein amino acid phosphorylation
  Homolog annotation: Hit_ID=Q1RXR7; Match level="QueryCoverage=100%, HitCoverage=90%, E-value=0.0, Identity=39%"; Hit description =Tyrosine protein kinase, active site
  Pfam annotation: Domain name=LRR_1; Domain location=102-124; Score =15.4; E_value=0.21; Accession=PF00560.23; Description=Leucine Rich Repeat
  Pfam annotation: Domain name=LRR_1; Domain location=126-148; Score =17.2; E_value=0.058; Accession=PF00560.23; Description=Leucine Rich Repeat
  Pfam annotation: Domain name=LRR_1; Domain location=149-171; Score =7.4; E_value=12; Accession=PF00560.23; Description=Leucine Rich Repeat
  Pfam annotation: Domain name=LRR_1; Domain location=173-195; Score =15.2; E_value=0.25; Accession=PF00560.23; Description=Leucine Rich Repeat
  Pfam annotation: Domain name=LRR_1; Domain location=197-219; Score =12.1; E_value=1.6; Accession=PF00560.23; Description=Leucine Rich Repeat
  Pfam annotation: Domain name=LRR_1; Domain location=221-243; Score =11.6; E_value=1.9; Accession=PF00560.23; Description=Leucine Rich Repeat
  Pfam annotation: Domain name=LRR_1; Domain location=245-266; Score =13.6; E_value=0.71; Accession=PF00560.23; Description=Leucine Rich Repeat
  Pfam annotation: Domain name=LRR_1; Domain location=268-289; Score =13.4; E_value=0.86; Accession=PF00560.23; Description=Leucine Rich Repeat
  Pfam annotation: Domain name=LRR_1; Domain location=30-52; Score =10.5; E_value=3; Accession=PF00560.23; Description=Leucine Rich Repeat
  Pfam annotation: Domain name=LRR_1; Domain location=54-76; Score =10.2; E_value=3.5; Accession=PF00560.23; Description=Leucine Rich Repeat
  Pfam annotation: Domain name=LRR_1; Domain location=6-25; Score=6.5; E_value=17; Accession=PF00560.23; Description=Leucine Rich Repeat
  Pfam annotation: Domain name=LRR_1; Domain location=78-100; Score =10.2; E_value=3.6; Accession=PF00560.23; Description=Leucine Rich Repeat
  Pfam annotation: Domain name=Pkinase; Domain location=394-668; Score =138.0; E_value=2.5e-38; Accession=PF00069.15; Description=Protein kinase domain
  Pfam annotation: Domain name=Pkinase_Tyr; Domain location=394-668; Score=72.2; E_value=1.7e-18; Accession=PF07714.7; Description =Protein tyrosine kinase
  Pfam module annotation: Pfam domain module=LRR_1::LRR_1::LRR_1::LRR _1::LRR_1::LRR_1::LRR_1::LRR_1::LRR_1::LRR_1::LRR_1::LRR _1::Pkinase::Pkinase_Tyr; Domain location=102-124::126-148::149 -171::173-195::197-219::221-243::...
  Pfam module annotation: Domain location=245-266::268-289::30-52::54 -76::6-25::78-100::394-668::394-668
MNMLTALENLQLADNNFIGHLPQNICIGGTLKNFSASNNNFIGPIPVSLKNCSSLIRVRLQQNQLTGDITDAFGVLPNLDYIELSDNNFYGQLSPNWGKFRSLTSLMISNNNLSGVIPPELAGATKLQRLHLYSNHLTGNIPHDLCNLPLFDLSLDNNNLTGNVPKEIATMQKLQILKLGSNKLSGLIPKQLGNLLNLLNMSLSQNNFQGNIPSELGKLKFLTSLDLGGNSLRGTIPSMFGELKGLEALNVSHNNLSGNLSSFDDMTSLTSIDISYNQFEGPLPNILAFHNAKIEALRNNKGLCGNVTGLEPCSTSSGKSHNHMRKKVMIVILPLTLGILILALFAFGVSYHLCQTSTNKEDQATSIQTPNIFAIWSFDGKMVFENIIEATEDFDDKHLIGVGGQGCVYKAVLPTGQVVAVKKLHSVPNGEMLNLKAFTCEIQALTEIRHRNIVKLYGFCSHSQFSFLVCEFLENGSVEKTLKDDGQAMAFDWYKRVNVVKDVANALCYMHHECSPRIVHRDISSKNVLLDSEYVAHVSDFGTAKFLNPDSSNWTSFVGTFGYAAPELAYTMEVNEKCDVYSFGVLAREILIGKHPGDVISSLLGSSPSTLVASRLDHMALMDKLDQRLPHPTKPIGKEVASIAKIAMACLTESPRSRPTMEQVANEL

SEQ ID NO: 203115 - protein, 132 aa, Glycine max
  Coding DNA Sequence Number=SeqID_86337
  Gene Ontology: Mol. function=protein binding; Cellular component =integral to membrane; Biological process=protein amino acid phosphorylation
  Homolog annotation: Hit_ID=Q4G2V8; Match level="QueryCoverage=97%, HitCoverage=77%, E-value=3e-30, Identity=42%"; Hit description=Hcr2 -p3
MVKGIDPVSSLDCINNSLSFDKFSMVKGMDPESLFSSRNKESKLTKLPMEAGIAPESSLEDIDNTLSFDKFPMVKGMDPKSLFSSRSMKSKLTKLPMEAGIGSVSSLVDISNTLSFDKFPMVKGVDPESLFS

SEQ ID NO: 203116 - protein, 76 aa, Glycine max
  Coding DNA Sequence Number=SeqID_86338
MKREKHDFGCQGWISTSTKHLLLKQCQKKQQMHRREVLTSNSWDMHTYMQNIVKHEPESRDMHIKQDSRSVGSIYV

SEQ ID NO: 203117 - protein, 246 aa, Glycine max
  Coding DNA Sequence Number=SeqID_86339
  Homolog annotation: Hit_ID=Q9AVH2; Match level="QueryCoverage=68%, HitCoverage=100%, E-value=1e-47, Identity=44%"; Hit description =Putative senescence-associated protein
ERRIKATRAESQWIVAARPLCHLQYPVAYLSRLQRILPAARWELRFKASRRANPPHEGHQRHVPLGGRGPLLLVGKRTAGARVASSPDSDLEAFSHNPTHGSFAPLAFQPSAMTNSHVPYWWVNNPTLGEFCFTMIGRADIEGSKSNVAMNAWLPQASYPCAHLRTPALSLTDVPPQPNSPLTMSSARIDRPKPTLAPTYPTPLKSFHKVGLESSSTGSSFPADSAKPVPLAVVSLDSRQGQWESR

SEQ ID NO: 203118 - protein, 97 aa, Glycine max
  Coding DNA Sequence Number=SeqID_86340
  Gene Ontology: Mol. function=unspecific monooxygenase activity
  Homolog annotation: Hit_ID=O04892; Match level="QueryCoverage=98%, HitCoverage=23%, E-value=9e-22, Identity=54%"; Hit description =Cytochrome P450 like_TBP
  Subcellular localization annotation: CTP_CleavageSite=30; ConfidenceScore=5.38e-01
GSVTSGKGLALRAGHGGPSPEPVGCRWTARAASAARAGRRVPVGGRIGNGPFGASSPGVEQSTQNCALNVKVKKFNQARVNGGSNYDSLKVAKCLVI

SEQ ID NO: 203119 - protein, 393 aa, Glycine max
  Coding DNA Sequence Number=SeqID_86341
  Gene Ontology: Mol. function=DNA binding; Cellular component=nucleus; Biological process=regulation of transcription, DNA-dependent
  Homolog annotation: Hit_ID=Q84U53; Match level="QueryCoverage=64%, HitCoverage=65%, E-value=2e-90, Identity=65%"; Hit description=MYB1
  Pfam annotation: Domain name=Myb_DNA-binding; Domain location=14-61; Score=48.1; E_value=2.9e-11; Accession=PF00249.21; Description=Myb -like DNA-binding domain
  Pfam annotation: Domain name=Myb_DNA-binding; Domain location=67-112; Score=48.7; E_value=2e-11; Accession=PF00249.21; Description=Myb-like DNA-binding domain
  Pfam module annotation: Pfam domain module=Myb_DNA-binding::Myb_DNA -binding; Domain location=14-61::67-112
MGRSPCCEKEGLKKGPWTPEEDQKLMAYIEEFGHGSWRALPAKAGLQRCGKSCRLRWTNYLRPDIKRGKFSLQEEQTIIQLHALLGNRWSAIAAQLPKRTDNEIKNYWNTHLKKRLTRMGIDPTTHKPKTDALGGSGGGQTRDAANLSHMAQWESARLEAEARLVRESKLQVQNNLGSCSSTQPARLVLNKITTQQQPSLPPCLDILKAWQSSWNKPPQQPTTKENNTKIMHSMYAMMLSTDDTLESPTSTLCFPGTTTTTTMLPISNNIGLLFNENNNSNNNMYPLATTIDDGVFMKDNTTTMLNLQMQDDDIMAAVEAFRAYDNNSSRNKYNNNNVVVPPSLSNSVILEGLNNDNDDNSKAALVVYDSNDDLGTEEADNLAIINGDGSLCN

SEQ ID NO: 203120 - protein, 169 aa, Glycine max
  Coding DNA Sequence Number=SeqID_86342
  Gene Ontology: Mol. function=chitin binding; Cellular component =extracellular region; Biological process=chitin metabolic process
  Homolog annotation: Hit_ID=UPI000044ABC7; Match level="QueryCoverage =90%, HitCoverage=52%, E-value=9e-13, Identity=32%"; Hit description =PREDICTED: similar to retinitis pigmentosa 1-like protein 1, partial
RTTCPRLQRVARSRLQRATHPRLQRTGRPLLQRATRPHLQRTILPHLKRTARPHIQRAAYPRLQRTTRPHLQRATRPHLQRTTRPHLQGLHALAFRGLDVLTFRGLHALTFRGLYVLTLKGLHVLVFKGLLTLDFRGLRVLTFRGLHVLTFRGLHILTFKGCTPSPLED

SEQ ID NO: 203121 - protein, 131 aa, Glycine max
  Coding DNA Sequence Number=SeqID_86343
MNGGNGTTPTMVSPPSPHSSCGSTKPNQEDNNNNNNEDENNNKNNGGDDNNHNNNHNNNIIIIINNNNNNNNNNNGDNNNNNNGDNNNSHHHPEAPSLVLVGCPQCLMYLMISEDNLMCPTCKSINLIHFT

SEQ ID NO: 203122 - protein, 133 aa, Glycine max
  Coding DNA Sequence Number=SeqID_86344
  Subcellular localization annotation: CTP_CleavageSite=21; ConfidenceScore=5.05e-01
MNGGNGTTPTMVSPPSPHSSSGSTEPNQEDNNNNNNNNNNNGGDDNNHNKNDADNNNIIIIINNNNNNHNNNNNNHNSNNNNNNNGDNNNNHHHPEASSLVLVGCLHCLMYLMISDDNLMCPKCKSINLIHFT

SEQ ID NO: 203123 - protein, 71 aa, Glycine max
  Coding DNA Sequence Number=SeqID_86345
MICTGSLSAPLHLSKRTASVHLLSEKESLDWDSELCMSRVSRERKVQVPKSFERFCCVKICRDQSLKQEPV

SEQ ID NO: 203124 - protein, 169 aa, Glycine max
  Coding DNA Sequence Number=SeqID_86346
  Homolog annotation: Hit_ID=Q60DK0; Match level="QueryCoverage=36%, HitCoverage=32%, E-value=3e-17, Identity=66%"; Hit description =Expressed protein
MSTHANQEPLNSHQPEAKPQDLPPDQPGSVSPGAEAEAEAGEEEEGECGFCLFMKGGGCRDEFIGGRIASRRPRATTRTSSRSAPRSPPRSSAVWKPTPTTTSPSSAPRSSLRNRPSSNWRRRSRINNNHHHKTKSFQLQFVVVLDNVGNCKHMWLMRLQLWWWRLQKP

SEQ ID NO: 203125 - protein, 74 aa, Glycine max
  Coding DNA Sequence Number=SeqID_86347
MADIRECFYAVNKGICFPMRLRHDFNALSVKKESRRAPESKQSAKREISSLSESSVSCQAQCSIGAKPKSTYSR

SEQ ID NO: 203126 - protein, 154 aa, Glycine max
  Coding DNA Sequence Number=SeqID_86348
MVSCRWSAFKGKRERGFWRENRNEIKVGYKYRGREGFGCSLCSEDVVLGFHSKGQNFTTARATMRASPAIATMPMSPTRASTPTTPTSPAAPTSSKTILATPTSPNVIHHLLQHHQQENTIVEMNVPELAGFLAFALNFGGFVRLEKLGFCISD

SEQ ID NO: 203127 - protein, 720 aa, Glycine max
  Coding DNA Sequence Number=SeqID_86349
  Gene Ontology: Mol. function=receptor activity; Cellular component =integral to membrane; Biological process=red or far red light signaling pathway
  Homolog annotation: Hit_ID=Q6R8G7; Match level="QueryCoverage=99%, HitCoverage=99%, E-value=1e-121, Identity=56%"; Hit description=PHO1- like protein
  Pfam annotation: Domain name=EXS; Domain location=545-694; Score =202.2; E_value=1.2e-57; Accession=PF03124.5; Description=EXS family
  Pfam annotation: Domain name=SPX; Domain location=1-353; Score=198.3; E_value=1.8e-56; Accession=PF03105.10; Description=SPX domain
  Pfam module annotation: Pfam domain module=EXS::SPX; Domain location =545-694::1-353
MKFGKEFAAQMVPEWQEAYMDYGYLKSLLKDIMLHKQRKKPHSSATPAALMRKLSLNRTFSGLTHRYYQPVSPEHDIENQPILVHSVKRDGHEKYETNFLMAAEEGGEYELVYFKRLDDEFNKVDKFYRSKVEEVMKEAAELNKQMDALVAFRVKVEHPTASFDGSVEMTRLASDVSASATALHASTPRGVQLNRAQTGRIPTLIEDIKEEGSTHHGHSEESRDSEKGEEIQTTNKRVEVQNKKKKNITPIKPIRPASVEILNRVQLNNTCETPRSTIRGFIKYPGQTEINFTKENLSKVEETLKLAFIEFYQKLRLLKNYTFLNVLAFSKIMKKYDKITSRGAAKAYMKMVDKSNIGSSDEVTRLMERVENVFIKHFSNSNRNIGMRVLRPKPKRERHRVTFSMGFSAGCSAALTVALILIVRARKIMDHSGTLALTSVLANLDMQIDPETKEYKAFTELLPLILVLVLIAILLCPLNIVYRSSRMFFLTCLIHCICAPLYKVTLPDFFMADQFTSQVQALRSFEFYICYYGWGDFKQRETSCKSNRIFIAFSFIVAVIPYWSRFLQEKDKMQGYNALKYFLTIAAVCLRTAYTLHQGMGLKVMAWIFSISTAIFSTYWDLVLDWGLLQRHSKNRWLRDKLLVPQKSVYFAAMTILNLNFSSLHRQAMVSIVANLEIIRRGIWNFFRIENEHLNNVGKYRAFKSVPLPFNYEEEEDKDE

SEQ ID NO: 203128 - protein, 566 aa, Glycine max
  Coding DNA Sequence Number=SeqID_86350
MSSIFGSALGVGGSNFGCSIQQPMVEWEVVLIGDYSLEESPHEASDSESSFFKRLMKPSHVSEEELSATTTRSNGGEVRIFPQNRRRCGSEAPSSPPFVVGFKWVKDDVLRTSFYSCVMVQAVDPSSKSTATCLRAFEVLCPFFNIRSNVPMFLYFFEMKLTGKIGWVLLSSVSKKMFEFKSNVFHIFKDCFFKVKATSVIADKFPLMHDWNMEPHDIHPLTSSFLSLLLGKEVKLKPESTLLELLKLMRKKFLRLHPTCFHLWQPRGSAMKGLGAPLPSQVVVVVVVIFDSLIPLFVPLQAIPSTMLATSTPLVVPVSAPLSSIMMPLLNVGVTTIDALVNLHPPSSALLPSAPTILPSAIPSSSSPPSVSLDHVYTCRDTKSLWSMVYKPKQRNPTNFESGYLGGEWKRHKEVLNKIISLETKVTKWRAITRTVFERCKDLLKESYDFVSKVERFTKEKEELNAIVSESAKEIAKLKEFELKVAKEKEENKELEEELIMFKKEVVEQHEKGFLKTVKQVDFFTEGLDLCLFDPFKDVKDDQLLDKEEIVVGEEDDDGEDNEANV

SEQ ID NO: 203129 - protein, 102 aa, Glycine max
  Coding DNA Sequence Number=SeqID_86351
MGVGFKVCCLSCWSTMEKNPVDSGQRIHEQYLGVDNRKPFIKAFQESYDKILLDMHKDENEGAYGAVREESKRAIDGARDSSSVELYVSVPMQRGFPCARAR

SEQ ID NO: 203130 - protein, 119 aa, Glycine max
  Coding DNA Sequence Number=SeqID_86352
  Gene Ontology: Mol. function=RNA-directed DNA polymerase activity; Cellular component=mitochondrion; Biological process=RNA-dependent DNA replication
MAWRLRSVMESLVNHFQCSFVPNRNSGDNIIIAQEAIHSIRNKRHGKGWMVIKMDLEKTYDRLNWSFVVDTLRDIGFPESFVNMVYQFISTSNMRVIWNDEALDSFSPSLEYLTPLLDD

SEQ ID NO: 203131 - protein, 76 aa, Glycine max
  Coding DNA Sequence Number=SeqID_86353
MHIKGFDTIYLEFSLTTVVKNGSKIDKVRNPALIGDFFNSILRSHEHQGGATSPSRKRMNDFDEMMFKCNLINGGF

SEQ ID NO: 203132 - protein, 107 aa, Glycine max
  Coding DNA Sequence Number=SeqID_86354
  Subcellular localization annotation: CTP_CleavageSite=21; ConfidenceScore=5.55e-01
MDPLPTINRTNASLPFLTKIAAATTSVRRETPRKTLKRATKFAPTVVKPSILSMNVMLNIHAILDVPAIATAQATPPSIVTPQATLRKETRRKKPLEAQCQHHYNSA

SEQ ID NO: 203133 - protein, 82 aa, Glycine max
  Coding DNA Sequence Number=SeqID_86355
KHGHFKSDCPKLEKSKDKYKYYKSKEKKSFVSTWENLGDTTSNEEGKEEANLCLMVDIALKHNYSNSSLSSTLAPSSMFNLL

SEQ ID NO: 203134 - protein, 87 aa, Glycine max
  Coding DNA Sequence Number=SeqID_86356
WLGAQPSPSRGGGASAAQEPASEEPTAAATEGEDELTPPEPFYFDACIHMAQEEDASTDQIPESSPTPIHDDASPSALAFELEHPIS

SEQ ID NO: 203135 - protein, 174 aa, Glycine max
  Coding DNA Sequence Number=SeqID_86357
  Gene Ontology: Mol. function=isomerase activity
  Homolog annotation: Hit_ID=Q1IU06; Match level="QueryCoverage=93%, HitCoverage=35%, E-value=3e-53, Identity=50%"; Hit description =Mannose-6-phosphate isomerase-like protein
MISTVALFDAFQQTVSAPFRVVPFFDPGPWGGQWLKEVCDLDRSLPNYAWGFDCVPEENSLLLGFGNQVVEIPSSNLVFFQPEALLGKEVYEGFGDEFPIRFDFLDTMEGGNLSLQLMMKELEAAQHDQVPFDAEKYVQKWPVRKHDHVSIPSGTVHCSGANSVEMAGGKNVQV

SEQ ID NO: 203136 - protein, 78 aa, Glycine max
  Coding DNA Sequence Number=SeqID_86358
MSDMPFRGSKSARKRTAFFEKCDELAKRVCCAKQVHQYSLCTKAFLEELAKRTYHAKRVHPLSMNTHPLAELPVAKRG

SEQ ID NO: 203137 - protein, 91 aa, Glycine max
  Coding DNA Sequence Number=SeqID_86359
MGGDDIDMQLQPNYLDFSSFSSDDLLNLAQRVRKEHRFVVMIQKSKAKMDIAAEVWKMLKNWSSALNTRSQVGSQLYRASFWRELVNKGTK

SEQ ID NO: 203138 - protein, 105 aa, Glycine max
  Coding DNA Sequence Number=SeqID_86360
MIIKGGSLLDGGGWRGHCELMGRWIYKGIVKGHSYKQLVGSGVGVKQLGHSGWKTQFDTRLQHHYFNSSMHLFYQLHVYLGNFGGAVGFCVTWLMRILCLLGLSS

SEQ ID NO: 203139 - protein, 380 aa, Glycine max
  Coding DNA Sequence Number=SeqID_86361
  Gene Ontology: Mol. function=nucleic acid binding
  Homolog annotation: Hit_ID=Q1S9I4; Match level="QueryCoverage=35%, HitCoverage=13%, E-value=4e-15, Identity=32%"; Hit description =Integrase, catalytic region; Zinc finger, CCHC-type
MGVFLEYVDRGVWDPVMNSPYIPKVVVDGKEVEKDFNSWTPEENKCAQYNVRAKNILASTLTLDEFYHASQCPDAKEIWEILEVTHEGTKKVKRARKNTLIQEYEIFQMLLGENISDVKKHFTHVVNHLLALGKTMEKQELNRLREFELELGRLKDEEVDKKKKGLALKMSTSHHVASDEDPTENSDNKNMNLLVENFSNTKKIDSTLTTYTCIKCGTQGHIKTYYPTYLKKQQGGDTKQKKSFKNRRTYIACDDNDASSLSDSSDEEEADLCLMDDIYEDETKSNVSDSFSESNTNYDNLLDAFKELHEEAQRLIFANKTLKGQVRWHIDVEAKLHGECDSKNKIKIQEESLESRIKIQDSRHDIISMFNYMAIAALVG

SEQ ID NO: 203140 - protein, 98 aa, Glycine max
  Coding DNA Sequence Number=SeqID_86362
  Gene Ontology: Mol. function=DNA binding; Biological process=DNA integration
  Homolog annotation: Hit_ID=Q1S785; Match level="QueryCoverage=94%, HitCoverage=12%, E-value=4e-14, Identity=41%"; Hit description =Integrase, catalytic region
MSCKCFILKTRDQLAKLDSKVDKEIFSGYFDTSKAYRVFNSRTLVVEESIHVKFIDRLTTNRNMKSNSLMKFFLILDNHLINNLKQKDWKFVNYHPLD

SEQ ID NO: 203141 - protein, 351 aa, Glycine max
  Coding DNA Sequence Number=SeqID_86363
  Gene Ontology: Mol. function=[ribulose-bisphosphate carboxylase] -lysine N-methyltransferase activity; Cellular component=chloroplast
  Homolog annotation: Hit_ID=Q43088; Match level="QueryCoverage=93%, HitCoverage=67%, E-value=1e-143, Identity=76%"; Hit description =Ribulose-1,5 bisphosphate carboxylase/oxygenase large subunit N- methyltransferase, chloroplast precursor
  Pfam annotation: Domain name=Rubis-subs-bind; Domain location=180 -306; Score=183.1; E_value=7e-52; Accession=PF09273.1; Description =Rubisco LSMT substrate-binding
  Pfam annotation: Domain name=SET; Domain location=1-157; Score=48.7; E_value=1.9e-11; Accession=PF00856.18; Description=SET domain
  Pfam module annotation: Pfam domain module=Rubis-subs-bind::SET; Domain location=180-306::1-157
MGIWVVFIWLVDSVGNWLFQCRSEEELSELQGTQLLNTTRSVKQYVQNEFRRLEEEIIIPNKKLFPSSITLDDFFWAFGILRSRAFSRLRNENLVVIPLADLINHSARVTTDDHAYEIKGAAGLFSWDYLFSLRSPLSLKAGDQVYIQYDLNKSNAELALDYGFIEPNTDRNAYTLTLQISESDPFFGDKLDIAESNGFGETAYFDIFYNRPLPPGLLPYLRLVALGGTDAFLLESIFRNSIWGHLELPVSRDNEELICRVVRETCKTALAGYHTTIEEDQKLKEAKLDSRHAIAVGIREGEKNLLQQIDEIFKEKELELAQLEYYQERRLKDLGLCGENGDILGDLGKFF

SEQ ID NO: 203142 - protein, 414 aa, Glycine max
  Coding DNA Sequence Number=SeqID_86364
  Gene Ontology: Mol. function=nucleotide binding
  Homolog annotation: Hit_ID=Q84WS1; Match level="QueryCoverage=95%, HitCoverage=77%, E-value=1e-160, Identity=69%"; Hit description =Putative axi 1 protein
  Pfam annotation: Domain name=DUF246; Domain location=1-356; Score =631.1; E_value=9.1e-187; Accession=PF03138.5; Description=Plant protein family
MVTVARLLNLTLVVPELDKKSFWADPSNFEDIFDVRHFIDSLQDEVRIVKRVPKRFSRKSGYSTLKMPPVSWSNEKYYLEQDCNGHRYLYMMMMMMMMMMVRQMTNILPLFGKHKVVHFNKTDARLANNGLPLDLQKLRCRVNFQALKFTPQLENLGQKLIRILRENGPFLALHLRYEMDMLAFSGCTHGCSIEEAEELKQMRYAFPSWREKEIVSEERRSQGLCPLTPEESALILQALGFDRETPIYIAAGEIYGGEHRLAQLRAAFPRIVKKETLLVNDELQQFQNHSSQMAALDFMVSVASNTFVPTYYGNMAKLVEGHRRYSGFKKSILLDRKKLVELFDMHQNGTLPWNEFSNAVRQVHEKRMGQPTHRRVDVDKPKEEDYFYANPYECLCEGTKCDDLLGPLNSSQIR

SEQ ID NO: 203143 - protein, 90 aa, Glycine max
  Coding DNA Sequence Number=SeqID_86365
MHVDPIRLPLPTSTSWGHFSETLDDIHEVIGGDLDDFGGNKIDYDFKRGGWALGVEALTSTTRFCQREILMNIKIQVVEPCISLDFGVKM

SEQ ID NO: 203144 - protein, 141 aa, Glycine max
  Coding DNA Sequence Number=SeqID_86366
  Homolog annotation: Hit_ID=Q1T193; Match level="QueryCoverage=45%, HitCoverage=24%, E-value=1e-12, Identity=53%"; Hit description=RNA -directed DNA polymerase
MIKQDDFIEEKEIFRLLNPHLKSNPCMKAHDPRPTKSNTSLLSFLDAYSSYNQIRVSLIHEDKTKSITNSTNYYYKVMPFRLKDVRATYHRLMDKISSAQLGRNLEKREKARKTLFFERSKVRGLVTQREGTSTLNVYSTL

SEQ ID NO: 203145 - protein, 150 aa, Glycine max
  Coding DNA Sequence Number=SeqID_86367
MANGRWAEEILKKWEGCPLEGKISKKPRTRRPYRNLRRDHPLVHLVVIITIIFILLNPVGHMGRYRRGRRQFSNRSPIFGNVINGNQLPIIDILIHVKDGLIWHVTMKKHLMKVVIEAGCMHLKYIITSLLLNASLLLPVVIPLFVHQSK

SEQ ID NO: 203146 - protein, 69 aa, Glycine max
  Coding DNA Sequence Number=SeqID_86368
  Gene Ontology: Mol. function=oxidoreductase activity, acting on NADH or NADPH, quinone or similar compound as acceptor; Cellular component=photosystem II; Biological process=ATP synthesis coupled electron transport
  Homolog annotation: Hit_ID=Q2PMM9; Match level="QueryCoverage=55%, HitCoverage=5%, E-value=2e-16, Identity=97%"; Hit description=NADH -plastoquinone oxidoreductase subunit 5
MGEYNQLSLRISSLDQKQAKGGIPQRESVPTKKEVFVIGRTMKKRKKSSYKKNSRGYHSSSMYKGRKLE

SEQ ID NO: 203147 - protein, 394 aa, Glycine max
  Coding DNA Sequence Number=SeqID_86369
  Gene Ontology: Mol. function=protein serine/threonine kinase activity; Cellular component=cytoplasm; Biological process=protein amino acid phosphorylation
  Homolog annotation: Hit_ID=Q7XI53; Match level="QueryCoverage=95%, HitCoverage=83%, E-value=1e-172, Identity=74%"; Hit description =Putative ankyrin-kinase
  Pfam annotation: Domain name=Ank; Domain location=29-61; Score=45.9; E_value=1.3e-10; Accession=PF00023.20; Description=Ankyrin repeat
  Pfam annotation: Domain name=Pkinase; Domain location=121-376; Score =258.5; E_value=1.4e-74; Accession=PF00069.15; Description=Protein kinase domain
  Pfam annotation: Domain name=Pkinase_Tyr; Domain location=121-376; Score=247.6; E_value=2.6e-71; Accession=PF07714.7; Description =Protein tyrosine kinase
  Pfam module annotation: Pfam domain module=Ank::Pkinase::Pkinase_Tyr; Domain location=29-61::121-376::121-376
MSSGSSHSSEKEKEKQREDPSLVKARDYDNRTPLHVASLHGWIDVATCLIEFGADVNAQDRWKNTPLADAEGAKKSNVIELLQSHGGLSFGQNGSHFEPKPVAPPLPNKCDWEVEPTELDFSNSVRIGKGSFGEILKAHWRGTPVAVKRILPSLSEDRLDFRHEVNLLVKLRHPNIVQFLGAVTARKPLMLITEYLRGGDLHQYLKEKGALSPATAINFSMDIVRGMAYLHNEPNVIIHRDLKPRNVLLVNSSADHLKVGDFGLSKLITVQSSHDVYKMTGETGSYRYMAPEVFKHRRYDKKVDVYSFAMILYEMLEGEPPFASREPYEGAKYAAEGHRPHFRAKGYTPELQELTEQCWAHDMSQRPSFIEILKRLEKIKENLPTENHWHLFTS

SEQ ID NO: 203148 - protein, 113 aa, Glycine max
  Coding DNA Sequence Number=SeqID_86370
MGSFRDNSKESEELGSRVRGSNEEVFVVSLGSDSIESGSFLLTVSFAKEGFTDLSTFLDSFLKQIVDNISRGVGHNANTATGFSNRLVGALSRTSIVREENDESLAEDAPWKR

SEQ ID NO: 203149 - protein, 72 aa, Glycine max
  Coding DNA Sequence Number=SeqID_86371
MKHGHAIEVQRPASKAHRTRKRVRLRCDAVSVASAVIGHGWIRVRVLHFGDYRRLRVRVRVVFGVRVSVDVS

SEQ ID NO: 203150 - protein, 69 aa, Glycine max
  Coding DNA Sequence Number=SeqID_86372
MADQESGHQDTTPVLGYTLSPSPSPCYTLSPFAGHVPSATPNESILPHEAEEIADNLEGTTQTGTSRLK

SEQ ID NO: 203151 - protein, 408 aa, Glycine max
  Coding DNA Sequence Number=SeqID_86373
  Gene Ontology: Mol. function=RNA-directed DNA polymerase activity; Cellular component=chromatin; Biological process=RNA-dependent DNA replication
MCPKYFTCGIVAKEHFKNLRKNWLARRTSKVVCRCSRRWMERCITRKALQGTRSGRDASKMLSTSDEKGARARANYACLEHGGDLCLDFLLLTIWVPIGLDVDWGGCGSEVNAMIGWSRRGYGRADADMKEFTSTVGLNQTTKLHGRDSFKVSGSVTAELDNLPMMNEFHGEGVIISQDWPKGFQPVHIEDHVYATYRQDMEVCGPGGRLGELARSCACSCRRPGSRRAGSQYSPTCVGIWVRAKYIRVWGFLKTLIICDEDEEPGGVRHFKGTNGGLGGVGNKGRVREEGEGREKIEGLGGGSGGGGPVLGAGRPRGLAEDDKGEWVELRLQYGRDSTCRDQQWKAEMKAPKLLRAKVKFPAFETQCAMVVMVGGGTEEEEVLMAREEGEAIGREIQRMKYDVALLG

SEQ ID NO: 203152 - protein, 333 aa, Glycine max
  Coding DNA Sequence Number=SeqID_86374
  Homolog annotation: Hit_ID=Q9FLJ9; Match level="QueryCoverage=73%, HitCoverage=66%, E-value=1e-12, Identity=26%"; Hit description =Arabidopsis thaliana genomic DNA, chromosome 5, P1 clone:MFB13
MEISSGGCSPRIRSEYSRKEGSEGTPFQHMELSVRDRNYQIQSMNALEILRETIRILRFNSWGFMAIAFMLICPVSAVLLSNVIVDESIVKNLSIRLMLVAQTSGLPLRPIIKQSCQRFAETVVSSAMCFPFYATLLLLSKAAVVYSVDCTYSRKKVDASKFCVIVAKFWRKILFTYMWVCTVVVGCITLFCVFLVAFCSALAVLGFSPDVVVYCAMLVGLVFSVVFAKAIIICNIAMVISVLEDVSGAQAMLRSSILIKGQTQVGLLIFLGSTIGMAFVEGLFEHRVKTLSYGDGSSRVWEGPLLVRDAVRDCSQKIVLAIEEPCKLQQFFL

SEQ ID NO: 203153 - protein, 157 aa, Glycine max
  Coding DNA Sequence Number=SeqID_86375
GHLPINLQSAIRFIPVSFLPLLVSQAVVFCISLLYALLLVLLTHDVAELVHGTGVALSSFFFYGFCTVFSVLGCLSVMRDSDGSTENWFSVEWNWVYIVLVSFLLAMIMLSNIGVDIRSCAYIARPIMVRLQRSLGGNMLACPSMMEMSLILFKLLR

SEQ ID NO: 203154 - protein, 73 aa, Glycine max
  Coding DNA Sequence Number=SeqID_86376
  Subcellular localization annotation: CTP_CleavageSite=26; ConfidenceScore=5.02e-01
MERSAGRSFTGRPKKPWKTLWVMEARANKEKNTTKRRKKSRGNENGNGSSGGGVSVRVRVRGWGWVWRRRMWM

SEQ ID NO: 203155 - protein, 310 aa, Glycine max
  Coding DNA Sequence Number=SeqID_86377
  Gene Ontology: Mol. function=zinc ion binding
  Homolog annotation: Hit_ID=Q9C533; Match level="QueryCoverage=85%, HitCoverage=54%, E-value=6e-53, Identity=48%"; Hit description=DHHC -type zinc finger protein, putative
  Subcellular localization annotation: CTP_CleavageSite=63; ConfidenceScore=5.24e-01
MREQEQEQLGNGGQQSPQMSTVSSFTGLSSASSFTTLHRGAWCTPPRLLLQDQFDVVPPETASVSSVGKKTMREDPLKKKNPGTVKISPWTLARLNAEEISKAAAEARTKSKVLQPVTRHGEAIRLEPESSFSSSGRRMVPRIESNKKGASKRIHHPANLSMESLTKVSASNTDKGLSGMSRLAPLPFEAHNTFQTSQPMSSSAGIVPSSPESSLDSPDIHPFRVSSSGAEKARQLAVAGASGAGAATLKEISLSGSTSDGYEASGGEDSDRVVPFRIVQRSTNWTNLFRADQDERAFKKPQSSTIVGHR

SEQ ID NO: 203156 - protein, 276 aa, Glycine max
  Coding DNA Sequence Number=SeqID_86378
  Gene Ontology: Mol. function=zinc ion binding
  Homolog annotation: Hit_ID=UPI000034F516; Match level="QueryCoverage =100%, HitCoverage=43%, E-value=2e-79, Identity=53%"; Hit description= metal ion binding
  Pfam annotation: Domain name=zf-DHHC; Domain location=169-233; Score =84.9; E_value=2.5e-22; Accession=PF01529.11; Description=DHHC zinc finger domain
MRKHGWQLPYHPLQVVAVAVFLALGFAFYVFFAPFVGKKMYQYIVTGLYSQLIISVFGLYIWCAAADPADPGVFKSKKYLKIPDSKKLAELKNSKLGEESTSSMHEANASMVGSNSVDKEALGKIRTSKDASNSVEKSTSSSCSSCILLVSSPCAYICSCSSPTEKSSDKQTSEDGMFYCSLCEVEVFKYSKHCRVCNKCVDHFDHHCRWLNNCIGKKNYRQFFTLMVAAMLLFILQWLTGILVLICCFVKRKEFSVDISSKLGTSFSLVPFVLVV

SEQ ID NO: 203157 - protein, 76 aa, Glycine max
  Coding DNA Sequence Number=SeqID_86379
MLQPLEISIGLREHSNPMTPKAYTPKSPSGPLPLDSGPTPKIILTQTLLVNYTIPTTSHSCLKHVQHIALQFNTGS

SEQ ID NO: 203158 - protein, 793 aa, Glycine max
  Coding DNA Sequence Number=SeqID_86380
  Gene Ontology: Mol. function=zinc ion binding
  Homolog annotation: Hit_ID=Q6ZI16; Match level="QueryCoverage=65%, HitCoverage=53%, E-value=8e-46, Identity=29%"; Hit description =Bactericidal permeability-increasing protein-like
  Pfam annotation: Domain name=C1_3; Domain location=449-479; Score =15.1; E_value=0.0085; Accession=PF07649.3; Description=C1-like domain
  Pfam annotation: Domain name=PHD; Domain location=450-501; Score =30.3; E_value=6.6e-06; Accession=PF00628.19; Description=PHD-finger
  Pfam module annotation: Pfam domain module=C1_3::PHD; Domain location= 449-479::450-501
MEEAVSDPHPEMEQQQQPPPLQNGDSDERCAKKPKFDQGAEFKRVAEIVLVLSTMATVRAGRKPSDAEVELMREARAKLASLCEGLAPKDIVTREAIGTVIEDLGLNFKLKDQRLGFRTPKMSIAERYSHAKWKVLKEYYYVYLDCCECVRVRQMRIAVCLDMHPAREKGIFGQIIVYQYACNAKKDAMPFPLMEEAKKISAPSTPSTTHTSQPLQTNIVGPVDNRVPSHVRIFPSDKSSHPSIPSMGAIVSIPAHVSVGSSAALQYQVISNEVRPPVVSGVMPGSHLGRNASSLALPKVEHPQFKVDGGSNGSPYMLQVQANSSANQPLVNAPTWSIQSQAASLARSASENKVPVQNSVKVEGTPDITVSRAGPQITTDPSFKPFITQTAPGTLPSVHQPLQATNIVQPPLIPSHTDIAKIVQKVLQPKLPVHPTWTPPSRDYMNKAFTCQMCELSVNEVDTVLLCDACEKGFHLKCLQPSVLRGIHNRVDWHCMRCLSLSGGKPLPPKYGRVMRSSNTPPKLPSNTGGILPCSEKKVENIDPKVIPQTLATNGSSVQTVCGGNHNVELSSESRIPDTKDMQGTNISSTIEAIDKKPDPNNSMKSLSAASSPSPCLLGKNSVQQINSKVLTGKETLESESLPKLSEPAKCEDLQSSQDFQVEHTMSQDNPEVSSDKHVDHNIMNNKQKEFHGGKSLTYDIKLDDQDAALANFVGTSGTNTDGTQHSALSSDSSHAVEWIGDVVQLVDEKKYYQSCCIDGVTYRLQGHALFPTSHGKLTPSKLQASKSSCFPL

SEQ ID NO: 203159 - protein, 96 aa, Glycine max
  Coding DNA Sequence Number=SeqID_86381
MTHQRVKGKDLHQVKKNKLVRSNKVGLEPALWRTILFRMLDQIFAFSHIRLYAIVFLMQSYPAMALDRRLQVDWARDAREHPMVLMSLRADFGPMG

SEQ ID NO: 203160 - protein, 143 aa, Glycine max
  Coding DNA Sequence Number=SeqID_86382
AVILIARFPNPNYGVKMGSSWCGVSTENNGGLWWLMVAVGDGERAWNVGNGFGRKKGEEMAFFQSYLDYKAQNAQMSNALGNGNGNIAHTPDIFSKIPTLKTKFREDPTVNEGWAAFLPRQLHVASLRSFIKRLPEEAYSWLL

SEQ ID NO: 203161 - protein, 85 aa, Glycine max
  Coding DNA Sequence Number=SeqID_86383
MKEQHEEPLKLMVAQVIGIRVKRGNDRRRNYTLFWEATTAVTVRKRKGVMDAMSFKEGADGDGWDEAYGATHQSSPSFTLRDYGR

SEQ ID NO: 203162 - protein, 407 aa, Glycine max
  Coding DNA Sequence Number=SeqID_86384
  Gene Ontology: Mol. function=nucleotide binding; Cellular component =protein complex; Biological process=barrier septum formation
  Homolog annotation: Hit_ID=O65875; Match level="QueryCoverage=99%, HitCoverage=99%, E-value=1e-161, Identity=76%"; Hit description=FtsZ protein
  Pfam annotation: Domain name=Tubulin; Domain location=64-246; Score =258.6; E_value=1.3e-74; Accession=PF00091.15; Description =TubulinFtsZ family, GTPase domain
  Pfam annotation: Domain name=Tubulin_C; Domain location=248-370; Score=100.7; E_value=4.3e-27; Accession=PF03953.7; Description =TubulinFtsZ family, C-terminal domain
  Pfam module annotation: Pfam domain module=Tubulin::Tubulin_C; Domain location=64-246::248-370
  Subcellular localization annotation: CTP_CleavageSite=55; ConfidenceScore=5.40e-01
MVMLHPLTNPNPNELLSLSCSSIFHHHAFTTSVSFKPRTTKIAPQRLSRRFGSVRCSYAYVDNAKIKVVGIGGGGNNAVNRMIGSGLQGVDFYAINTDAQALLNSAAENPIKIGEVLTRGLGTGGNPLLGEQAAEESRDAIADALKGSDLVFITAGMGGGTGSGAAPVVAQISKEAVLKDVRDACRQAFEAIERLQKNVDTLIVIPNDRLLDIADEQMPLQDAFRLADDVLRQGVQGISDIITVPGLVNVDFADVKAVMKDSGTAMLGVGVSSGKNRAEEAAEQATLAPLIGSSIQSATGVVYNITGGKDITLQEVNRVSQVVTSLADPSANIIFGAVVDDRYTGEIHVTIIATGFSQSFQKKLLTDPRAAKLLDKVAEGQESKAVPPPPKSSIKVESRPSPRKLFL

SEQ ID NO: 203163 - protein, 80 aa, Glycine max
  Coding DNA Sequence Number=SeqID_86385
MTHSTSIQWFFNESIASLIGIELFTPPPTEQNPVGKIEIEEEGKKEKNLNCARGLTARQKTSVIVAGMFIITAVIRFGTK

SEQ ID NO: 203164 - protein, 206 aa, Glycine max
  Coding DNA Sequence Number=SeqID_86386
  Gene Ontology: Mol. function=protein transporter activity; Cellular component=mitochondrial inner membrane; Biological process=protein transport
  Homolog annotation: Hit_ID=Q10QJ0; Match level="QueryCoverage=52%, HitCoverage=55%, E-value=1e-29, Identity=63%"; Hit description =Mitochondrial import inner membrane translocase subunit Tim17/Tim22/Tim23 family protein, putative, expressed
  Pfam annotation: Domain name=Tim17; Domain location=36-150; Score =119.9; E_value=7.4e-33; Accession=PF02466.9; Description =Tim17Tim22Tim23 family
  Subcellular localization annotation: CTP_CleavageSite=37; ConfidenceScore=5.66e-01
MSSSSSSSMATPNSDATTQTQDSDTVPYSNSPNALVPAAPAVCLLRFATDSAAGALMGSVFGYGAGLFKKKGFKGSFVEAGSYAKTFAVLSGVHSLVVCILKRLRGKDDGVAGCCTGLALSFPGAPQALLQSCLTFGAFSFIMEGLNKQQPALAVPISWKKPVQHNASPPLVLPLQLPLPDKLKDAFSFFSYSLKKRSKGPYPTSR

SEQ ID NO: 203165 - protein, 1202 aa, Glycine max
  Coding DNA Sequence Number=SeqID_86387
  Gene Ontology: Mol. function=microtubule motor activity; Cellular component=microtubule associated complex; Biological process =microtubule-based movement
  Homolog annotation: Hit_ID=Q8GZU1; Match level="QueryCoverage=99%, HitCoverage=99%, E-value=0.0, Identity=45%"; Hit description=Kinesin related protein
  Pfam annotation: Domain name=Kinesin; Domain location=102-416; Score =354.8; E_value=1.4e-103; Accession=PF00225.13; Description=Kinesin motor domain
  Pfam annotation: Domain name=Kinesin-related; Domain location=492 -1163; Score=759.5; E_value=2.1e-225; Accession=PF06548.2; Description=Kinesin-related
  Pfam module annotation: Pfam domain module=Kinesin::Kinesin-related; Domain location=102-416::492-1163
  Subcellular localization annotation: CTP_CleavageSite=59; ConfidenceScore=5.20e-01
MRQSSNSETAETHFSGTISSSSLKKFLPRSLSSKHKPISNPKISNLDAENTRPTDPNIQINHEQSLPSTTKQSQSKTSISQNNLKQSKFPLQSDPSVKVVVRIRPTNNNGIEGDRTVKKVSSDTLCVGDRQFTFDSVFDSNSNQEDIFQSVGVPLVKNALAGYNTSILSYGQSGSGKTYTMWGPPSAMFEEPSPKSHKGIVPRIFQMLFSELEREQHVSDGKQFNYQCRCSFLEMKDDSKNALYIENLTEEYVTSYDDVTQILIKGLSSRKVGATSLNSKSSRSHIIFTFVIESWCKGISSNGFSSSKSSRISLIDLAGQDRNKVEDAGKQCLKEDKNVKKSLSQLGQLVDALTKETHSGKAEEISNRNSCLTRLLQDSLGGNAKLSLICSISPDNKNNGETLRTLRFGQRVRTIRNEPVINEIKEEDVNDLSDQIRKLKEELIRAKAEVHSSDGSKNGYLQVRNVRDSLNQLRVSLNRSLLLPCIDNDTDEEVNVDEEDIRQLRQQIDELYHSCEENPKKISVSEDCVQYYSVAENCDTDMTSGDEIEKEEVCYGDAMSKLCPEESEGSTTTLYASADDFACTANASWTIKSAFRDSISVSSCSRSPILGEPQLSESPKIKNVQRKSVVYSPSCLGSWNNVAEENMNSSNDILRQSFKEGEQMRSSLRSSKVFQGPTESLAASLQRGLQIIDYHQRNSALNKSSTSFSFECLTLTPCPEDKDDSCDQMMQQKKYSVDERTASLLCESCLKRIYDQDSTEVQDSIKSRVETAEAENPDGLTDKVPKDLQSIMDKAITREKELEKVCKKQAARIEELNQLVEKFKGEMEAKSSIIVYDPESNKQTRHEEEYNSLKDEDKLPRGTSLDRHLPDIIEENCEIKKVQEEVTQRDGCFNATEKEELLKEIQNLRSRLQLCSDAPVKKSTDKLRSSLSLMSRSIQLQKSGVFSLDNGGDELEKERERWTEMESEWICLTDELRVDLESIRQRAERVEMELSLEKKCTEELDDALKRAVLGHGRMVEHYADLQEKYNDLAAKHNAIMEGIAEVKKAAAKAGKRGHARFAKSLAAELSALRVEREREAKFLKKENMNLKIQLRETAEAVHAAGELLVRLREAEHAASAAEENFRKVQQDNEKLKKQMDKLKRKHKMEIVTMKQYLAESKLPESALQPLFREDSDDVHKDATSHDDQAWRVEFGAIYQQHY

SEQ ID NO: 203166 - protein, 332 aa, Glycine max
  Coding DNA Sequence Number=SeqID_86388
  Gene Ontology: Mol. function=transcription cofactor activity; Cellular component=nucleus; Biological process=abscisic acid mediated signaling
  Homolog annotation: Hit_ID=Q75LB9; Match level="QueryCoverage=93%, HitCoverage=78%, E-value=1e-109, Identity=60%"; Hit description =Putative pirin-like protein
  Pfam annotation: Domain name=Pirin; Domain location=30-157; Score =127.8; E_value=3e-35; Accession=PF02678.6; Description=Pirin
  Pfam annotation: Domain name=Pirin_C; Domain location=210-315; Score =169.1; E_value=1.1e-47; Accession=PF05726.3; Description=Pirin C -terminal region
  Pfam module annotation: Pfam domain module=Pirin::Pirin_C; Domain location=30-157::210-315
MPDQDIFSCISEPRLVARKFLARPQHEGVGAVVRRSIGRFELKYFDPFLVLDEFSVTAPAGFPDHPHRGLPIGSSVSFMFFNDLICLVSDLFLPCGAQYGVNLCAGGVATSVTHEDFEGHKGTIEAGDLQWMTAGRGLVHSEMPAAQGTQKGLQLWINLASKHKMIEPRYQEMLSKDIAETMIDGIKVRVIAGEALGIKSPIYTRTPTMYLDFTLKPGAHLQQLIPKSWNAFVYILEGEGVFGNQKSQPVTSHHILLLGPGDGLEAWNKSSKVLRFILVGGEPLGEPVVQFGPFVMNTQEEIDQTIDDFENYTNGFEKARHWRSESAISLDY

SEQ ID NO: 203167 - protein, 78 aa, Glycine max
  Coding DNA Sequence Number=SeqID_86389
  Gene Ontology: Mol. function=unspecific monooxygenase activity
  Homolog annotation: Hit_ID=UPI00006A2901; Match level="QueryCoverage =40%, HitCoverage=20%, E-value=2e-10, Identity=96%"; Hit description =UPI00006A2901 related cluster
  Subcellular localization annotation: CTP_CleavageSite=11; ConfidenceScore=5.10e-01
PEPVGCRWTARAASAARAGRRVPVGGRIGNGPFGASSPGVEQSTQNCALNVKVKKFNQARVNGGSNYDSLKVAKCLVI

SEQ ID NO: 203168 - protein, 311 aa, Glycine max
  Coding DNA Sequence Number=SeqID_86390
  Homolog annotation: Hit_ID=Q9AVH2; Match level="QueryCoverage=74%, HitCoverage=100%, E-value=9e-73, Identity=53%"; Hit description =Putative senescence-associated protein
EGRIKATRAESQWIVAARPLCHLQYPVAYLSRLQRILPAARWELRFKASRRANPPHEGHQRHVPLGGRGPLLLVGKRTAGARVASSPDSDLEAFSHNPTHGSFAPLAFQPSAMTNSHVPYWWVNNPTLGEFCFTMIGRADIEGSKSNVAMNAWLPQASYPCGNFSDTSSFKFRRTKGSIGHAFHGSYSYWKSESNELFTLFVPHEISVLVELILGHLRYLLTDVPPQPNSPPDNVFRPDRPAEADLGSKKRGSAPLPIHGITPTYPTPLKSFHKVGLESSSTGSSFPADSAKPVPLAVVSLDSRQGQWESR

SEQ ID NO: 203169 - protein, 115 aa, Glycine max
  Coding DNA Sequence Number=SeqID_86391
GVVGLAKPPDRSDHDVDDPLYLMTLTIPRLFLKPLQVMWDAAVFGVSNDNFPLYIKHEDLSEIACGGQCLSISVIQLCIFALKRLDDTPQSKFKVAARWIVVKYFNDANHWNQRD

SEQ ID NO: 203170 - protein, 78 aa, Glycine max
  Coding DNA Sequence Number=SeqID_86392
MGLRIIFDGGGCTNNARQSIRGAPDLMAINSWGSGLDGGGCMNGNQFMGLRIRFDGGGRTNNARQSIRGAPDSMVEDA

SEQ ID NO: 203171 - protein, 70 aa, Glycine max
  Coding DNA Sequence Number=SeqID_86393
MEQSSKGKGITVEPESSPPIFVPTSSDYDPGNSTCLTPTKRISCQQISSDFDSDEHAEYQLSTNKHIKAE

SEQ ID NO: 203172 - protein, 75 aa, Glycine max
  Coding DNA Sequence Number=SeqID_86394
MKHSSKIESGGHMNENAIHGAPKEGGEWRIALRVRTQAIIKHSSKLESGGHMIENAIHGARKKGGEWRIALRVHT

SEQ ID NO: 203173 - protein, 198 aa, Glycine max
  Coding DNA Sequence Number=SeqID_86395
  Gene Ontology: Mol. function=transferase activity; Cellular component= chromatin; Biological process=DNA integration
  Homolog annotation: Hit_ID=Q1SXA8; Match level="QueryCoverage=77%, HitCoverage=10%, E-value=1e-43, Identity=58%"; Hit description=Zinc finger, CCHC-type; Polynucleotidyl transferase, Ribonuclease H fold
MDGLQEEAREPIGRIMRKNHLESQIISDLTNRVQTRSSFRSQELPKGKKAIGAKWVFHNKLDENGKAVKNIARLVAKVCSLQKGIDYKETYAHVTPLEEMRNLLSFVAHSNMKLYQMDVKYKFLDGLIQEEVYVEQPLGFESDTLPHHVFILNKALYGLKQAPQSWFEKLSSFLLENGIKRGKWIQLCFVKIKTHNLY

SEQ ID NO: 203174 - protein, 385 aa, Glycine max
  Coding DNA Sequence Number=SeqID_86396
  Gene Ontology: Mol. function=ATP-dependent helicase activity; Cellular component=chloroplast; Biological process=rRNA processing
  Homolog annotation: Hit_ID=Q1RV87; Match level="QueryCoverage=97%, HitCoverage=100%, E-value=0.0, Identity=84%"; Hit description =DEAD/DEAH box helicase, putative
  Pfam annotation: Domain name=DEAD; Domain location=10-187; Score =138.2; E_value=2.2e-38; Accession=PF00270.19; Description=DEADDEAH box helicase
  Pfam annotation: Domain name=Helicase_C; Domain location=273-349; Score=52.2; E_value=1.8e-12; Accession=PF00271.21; Description =Helicase conserved C-terminal domain
  Pfam module annotation: Pfam domain module=DEAD::Helicase_C; Domain location=10-187::273-349
MEEIGYVMPTDIQREALPYLFSGLDCILHAQTGSGKTLTYLLLIHSIINAAKSSVQALVLVPTRELGMQVTKVARTLAAKPTGVDGEQKSCSIMALLDGGTLKRHKTWLKAEPPTIVVATVGSLCQMLERHFFSLETVRVLIVDEVDCIFNSSKQVSSLRKILTSYSSCNNRQTVFASASIPQHNRFIHDSVQQKWTKRDVVHIHVSAVEPMPSRLYHRFVICDTKRKLHTLLSLIQSDAPESGIIFVAEQSEKSKKAGKAPSTSLLIDFLKTSYQGDLDILLLEDKMNFNSRAASLLEVRKGGGYLLVATDIAARGFDLPEMSHIYNFDLPRTAIDYLHRAGRTCRKPFSDINCTVTSIIVPDERFVLQRYENELMFNCEELVP

SEQ ID NO: 203175 - protein, 96 aa, Glycine max
  Coding DNA Sequence Number=SeqID_86397
MDWAWNSSLTLKERIELLEKIIVKSIFRICLEVRFWREGERRTKGNGRNCRNETHFYFLYSDVAVVAFEQETTSSFSGMSSSLRILLAIGGNTEKL

SEQ ID NO: 203176 - protein, 394 aa, Glycine max
  Coding DNA Sequence Number=SeqID_86398
  Gene Ontology: Mol. function=metal ion binding
  Homolog annotation: Hit_ID=O23280; Match level="QueryCoverage=67%, HitCoverage=72%, E-value=1e-57, Identity=48%"; Hit description=RING -H2 finger protein RHF1a
  Pfam annotation: Domain name=zf-C3HC4; Domain location=36-76; Score =34.9; E_value=2.9e-07; Accession=PF00097.15; Description=Zinc finger, C3HC4 type (RING finger)
MANFTSSSPLPLTLTMSHISTPSSSAAFDDSSEDACSICLEPFSTHDPATITSCKHEYHLHCILEWSQRSKECPICWQLLILKDPASQELLNAVEAEKRLSSRTVYSHAFTDSRSPLHRLNNDQDDSDFDEQLTQHLVSAASRARYICRGERQRSPGAGPSEVLVFNSSMHASGMQSTLTTSPSSGVPSTSAFSSVGMVTTNTSSESDMPCKPRVIYSQPSPENARRLNTSEIFSFPESFKSKLSAASARCKESISKNTRGLKEKLIARNASVKELSKGVQREMNAGIAGVARMVERLDLTSKRSSSPLIPVKGKSVQENGVEQFPNKEESGVLVADVTSNAASLDSSLVAVGVEIPPSCVQEEACNARDDLIITNVAVGMRPAFGQISCRNSK

SEQ ID NO: 203177 - protein, 292 aa, Glycine max
  Coding DNA Sequence Number=SeqID_86399
  Gene Ontology: Mol. function=kinase activity; Cellular component =cytosol; Biological process=porphyrin biosynthetic process
  Homolog annotation: Hit_ID=Q9D7G7; Match level="QueryCoverage=64%, HitCoverage=61%, E-value=1e-39, Identity=43%"; Hit description=Adult male tongue cDNA, RIKEN full-length enriched library, clone:2310009L13 product:RIKEN cDNA 0710008K08
  Pfam annotation: Domain name=Carb_kinase; Domain location=111-292; Score=-45.4; E_value=0.00037; Accession=PF01256.8; Description =Carbohydrate kinase
MKCKTVGLSLESSKVGVADSPACAVDRDWCLLKLMRDGMNSRILLDAAKSCILASSPVFRRQQFLIRCVGGSTDQRDMQALRSLEVDSQSIIRAITPALDPTRHKGQAGNIAVIGGCREYTDAAPVIKSYSPELIVHPVLEESYNVGEEHKSSIASKVLAEVDKWLERFDCLVVGPGLGRDPFLLDCVSEIMRHARQSNIPIVIDGDGLFLVTNNLELVSGYALAVLTPNVNEYKRLVQKVLSSEVNDIDAPQQLLSLAKQIGGVTILRKGNSDLISDGDTGSQISERLWFS

SEQ ID NO: 203178 - protein, 972 aa, Glycine max
  Coding DNA Sequence Number=SeqID_86400
  Homolog annotation: Hit_ID=O65041; Match level="QueryCoverage=48%, HitCoverage=94%, E-value=1e-153, Identity=59%"; Hit description =NEDD8-activating enzyme E1 catalytic subunit
  Pfam annotation: Domain name=DUF231; Domain location=257-425; Score =159.2; E_value=1e-44; Accession=PF03005.6; Description=Arabidopsis proteins of unknown function
  Pfam annotation: Domain name=E2_bind; Domain location=867-958; Score =90.0; E_value=7e-24; Accession=PF08825.1; Description=E2 binding domain
  Pfam annotation: Domain name=ThiF; Domain location=516-720; Score =154.1; E_value=3.7e-43; Accession=PF00899.11; Description=ThiF family
  Pfam annotation: Domain name=UBACT; Domain location=773-843; Score =123.1; E_value=7.7e-34; Accession=PF02134.11; Description=Repeat in ubiquitin-activating (UBA) protein
  Pfam module annotation: Pfam domain module=DUF231::E2_bind::ThiF::UBAC T; Domain location=257-425::867-958::516-720::773-843
MSVFEAIRKAKRLRLFEPSLGVLGFVVVTVFVICCFFYSDNGYLASRVGFFEQPQRFAWLRIEGSTAPPRVEFLGEKGGGCDLFDGEWIWDESYPLYQSKDCRFLDEGFRCSENGRRDLFYTKWRWQPKGCNLPRFNATLMLEKLRNKRIVFAGDSIGRNQWESLLCMLSSGVPNKESIYEVNGSPITKHKGFLVFKFKDFNCTVEYYRAPFLVLQSRPPTGAPENIRTTLKVDTMDWNSKKWRDADILVLNTGHWWNYEKTIRGGCYFQEGMDVKLEMQVEDAYKQSIQTVLNWIQDTVNPIKTRVFFRTLAPVHFRGGDWKNGGNCHLETLPELGSSLVPNDNWSQLKIANAILSAAHTNISETNKFMVLNVTQMTAQRKDGHSSIYYLGRSAGHVHHHRQDCSHWCLPGVPDTWNELLYALLLKHETAHRGNFVTQKQQDTFYIGDLQPGTKVSDFVAANHHDCEGREASLAPNPMADTSSRSRDLDKLLLRPGNLVGPRFEPGPELRDDLQAFAKVLVVGAGGLGCELLKDLALSGFRNLEVIDMDRIEVTNLNRQFLFRLEDVGKPKAEVAAKRVMERISGVEIVPHFCRIEDKEIEFYNNFNIIALGLDSIEARSYINTVACSFLADEATIAVALQSQTPQKPLCCGRKCGRGLISISTFSPKDLVQTAYANFQFLFLLLINLEYDSDDNPQEETIKPMVDGGTEGFKGHARVIMPGITPCFECTIWLFPPQVKFPLCTLAETPRTAAHCIEYAHLIKWNEVHGGVAFDPDNPEHMKWVYDEAVKRAELFGIPGVTYSLTQGVVKNIIPAIASTNAIISAACALETLKIATEYNGSEGLHTEVAEFERDKDCLVCGPGIRIELDPSITLQKFMDLLEEHPKLRLSKASITHRGKNLYMQAPPVLEEMTRSNLNLSLFNLMGKLPKDVVHVNGTTIKNDQKFSCLRKLRVVFKGVDGVTDMDTAGGA

SEQ ID NO: 203179 - protein, 169 aa, Glycine max
  Coding DNA Sequence Number=SeqID_86401
MGCTHGPEIYPKAHKNPRAFSCIFGPIYLEFSIQCPCEVGLHHVGLARIMRLARHSARLARWENLEKNMRSICALNVSLTRLERRLSLPALSAPSSLSRFSLTCAKCENAAKQAFEDRKLFLRLKLEKSSKSSKREANSERRKQNKGAKQSKEAKNLNFQEDLRFRGNF

SEQ ID NO: 203180 - protein, 237 aa, Glycine max
  Coding DNA Sequence Number=SeqID_86402
  Gene Ontology: Mol. function=RNA-directed DNA polymerase activity; Biological process=RNA-dependent DNA replication
MGRGPPALVEREKFDHIEERVRVIEGGGNYAFADMVELCLVLDMVIPLKFKVSDFNKYKGNTCQKNHLKMYCRKIGAYAKDEKLLMHFFKRVWLGRLSLGTPIWNLPGQYQYNSDIASDRMQLQNMCKREQESFKEYAQWWRDLAAQVAPLMMEREMITMKVDTLLVFYYEKMVSYMPSSFADLVFAGERIEVGLRRDKFDYASLMNRKPKANRENKNEGETHVVVAVPTWPNFPLA

SEQ ID NO: 203181 - protein, 113 aa, Glycine max
  Coding DNA Sequence Number=SeqID_86403
MKSKKEKESAKGGPSNKGKHTTCSPLPSLTPKAWIEIAGLSSEGLMDNQNDLKDVGVKFNKVTKYMSLTKNPYTFTFIVAKAKGKQIFDVGPLLLEHRFLTYVIDWIITPRGS

SEQ ID NO: 203182 - protein, 57 aa, Glycine max
  Coding DNA Sequence Number=SeqID_86404
MHYVGRINSDRAQHYCCASRGSSLDQWADMRTLVEAKLKSKGVMLSKFVKAILSEFV

SEQ ID NO: 203183 - protein, 97 aa, Glycine max
  Coding DNA Sequence Number=SeqID_86405
  Homolog annotation: Hit_ID=Q94FN2; Match level="QueryCoverage=39%, HitCoverage=1%, E-value=7e-07, Identity=71%"; Hit description =Microtubule organization 1 protein
MMFHKYVRRSKNNNNDIKGFLTDVKPALLSALDTKYEKNPFELPRGLSGQKTHLQLLLLVDKAYAKNHNDTKLLVEVMRLLKKNDLPVQPDTTDIVF

SEQ ID NO: 203184 - protein, 374 aa, Glycine max
  Coding DNA Sequence Number=SeqID_86406
  Gene Ontology: Mol. function=RNA-directed DNA polymerase activity; Cellular component=chromatin; Biological process=chromatin assembly or disassembly
MGDWSRGWKEFGFLEEVGVLVEQGGDGGRVETPLVWMRRRTCWAEAELGWGVCIAKGNGEEIHHEMVALDDHGGKSQKFHDRALYKIMRTTAINKDEDLVVVDSAKESHSLGNRHTGQGIEAELREYWVGVPARGWYCPRRRQQLANGDEGCSDDPWSTVHRNGNKDPATGVDMCVAWWLGLEWLVVFEWLVGHNLRKGHGLEGLDLATEVGVEARNKTTEKEGRGETNRAICKPLELRQVVVDGAALQELKQSPMGESAGPSIKGLPISGEDGECWVGELVSEELQESQAWRDDLEWIRVFRSWWSGLVTGFGLPPQGAQWPTNEYCAPASSVSRFVVTEYGRVVVILNRLKRLHKVLQVDRFVDHPFGPGIP

SEQ ID NO: 203185 - protein, 400 aa, Glycine max
  Coding DNA Sequence Number=SeqID_86407
  Gene Ontology: Mol. function=kinase activity; Cellular component =apicolateral plasma membrane; Biological process=purine nucleotide metabolic process
  Homolog annotation: Hit_ID=Q9SCL8; Match level="QueryCoverage=97%, HitCoverage=99%, E-value=1e-128, Identity=60%"; Hit description =Guanylate kinase-like protein
  Pfam annotation: Domain name=Ca_channel_B; Domain location=130-359; Score=-39.5; E_value=0.069; Accession=PF00774.10; Description =Dihydropyridine sensitive L-type calcium channel (Beta subunit)
  Pfam annotation: Domain name=Guanylate_kin; Domain location=170-274; Score=177.5; E_value=3.2e-50; Accession=PF00625.11; Description =Guanylate kinase
  Pfam module annotation: Pfam domain module=Ca_channel_B::Guanylate _kin; Domain location=130-359::170-274
MGEAPTFILQELQNGIGNGFELKSGTFETDTIVGDKKYIIGGTNGETFSVKDQILDNNGLGACVDLIELGTKPISCNGHSAVLLKDRILILKETAKPDDCIWFLEVDTPYVRQQKKILGTDVVAWSKGVIGNSEKPVVISGPSGVGKGTLISMLMKEFPSMFGFSVSHTTRAARGMEKDGVHYHFTEKNVMEKEIKDGKFLEFASVHGNLYGTSVEAVELVSDAGKRCILDIDVQGARSVRASSLEAMFIFICPPSMEELEKRLRDRGTETEEQVLKRLRNAQAEIEQGRSSGIFDHILYNDKLEECYENLKKLLGLDECITPPKSSPPKEINLPRDHSVSKIDDKIIISSISSGLEKESKNLIMLDVSSLKGGAPGRTRGLDFQVIGSFSDGFNGNGPF

SEQ ID NO: 203186 - protein, 784 aa, Glycine max
  Coding DNA Sequence Number=SeqID_86408
  Gene Ontology: Mol. function=RNA-directed DNA polymerase activity; Cellular component=chromatin; Biological process=chromatin assembly or disassembly
  Pfam annotation: Domain name=Chromo; Domain location=702-753; Score =15.5; E_value=0.014; Accession=PF00385.14; Description='chromo' (CHRromatin Organisation MOdifier
  Pfam annotation: Domain name=rve; Domain location=425-556; Score =32.6; E_value=1.4e-06; Accession=PF00665.16; Description=Integrase core domain
  Pfam module annotation: Pfam domain module=Chromo::rve; Domain location=702-753::425-556
MTVKDRFLMPTIDELLDELGQAKWFSKLDLYQGFHQIRVAEEDIHKTAFRTQHGHYKFRVMPFGLCNAPATFQSTMNELLKPYLRRFAAVFFYDILVYILTLPVHVQHLQAIFRTLSQGEFYLRQTKCLLARCTLQYLGYIVSDQGISPDPDKIQAMLTWPIPTSVSKLRRFMGFTGFYRRFIRGYASIANPLTSLLRTDCFHWNPEAQAAFNKLQQAMTQVPVMAPPDFTIPFILEIDASGTAMGVVLIQRAHPIAFHSKILCNRLRRASTYVRELHAITVATPEQQTYMTKLLGYDYSIEYKSGAANVVANALSRIPSPRSLLLLSMPNFEFMDQLRQSLHSSDSYTNLLNAVIHYPDQHEGFTTARDMIFFNKKIWLPSDCPFISVIMDEFHSTPFVTECTICLQTKYKAKKPAGLLHPLPAPIAPWEELSLDLICGLPSSHGHSSILVIVDRFYKGIHLGALPPHYTAHSVATLFFDLVCKHHGFPRSLVSDRDPIFVSKFWKELFRLTEQYLRAFMHDHPHSWTRFLALAEWSYNTSVHSATGLTPFEVTYGKPPPSILQYLHDTSQVEAMDILLANHQCIRSVLHGRLRKAQENMKKAADSHRQDVSYSQGDWVYIRLRPYRQSSIASSYYKLSKSYFGPFQILERIGPVAYHLALPVKSRIHPVFHVSLLKLHPGPPPSTPGVLPMASKDNNPIVTPLTILDWKWNASTTPPSRLVLVQWHGLSPKDSTWEDWNDLAATYVLEDKDIFPSGGIDSNLTGNARPKRVINKPTHLKDFV

SEQ ID NO: 203187 - protein, 248 aa, Glycine max
  Coding DNA Sequence Number=SeqID_86409
  Gene Ontology: Mol. function=pepsin A activity; Biological process =proteolysis
  Homolog annotation: Hit_ID=Q9FSZ9; Match level="QueryCoverage=58%, HitCoverage=38%, E-value=3e-42, Identity=61%"; Hit description =Putative extracellular dermal glycoprotein
MNAVPDATIHRPNVRSIVSHKKCPKGAACSGTGCIGPYKSGCATNDCDITVTNPLAQFSSSYPMVEDAIFLSHTFILGFLVGCVDLVDDVISGHALQVGGGGGNPQVESKFLQTTPLVVNPVATGAVSIYGTPSIEYFIDVKAVKIDDHVVNLNPSLLSIDKKRNGSTKISTATPWTELHSSLYKPFVQEFVNKAARRRIKRVTSVSPFDACFDISTIGNSVTGLAVPIIDLVLPGGVRWLFMEPIQW

SEQ ID NO: 203188 - protein, 242 aa, Glycine max
  Coding DNA Sequence Number=SeqID_86410
  Gene Ontology: Mol. function=transferase activity, transferring hexosyl groups; Cellular component=mitochondrion; Biological process= metabolic process
  Homolog annotation: Hit_ID=Q1SMD3; Match level="QueryCoverage=71%, HitCoverage=73%, E-value=2e-18, Identity=29%"; Hit description=TonB box, N-terminal; Tetratricopeptide-like helical
  Pfam annotation: Domain name=PPR; Domain location=143-177; Score =35.0; E_value=2.6e-07; Accession=PF01535.11; Description=PPR repeat
  Pfam annotation: Domain name=PPR; Domain location=195-229; Score=9.1; E_value=0.62; Accession=PF01535.11; Description=PPR repeat
  Pfam annotation: Domain name=PPR; Domain location=82-116; Score=21.2; E_value=0.0036; Accession=PF01535.11; Description=PPR repeat
  Pfam module annotation: Pfam domain module=PPR::PPR::PPR; Domain location=143-177::195-229::82-116
MIHWGHVPRSNTDRDSTAGSKGSTRSKKYKAKTEGNNLSPIWHWHPRNQLIFSFYLFISGGADPRTWWVFNEFKRKVVMDAYSFGIMIKGRCEAGDLMKGFRLLAMLEEFGFSLNVVIYTTLIYGCCKSGDNMKPSGIVPNAYAYNCVISEYCNARMVDKALNVFAEMREKGKKFGEAVKIVHQVNKVGLSPNIVTYNILINGFCDVGKIDTAVENLAGALDLVKEMEERCIPPSKVTYNSN

SEQ ID NO: 203189 - protein, 229 aa, Glycine max
  Coding DNA Sequence Number=SeqID_86411
  Gene Ontology: Mol. function=pepsin A activity; Biological process =proteolysis
  Homolog annotation: Hit_ID=Q1S7J2; Match level="QueryCoverage=70%, HitCoverage=48%, E-value=9e-14, Identity=31%"; Hit description =Peptidase aspartic, catalytic
  Subcellular localization annotation: CTP_CleavageSite=69; ConfidenceScore=5.88e-01
MATCPVALIIHFFLFSLLSSSSSPSRKTLQPFSTQLPSTWNASYGSSAATTPTPQRTTLSDVGLTNACKQAKGTACITCTNHTLKTGCTNNTCGVDPFNPLGAFFVSGDVDEDIYLVLRPLYTCHASFLHVLGLMAFCKTSPRSRKGSWALQGLLFPYQHNSHFVYLQLQSITIFDDDPSSEYFIDDKSIKVDGKIVNLNTCLLSIDKQGNGGSKLSTVVPYTKLHTLI

SEQ ID NO: 203190 - protein, 149 aa, Glycine max
  Coding DNA Sequence Number=SeqID_86412
MFKREHESFKEYAQRWRDLVAQVAPPMMEREMITKIVDTLPVFYYEKMVGYMPSSFADLVITGKRTEEAWANEENKKEGGTHVAIPTWPNFPPAQQYQYSANISPSHYPPHYHPRTLNHPQRPPLNQPQKPPAAHPIPNTTLNTNQNTN

SEQ ID NO: 203191 - protein, 125 aa, Glycine max
  Coding DNA Sequence Number=SeqID_86413
  Gene Ontology: Mol. function=protein tyrosine/serine/threonine phosphatase activity; Biological process=protein amino acid dephosphorylation
  Homolog annotation: Hit_ID=Q9ZR37; Match level="QueryCoverage=62%, HitCoverage=39%, E-value=3e-19, Identity=49%"; Hit description =DsPTP1 protein
  Subcellular localization annotation: CTP_CleavageSite=40; ConfidenceScore=5.12e-01
TSSSSSLKGPSSSLGKPDYAVNSSSFGWVDEKGSITRILKVSAVTEQFDNCMKKQVEAIARVLHLFQSYKEDNIPCKIDEGLYLGSIATAANKPALKDCNITHVLTVAGRIPPAHPHDFVYKIID

SEQ ID NO: 203192 - protein, 96 aa, Glycine max
  Coding DNA Sequence Number=SeqID_86414
  Gene Ontology: Mol. function=protein dimerization activity
  Homolog annotation: Hit_ID=Q1T3H7; Match level="QueryCoverage=65%, HitCoverage=10%, E-value=4e-11, Identity=50%"; Hit description=Zinc finger, BED-type predicted; HAT dimerisation
MTKFVELCLNEWGLNLVLSLMVDNATSNDTGILHLKERWNSTYLILDVALKPKKTFQKSEFYDPQYVDDLGKGIGLPSNEDWEYVEAILPFLTIVY

SEQ ID NO: 203193 - protein, 89 aa, Glycine max
  Coding DNA Sequence Number=SeqID_86415
MEKMNVHIITRGTPKARPGELILSHELTSLPRRAGYLTWKSYGGPGYPGASLGELGSRKLKKRPFCPSCLATGKNQGRKTCKQKDIEAL

SEQ ID NO: 203194 - protein, 90 aa, Glycine max
  Coding DNA Sequence Number=SeqID_86416
MVKSRNISHFEESDNCEREMIFGRAGIPQIKLKCSPIAPKESFLKLNTDDNFIGNPGHYRFGGLLRNNLSGYWVLDYLGSCGYTINIIPQ

SEQ ID NO: 203195 - protein, 83 aa, Glycine max
  Coding DNA Sequence Number=SeqID_86417
MKKIPSFLTKKPVYIPLMEQESQIGVCVKAPWEGGQAIKHMPHNLSHVKSIHNFMTHLLYLEPDQKQEFQKNIQDKNNWNLRK

SEQ ID NO: 203196 - protein, 228 aa, Glycine max
  Coding DNA Sequence Number=SeqID_86418
MLLHILVHSLRIERPLDFANFYTTKTYIAWKLVIKEQEAVQVSLMGKVQGFSLRSFGGCFDSCRDHSQGSGYGTRIWNLSDRPVELQIRVGSILKKIHTLKPGSSKRLKCKSIYKAYIPGGSGSVGGSLKSLLYYYDETCQPYILIRDTGCQSLRMAKQQYISLEDLRDSSEIKVFWDHLRGECYRLKEDDLIDMKQDQRIIAETEILIHILRRCLCTVGRNKRLSNE

SEQ ID NO: 203197 - protein, 299 aa, Glycine max
  Coding DNA Sequence Number=SeqID_86419
  Gene Ontology: Mol. function=metal ion binding; Cellular component =nucleus; Biological process=ubiquitin cycle
  Homolog annotation: Hit_ID=Q8RUJ8; Match level="QueryCoverage=70%, HitCoverage=51%, E-value=8e-54, Identity=50%"; Hit description =Putative hydroxyproline-rich glycoprotein
MGISWSNSNSNRRRRRINTYFHPPHLPPPYYYHPPPPPPPPPQGYFIASTNPYASTTGYVGPPPTQYYPNGVNSVMLHQQPLASGILASPPPYVDHQATKKIRNDVNLHKHTLRLHLDPNNSDHHLISFDFDALYDGSITIFYLAKEEEKCRFIPLFPDVFEPITFPFQKGAGQKFCQPSGTGIDLGFFELDDLSLPSPEEDVFPLVICAETTSNSVIDASPHMQITQAVLEKSNGIGPFQVKVVRQILWIDDIRYELRELYGIGSSTVADFDDNDPGKECVICMTEPKDTAVLPCRHM

SEQ ID NO: 203198 - protein, 145 aa, Glycine max
  Coding DNA Sequence Number=SeqID_86420
  Homolog annotation: Hit_ID=Q8H3D8; Match level="QueryCoverage=89%, HitCoverage=36%, E-value=9e-17, Identity=44%"; Hit description =Integral membrane protein-like
MDPFDLLKIMPITLALVYVGTTFKDLSDVTRGWGEFSKTHLPWIISGLVISALYATSSVLQWLGGRCVAEWEKAGRCCIWECVVLMIWVTKVAKSALDKALAECEDMDNTASSPELPIVTETSVDLNQPLINKTNQDEGNLNSTV

SEQ ID NO: 203199 - protein, 123 aa, Glycine max
  Coding DNA Sequence Number=SeqID_86421
MENPLYGKFRIKGLPFAHKLIELFKDVVANGEFQWAPSSGILPVSVEVDMNDGYHPSLEGIGLDLEEGSSDSEDASVGAIDAFEGIHMNDSQGTISQGIVSQKRKGINHTKKLARRRQLPLKE

SEQ ID NO: 203200 - protein, 109 aa, Glycine max
  Coding DNA Sequence Number=SeqID_86422
MDCQFLVCAFVDYCRYRSWNFDVTIRRDVGRRAADAEALEEETRRRIFEEDQTPRRKVVWAQRKEEMTTMTTEELKAAKKEEEASRAKMRENHTAPRLKRNRARGSGRC

SEQ ID NO: 203201 - protein, 536 aa, Glycine max
  Coding DNA Sequence Number=SeqID_86423
MVGMVVVWSIDGCTVKNIIQAWRYQQDYLAVKSHTPNLTFVSPYSPVNFTVYGKKPLLVKGHASWVSSELEPNLTSNLIARWSARGGEPCKDSKAVEIAIPGLDGGEVIELSAGDVHEFGFQALDDSGKPLCVGGDYFETDLSGDSWKSRPLVKDFSNGSYLISLQVHPDFDGVYNLTIILLYRHFEGLKFTPWRFSYDQMLRSVAIRFYKSSVRLPELQGCKASDFDRDVWIGRWTRHGKNDDCTIGNDGRYRCLAPDFPCQAPWCDGSLGILESNGWVYSTHCSFKLYSAESAWNCLKNRWIFFWGDSNHVDTIRNLLNFVLDLPEIPSVPRRFDMNFSNPRDPSQTVRITSIFNGHWNETQNYLGLDSLRDEGFQDLLKKYFSEDTIPDTVIMNSGLHDGVHWRNIRAFSVGADYAASFWGDVMKTVKQRGLAWPRVFFRNTVATGGYARSLAFNPNKMEVFNGVLLEKLKQSGVVSGVIDNFDMTFPWHFDNRCNDGVHYGRAPAKMKWRDGQIGHQYFVDLMLAHVLLNAL

SEQ ID NO: 203202 - protein, 72 aa, Glycine max
  Coding DNA Sequence Number=SeqID_86424
MVVENIVLTHQSVNVTWTYEHREDLRGYEGVTCFNPYYNVGDDSLWWLEVERERGQIVLSFLKNAFHYWYVQ

SEQ ID NO: 203203 - protein, 95 aa, Glycine max
  Coding DNA Sequence Number=SeqID_86425
  Homolog annotation: Hit_ID=Q1T0K7; Match level="QueryCoverage=100%, HitCoverage=43%, E-value=5e-23, Identity=56%"; Hit description=Heat shock protein Hsp20
MDLKLGLKITKTRDDIASISEYRLAKAGPIFQSRETNIMFILTAHLKGYKRNNIDIKISEDGSKISISGEKPVQNILMMGWLMHRKEVDVAGFNK

SEQ ID NO: 203204 - protein, 90 aa, Glycine max
  Coding DNA Sequence Number=SeqID_86426
MADLSVLFCFYLSTSAKGYHSVPKEIANPNAKEFKGILLLRLASVKENMLSKAFLTRFLSLIKNKGGVIEKLKASRQQCILQPILYIRCK

SEQ ID NO: 203205 - protein, 466 aa, Glycine max
  Coding DNA Sequence Number=SeqID_86427
  Gene Ontology: Cellular component=nucleus
  Homolog annotation: Hit_ID=Q3ECY6; Match level="QueryCoverage=99%, HitCoverage=82%, E-value=6e-72, Identity=38%"; Hit description =Protein SET DOMAIN GROUP 41
MEMRSKEEIEIGRDITATLTPLSFCLHTFYLHTHCSACFSSLPIPNPNPNPNSLFYCSPPCSAALSPLHHSSAERHLPPSAHSSHLCTALRLLLSHRPTSSSRLAGLLSNRHILTSLSVHDDVSERISVGAGAMAEAIAKQRGIPNDDAVLEEATIALSAVLTNAVEVHDNEGRALGIAVFDQIFSWINHSCSPNACYRFVLSSSSHSGEAKLGIAPHLQMNSSGVSISSSEFAKGGLGYGPRLVVRSIKKINKGEEVTVAYTDLLQPKAMRQSELWSKYRFVCCCKRCSALPSSYVDHALQEISAITCESSGSCSKFLKDMADRRLTECIDDVILEYLSVGDPESCCEKLEEILTQGLKEHLEVIEVKPDYSETDINQLKAFDMSRISAAYSLVLAGATHHLFNSESSLIASVANFWTGAGESLLSLSKSSGWSMCVNLGLVIPNLASAMKFKCTKCSLMDRFRA

SEQ ID NO: 203206 - protein, 173 aa, Glycine max
  Coding DNA Sequence Number=SeqID_86428
  Homolog annotation: Hit_ID=Q10RR9; Match level="QueryCoverage=60%, HitCoverage=29%, E-value=4e-14, Identity=36%"; Hit description =Expressed protein
MGPTILNFPCKSLNKRELPHLRFSRRRFLSNVCDQLDIAAKGTYILNKDFDTMTRVVARLYDEIEHKRTMVQFFLDKKDDKFSLQMVKELKKSGDGFRKQVEELKEHVYLCLVTINRARCLVTEEMTKMCTEGIGSVDMLLASSEQEKVKNSTRKMVGNSNSPESKVRRYMDS

SEQ ID NO: 203207 - protein, 307 aa, Glycine max
  Coding DNA Sequence Number=SeqID_86429
  Gene Ontology: Cellular component=nucleus
  Homolog annotation: Hit_ID=Q3ECY6; Match level="QueryCoverage=85%, HitCoverage=53%, E-value=1e-23, Identity=27%"; Hit description =Protein SET DOMAIN GROUP 41
MVILCYTQAMRQSELWSKYRFVCCCKRCSALPSSYVDHALQEISAITCESSGSCSKFLKDMADRRLTECIDDIGVSFYSETYINQLKAFDMSKISAAYSLVLAGATHHLFNSESSLIASVANFWTGAGESFLSLSKSSGWSMCVNLGLIIPNIASAMKFKCTKCSLMDRFRADITQKVWGFLISDCQFLQSCKDPIISSWLMSTKSSSTVNVEVCVNKTNMRYTHESENSVSLGHEQTYADHAVACIFHLGLHCLAYGGLLASICYGPHSHLQKLDGMINAEEIDVQLSYSIIGSKMKCIRNIRLDD

SEQ ID NO: 203208 - protein, 181 aa, Glycine max
  Coding DNA Sequence Number=SeqID_86430
  Subcellular localization annotation: CTP_CleavageSite=84; ConfidenceScore=5.78e-01
MWSKTAIPRARPSLSCTSTAFVSTALSAIVASSKTASPLGTPRCFAIASAMAPASTLILSETSSSTEREVGGARRRSGGEVKVRRSMEGSNRRVNRDWDWDWELEGKRSKQSSECEDRKCGDKKREESVLLLCLFLFLFGASHCWCLLKKKMLGNRKMHINRKKAHRSSNGSSIHHMNPMY

SEQ ID NO: 203209 - protein, 196 aa, Glycine max
  Coding DNA Sequence Number=SeqID_86431
  Gene Ontology: Mol. function=RNA-directed DNA polymerase activity; Cellular component=exocyst; Biological process=RNA-dependent DNA replication
MGFNGKWVSWIKNMLSSSSISILVNESLTGEFKSTRGLRQGDPIAPFLFLVVVEGLSGLMRQALLKGLYKGYKVGKQNAELSLLQFADDTLFFVEDSLQNVLCIKSILRSFKMVSGLKINFHKSSIGGIGVVDTLLHRYALFLNCSYMDFPFVYLGVPIGANPRRKSVWSKVLEKCRKKLSVWRQKNTFLGGGGVI

SEQ ID NO: 203210 - protein, 79 aa, Glycine max
  Coding DNA Sequence Number=SeqID_86432
DGQNVDHFLGEPEQLRFGGVEKFGVELKDGVEEIAPLRRAYWSGVGMDKEKGGLRDGCRDSKATLSDASNAFSASKGAV

SEQ ID NO: 203211 - protein, 555 aa, Glycine max
  Coding DNA Sequence Number=SeqID_86433
  Gene Ontology: Mol. function=DNA binding; Cellular component=beta -galactosidase complex; Biological process=DNA integration
  Homolog annotation: Hit_ID=Q1SS72; Match level="QueryCoverage=89%, HitCoverage=40%, E-value=1e-108, Identity=39%"; Hit description =Integrase, catalytic region
MSVCCSDDLDSISDVSDNTFSRTSGSSHWDHLENTYYRRELSSKLYAEDGVSYFQLEVDTTIGASFALPSPSVRRSIRTSNPPPYLLDYIRPQPRQKSHPIQDHCSLVHLHSPYKDFIAQVSTIYEPQFYHQAVPFPEWHQAMTAEIKALESNNTWTLVPLPIAKGYTQQAGIDFSDTFSPLDVDNAFLNGDLFEEVYMELPKGYTSVDKNLVCRLNKSIYDLRQASRQWFYKLSTTLIENGFSQSKNDYSLSTIGKGASLVVLLVYVDDILLAGPSATCVHSVQAKLQALFKLKILGSLQYFLGLQVAKSSKGIVLTQRKYALSLLEDTGFLGCKPSSLPMDPNLKLDMLSGDLLPNPSMYRCLLGRLMYLTISMPDITFAVNKQSQCMQHPRIPHLNAVHHLLQYIKGTPGQGLHFPASNSFNLSAYADADWGGCLDTRTAEAEYRALSSVPSEVIWLRRLLLHFEISIPSAMLFCDSKSAIYLASNPAHHERSKHIDIDYHFIRELVQSNTLKLVHVKSQHQVADIFTKPLMLLAFSSFIRKLGLINIYSPT

SEQ ID NO: 203212 - protein, 844 aa, Glycine max
  Coding DNA Sequence Number=SeqID_86434
  Gene Ontology: Mol. function=metal ion binding
  Homolog annotation: Hit_ID=Q6K9X4; Match level="QueryCoverage=98%, HitCoverage=98%, E-value=1e-118, Identity=35%"; Hit description =Ubiquitin-protein ligase-like
  Pfam annotation: Domain name=zf-C3HC4; Domain location=792-830; Score= 7.3; E_value=0.028; Accession=PF00097.15; Description=Zinc finger, C3HC4 type (RING finger)
MTDFQPLQQKPEPADAHAEFELGLEEFMRGHLDDCMSFASCSSSRAPDDEDDEGDQLVRRRRRSDLEGDDLAESSAARRRHSRILSRWAARQAQEMITTIERRNRESELMALAGLHTVSMLDSSFLRGSQSPTSGQEGAVERPSTQASAILQMWRELEDEHLLNRARERMRVRLRHQRNSDSNTNVSSTMSDSRGSENQGSLGDASESETDYGTWSHDQIGSRNAHGDHNGSSREQSPDLGEVERERVRQIVQGWMESGISDHSSNVSQRNNNRRAEWLGETERERVRNIREWVQMISQQRSSRGSRRDAQVSEGAQSDRARDVVADNDESQPEHVRRDMLRLRGRQALVDLLVRIERERQRELQGLLEHRAVSDFAHRNRIQSLLRGRFLRNERTVEDERPPSMAASELVQLRQRHTVSGLREGFRSRLENIVLGQAGTSPDSTSNSNASETRGDGSQANSLVDGQQENYEQQIRSLETDVRQLPNRTGTLESSTSESISWQEASNQGGNWQEQIAEEGGGNWQRSPFDQTRDGRAVSDWPQEPPRNLTGEDPHPQEAQRIWHDDNTRETVGNWSEGPSGASRNRRGVPIRRFNRFHPPDDDNVYSMELRELLSRRSVSNLLRSGFRESLDQLIQSYVERQGRAPIDWDLHRNLPTPTPASPERDPDQQGEERDEGQHETINRPSLVLPSPPVPPPQPLWHQDLHQTGWSRHSMHRSEIEWEIMNDLRSDMARLQQGMNHMQRMLEACMDMQLELQRSVRQEVSAALNRSGLSAETSDDGSKWGHVKKGTCCVCCDNHIDSLLYRCGHMCTCSKCANELIRGGGKCPLCRAPIVEVVRAYSIL

SEQ ID NO: 203213 - protein, 37 aa, Glycine max
  Coding DNA Sequence Number=SeqID_86435
MAIIDTTVSNQCLKKNVTNACTFGAARFKPGSFGFFA

SEQ ID NO: 203214 - protein, 1202 aa, Glycine max
  Coding DNA Sequence Number=SeqID_86436
  Gene Ontology: Mol. function=protein transporter activity; Cellular component=COPI vesicle coat; Biological process=intracellular protein transport
  Homolog annotation: Hit_ID=Q1S9I3; Match level="QueryCoverage=99%, HitCoverage=100%, E-value=0.0, Identity=83%"; Hit description =Coatomer WD associated region; Coatomer alpha subunit, C-terminal; Cytochrome cd1-nitrite ...
  Homolog annotation: Hit description=reductase-like, C-terminal haem d1
  Pfam annotation: Domain name=COPI_C; Domain location=790-1202; Score =882.4; E_value=2.1e-262; Accession=PF06957.2; Description=Coatomer (COPI) alpha subunit C-termin
  Pfam annotation: Domain name=Coatomer_WDAD; Domain location=337-767; Score=799.5; E_value=1.9e-237; Accession=PF04053.4; Description =Coatomer WD associated region
  Pfam annotation: Domain name=WD40; Domain location=1-37; Score=5.6; E_ value=8.1; Accession=PF00400.22; Description=WD domain, G-beta repeat
  Pfam annotation: Domain name=WD40; Domain location=125-163; Score =48.6; E_value=2.1e-11; Accession=PF00400.22; Description=WD domain, G-beta repeat
  Pfam annotation: Domain name=WD40; Domain location=194-232; Score =37.7; E_value=4e-08; Accession=PF00400.22; Description=WD domain, G -beta repeat
  Pfam annotation: Domain name=WD40; Domain location=238-276; Score =36.5; E_value=9.2e-08; Accession=PF00400.22; Description=WD domain, G-beta repeat
  Pfam annotation: Domain name=WD40; Domain location=41-79; Score=43.5; E_value=7e-10; Accession=PF00400.22; Description=WD domain, G-beta repeat
  Pfam annotation: Domain name=WD40; Domain location=83-121; Score =46.8; E_value=7.5e-11; Accession=PF00400.22; Description=WD domain, G-beta repeat
  Pfam module annotation: Pfam domain module=COPI_C::Coatomer _WDAD::WD40::WD40::WD40::WD40::WD40::WD40; Domain location=790 -1202::337-767::1-37::125-163::194-232::238-276::41-79::83-121
MLTKFETKSNRVKGLSFHPKRPWILASLHSGVIQLWDYRMGTLIDKFDEHDGPVRGVHFHHSQPLFVSGGDDYKIKVWNYKLHRCLFTLLGHLDYIRTVQFHHENPWIVSASDDQTIRIWNWQSRTCISVLTGHNHYVMCALFHPKEDLVVSASLDQTVRVWDISSLKRKSASPADDILRLSQMNTDLFGGVDAVVKYVLEGHDRGVNWASFHPTLPLIVSAADDRQVKLWRMNDTKAWEVDTLRGHMNNVSCVMFHAKQDIIVSNSEDKSIRIWDATKRTGIQTFRREHDRFWILAAHPEMNLLAAGHDSGMIVFKLERERPAFVVSGDSLFYTKDRFLCFYEFPTQRDAQVLPFRRPGSLSLNQSPKTLSYSPTENAFLLCSDVDGGSYELYCISKQSYGRGDVQDEKRGHGASAVFVARNRFAVLEKSSNNVLIKNLKNDIVKKSVLPIATDAIFYAGTGNLLCRSEDKTPFIKYVVWSDDMEHVALLSKHAIIIASKKLVHQCTLHETIRVKSGAWDENGVFIYTTLNHIKYCLPNGDNGIIKTLDIPIYITKVSGNTIFCLDRDGKNRAIIIDSTEYIFKLSLLKKRYDHVLNMIRNSQLCGQAMIAYLQQKGFPEVALHFVKDEKIRFNLALESGNIQIAVASATAIDEKDHWYRLGVEALRQGNAGIVEYAYQRTKNFERLSFLYLVTGNMEKLSKMLKIAEVKNDVMGQFHNALYMGDVRERVKILENVGHLPLAYITASVHGLHDVAERLAAELGDNVPSLPAGKVPSLVMPPSPVMCGSDWPLLRVMRGMFDGVLDNTGRGVADEEEYEAADGDWGEELDIVDADGLQNGDVTAILEDGEVAEENDEEGGWEMEDLGLGPEADTPKASISTQSSVFVTPTPGMPVSHIWTQKSSLAADHAAAGNFDTAMRLLNRQLGITNFAPLKTMFLDLHTGSHSYLRAFSSAPIISLAVERGWTESSSANVRGPPALPFKLSQLDEKLKAGYKFTTAGKFTEALKTFVNILHTIPLIVVESRREVDDVKELIIIVKEYVLGSQMELKRREVKDNIVRQQELAAYFTHCNLQTPHLRLALQNAMTVCFRAKNLATAANFARRLLETNPTNENQARAARQVVAAAEKNMTDATQLNYDFRNPFVICGATYMPIYRGQKDVSCPYCSSRFVPTQEGQLCNVCDLAVIGADASGLLCSPSQIR

SEQ ID NO: 203215 - protein, 110 aa, Glycine max
  Coding DNA Sequence Number=SeqID_86437
MASRLDSLFTTNNNFRDGGDHTTTTDSDATAHVSPTMASVVADVLCLRLYHRKTNALLVVVRVRTTNLSVTDIEVVAELDNGSAGEDHQDGANKKEWDSTVKEETDRTCD

SEQ ID NO: 203216 - protein, 490 aa, Glycine max
  Coding DNA Sequence Number=SeqID_86438
  Gene Ontology: Mol. function=DNA binding; Cellular component=cell outer membrane
  Homolog annotation: Hit_ID=O04697; Match level="QueryCoverage=99%, HitCoverage=96%, E-value=2e-75, Identity=51%"; Hit description=DNA -binding protein PD2
MMHSVKGGWGQTFALAKHNESEGRKTRIRRSKQERKAMVESFIKKYQELNNGNFPSLNLTHKEVGGSFYTVREIVRDIIQENRVLGPAKFTLEELNTDQFFEQNPLGSIARDPQPFLAASLIENHCELDKLQDTNSKMISVSDVSYTEAVHQQVVDKGDVISVGHVDVTNKESIEAAVVVDGCDTGDEHPMFDKGQTMNVSQVDVTNNESVETAVFSGGCCSGTEHKIVDRGHVLNGSQVNMINEESNETVIPEMQVGDPLALNQNAEQELAVATTPMAKVTAVTEDLVVETFPLNSVSGTTDLGGLGDSSNSPENDIKKLKLKQCEKFEYAPGNQILEDSSNAGLDKEENVQDMLEESSNHSTRKELFDHHEFEDRSDSQVRAYNQNIITFKTISQSQMIDGVKTSTQTNNLSKTCKPSEEDGSLLKADKHRVDDQLGGNSQRRSNTTVDRINLESWDGAAKNSAKQEPNPLLAVLKVFVDAFVKFWSG

SEQ ID NO: 203217 - protein, 513 aa, Glycine max
  Coding DNA Sequence Number=SeqID_86439
  Gene Ontology: Biological process=biosynthetic process
IQQGSWEWNLFQNEIDLSKIDSNRKVSIVYAVEHELASLNYSTSIVENGTEVPLQDELTQLDLDTLREIEISEENEMFEVEEAEERMEKGVSVWDDIYRNARKSEKLKFEVNERDEGELERTGQSVCIYEIYNGAGVWPFLHHGSLYRGLSLSRRAQRQTSDDVDAVGRLPLLNDTYYRDILCEMGGMFAIANRVDSIHRRPWIGFQSWRAAGRKVALSAKAENVLEETMQENFRGDVIYFWGRLDMDQSAIRNHNAISFWYMCDILNGGNCSPFEKYETSSKRNMFGGSELEFLEVGLWSLDIVIIVFQDGFRQMYALPPHAEALPPMPEDGGYWSALHSWVMPTSSFLEFIMFSRMFVDSIDAKHRDSTKYSLCLLGSSEIEKKHCYCRMLELLINVWAYHSARKMVYINPNTGSMEEQHPIEQRKGFMWSKYFNFSLLKSMDEDLAEAADDGDHPREMWLWPMTGEVHWQGIYEREREERYRLKMDKKRKTKEKLFERMKYGYKQKSLGR

SEQ ID NO: 203218 - protein, 192 aa, Glycine max
  Coding DNA Sequence Number=SeqID_86440
  Homolog annotation: Hit_ID=Q1S064; Match level="QueryCoverage=62%, HitCoverage=30%, E-value=1e-06, Identity=32%"; Hit description =Cyclin-like F-box; F-box protein interaction domain
MVHSESLPVCTSDNLHHNCNLGYMSQALRQHNLSKHFILKTKGQNKIVPSTGHIALGNPMNKPVLKTIGSISSHVTDRSNAIKDPPRPSCKRVKLKQGSRKAKAFIIHDARNSDHLVIAITRIKTEGNVGMVVARVVVGCIVHRRQCKGDLGDAGITEGNDGELVIGEGGKAEGEEGISAAVVEGDEGFVGD

SEQ ID NO: 203219 - protein, 169 aa, Glycine max
  Coding DNA Sequence Number=SeqID_86441
  Gene Ontology: Mol. function=DNA binding; Biological process=DNA integration
  Homolog annotation: Hit_ID=Q1S9T4; Match level="QueryCoverage=69%, HitCoverage=23%, E-value=4e-15, Identity=78%"; Hit description =Integrase, catalytic region
MAYILLYVDDIILTTSSYVIRMSIISLLNSEFAMKDLGPLSYFLGIVVTRHQMLIGVGVRIPDALHLVIMCFLVVRGEVRVLPVPSRYQIADIFTKGLPLVLFENFRNNLSVQQLPVSTVVLHSAVVYIILTNLIRSVTSVEVKLYSLGFYLIRESRDLKVKVPLAIGG

SEQ ID NO: 203220 - protein, 113 aa, Glycine max
  Coding DNA Sequence Number=SeqID_86442
  Gene Ontology: Mol. function=protein tyrosine/serine/threonine phosphatase activity; Biological process=protein amino acid dephosphorylation
  Homolog annotation: Hit_ID=Q93X44; Match level="QueryCoverage=90%, HitCoverage=23%, E-value=3e-21, Identity=84%"; Hit description =Protein tyrosine phosphatase
MKVMDFDAFDLRRRLPVVVSKLYKAINSNGGVTYIHCTAGLGRAPAVAVTQIEFMAFMISMHNDCVAIIDSSTVIVESPVSKIRAKGHAFQNWMPLKVQQLILCDLLDKSFSP

SEQ ID NO: 203221 - protein, 89 aa, Glycine max
  Coding DNA Sequence Number=SeqID_86443
  Homolog annotation: Hit_ID=Q10SY1; Match level="QueryCoverage=37%, HitCoverage=9%, E-value=1e-08, Identity=73%"; Hit description =Protein tyrosine phosphatase, putative, expressed
MELNILDENTLPGYTDEITSDNEEKEKKHKNWGFKLAKHILRNGIFLKPKQEISIITCPHPISSPEISTVEQLLPSHDKVTDFLLRPVS

SEQ ID NO: 203222 - protein, 166 aa, Glycine max
  Coding DNA Sequence Number=SeqID_86444
  Homolog annotation: Hit_ID=Q1RZQ1; Match level="QueryCoverage=54%, HitCoverage=22%, E-value=3e-09, Identity=36%"; Hit description=IMP dehydrogenase/GMP reductase
MAYNKLQLLISLIMNHKLENIICCDIAAIHSTPLVNLEDQDQLAWKFTPTDWELRHLKVNGNWVAVRKLEAPTKIKHFLWRALRGCLPTRQRLINKAATSSQHHHSHNYCSLEHMEKKKPEALQFTWRQANLVADKLAKTSRFHVHTKVYDFIPHLVYPIIMNEMK

SEQ ID NO: 203223 - protein, 185 aa, Glycine max
  Coding DNA Sequence Number=SeqID_86445
MNEGTRTHESYPWRADANSGLGANRIESIAREEPLRNPPGDEAERGAEADSSADVPGAIGTLAEDGGDGALQDHGGEGEEEDHDDDESVESGLGLGEREEPQQQALALVEVRSDANVVVVAAAAAAAVVGARQLPIEGGAVAVVARVPLEGESAADRTESNVPAGVVDLRLRSHVARQSHRKINE

SEQ ID NO: 203224 - protein, 55 aa, Glycine max
  Coding DNA Sequence Number=SeqID_86446
MENWRTALRNNFAGLQTRREWRIGEQRYAITSRGSRLEGGGHMNSARQLHSWVSE

SEQ ID NO: 203225 - protein, 35 aa, Glycine max
  Coding DNA Sequence Number=SeqID_86447
MEMFVYPGEKSDNAWGRGIQALLQACRLLRITEGN

SEQ ID NO: 203226 - protein, 85 aa, Glycine max
  Coding DNA Sequence Number=SeqID_86448
  Gene Ontology: Mol. function=hydrolase activity; Cellular component =integral to membrane; Biological process=aromatic compound metabolic process
  Homolog annotation: Hit_ID=Q9FN79; Match level="QueryCoverage=94%, HitCoverage=18%, E-value=6e-18, Identity=49%"; Hit description =Arabidopsis thaliana genomic DNA, chromosome 5, P1 clone:MVA3
MHNVICGGEKFVDSYLMILTKAGVRINVIQGDKDKAVPMECCSKLNLKAPNAEISIIPNANHGTVLFGRKKEFACSLEHIWESCC

SEQ ID NO: 203227 - protein, 288 aa, Glycine max
  Coding DNA Sequence Number=SeqID_86449
  Gene Ontology: Mol. function=hydrolase activity; Cellular component =integral to membrane; Biological process=aromatic compound metabolic process
  Homolog annotation: Hit_ID=Q9FN79; Match level="QueryCoverage=95%, HitCoverage=62%, E-value=7e-90, Identity=57%"; Hit description =Arabidopsis thaliana genomic DNA, chromosome 5, P1 clone:MVA3
  Pfam annotation: Domain name=Abhydrolase_1; Domain location=43-281; Score=78.1; E_value=2.8e-20; Accession=PF00561.10; Description =alphabeta hydrolase fold
NGENFRGNHPSENAIFLHGFLCSSSFWTQTVFPCFSEKVNKNYRLIAIDLLGFGKSPKPRDCSYTLKDHVEMIEKSVIQPLELSSFHLVAHSMGCIIALALAAKYPKCVKSITLVAPPYTSSEGNEACLNALSMLAGKKLWSPLSFGSSFMSWYEHLGRTVCLVYCRNHRIWESILKFITRKRDLPFFTIDLTRHTHHSAWSTMHNVICGGAKFVDSYLMILTRVGVRINVIQGDKDQIVPMECCSKLKLKAPNAEICIIPNANHGTVLFGRKKAFAYSLEHIWESCC

SEQ ID NO: 203228 - protein, 117 aa, Glycine max
  Coding DNA Sequence Number=SeqID_86450
  Gene Ontology: Mol. function=hydrolase activity; Cellular component =integral to membrane; Biological process=aromatic compound metabolic process
  Homolog annotation: Hit_ID=Q9FN79; Match level="QueryCoverage=72%, HitCoverage=18%, E-value=7e-17, Identity=50%"; Hit description =Arabidopsis thaliana genomic DNA, chromosome 5, P1 clone:MVA3
MGFLHFGRKREDSKRKHGRGAGGAGSVNRWSDWGCESCLSWVNDGSDYNKLHFVEKEPLLATYENFRENPPENVIFLHGFLSSSSFWTRTVFPYFSGKVNQKYRLIAIDLLGFNRWG

SEQ ID NO: 203229 - protein, 651 aa, Glycine max
  Coding DNA Sequence Number=SeqID_86451
  Gene Ontology: Mol. function=metal ion binding; Cellular component =intracellular
  Homolog annotation: Hit_ID=Q8S9K3; Match level="QueryCoverage=98%, HitCoverage=74%, E-value=1e-117, Identity=41%"; Hit description=Zinc finger protein VAR3, chloroplast precursor
  Pfam annotation: Domain name=zf-RanBP; Domain location=88-117; Score =36.1; E_value=1.2e-07; Accession=PF00641.9; Description=Zn-finger in Ran binding protein and others
MVLDTDRANTVDLMKFLLSYASNPFLSSEGNNLNKRDIVESSVRNLFGELFKLSYSAPGPNAFDSVKSQMAGRFEQTKLPPGQKIEMKRGDWLCPRCNFMNFARNIKCLECEEARPKRQLAGGEWECPQCDCKQPGQISLGTTNTMSNMGYENGNNLNTSDVDARLAANEEKAQRWFSKVSQLDSSADINSVITDEDFPEIMPLRKGVNRFVVSTRKTPLERRLANAQYKRNLTNNDIPGIEDSNAGESIKPHGNLDDMLGRSAGLPQFDNKNFVDEQNSSGDSQPSFASNTSHFNNVKGSYSSTVPPIPLSADALSQKSENLLAEESKKVVLDTDVGYASSGDSSQLSNNSNITEDREKQQGEKSERWFRKVAELNDFPDIPSAISDKDFPEIMPMRKGENRFVVSKKKDRSLTTPAYKRRAAMEQSGKTNFVPFVPFPPDYFAKKDKQQADGTDSTVADAAASTDRSDDDTSSISEVAQKPPEMSVDARAQPGQSPNPSEQSSNNNDVGSMYGETTSGNSRQSFNQDRVPNLTESSSPGPASENQSGRAEWTGKSLEGSAVKDPDPLDMSEEAKAERWFRRVAQIKDISELSQIPDEDFPSIMPMRKGVNRFVVSKRKTPLERRLTSQQYRRNLPTVSSDPINKENEGS

SEQ ID NO: 203230 - protein, 107 aa, Glycine max
  Coding DNA Sequence Number=SeqID_86452
  Gene Ontology: Mol. function=hydrolase activity; Biological process =aromatic compound metabolic process
  Homolog annotation: Hit_ID=Q9FN79; Match level="QueryCoverage=84%, HitCoverage=19%, E-value=3e-11, Identity=34%"; Hit description =Arabidopsis thaliana genomic DNA, chromosome 5, P1 clone:MVA3
MSLAVAVSSPKWLTNCVQALTSILCCVVFLMFDFLDAVFCVIYRFLDERVEGEASPCCCSNREMLKRRMNVTDDDGLSDSLYERKNTFREMGFLQFGRKCEDSNRKH

SEQ ID NO: 203231 - protein, 296 aa, Glycine max
  Coding DNA Sequence Number=SeqID_86453
  Gene Ontology: Mol. function=phosphatidate cytidylyltransferase activity; Cellular component=integral to membrane; Biological process=phospholipid biosynthetic process
  Homolog annotation: Hit_ID=Q2N2K1; Match level="QueryCoverage=85%, HitCoverage=92%, E-value=1e-118, Identity=83%"; Hit description =Probable phytol kinase 1, chloroplast precursor
  Pfam annotation: Domain name=CTP_transf_1; Domain location=99-256; Score=-51.5; E_value=0.0032; Accession=PF01148.10; Description =Cytidylyltransferase family
  Subcellular localization annotation: CTP_CleavageSite=41; ConfidenceScore=5.53e-01
MTLLSSPLLVFSAVHRRAPPPSTTTPTTNHTVRFLCSPDVPAVRLDQRLPRFVVPVAAEDLLYNAGATVGVLGGGYALVRAFDELTRRNILQQDSNSPKARYFAAFVPLVNCLRLLVNGLSLASDEGLIKSVTREGDPLELLRGPLYYVLILIFCALVFWRESPVGVVSLAMMCAGDGIADIIGRRYGSLKIPYNQHKSLAGSMSMLVFGFLVSIGMLYYYSVLGHVQLDWASTVPRVAFISFVATLVESLPITKSNTLIPNLLENYFQIQELDPNQWLNIRLVMIYASRFFMAEY

SEQ ID NO: 203232 - protein, 91 aa, Glycine max
  Coding DNA Sequence Number=SeqID_86454
MTIGPESGHAQRRKHVRSISDPLVQPLIQYLDPINHRFNFLKLWTVVGWNNDNDGDNDNGDNDDGGGSCGGMIAMEVTMTKVVTMVLVVVE

SEQ ID NO: 203233 - protein, 411 aa, Glycine max
  Coding DNA Sequence Number=SeqID_86455
  Gene Ontology: Mol. function=protein serine/threonine kinase activity; Cellular component=plasma membrane; Biological process =protein amino acid phosphorylation
  Homolog annotation: Hit_ID=Q5I6E8; Match level="QueryCoverage=93%, HitCoverage=73%, E-value=1e-166, Identity=77%"; Hit description=3 -phosphoinositide-dependent protein kinase-1
  Pfam annotation: Domain name=Pkinase; Domain location=1-183; Score =68.0; E_value=2.9e-17; Accession=PF00069.15; Description=Protein kinase domain
  Pfam annotation: Domain name=Pkinase_Tyr; Domain location=1-175; Score=-135.8; E_value=0.00039; Accession=PF07714.7; Description =Protein tyrosine kinase
  Pfam module annotation: Pfam domain module=Pkinase::Pkinase_Tyr; Domain location=1-183::1-175
MISTSKISDFYVQKGRLSEDEARFYAAEVVDALEYIHNLGVIHRDIKPENLLLTAEGHIKIADFGSVKPMQDSQITVLPNAASDDKACTFVGTAAYVPPEVLNSSPATFGNDLWALGCTLYQMLSGTSPFKDASEWLIFQRIIARDLRFPDYFSDEARDLIDRLLEARRYTCRLLDNRHRVYLMHIEGQDLDPSRRPGAAPDGYAILKRHPFFKGVDWDNLRAQIPPKLAPEPGTQSPVADDVHDSSWSPSHIGDGSAASVRQPDGATSSEGTGHITRLASIDSFDSKWQQFLEPGESVLMISMVKKLQKLTSKKVQLILTNKPKLIYVDPSKLIVKGNIIWSDNPNDLSIQVASPSNFKICTPKKVMSFEDAKQRACQWKKAIEGLQNRPWLDREAILKFQMDYLALGNL

SEQ ID NO: 203234 - protein, 51 aa, Glycine max
  Coding DNA Sequence Number=SeqID_86456
MARINLLAQALCFILPRRNVGARFRRLQNRLTLEENIFDLSQDKAVKFLFP

SEQ ID NO: 203235 - protein, 176 aa, Glycine max
  Coding DNA Sequence Number=SeqID_86457
  Gene Ontology: Mol. function=transferase activity
  Homolog annotation: Hit_ID=Q9AUK5; Match level="QueryCoverage=38%, HitCoverage=9%, E-value=1e-22, Identity=72%"; Hit description =Putative exostoses
MGSGQIVGGGNGGSCCDMSVKCSCRWRLENQQYYKRLFSSGFVFFFGCFVLFGSIATLYGWLAFSPTVHTSLSSFGCRDDNEGSWSVGVFYGDSPFSLKPIEAANVSNDESAAWPVANPVVTCASVSDAGYPSNFVADPFLFIQIIGSCCHPWFPPPSWRERLGVRTCRETVKANA

SEQ ID NO: 203236 - protein, 213 aa, Glycine max
  Coding DNA Sequence Number=SeqID_86458
  Gene Ontology: Mol. function=FMN binding; Cellular component=proton -transporting two-sector ATPase complex; Biological process=ATP synthesis coupled proton transport
  Homolog annotation: Hit_ID=UPI00003841E5; Match level="QueryCoverage =91%, HitCoverage=96%, E-value=3e-63, Identity=58%"; Hit description =COG3576: Predicted flavin-nucleotide-binding protein structurally related to ...
  Homolog annotation: Hit description=pyridoxine 5''''-phosphate oxidase
  Pfam annotation: Domain name=Pyridox_oxidase; Domain location=48-142; Score=87.0; E_value=6e-23; Accession=PF01243.10; Description =Pyridoxamine 5'-phosphate oxidase
MMSAQSTSNWVAPSDIAFTPAVKARQAENGSRIGYAKFERTRGWESQVTPILAEFIAAQTSMYIATANAQGQPYMQHRGGPRGFLRVLDSQTLAFADYAGNKQYITAGNLDENPKAQLFLMDYANAQRVKIWGEARIVTGDQDLIRRVSLPDDPAKAERVVVFTVKAWDANCHKHIPKLLHVEDVLPAIQERDQKIATLEARLKLLEKKIAGQ

SEQ ID NO: 203237 - protein, 206 aa, Glycine max
  Coding DNA Sequence Number=SeqID_86459
  Subcellular localization annotation: CTP_CleavageSite=30; ConfidenceScore=5.01e-01
MAVNSINAYSALQTQSTSSVQQLKQTVNALDSALKSGDLQSAKDAYSKLSQLKTIDSNSPLFTIGQALKKDDIQSALQVINPVQTNATDKTTPLAWQQLAKLTAGTNTTESTLSANNKISSLLNYLASGSGDATSTSTNYTPGIINQVISQMNSASSTVSLGSSTSAETTELYSQLAQQIKNNPQLGAILVERLKAQSSNGVFSYL

SEQ ID NO: 203238 - protein, 44 aa, Glycine max
  Coding DNA Sequence Number=SeqID_86460
  Subcellular localization annotation: CTP_CleavageSite=28; ConfidenceScore=5.03e-01
MAVSANGFFLTFPSPSKTHCPQGVGCIKQNMSKVALFVGLFESS

SEQ ID NO: 203239 - protein, 47 aa, Glycine max
  Coding DNA Sequence Number=SeqID_86461
MGAPAVDVNLVIVSAISDIWHTHILGTGEWKEDGVSVQWLDPLGYPT

SEQ ID NO: 203240 - protein, 101 aa, Glycine max
  Coding DNA Sequence Number=SeqID_86462
  Gene Ontology: Cellular component=spliceosome; Biological process =mRNA processing
  Homolog annotation: Hit_ID=Q9NX01; Match level="QueryCoverage=96%, HitCoverage=80%, E-value=4e-18, Identity=43%"; Hit description =Thioredoxin-like protein 4B
  Pfam annotation: Domain name=DIM1; Domain location=4-101; Score=-7.0; E_value=0.00015; Accession=PF02966.7; Description=Mitosis protein DIM1
MSDMLTTFTKKKEVDTIIRDTFDKVVVLRFGRASDLVCLQQDHILSKAARDVSKFATVALVDVDSEEIQVYLKTADHTKWIGAFYAKQDFVDVVEGIHVDF

SEQ ID NO: 203241 - protein, 110 aa, Glycine max
  Coding DNA Sequence Number=SeqID_86463
  Gene Ontology: Mol. function=oxidoreductase activity; Cellular component=intracellular; Biological process=lignin catabolic process
  Homolog annotation: Hit_ID=Q9AUI3; Match level="QueryCoverage=81%, HitCoverage=15%, E-value=2e-27, Identity=59%"; Hit description =Laccase
  Pfam annotation: Domain name=Cu-oxidase_2; Domain location=6-107; Score=75.3; E_value=2e-19; Accession=PF07731.4; Description =Multicopper oxidase
MVACSKLHVLNDSQTMQGTRVNVLNYGATVEIVFQGTTNLVGGTDHPIHLHGYSFHVVGYGLGNFNQSVDHMNFNLVDPPYLNTVVVPINGWAAIRFEAVNPGMWLGIPS

SEQ ID NO: 203242 - protein, 139 aa, Glycine max
  Coding DNA Sequence Number=SeqID_86464
MGEQGKALIHLSENLWPNESLILMTSAPRVYFDFTSLDFPNNLYIHAKDVSEISGEVGMMLFAKTAIVVLGDLADTLGSNTGPLIQQKAEKLLTQTDSVHKEFMPLQEEAELTQEEIMNKWFTEDVFVEAAEEGDFKKD

SEQ ID NO: 203243 - protein, 89 aa, Glycine max
  Coding DNA Sequence Number=SeqID_86465
  Gene Ontology: Mol. function=serine-type peptidase activity; Cellular component=integral to membrane; Biological process=proteolysis
  Homolog annotation: Hit_ID=Q2R135; Match level="QueryCoverage=94%, HitCoverage=42%, E-value=4e-12, Identity=45%"; Hit description =Signal peptidase I family protein, expressed
MEGDSVTFISNPETYELESDSFTKISSPDNGDKSKTIVISLSKYAFPLLVPKGAVWVEGDNKYNSNDSRKFGPVPFDLIDGKMFWNNAT

SEQ ID NO: 203244 - protein, 74 aa, Glycine max
  Coding DNA Sequence Number=SeqID_86466
MSLGGEMLQYPRPSTIIKKEKRCKCHRIEFVDRGGVWTCVGVCVVVLVFGEWWWCTAWRRRGRTVPRCGGGRRW

SEQ ID NO: 203245 - protein, 431 aa, Glycine max
  Coding DNA Sequence Number=SeqID_86467
  Gene Ontology: Mol. function=dihydrolipoyllysine-residue acetyltransferase activity; Cellular component=pyruvate dehydrogenase complex; Biological process=metabolic process
  Homolog annotation: Hit_ID=Q0WQF7; Match level="QueryCoverage=91%, HitCoverage=61%, E-value=1e-114, Identity=52%"; Hit description =Dihydrolipoyllysine-residue acetyltransferase component 1 of pyruvate dehydrogenase ...
  Homolog annotation: Hit description=complex, mitochondrial precursor
  Pfam annotation: Domain name=2-oxoacid_dh; Domain location=354-431; Score=-110.9; E_value=5.7e-06; Accession=PF00198.13; Description=2 -oxoacid dehydrogenases acyltransferase (catalytic domain)
  Pfam annotation: Domain name=Biotin_lipoyl; Domain location=148-222; Score=66.4; E_value=8.9e-17; Accession=PF00364.12; Description =Biotin-requiring enzyme
  Pfam annotation: Domain name=Biotin_lipoyl; Domain location=28-96; Score=56.3; E_value=9.8e-14; Accession=PF00364.12; Description =Biotin-requiring enzyme
  Pfam annotation: Domain name=E3_binding; Domain location=280-316; Score=48.6; E_value=2.1e-11; Accession=PF02817.7; Description=e3 binding domain
  Pfam module annotation: Pfam domain module=2-oxoacid_dh::Biotin _lipoyl::Biotin_lipoyl::E3_binding; Domain location=354-431::148 -222::28-96::280-316
MVSLGKQFFSLFVLSLFCLGLPRTVVDLIFWFQTQGNIAKWRKKEGEKIEVGDVLCEIETDKATLEFESLEEGFLAKILVPEGSKDVPVGQPIAITVEDENDIQNVPASAGGETRVEEKKPTREDVTDERKSESTSAIINASELPPHVLLEMPALSPTMNQGNIAKWRKQEGDKIEVGDILCEIETDKATLEFETLEEGYLAKILAPEGSKEVAVGHPIAITHWSISKYLRYLLFYKVEDASDIEAIMNSVSRSSTNQQKAPQRDTKSEAKAQKNNIIRISPAAKLLITEYGLDASTLNATGPYGTLLKGDVLSAIKSGKLSPKPASSKEKVSSFQSHQQVAASQESKSDLKLSDAYEDFPNSQIRKVIAKRLLDSKQNTPHLYLSSDVVLDPLLSLRKDLKEQYDVKVSVNDIIVKVVAAALRNVPEANV

SEQ ID NO: 203246 - protein, 101 aa, Glycine max
  Coding DNA Sequence Number=SeqID_86468
MACIFASKTEEHVISASTKDGAACGTGSGQSEILREAKELGKPCPGRDSRFWHPFISLCLSAVNRDNGKDERLSQQLLSMCKCLRARKGLQRWTIADDQFP

SEQ ID NO: 203247 - protein, 203 aa, Glycine max
  Coding DNA Sequence Number=SeqID_86469
MIQLLRAPLYMGLLRRFQSRNLLPNNYWTEGFLTGTGQNSGGNIDFTMHDMVCVLALFVSAKIYPIFDRNDESIETSFLISNLQNVEESSSELYGPLMEEYIPLKDNIDVGNITHGLDQQTPKIELNYLSTTANDAVQTTFEYGTHFDTLRILDASQLVELPSELHSLRIEGCHSFKSLQDVLMDRRTNFFELFIIDCSFLEY

SEQ ID NO: 203248 - protein, 141 aa, Glycine max
  Coding DNA Sequence Number=SeqID_86470
  Gene Ontology: Mol. function=chromatin binding; Cellular component =signal recognition particle, endoplasmic reticulum targeting; Biological process=chromatin assembly or disassembly
  Homolog annotation: Hit_ID=O22265; Match level="QueryCoverage=66%, HitCoverage=41%, E-value=2e-12, Identity=45%"; Hit description =Signal recognition particle 43 kDa protein, chloroplast precursor
MDPGPPLSSNSPSSSPCVVLVNLDPREAASGGRCESGPLRPKRRPRGAAHGGRGDSDGDAKGESDAVRTQDWTRRWESENGVGSGVGRGSVRAKFVAEDLVKYFQAGLEYDITTAVLAKRGRGSWNWDAERRPFLTNSGGY

SEQ ID NO: 203249 - protein, 148 aa, Glycine max
  Coding DNA Sequence Number=SeqID_86471
  Gene Ontology: Mol. function=dihydrolipoyllysine-residue acetyltransferase activity; Cellular component=pyruvate dehydrogenase complex; Biological process=metabolic process
  Homolog annotation: Hit_ID=Q0WQF7; Match level="QueryCoverage=62%, HitCoverage=14%, E-value=8e-23, Identity=60%"; Hit description =Dihydrolipoyllysine-residue acetyltransferase component 1 of pyruvate dehydrogenase ...
  Homolog annotation: Hit description=complex, mitochondrial precursor
  Pfam annotation: Domain name=2-oxoacid_dh; Domain location=25-148; Score=-142.1; E_value=0.0013; Accession=PF00198.13; Description=2 -oxoacid dehydrogenases acyltransferase (catalytic domain)
MKKGKRTGDFRFIDILSSPFSCRVQTLHEIIPVLLPSLLCLFEHTLDENMLFWKIFQSAWFTSLRLVTQVVDPCEQDCKMSKACILAVGRGNKVVEPVIGTDGIEKPSIATKLSLTLSADHRVFDGKVGGAFLSALQSNFSDIRRLLL

SEQ ID NO: 203250 - protein, 264 aa, Glycine max
  Coding DNA Sequence Number=SeqID_86472
  Gene Ontology: Mol. function=membrane alanyl aminopeptidase activity; Cellular component=extracellular space; Biological process=proteolysis
  Homolog annotation: Hit_ID=Q6Z6L4; Match level="QueryCoverage=81%, HitCoverage=28%, E-value=5e-90, Identity=66%"; Hit description =Putative aminopeptidase M
  Pfam annotation: Domain name=Peptidase_M1; Domain location=1-163; Score=-47.8; E_value=3.4e-10; Accession=PF01433.10; Description =Peptidase family M1
GKFALDVVVKTLELYKGYFATPYSLPKLDMIAIPDFAAGAIENYGLVTYRETALLYGDQHSAAANKQRVATVVAHELAHHWFGNLVAMEWWTHLWLNEGFATWVSYLATDSCFLEWKIWSKFLHESTEGLSLDGLAESHPIEVEINHACEIDEIFDAISYRKGAYAALEEGFGEPVNKLMTSWTKQKGYPVVYVKVNDKKLEFNQSQFLSSGAQGEGHCNILEILPGIFENDYFQKLAPTDAEKREKLEPEKWHATRGRILAFL

SEQ ID NO: 203251 - protein, 467 aa, Glycine max
  Coding DNA Sequence Number=SeqID_86473
  Gene Ontology: Mol. function=oxidoreductase activity, acting on the CH-OH group of donors, NAD or NADP as acceptor; Biological process =metabolic process
  Homolog annotation: Hit_ID=UPI00005F7164; Match level="QueryCoverage =53%, HitCoverage=83%, E-value=5e-94, Identity=65%"; Hit description =COG0111: Phosphoglycerate dehydrogenase and related dehydrogenases
MTPERVILRQRLAGEHVQRGGGQLPLLQRRQQIGFYQVRAARDVDEIGARTQLREQLAVENADGLRRIGQQVDQQFDAVEEGGALRLPGEALHAIDLFGAAAPAAHAEAKLGQLVRHALPQHAGAEDADGEIIQRRLILVETAEIAQHIAQRVFLHLLRHAGILQPQQRHAGRQRAGVFALLIEDRVDAGAEGEHRFQIAAVGQHLVRRAPHQRVIGRPLVAALPFADLGLRQALLDTGQPFLGVKQGVPFAIRRRMQALKPKIKTAPTSGAVVHVSQSGGSWAVAPDKAPQQRNENQHRHADARRPPTQRAEDFAVAGVGLQRRAAAVFRHQAGDVARQHRGDAGHHHPAAHHHALIARRRQLANHGVTDRRDHQFTDALQHIADDDPFKRHQPVAARHADAQRQHQHAEPDAEQRSGELQRNVDVATASAQAVEPPGQQRAAHHDHQRVDVLDPLRRHLNAVNVQ

SEQ ID NO: 203252 - protein, 276 aa, Glycine max
  Coding DNA Sequence Number=SeqID_86474
  Gene Ontology: Mol. function=magnesium ion binding; Cellular component=intracellular; Biological process=response to DNA damage stimulus
  Homolog annotation: Hit_ID=UPI00005F9A59; Match level="QueryCoverage =66%, HitCoverage=83%, E-value=8e-80, Identity=75%"; Hit description =COG0847: DNA polymerase III, epsilon subunit and related 3''''-5'''' exonucleases
IAGIFLGDAIDLLPAILAEFELLQQHRLFGDLHHLLRRPARILDDALQQRGGDVAVVQRAVRVQRGVCRQLHVQVQRVAQILVAVLDVRIQRARQFEGADPGAVHLRQHAAIESGVVRHIVGAALIAADRHRNARFAFHHLFGDVMNRHRVEADGAIRADQIAHRVGQLAVEQIEGGHFHHAAVQPAGLGFSLTAAGGRANRPQVVGNKKPALAGLMTDGRALTHQTDALFWRVSPHVLSWGFQRLLLRILFAIHSLTHDGLSLPMIGWLAQPLTA

SEQ ID NO: 203253 - protein, 805 aa, Glycine max
  Coding DNA Sequence Number=SeqID_86475
  Gene Ontology: Mol. function=protein binding; Cellular component =membrane; Biological process=defense response
  Homolog annotation: Hit_ID=Q6R270; Match level="QueryCoverage=99%, HitCoverage=68%, E-value=0.0, Identity=57%"; Hit description=Disease resistance protein
  Pfam annotation: Domain name=LRR_1; Domain location=576-598; Score =14.6; E_value=0.36; Accession=PF00560.23; Description=Leucine Rich Repeat
  Pfam annotation: Domain name=LRR_1; Domain location=600-621; Score =9.4; E_value=5.1; Accession=PF00560.23; Description=Leucine Rich Repeat
  Pfam annotation: Domain name=LRR_1; Domain location=623-645; Score =14.3; E_value=0.46; Accession=PF00560.23; Description=Leucine Rich Repeat
  Pfam annotation: Domain name=LRR_1; Domain location=647-668; Score =4.9; E_value=34; Accession=PF00560.23; Description=Leucine Rich Repeat
  Pfam annotation: Domain name=NACHT; Domain location=193-345; Score= -26.7; E_value=0.0069; Accession=PF05729.3; Description=NACHT domain
  Pfam annotation: Domain name=NB-ARC; Domain location=152-456; Score =323.2; E_value=4.5e-94; Accession=PF00931.13; Description=NB-ARC domain
  Pfam module annotation: Pfam domain module=LRR_1::LRR_1::LRR_1::LRR _1::NACHT::NB-ARC; Domain location=576-598::600-621::623-645::647 -668::193-345::152-456
MAEALVGGALLSAFLQVAFDRLASRQVVDFFRGRKLNEKLLKKLKVKLLSINAVVDDAEQKQFENSYVKAWLDEVKDAVFDAEDLLDEIDLEFSKCELEAESRAGTRKVRNFDMEIESRMKQVLDDLEFLVSQKGDLGLKEGSGVGVGLGSKVSQKLPSTSLVVESDIYGRDEDKEMIFNWLTSDNEYHNQLSILSVVGMGGVGKTTLAQHVYNDPRIEGKFDIKAWVCVSDDFDVLTVTRAILEAVIDSTDNSRGLEMVHRRLKENLIGKRFLLVLDDVWNEKREKWEAVQTPLTYGARGSRILVTTRTTKVASTVRSNKELHLEQLQEDHCWKVFAKHAFQDDNPRLNVELKEIGIMIVEKCKGLPLALKTIGSLLYTKVSASEWKNVFLSKIWDLPKEDNEIIPALLLSYHHLPSHLKRCFAYCALFSKDHEFDKDDLIMLWMAENFLQFPQQSKRPEEVGEQYFNDLLSRSFFQESRRYGRRFIMHDLVNDLAKYVCGNICFRLEVEEEKRIPNATRHFSFVINHIQYFDGFGSLYDAKRLRTFMPTSGRVVFLSDWHCKISIHELFCKFRFLRVLSLSQCSGLTEVPESLGNLKHLHSLDLSSTDIKHLPDSTCLLYNLQTLKLNYCYNLEELPLNLHKLTNLRCLEFVFTKVRKVPIHLGKLKNLQVLSSFYVGKSKESSIQQLGELNLHRKLSIGELQNIVNPSDALAADFKNKTHLVELELNWNWNPNQIPDDPRKDREVLENLQPSKHLEKLSIKNYGGLDGIVNIDANFYGSSSSSFTSLETLHFSNMKEWEEWE

SEQ ID NO: 203254 - protein, 435 aa, Glycine max
  Coding DNA Sequence Number=SeqID_86476
  Gene Ontology: Mol. function=transmembrane receptor activity; Cellular component=membrane; Biological process=defense response
  Homolog annotation: Hit_ID=Q1RVS5; Match level="QueryCoverage=82%, HitCoverage=80%, E-value=8e-42, Identity=34%"; Hit description=TIR; Disease resistance protein
  Pfam annotation: Domain name=NB-ARC; Domain location=144-411; Score= -91.7; E_value=0.00019; Accession=PF00931.13; Description=NB-ARC domain
  Pfam annotation: Domain name=TIR; Domain location=17-141; Score= -13.7; E_value=0.0011; Accession=PF01582.10; Description=TIR domain
  Pfam module annotation: Pfam domain module=NB-ARC::TIR; Domain location=144-411::17-141
MVTFNLSVEPKPFTNDVVIISDKDTRWGFGGTLLKAFQLCGFRAVLVGAGNELGRKEIEESMVVIPVFSMDLVSSPDHLEELATVVDEKRMCQMFLPFLYKLELKDVRYLMGGKLFEKFYEVLTKVTDLTGFRFGDGVTYEYQCVEKIVQVSAKHAASTIGVIPRVTEAMLLLSPESDNGVNVVGVVGPGKETITRKVYEVIAPSFPAHCFLPDVGEKIREHGPEYLQNMLGPYMLGNSQEGVPFIRHEKVLAVLDCIDSLDSLKAALGLTPRFAPGSQVFIIAPDITLLENNGIEKVYEVKGLDKTSAYQVLCLEAFSSMNMSFKYMDIISRAETCADGNPCALKAIGSSFRGKTIAECEIALDEYKRIHYSELIESMIGENNWIPSFGDISEEYTEYDMPDVELASDDGSGMGNFLGSSTLLSQANMQDVEAA

SEQ ID NO: 203255 - protein, 607 aa, Glycine max
  Coding DNA Sequence Number=SeqID_86477
  Gene Ontology: Mol. function=inositol or phosphatidylinositol phosphatase activity; Cellular component=cytoplasm; Biological process=phospholipid dephosphorylation
  Homolog annotation: Hit_ID=UPI000034F077; Match level="QueryCoverage =93%, HitCoverage=84%, E-value=0.0, Identity=60%"; Hit description =phosphoprotein phosphatase
  Pfam annotation: Domain name=Myotub-related; Domain location=20-93; Score=-6.1; E_value=0.00012; Accession=PF06602.5; Description =Myotubularin-related
MAQGVRVEFWGSLVRRGFGIIPRIRITLAWDGEYLPAVRPFCTLFPCPHSCSPQRGKLYIVDARPRKNALANGAMGGGSESSSNYFQSEIVFLGIDNIHAMRESFVRLREYMDTHGRTSSDGMSSFLRQGGSTWGGGNLSSMSASVSTLGDSGWLLHVQNVLAGAAWIAARVAMENASVLVHCSDGWDRTSQLVSLANLLLDPYYRTFTGFQALVDKDWLAFGHPFSDRVGMPSVSGTGNVPFELSRQSSTSNFPPSPMRQSSGTFVSQPPASSHSHNSNNYSPIFLQWVDCVSQLLRIYPFAFEFSAAFLVDFVDCMLSCRFGNFLCNSEKERQQFNVFEACGCLWVYLADLRTSSGGSHVHYNPFYDPLKHSGPLLPPAAALAPTLWPQFHLRWACPEEAQAGEIEAQCRKIVMKYAEMQKVAKEMAERKAKEVTNSMESLNAELRREKQLNSSAMNMAKSMSKENMAIKRAIQSMGCKVHVSGSSGECIVDIESNPDILCCSSRKESNSNVRDDKKDMSVSVVITAGDDDDGNNAIGRVCETLCPFRFGDGRVCETLCPFRFGDGGCRWPNGGCAQLGSQYVGLKANFDAFDKLSIDDSYFKSE

SEQ ID NO: 203256 - protein, 100 aa, Glycine max
  Coding DNA Sequence Number=SeqID_86478
  Homolog annotation: Hit_ID=Q41393; Match level="QueryCoverage=87%, HitCoverage=54%, E-value=4e-10, Identity=38%"; Hit description=E24 ASN
MSRRSDETAAQQEGPKPSRVQFPKTQVAVVASSPLQAEPDADHSPAAKTTNPLILWQIYAIGAIAISSWVWARWNERKGRGGGSPNDERGEGRHSDDGNQ

SEQ ID NO: 203257 - protein, 73 aa, Glycine max
  Coding DNA Sequence Number=SeqID_86479
MEVGCDLLSLTSHCSLDDRLTGMWGQMARMVKLPSTREVVGEREINSDRSNGRPNGDVTCCIRHQLKGCLRTL

SEQ ID NO: 203258 - protein, 471 aa, Glycine max
  Coding DNA Sequence Number=SeqID_86480
  Gene Ontology: Cellular component=integral to membrane; Biological process=peroxisome organization and biogenesis
  Homolog annotation: Hit_ID=Q94DE5; Match level="QueryCoverage=80%, HitCoverage=82%, E-value=1e-122, Identity=55%"; Hit description =Putative betaine/proline transporter
  Pfam annotation: Domain name=Aa_trans; Domain location=42-441; Score =175.8; E_value=1.1e-49; Accession=PF01490.8; Description =Transmembrane amino acid transporter protein
MGTVTRSSSEVYSSDSEKGFAMNHSTSTSPELDAGAKFVLVSRGSWLHCGYHLTTSIVAPVLLTLPFSFTLLGWVGGVLWLTLAAVITFYSYNLLSVVLEYHAQLGRRQLRFRDMARDILGPGWAKYFVGPLQFAICFGTVIGGPLVGGKSLKFIYQLYNPEGSMKLYQFIIICGVITLILAQLPSFHSLRHVNMISLILSVLYATCVTIGSIYIGHSKNAPPRHYSVRGSDADQLFGVFNGISIIATTYASGIIPEIQATLAPPVKGKMLKGLCVCYSVIATTYFSVAISGYWAFGNESGASILANFIGETKPLLPKWFFLMTNIFILLQVMALTAVYLQPTNEMFETTFGDPKMGQFSMRNVVPRVVLRSLSVAAATVLAAMLPFFPDIMALFGAFGCIPLDFILPMGTSFQHGFGQGGMRGRVEEGLPMIRGLKEGILMMVVIHLQGNGMNRNSHWTQCYVNTLKFSV

SEQ ID NO: 203259 - protein, 78 aa, Glycine max
  Coding DNA Sequence Number=SeqID_86481
MYWREKSDQVQRGEVPPQRWLWETERRWASDSDAEKDKLFHENHRAFNFSVFGHCRSFFSSVKEIAIAMEIKSGMKLN

SEQ ID NO: 203260 - protein, 413 aa, Glycine max
  Coding DNA Sequence Number=SeqID_86482
  Gene Ontology: Mol. function=kinase activity; Cellular component =nucleus; Biological process=amino acid biosynthetic process
  Homolog annotation: Hit_ID=Q1SN30; Match level="QueryCoverage=64%, HitCoverage=56%, E-value=2e-84, Identity=59%"; Hit description =Aspartate/glutamate/uridylate kinase; MADF; Homeodomain-related
  Pfam annotation: Domain name=AA_kinase; Domain location=245-412; Score=-6.1; E_value=4.8e-05; Accession=PF00696.18; Description=Amino acid kinase family
MTEIVTASVITSSLIPPSQTLTLTLTNPKSLIPLSLGGHRSYPLLDYPSHAQPHLHAPTRHHFLSSSSSSPTTLPAADIATADYYPHASSFSDDSAKSNSKRASAAGSPYYNKKLKSTTDSVPATDYSKDREEWSDTAIACLLEAYTEKFNLLYRGNLRSRDWEEVAEAVGGRCGGEGKHQKSVEQCKNKIDNLKKSWLFKACYAVRHWDGLLTISDKFVGRYAPSNATVAINLKLKPASNLKWHRVLFKISGSALAGNCQNIDPKVAMQIAREVATTCRLGVEVAIVVGGRNFFCGDAWVSATGLDRPMAYQIGMMGTVMNSILLQSALEKLGVQTRVQNTFLMPEVAEPYRRQRAIRHLEKGRVIFGGVGAGTGNPHFTTDTAAALRASERMTLHFHLSIASLVLLFLCQF

SEQ ID NO: 203261 - protein, 47 aa, Glycine max
  Coding DNA Sequence Number=SeqID_86483
MIPLGVILAILDPVLIAVSKSAPALIAGNSFVLKPPTQKIQLVLASH

SEQ ID NO: 203262 - protein, 61 aa, Glycine max
  Coding DNA Sequence Number=SeqID_86484
MERDHRWQASGGEFEPITSGDHGGVGGEGVNFLFAVVEATRLDKGVIGCLGARKKERRCQG

SEQ ID NO: 203263 - protein, 100 aa, Glycine max
  Coding DNA Sequence Number=SeqID_86485
  Subcellular localization annotation: CTP_CleavageSite=79; ConfidenceScore=5.36e-01
MTHSHDQSQSLSLNPKKLTALVLRLNSCRLLKWSSHPHSFTVVDSSGDREAIAFASCFGIKSAVVGGSSTTGISYRCLRADAVGLRRWGIIIIVTSLFPS

SEQ ID NO: 203264 - protein, 64 aa, Glycine max
  Coding DNA Sequence Number=SeqID_86486
  Subcellular localization annotation: CTP_CleavageSite=36; ConfidenceScore=5.21e-01
MAWRLKAFLLPRSVSTSSPNKETKKKKKKTTKTKVLAVTKKKKKKLYLGNVATSHGREEAVQRT

SEQ ID NO: 203265 - protein, 514 aa, Glycine max
  Coding DNA Sequence Number=SeqID_86487
  Gene Ontology: Mol. function=protein binding; Cellular component =integral to membrane; Biological process=protein amino acid phosphorylation
  Homolog annotation: Hit_ID=Q1SLU2; Match level="QueryCoverage=99%, HitCoverage=73%, E-value=1e-110, Identity=34%"; Hit description =Leucine-rich repeat, plant specific
  Pfam annotation: Domain name=LRR_1; Domain location=116-138; Score =15.8; E_value=0.16; Accession=PF00560.23; Description=Leucine Rich Repeat
  Pfam annotation: Domain name=LRR_1; Domain location=140-159; Score =12.0; E_value=1.6; Accession=PF00560.23; Description=Leucine Rich Repeat
  Pfam annotation: Domain name=LRR_1; Domain location=164-184; Score =1.1; E_value=1.8e+02; Accession=PF00560.23; Description=Leucine Rich Repeat
  Pfam annotation: Domain name=LRR_1; Domain location=19-40; Score=8.6; E_value=7.1; Accession=PF00560.23; Description=Leucine Rich Repeat
  Pfam annotation: Domain name=LRR_1; Domain location=190-213; Score =7.7; E_value=10; Accession=PF00560.23; Description=Leucine Rich Repeat
  Pfam annotation: Domain name=LRR_1; Domain location=334-356; Score =15.8; E_value=0.16; Accession=PF00560.23; Description=Leucine Rich Repeat
  Pfam annotation: Domain name=LRR_1; Domain location=358-380; Score =18.6; E_value=0.022; Accession=PF00560.23; Description=Leucine Rich Repeat
  Pfam annotation: Domain name=LRR_1; Domain location=382-401; Score =8.5; E_value=7.4; Accession=PF00560.23; Description=Leucine Rich Repeat
  Pfam annotation: Domain name=LRR_1; Domain location=43-65; Score=7.9; E_value=9.6; Accession=PF00560.23; Description=Leucine Rich Repeat
  Pfam annotation: Domain name=LRR_1; Domain location=67-86; Score=7.2; E_value=13; Accession=PF00560.23; Description=Leucine Rich Repeat
  Pfam annotation: Domain name=LRR_1; Domain location=92-114; Score =11.2; E_value=2.3; Accession=PF00560.23; Description=Leucine Rich Repeat
  Pfam module annotation: Pfam domain module=LRR_1::LRR_1::LRR_1::LRR _1::LRR_1::LRR_1::LRR_1::LRR_1::LRR_1::LRR_1::LRR_1; Domain location =116-138::140-159::164-184::19-40::190-213::334-356::358-380::382 -401::43-65::67-86::92-114
MVDLHSNQLRGSIPNFVRGAVHLDFSNNKFSFIPPDIRESLRFTYFLSLSNNSFHGKIPQSFCNCSILRMLDLSHNSFNGSMPECLTSRSSTIRVLDIGGNKLTGSISNTIPSSCNLRFLNLNGNFLGGTIPKSLVNCQNLEVLNLGNNMLSDRFPCFLWSISTLRVLILRLNKLHGPIQCQHNIGNWKMLHIVDLAYNNFTGAIPQTLLQSWIAMVGNEGEAQQKSGNLFFDLYDFHHSVRYQDALASLDKIIVMRLAQVVATIPPLAIDSMFSYFVNAYQLQFGGAYLDSATVVTKGLQMKFVKIPAIFASLDFSSNHFEAPIPKELMSFRALIVLNLSHNSFSSHIPSSLGNLTQLESLDLSSNSLSGEIPQEIASLSFLSVLDLSFNHLVGKIPTGTQIQSFEPVSFEGNEGLCGPPITKNCIDNDGSPTPPSLAYYGTHGSIDWNFLSAELGFIFGLGLVILPLIFWNRWRLWYIENVEDLLCWIFPQLYFVYQHRGERKYRSLRWRHG

SEQ ID NO: 203266 - protein, 199 aa, Glycine max
  Coding DNA Sequence Number=SeqID_86488
  Gene Ontology: Mol. function=DNA binding; Biological process=DNA integration
MTDLGFDKPLEMRLGACPSWVLSFCCSLKNSLLIDGSLTSTRIMAPVPYGLEDDSIDFLLMIVGLGMFNKGYEVLDTESCQEVFRSLIFELGVVVGDNGVREAIPSYESIMTSKYLIAPGKRPRGAQAVEIVRRDARVSRYSTAKEEKVQVADDSLSEANLLSDVQSAHPVRSLSLLTLSAPSLAKPKFTYFRLASQSR

SEQ ID NO: 203267 - protein, 193 aa, Glycine max
  Coding DNA Sequence Number=SeqID_86489
MEKRLKPPLVLSSFDSLFSLHEYYLSNPNGGSVRIEFRTTYPNFMKIQRLTKPGSYFYRDSFGFLREIKMLQCEGFSSKLRYDFEIPNDENVRNWVANMILKFHDDPTVNGFEIVIFLRQSHFSKGLSNPRWVLGESRIAKGSLNPRFALGESRFSKGSSNPGSVLGESRITKSSKNPRPALGDVEAKLPRLL

SEQ ID NO: 203268 - protein, 107 aa, Glycine max
  Coding DNA Sequence Number=SeqID_86490
VEGEKHISWIKWEKKIVEKENGGLGVKDVALLMALIACKMKMRKIIKDDGSHVARNVKVFWLTATATAILNHDRSLWCNVVESKDAKFWLENRNGDTVFGLWLTSIA

SEQ ID NO: 203269 - protein, 112 aa, Glycine max
  Coding DNA Sequence Number=SeqID_86491
  Homolog annotation: Hit_ID=Q0FI33; Match level="QueryCoverage=37%, HitCoverage=19%, E-value=1e-10, Identity=66%"; Hit description =Leucyl/phenylalanyl-tRNA--protein transferase
  Pfam annotation: Domain name=Leu_Phe_trans; Domain location=1-84; Score=-90.7; E_value=0.044; Accession=PF03588.5; Description =Leucylphenylalanyl-tRNA protein transferase
MESFITLHDYGLARSIEVWKDGELVGGFYGLQIGNVFCGESMFAKVGALRVLIAGIILLPIAISKYKLFPKKHIKWLILAAITGNFIPMFLFPIAETEAHWYGNLKPQNIRS

SEQ ID NO: 203270 - protein, 146 aa, Glycine max
  Coding DNA Sequence Number=SeqID_86492
  Gene Ontology: Mol. function=intramolecular transferase activity, phosphotransferases; Cellular component=membrane; Biological process= carbohydrate metabolic process
  Homolog annotation: Hit_ID=Q1XQ48; Match level="QueryCoverage=100%, HitCoverage=31%, E-value=5e-55, Identity=74%"; Hit description =Phosphomannomutase
  Pfam annotation: Domain name=PGM_PMM_I; Domain location=2-144; Score =117.7; E_value=3.3e-32; Accession=PF02878.6; Description =Phosphoglucomutasephosphomannomutase, alphabetaalpha domain I
MSLIKSISGIRGTIGGKVNDNLTPLDVVKFASAFGTWLQNNKNKKNLTLVIGRDARISGGMVSSLVTATLQGLGINVIDLGLSTTPTVEIMVPELKADGGIILTASHNPKQWNALKLLNEKGEFISGENGAEMLAIAESEDFNFAE

SEQ ID NO: 203271 - protein, 63 aa, Glycine max
  Coding DNA Sequence Number=SeqID_86493
MSYDAAIEVRNHVSPEPEVEDAGVASLANPKACDKFGMQNDFKGSKVASKSENVSKCERFYGK

SEQ ID NO: 203272 - protein, 809 aa, Glycine max
  Coding DNA Sequence Number=SeqID_86494
  Gene Ontology: Mol. function=catalytic activity; Cellular component =Golgi transport complex; Biological process=metabolic process
  Homolog annotation: Hit_ID=Q9FFF3; Match level="QueryCoverage=99%, HitCoverage=76%, E-value=0.0, Identity=60%"; Hit description=Low density lipoprotein B-like protein
ESWISQILGNAGPGDASSLVVSILCDVLGIIQVLNDMPLFYKVILGSPPASQLFGGIPNPDEEVRLWKSFRDKLESIMVMLDKRYIADTCFAWLRGCVSKISGRNLIDVVGSGQDLACAEKSIRETMESKQVLQESLEWLKSVFGSEIELPWSRIRELVLEDDSDLWDEIFEDAFVGRMKAIIDLRFRELTGAVDVLNSISAIGDFCTKLEDVQGYLNRPSTAGGVWFLESNARKTGVASGFKVQPEESEFQYCLNAYFGPEVSRIRDAVDVSFQSIFEDLLSFLESPKASRRLKDLAPYLQSKCYECVSSILMTLKKELDSLYAPTENGKVPTAVTVEKSLFIGRLLFAFQNHSKHIPLILGSPRFWANGNASAVGKLPTLVKQSRFGSDSAICDSPGRQTSLGSKRQNSSAVSALLGVREGASHELEELNKTIGDLCIRAYNLWILWISDELSAIVSQDLKQDDALSLSTPWRGWEDIIVKQDQSDENQSDMKISLPSMPSLYIISFLFRACEEVHRVGGHVLDKKILHKLASRLLEKVTGIFEDFLSTAESGVHQVSEKGVLQVLLNFKFATDVLSGGDSNMVGELSSNPKAKLPGRRKQDQSLTTSAIRERSNQLLNRLSQKLDPIDWLTYEPYLWENERQSYLRHAVLFGFFVQLNRMYTDTVQKLPTNSESNILRCSTVPRFKYLPISAPALSSRGTKKAFTPSSSEISSRSSWNSITNGELSQKINLDDSSSLGVAAPLLKSFMQVGSRFGESTFKLGSILTDGQVGIFKDRSAAAMSSFGDILPAHAAGLLSSFTAPRSDS

SEQ ID NO: 203273 - protein, 605 aa, Glycine max
  Coding DNA Sequence Number=SeqID_86495
  Homolog annotation: Hit_ID=Q8LK56; Match level="QueryCoverage=33%, HitCoverage=10%, E-value=3e-12, Identity=32%"; Hit description =Transcriptional activator DEMETER
MFSTLPHNTFPGNFRLSMMNFGKQLLGQDERQLEMNNTWVPIPTEKLVQLTSNTPSDWPVNQMRRPNYQEIRLPGSDYMKEKSLHYYPGPNQNLPLIGQTSQTGENKTFDGHLMNRNSVLDHIPGSYTQPWHYESNGSNSNTLEQLLKKNISNIDSANRNLDANNNMAARNPLLSMFYPQASSNVSDPYAGVQRGNIHSASDIVFKEANRLLFPNKNSEIDGSNSNSLLNNDIHCSVPNQLEGFFSEITYGDSYHNYNLNYVPIAEAGVTASFTNSLQSVPKMMDQLKFVDNQFFTIPDYMIAESTSQEKDKQKTSVSATENEFQEHCVGLLQQIVDSSPAAISTTYGDQKGSDNICGKGSDLGFDLNKTPEQKAPQRRKHRPKVIKEAKPKSTRKPATQKTQMKENPHKKRKYVRKTAATPQTNVTEESVDSIVATKKSCRRALNFDLEHNKYASQSTISCQQEIDHRNEKAFNTTSDHKAKEPKNTDDNTLLLHEKQANNFQSERKLITALSETTEEPQIAKFPATEEGPALENSDLCQEGNNGSRHQYIQTKEIDNILYQSETCFENSQKTGEPICQNTLQLVPNILSNSIEAAKGSKRKYS

SEQ ID NO: 203274 - protein, 201 aa, Glycine max
  Coding DNA Sequence Number=SeqID_86496
  Gene Ontology: Mol. function=4 iron, 4 sulfur cluster binding; Biological process=base-excision repair
  Homolog annotation: Hit_ID=Q8LK56; Match level="QueryCoverage=68%, HitCoverage=6%, E-value=7e-35, Identity=59%"; Hit description =Transcriptional activator DEMETER
MSKENPQNARTKDKNGFQTQSNEEIPDICIESNRFVEQQNNGASTGECFAISEEPHQIYSNLIDEIICQLNDLKLGESNMTEMEGQKALVPYNGDRSVVPYQEFELLKKHKPRPKVDLDAETERTWKLLMGKGGSEGLEGTDKEKEKWWDEERNVFHGRVDSFIARMHLIQGDRRFSKWKGSVVDSVIGVFLTQNVSDHLS

SEQ ID NO: 203275 - protein, 602 aa, Glycine max
  Coding DNA Sequence Number=SeqID_86497
  Gene Ontology: Mol. function=4 iron, 4 sulfur cluster binding; Cellular component=nucleus; Biological process=regulation of transcription, DNA-dependent
  Homolog annotation: Hit_ID=Q8LK56; Match level="QueryCoverage=97%, HitCoverage=28%, E-value=7e-66, Identity=33%"; Hit description =Transcriptional activator DEMETER
  Pfam annotation: Domain name=HhH-GPD; Domain location=442-582; Score =53.8; E_value=5.8e-13; Accession=PF00730.15; Description=HhH-GPD superfamily base excision DNA repair protein
  Subcellular localization annotation: CTP_CleavageSite=32; ConfidenceScore=5.15e-01
MMSNPTEKFMLLSFLCSSAFMSLASRFPLQSKSSKKSYDVDTNTLLKEAGLCIVNPADTITPYGSGTLNQPTYHLCFETPHHARELWRDSETSRPKGSLIKPNNQSSEEEFLSPQDSLDSSITQDARNRSSSGSNSESEGLDCRCEHRETQFLTAINSLQVGKTTMFQEFYNSINGVSLFEERNKDGQLHPEEYVKQNCSIGRNSSPNICSAFSHPNNFAYPPKQLPVVPSTDYRLYYSDTQGLKTFQMNGGKFSWTETVSVHSELQDNNSGNRKVGDSADKPTEMQYANGTLGSPEIPTIDPYGPLSKYLVLPHDTSQFGSHTNYNQPSPNHHLVGQKSLESESREFTNSLNTSHILDRCQDDVVKDSGNIPKHAEGLDSEKISAANSQGCSENSRAESNPLKQVYSPNSIDKKSKIKVSKERKAKPETEKKHASDWDKLRKEVQINRIEKERSTDTMDSLDYEAIRCASVKEISKTIKERGMNNMLAERIKEFLNRLVTEHGSIDLEWLRHVPQDKAKDYLLSFRGLGLKSVECVRLLTLHHIAFPVDTNVGRIAVRLGWVPLQPLPEALQLHLLELYPVLETVQKYLWPRLCKLDQRTL

SEQ ID NO: 203276 - protein, 45 aa, Glycine max
  Coding DNA Sequence Number=SeqID_86498
MVLIVFCVMLVAVLYGAAQSSEISSHSTCTITKSSFNIGLLTSIF

SEQ ID NO: 203277 - protein, 406 aa, Glycine max
  Coding DNA Sequence Number=SeqID_86499
  Gene Ontology: Mol. function=4 iron, 4 sulfur cluster binding; Cellular component=nucleus; Biological process=regulation of transcription, DNA-dependent
  Homolog annotation: Hit_ID=Q8LK56-2; Match level="QueryCoverage=92%, HitCoverage=51%, E-value=1e-109, Identity=55%"; Hit description =Isoform 2 of Q8LK56
  Subcellular localization annotation: CTP_CleavageSite=58; ConfidenceScore=5.23e-01
MHAQCEQSAGTLQVLLQASTSFLCKAPSVHPLPPRPKFFTCISNARLALPGPEEKRIVSMHVPIATERNYFVNENPMVLPLLENNLSRQVNPESWQCEPIIEEPATPEREWKEAEESDMEDFLKVDSDEILSIGLNAKESTVNVQNHLQEYKEHNEGDMSKALVALNPESASIPTPKLKNVSRLRTEHQVYELPDSHPLLEKMDKREPDDPSPYLLAIWTPGETPNSVEPPERRCESQDSANLCNDSTCFSCNSIREANSQTVRGTILIPCRTATRGSFPLNGTYFQVNELFADHASSVQPIDIPREWIWNLPRRTAYFGTSVSSIFKDQFITYGIIVLTKNTHFYQAFPPNKFSIAFGEPSPTPTPRNNFIRFVCVRGFDQKERAPRPLQARLHFSASRLAKAEK

SEQ ID NO: 203278 - protein, 264 aa, Glycine max
  Coding DNA Sequence Number=SeqID_86500
  Gene Ontology: Mol. function=RNA-directed DNA polymerase activity; Cellular component=intracellular; Biological process=RNA-dependent DNA replication
MSLKIKEEVKKKFDVGFLVVARYSKWVASIVPVPKKDGKGTFCYNVMSFGLKNAGATYQPAIVELFHDMLHKEVKVYVDDMIAKSKTEEEHLINLWKLFERLRIEVDPNKVKAILEMPEPHTEKQSIQWNDDYHVAFGRIKRCLMNPLVLVPPMPGRTLILYMTVLDESMGCMLRHHDASGKKERVVYYLSKNPPSKEIHAELHHLTEFDIVYVTQKVIEGSTLVDYLAQATLDLWVHLPRKEGARSRHQRLLEEDVGKTGKDV

SEQ ID NO: 203279 - protein, 439 aa, Glycine max
  Coding DNA Sequence Number=SeqID_86501
  Gene Ontology: Mol. function=nucleoside-triphosphatase activity; Cellular component=chloroplast; Biological process=macromolecule biosynthetic process
  Homolog annotation: Hit_ID=Q2PMM5; Match level="QueryCoverage=99%, HitCoverage=20%, E-value=0.0, Identity=89%"; Hit description=Protein ycf2
MSHTNGFGSTTMGSNVRDLVALTNEALSISIIQKKSIIDTNIIRSVLHRQTWDFRSQVRSVQDHGILFYQIGRAVSQNVLLSNCSIDPISIYMKKKSCDGGDSYLYKWYFELGTSMKKLTILLYLLSCSAGSVAQDLWSLPGPDEKNGITSYGLVENNSDLVHGLLEVEGALVGSSRTEKDCSQFDKDRVTLLLRDFSMKNMNRSLKKGGESSTPQQIEEDFFNHIVWAPRIWSPWGFLFYCIERPNELGFPYWARSFRDKRIIYDEEDELQENDSEFLQGGTMQYQTRDRSSKEQGFFRISQFIWDPADPLFFLFKDQPFVSVFSHRQFFTDEEMSRELLTSQTDLPTSIYKHWFIKNTQEKHFELLIHCQRWLRINSSLSNGFFRSNTLSESYQYLSNLFLSNEALLDQMTKTLLRKRWLFPDEMVVAICSNNESLV

SEQ ID NO: 203280 - protein, 527 aa, Glycine max
  Coding DNA Sequence Number=SeqID_86502
  Gene Ontology: Mol. function=protein kinase activity; Cellular component=integral to membrane; Biological process=protein amino acid phosphorylation
  Homolog annotation: Hit_ID=Q1SS76; Match level="QueryCoverage=92%, HitCoverage=94%, E-value=1e-154, Identity=58%"; Hit description =Protein kinase
  Pfam annotation: Domain name=LRR_1; Domain location=103-125; Score =4.0; E_value=51; Accession=PF00560.23; Description=Leucine Rich Repeat
  Pfam annotation: Domain name=LRR_1; Domain location=127-146; Score =12.7; E_value=1.2; Accession=PF00560.23; Description=Leucine Rich Repeat
  Pfam annotation: Domain name=LRR_1; Domain location=78-101; Score =8.3; E_value=8.1; Accession=PF00560.23; Description=Leucine Rich Repeat
  Pfam annotation: Domain name=Pkinase; Domain location=224-484; Score=- 73.0; E_value=0.00033; Accession=PF00069.15; Description=Protein kinase domain
  Pfam annotation: Domain name=Pkinase_Tyr; Domain location=263-484; Score=-115.1; E_value=2.1e-05; Accession=PF07714.7; Description =Protein tyrosine kinase
  Pfam module annotation: Pfam domain module=LRR_1::LRR_1::LRR _1::Pkinase::Pkinase_Tyr; Domain location=103-125::127-146::78 -101::224-484::263-484
MQNIRDSAVFLRRLVSFAILIFFIVDCTRGESSESESFFNFIRALDPKNVLNITWIESPSHPCLVKLNGVRCNSNATNVVHIRLENLNLSGTIDADSLCRLQKLTHLNVTGNQSSGRLPNALTKLKHLRNLDISNNNFSGMIPSKQQYSHLLSYYVTPSNKLESNSTKEWLKESDTHTIHTPNNGKDPWPEILGVILLGAGLLLSTIYFIVKKSAKFSAEREVVKDHRRVSPITKATTHEVQEVKLKEGDSELVFFVEDRERFTLEDLLRATADLRSEGFCSSLYKKISNLKHQNILPLVGYRSTSEEKLIIYEYQSNGSLLNLLNDYIAGRKDFPWKMRLNIACGIARGLAFIYRKLDGEEVMSHGNLKPSNILLDENNEPLISEHGLSKFMNPNRGFLFSSQGYTAPEKSLTEKGKSIEVSRIELARWVRSMVREEWTGEVFDKEVRENDHQWAFPLLNIALLCVSRFQENRPTTMEILEKIEEVMDQHHERCASKCCSIGSNHDECCSLHKIIPETWDSPGSNY

SEQ ID NO: 203281 - protein, 236 aa, Glycine max
  Coding DNA Sequence Number=SeqID_86503
  Gene Ontology: Mol. function=DNA binding; Biological process=DNA integration
MRGGGCTAARPSELMSPRRAGYFNPKLSGGMGEPGSIWQARTQMFANDCPQTKFGYDNILGNHKVVNTTKAMLDYVHSDYWGPLRVPSLGGARYFISIIDDYSKMTWVSGCPTYSHVSEGKLEPFAKKGFFMGYGDGVKGIQVWSPSKRKIILSRDIIFDELSMPHSKSDEDLGKVMDVTNGNSGHGVRAIQCPNYLSQGRLEQHILMQQLKKLKSFEMKDMGTAEKILGMEIKRD

SEQ ID NO: 203282 - protein, 86 aa, Glycine max
  Coding DNA Sequence Number=SeqID_86504
FQTKEEKVQAANDSLSEADPLSEWHPFSKASSSLSGWETLENKESEIYALSRQLTRPARTLSLLALTAPYLAMPKFTNLRLVSPAR

SEQ ID NO: 203283 - protein, 594 aa, Glycine max
  Coding DNA Sequence Number=SeqID_86505
  Gene Ontology: Mol. function=sequence-specific DNA binding; Cellular component=nucleus; Biological process=regulation of transcription
  Homolog annotation: Hit_ID=Q7XJB6; Match level="QueryCoverage=85%, HitCoverage=100%, E-value=0.0, Identity=92%"; Hit description =Putative WRKY-type DNA binding protein
  Pfam annotation: Domain name=WRKY; Domain location=223-281; Score =146.6; E_value=6.4e-41; Accession=PF03106.6; Description=WRKY DNA -binding domain
  Pfam annotation: Domain name=WRKY; Domain location=399-472; Score =130.6; E_value=4.3e-36; Accession=PF03106.6; Description=WRKY DNA -binding domain
  Pfam module annotation: Pfam domain module=WRKY::WRKY; Domain location=223-281::399-472
FGAPKYWGIRGSESKRVGSEFDGEVQADVTGEASDLEVAVHHDSSGAQSDVVSGIPGSSFQHEGNGLEEGKVEASPTTGSLRKLQQTMHGSMASAAFPVTTACFDTNTVDDRKSSFFEFKPLSRSNMVPADFNNHVSKQSTQVEGPGKTQSFASSPLVESEIAVPSNELSLSSPVQKVSSSASAPVDVDLDDINHKGNTATGLQASHVEVRGSGLSVAAEKTSDDGYNWRKYGQKLVKGSEFPRSYYKCTHPNCEVKKLFERSHDGQITEIVYKGTHDHPKPQPSCRYSTGTVMSIQGERSDKASMAGRDDKATAMYGQVSHAAEPNSTPESSPVATNDDGLEGVAGFVSNRTNEEVDNDDPFSKRRKMELGNVDITPVVKPIREPRVVVQTLSEVDILDDGYRWRKYGQKVVRGNPNPRDTEMDIWVKADENWSYYKCTNAGCPVRKHVERASHDPKAVITTYEGKHNHDVPAARNSSHDMAVPAAAAGGQTRTKLEESDTISLDLGMGISSAAEHRSNGQGKMLHSEFGDTQTHTSSSNFKFVHTTSAPVYFGVLNNSSNPFGSRDNRSDGPSLNRSSYPCPQSMGRILMGP

SEQ ID NO: 203284 - protein, 495 aa, Glycine max
  Coding DNA Sequence Number=SeqID_86506
  Gene Ontology: Cellular component=mitochondrion
  Homolog annotation: Hit_ID=Q9FM80; Match level="QueryCoverage=97%, HitCoverage=97%, E-value=1e-151, Identity=58%"; Hit description =Arabidopsis thaliana genomic DNA, chromosome 5, P1 clone:MDF20
  Pfam annotation: Domain name=mTERF; Domain location=153-465; Score =51.5; E_value=2.8e-12; Accession=PF02536.5; Description=mTERF
MAAVMPLYPYNPMLYFSTPSSFCSQFWILERERLGSARLKNLVKLAAHSNPRILKSNRKSKYGEALSLYDSDEDDEELDDDDNEDDDDDWLSDEEFSEPANLDVNNKRFKSKTTKGNDRQQEREWGLRSFDNEQSIRLPRSERVATLQRNESGKLPNRDTHSRNVKDKKYPQLSEEIPLDVKWLPLLDYLSTFGMKESHFVQMYERRMQSLQINVCSAQERLEYLLSIGVKQRDVRRILLRQPQILEYTVENNLKSHVAFLRGLGIPNSRIGQIIAAAPSLFSYSVENSLKPTVSYLIEEVGIKEKDLGKVIQLSPQILVQRIDISWNTRCMFLTKELGAPRDSIVKMVTKHPQLLHYSIDDGLLPRINFLRSIGMKNSDILKVLTSLTQVLSLSLEENLKPKYLYLVNELNNEVQSLTKYPMYLSLSLDQRIRPRHRFLVSLKKAPKGPFPLGSLVPTDECFCQQWAGTSLDKYLAFRQRLLLKKFAEKYERKM

SEQ ID NO: 203285 - protein, 140 aa, Glycine max
  Coding DNA Sequence Number=SeqID_86507
  Homolog annotation: Hit_ID=Q9FM81; Match level="QueryCoverage=61%, HitCoverage=61%, E-value=6e-19, Identity=53%"; Hit description =Arabidopsis thaliana genomic DNA, chromosome 5, P1 clone:MDF20
  Pfam annotation: Domain name=A2L_zn_ribbon; Domain location=98-132; Score=30.5; E_value=6e-06; Accession=PF08792.1; Description=A2L zinc ribbon domain
  Pfam annotation: Domain name=DUF1610; Domain location=103-128; Score =11.0; E_value=0.1; Accession=PF07754.2; Description=Domain of unknown function (DUF1610)
  Pfam module annotation: Pfam domain module=A2L_zn_ribbon::DUF1610; Domain location=98-132::103-128
  Subcellular localization annotation: CTP_CleavageSite=49; ConfidenceScore=5.57e-01
MEAAAASSSLSLLSLASVKTRSKVAQNCHVTQQRQRCNHVCVKNARRTRVTAVPVNVDDVTTVLDPAPVEVTWQIVVGAIAGVTPFVVAGIEFSKRIIAQKRCEVCGGSGLVLREKEKDYLRCPECGMIAFTSSHIMYSI

SEQ ID NO: 203286 - protein, 259 aa, Glycine max
  Coding DNA Sequence Number=SeqID_86508
  Gene Ontology: Mol. function=nucleic acid binding; Cellular component= intracellular; Biological process=chromatin modification
  Homolog annotation: Hit_ID=Q1SGQ8; Match level="QueryCoverage=66%, HitCoverage=40%, E-value=7e-21, Identity=34%"; Hit description=Zinc finger, C2H2-type
MWVSLKDNVKCGNKLNDVIKQQTKCGKGSGYVAEKEKMNGYNRPLMETPTTSLVVSRPSNTLGRLHELSVGDPSRKIVEMIFQKAWFNKSKPVKKVRTVLRVSYSEEVLERFEKYREYVKKVASEQNPRNPRSAVDGNELLQFYGTTMRCFQGKSAKKVHDLCKDPSCYLCQIIQFNFNTRYAEIHLNTSDKESRNRTTATARVHNVKKAAIICRIIAGTAVNEVDGEYEGSHSTGLGEMQFTLQKFVSNLTMSSAKED

SEQ ID NO: 203287 - protein, 150 aa, Glycine max
  Coding DNA Sequence Number=SeqID_86509
MPPMIEREMMIMIMDTLLVFYYEKMVGYMPSSFADLVFAGERIEACLRKGKFNYVSFANPGNRGLGRSGERKKEGEPHVVAAVPAWPNFPIAPVTTYPSAGGRRGAHRPTWALQNIPPEGCCFWRKQPGSPGRAELAWASWAATTSPILL

SEQ ID NO: 203288 - protein, 395 aa, Glycine max
  Coding DNA Sequence Number=SeqID_86510
  Gene Ontology: Mol. function=RNA-directed DNA polymerase activity; Biological process=RNA-dependent DNA replication
DIVMAFEYDSCPDSLHVGRTINVEALPVWGGLVVFNEFCQKVCHKLCLHGVSRFFQHLFDGVVRLDYHLVTLKVWPQTSGQVLLNVMEYVIGEVELTTSSNTERYRSRGTPGLGQVRTGSVAMVFLKTKKTCSQNGFAFLASFGRNLDRDVGLPFNLWTYWTLAHVIFADFSEYFFQVYHVLGYAMEFDDHVFDIDLDISFDLLFEDPASRKLSTWNPDASSTSLSMLSKGYSSLGHALLGLVEYLTSLMKLALRSLSTSSLTILRRYSPIFLFFCDTGFSLGTDGKLVAYNARVDTRHGCQVNRPFVHAHDLSIATRCEVRLGRLPAPRELALIKGGNEADVASDVEGAALVNENLGHDEVDDYDGDNHGVDIVDVDVLNGVEVTLARLAGLPS

SEQ ID NO: 203289 - protein, 476 aa, Glycine max
  Coding DNA Sequence Number=SeqID_86511
  Gene Ontology: Mol. function=protein serine/threonine kinase activity; Cellular component=integral to membrane; Biological process=protein amino acid phosphorylation
  Homolog annotation: Hit_ID=Q1SB06; Match level="QueryCoverage=83%, HitCoverage=44%, E-value=3e-62, Identity=38%"; Hit description =Protein kinase
  Subcellular localization annotation: CTP_CleavageSite=37; ConfidenceScore=5.23e-01
MDMDMTVSARQFLVSNAKSLRPNVICGVPNKLKRNVRYSMRSALVWIFTLNVCLHILFIPGGDSKPHPRFREKITEDYNRGFISIDCGASNDYLDEETSTFYKTDTDFIETGENLLASSQFIDINIPGFGRQLRTLRSFPEGNRNCYTLKPEYKQGEQQSYLIRAMFGYGNYDGKNHPPTFDLYLGVYYWINVNPAKYSYLWTEIIHAPTTDTIQVCLVNIDTGTPFISSLELRPLSTSIYQIMSQSYLHLWGRFDVGGPVETYYKRYKDDIYDRRWYSPDVKDWYKINTTIDVNKSGNDIYKVPAEVLKTAVQSFNRSYDLYYDYEIEWNVHLNKYSRYYVYFHFAEIQKLAPGLRRIINITLNDENILSEPITLEYMKPVTISNKNATQGFVRFSIRATAESDAPPILNAFEVYELITDLNSPTDIKDVDAMENIKRYYGISRIDWQGDPCLPEKFRWSGLDCSYGINPRIISL

SEQ ID NO: 203290 - protein, 196 aa, Glycine max
  Coding DNA Sequence Number=SeqID_86512
  Gene Ontology: Mol. function=protein serine/threonine kinase activity; Cellular component=integral to membrane; Biological process=protein amino acid phosphorylation
  Homolog annotation: Hit_ID=Q1SB07; Match level="QueryCoverage=99%, HitCoverage=24%, E-value=2e-70, Identity=66%"; Hit description =Protein kinase
MMGMLLQFLYVLFGVLISVVLVQAQDQSGYTEKTTSIFYISDAKFIDAGVSKSISPAEKSTHLQQLAYVRSFPSGERNCYRINVTSGTKYLIRATFFYGNYDGLNQPPQFDLHLGPNLWDTVSFPNASLSEISEIIYTPSLDYIHPCLVNKGQGAPFISTIELRTLKNASYVTASAESLAYYRRYDLGSITNLVYR

SEQ ID NO: 203291 - protein, 110 aa, Glycine max
  Coding DNA Sequence Number=SeqID_86513
  Gene Ontology: Mol. function=protein binding; Biological process =xylan catabolic process
  Homolog annotation: Hit_ID=Q1SWI7; Match level="QueryCoverage=77%, HitCoverage=13%, E-value=9e-31, Identity=70%"; Hit description =Leucine-rich repeat
MLDLSYNHLKGNIPTGTQLQTFDASSFIGNNLCGPPLPINCSSNGKTHSYEGSDGHGVNWFFVSMTIGFIVGFWIVIAPLLICRSWRGRVAERKEGKDRRCGEMELRITK

SEQ ID NO: 203292 - protein, 54 aa, Glycine max
  Coding DNA Sequence Number=SeqID_86514
MVTSMLQLDLMNLFVKARAWFNFITQGMAILIANTSSTIHRDERLGNMRAMHGK

SEQ ID NO: 203293 - protein, 162 aa, Glycine max
  Coding DNA Sequence Number=SeqID_86515
MGEVEEIQEKMKADMEAIKEKMATMMEAMMSVKKIMEANAVAIAATSIVAKVNPKSPSGLSQMNHPTSAMVGKDLGSTGGPHYAQSQNKHAFPPYGLPPNYTPPNVAYTPNKNVNNSTPIPIESQQPRTDHAHGKQLVVYPLKHFGRPSISPPATPLAFHDK

SEQ ID NO: 203294 - protein, 372 aa, Glycine max
  Coding DNA Sequence Number=SeqID_86516
  Gene Ontology: Mol. function=nucleic acid binding; Cellular component= spliceosome; Biological process=mRNA processing
  Homolog annotation: Hit_ID=Q6ZK57; Match level="QueryCoverage=70%, HitCoverage=43%, E-value=1e-67, Identity=54%"; Hit description =Putative RNA recognition motif (RRM)-containing protein
  Pfam annotation: Domain name=RRM_1; Domain location=293-361; Score =28.2; E_value=2.9e-05; Accession=PF00076.12; Description=RNA recognition motif. (a.k.a. RRM, R
  Pfam annotation: Domain name=zf-CCCH; Domain location=140-165; Score =28.8; E_value=1.9e-05; Accession=PF00642.15; Description=Zinc finger C-x8-C-x5-C-x3-H type (and similar)
  Pfam module annotation: Pfam domain module=RRM_1::zf-CCCH; Domain location=293-361::140-165
MAKLASCPDYFIREVAVQARKELQRLAAKPDMLAMSLTVNPQHGLSDLSVISPRTPTSPNFQVPPPYWDPQSAGNVNPDFMGMNYLDSIVELQKQTQMLTLENQIDAVKTGTGGIANDYYGLDASAANLGGKAGRRFSEFPMKICHYFNKGFCKHGTSCRFYHGQVVPENFSQMYGNDAISEDQVISPGSLAQLESEIIELLRTKGGPMSIASLPMAYYDKYKKVLQADGYLTESQRHGKSGYSLTKLLARLNNSIRLIGRPHGQHSVVLAEDAPTQMQKGDFARNISASRQIYLTFPADSTFTEDDVSNYFNTFGPVADVRIPNQQRRMFGFVTFVHSETVKTVLDKGNPHCVRGSRVLVKPYQEKAKVNE

SEQ ID NO: 203295 - protein, 345 aa, Glycine max
  Coding DNA Sequence Number=SeqID_86517
  Gene Ontology: Mol. function=magnesium ion binding; Cellular component=integral to membrane; Biological process=transport
  Homolog annotation: Hit_ID=Q9LK65; Match level="QueryCoverage=80%, HitCoverage=48%, E-value=1e-110, Identity=68%"; Hit description =Similarity to hemolysin
  Pfam annotation: Domain name=CBS; Domain location=27-124; Score=36.8; E_value=7.5e-08; Accession=PF00571.18; Description=CBS domain
  Pfam annotation: Domain name=CorC_HlyC; Domain location=145-248; Score=79.4; E_value=1.1e-20; Accession=PF03471.7; Description =Transporter associated domain
  Pfam module annotation: Pfam domain module=CBS::CorC_HlyC; Domain location=27-124::145-248
EPYVTEDELKLMLRGAELSGAIEEEEQDMIENVLEIKDTHVREVMTPLVDVVAIDASSSLGELLESTTVGDMAHKPAYFVPDSMSVWNLLREFRIRKVHMAVVLNEYGGTVGIVTLEDVVEEIVGEIFDENDSKEEIQKKTGYIVMRAEGVFDVDANTSIDQLSEDLNIKMPEGHQYETVSGFVCEAFGYIPRTGECIKVVLEREDEDDNNESNADQQDQKEKNQIFKLEILAGNARKVSAVRFERINNNDEMLETKVTRMVPKIMKRKWSSDENSDNDAEYDGDTFAKRPQDDIPSEYLVDQENSNRAYEMEKLRYMYKMRSNEFKHVKPCKRRIRGIFANESL

SEQ ID NO: 203296 - protein, 223 aa, Glycine max
  Coding DNA Sequence Number=SeqID_86518
  Gene Ontology: Mol. function=L-fucose isomerase activity; Cellular component=cytoplasm; Biological process=fucose metabolic process
  Homolog annotation: Hit_ID=Q9LK65; Match level="QueryCoverage=88%, HitCoverage=30%, E-value=3e-78, Identity=74%"; Hit description =Similarity to hemolysin
  Pfam annotation: Domain name=DUF21; Domain location=61-223; Score =121.8; E_value=2e-33; Accession=PF01595.10; Description=Domain of unknown function DUF21
ELLKRGIILAATVCGVLVFGCSRVFAVEGVANAGYGVFGQSILLLTNTWPKVLQVLRIFKEQGLVLAVLLGLSAFFSMAETSITTLWPWKVRELAEKEPENGVFRLLRSDVTRFLTTILIGTTVVNIGATALVTEAATAMFGEAGISAATGVMTVAILLLTEITPKSIAVHNATEVARFVVRPVAWLSLVLYPVGRIVTYLSMGMLKLLGLKGRRSAEKIARD

SEQ ID NO: 203297 - protein, 964 aa, Glycine max
  Coding DNA Sequence Number=SeqID_86519
  Gene Ontology: Mol. function=ATPase activity, coupled to transmembrane movement of substances; Cellular component=integral to membrane; Biological process=transport
  Homolog annotation: Hit_ID=Q9LK64; Match level="QueryCoverage=99%, HitCoverage=62%, E-value=0.0, Identity=73%"; Hit description =Multidrug resistance-associated protein 3
  Pfam annotation: Domain name=ABC_membrane; Domain location=395-665; Score=83.6; E_value=6.3e-22; Accession=PF00664.13; Description=ABC transporter transmembrane region
  Pfam annotation: Domain name=ABC_tran; Domain location=737-924; Score= 168.4; E_value=1.8e-47; Accession=PF00005.17; Description=ABC transporter
  Pfam annotation: Domain name=ABC_tran; Domain location=96-279; Score =136.6; E_value=6.9e-38; Accession=PF00005.17; Description=ABC transporter
  Pfam annotation: Domain name=MMR_HSR1; Domain location=97-174; Score=- 15.3; E_value=0.025; Accession=PF01926.13; Description=GTPase of unknown function
  Pfam module annotation: Pfam domain module=ABC_membrane::ABC _tran::ABC_tran::MMR_HSR1; Domain location=395-665::737-924::96 -279::97-174
IPLESGKILSALATFRILQEPIYRLPDTISMIAQTKVSLDRIVSFLRLDDLRSDVVEKLPWGSSDTAIEVVDGNFSWDLSSPNPTLQNINLKVFHGMRVAVCGTVGSGKSTLLSCVLGEVPKISGILKVCGTKAYVAQSPWIQSGKIEDNILFGERMDRERYEKVLEACSLKKDLEILSFGDQTIIGERGINLSGGQKQRIQIARALYQDADIYLFDDPFSAVDAHTGSHLFKFFQQHDSSSIIYECLLGLLSSKTVVYVTHQVEFLPAADLILVMKDGKITQCGKYTDLLNSGADFMELVGAHKKALSTLDSLDGATVSNEINALEQDVNVSGTYGFKEKEARKDEQNGKTDKKSEPQGQLVQEEEREKGKVGFSVYWKCITTAYGGALVPFILLAQILFQALQIGSNYWMAWATPISSDVEPPVEGTTLIAVYVGLAIGSSFCILARAMLLVTAGYKTATILFNKMHFCIFRAPMSFFDSTPSGRILNRASTDQSALDTDIPYQIASFAFIMIQLLGIIAVMSQAAWQVFVVFIPVIAVSIWYQQYYIPSARELARLVGVCKAPIIQHFSETISGTSTIRSFDQQSRFQETNMKLTDGYSRPKFNIAGAMEWLCFRLDMLSSITFAFSLVFLISIPQGFIDPGLAGLAVTYGLNLNMIQAWMIWNLCNMENKIISVERILQYTCISSEPPLVVDENRPDPSWPSYGEVGIQDLQVRYAPHLPLVLRGLTCKFRGGLKTGIVGRTGSGKSTLIQTLFRIVQPTSGQIMIDSINISSIGLHDLRSRLSIIPQDPTMFEGTVRNNLDPLEEYSDEQIWEALDKCQLGDEVRKKEGKLDSKVDAVVTENGENWSMGQRQLVCLGRVLLKKSKVLVLDEATASVDTATDNLIQQTLRQQFSGSTVITIAHRITSVLHSDMVLLLSQGLIEEYDTPTRLIENKSSSFAQLVAEYTMRSNSSFEKSDDH

SEQ ID NO: 203298 - protein, 510 aa, Glycine max
  Coding DNA Sequence Number=SeqID_86520
  Gene Ontology: Mol. function=ATPase activity, coupled to transmembrane movement of substances; Cellular component=integral to membrane; Biological process=transport
  Homolog annotation: Hit_ID=Q9LK64; Match level="QueryCoverage=97%, HitCoverage=33%, E-value=1e-136, Identity=51%"; Hit description =Multidrug resistance-associated protein 3
  Pfam annotation: Domain name=ABC_membrane; Domain location=299-509; Score=-30.7; E_value=0.023; Accession=PF00664.13; Description=ABC transporter transmembrane region
MFMLSLFSPLSTAVLLKPIFLHGFSAFIHLLLLLAVSLSWVWNKITAGARDESKEKPSHTLFKTTVFSSLGVSAFNFLLCLFTYFYWYTSGWSEEKLVTLLDLALKTLAWGVVCVCLQNGFFSSGERRFSFFFRAWCTFYLVVSCYCFVVDIVVVSERRVALPTRYLVSDVVSTCVGLFFCYVGYFVKNEVHVDNGIQEPLLNSDALESKESKGGDTVTPFSYAGFLSILTFSWVGPLIAVGNKKTLDLEDVPQLDGRDSVIGAFPSFREKLEADCGGINRVTTLKLAKSLIMSAWKEILITAFLALLNTLASYVGPYLIDGFVQYLDGQRLYENQGYFLVSAFFFAKLVECLTQRHWIFKLQQVGLRIRALLVTMIYNKALTLSCQSKQGHTSGEIINFMTVDAERVGVFSWYMHDLWMVALQVTLALLILYKNLGLASIAALVATVVIMLANVPLGSLQEKFQKKLMESKDTRMKATSEILRNMRILKLQGWEIKFLSKITELRKNEQ

SEQ ID NO: 203299 - protein, 226 aa, Glycine max
  Coding DNA Sequence Number=SeqID_86521
  Gene Ontology: Mol. function=RNA-directed DNA polymerase activity; Biological process=RNA-dependent DNA replication
  Homolog annotation: Hit_ID=Q1SDD8; Match level="QueryCoverage=38%, HitCoverage=16%, E-value=5e-10, Identity=36%"; Hit description =Ribonuclease H; Glutathione S-transferase, C-terminal-like
MTVEPRNRGLNIVSISHDSLNSIFFFLTLSRNCSLLYQASCGALIPAVRYLVICGPNYFPIAVRLNISRKCFGGLLGLAPLSTNGFAHGSPGHAGSNDISHDHQGGMLDCFSSYIDIYNSFFAEIFAVILALEMAKDKGWLNLWIEYDFAFVIQAFSNPSIVPYKLANVGALSRDFFNWWNLIPVFVRKELLRNRLSLSNYRFRQVVVGFDIIPPTFFILFFLIPI

SEQ ID NO: 203300 - protein, 509 aa, Glycine max
  Coding DNA Sequence Number=SeqID_86522
  Gene Ontology: Mol. function=nucleic acid binding; Cellular component= chromatin; Biological process=DNA integration
  Homolog annotation: Hit_ID=Q1RWN2; Match level="QueryCoverage=100%, HitCoverage=39%, E-value=1e-156, Identity=53%"; Hit description =Peptidase S8 and S53, subtilisin, kexin, sedolisin; Integrase, catalytic region; Zinc finger, CCHC-type
  Pfam annotation: Domain name=rve; Domain location=204-367; Score =146.9; E_value=5.3e-41; Accession=PF00665.16; Description=Integrase core domain
MLLMYFTETKSIDQKGVWFLDSGCSNHMCGIKDWFFDFDDKFKESVKLGDNSRMAIKGKDNIKLKIEGITQVITDVFYIPELKNNLLSIDQLQQRNLTIVFKQDMCKVFHNARGLIMSSKMSANRMFAIAAQVTVPSCLQMESEGSTYLWHCRYGYLSIKGLKIIAQKEMVRGLLKLQESSQVCTDCMVGKQHREVIPKESSWRASQRLELIHFDICGPINLESNSNKKYFITFIDDYSRKSWVYFMSEKFVALDIFKKFKIMVEKDSGNSIFCLRTDKGGEFNSCEFNSFCSNNGIKRQLTAAYTPLQNGFAERKNRTIMNMVRSMLSEKGVPKQFWPEALKWKIYVLNRSPTLAVKNVTPEEAWNGTKPSVKHFRVFGCIAYAHVPDAQRKKLDDKSIKCVHLGVSEESKAYKLYDPITKKVIVSKDVIFAEKEKWKWNKEEIGEKKNLAECKDDNESSEGENAEIEATQNTNNENAESEDQNPQAADSPNPAEGRTRRQPAWLEDY

SEQ ID NO: 203301 - protein, 214 aa, Glycine max
  Coding DNA Sequence Number=SeqID_86523
MLWFKLELENEIINLDDDDDDDDDDDDDGCTSKGLHGKKVISQIIAENEHPSSSDAIQHKSIFTEAQRFEAIKRKCLSDTQSSTSTSSDDDDSFEFDEGNPPKRRKTAPDSSGVNSLPRYGSHIEVECKKIIRTKGEKVDNGVATSEKTMSAAENSKELGTLEPPADPGEYAVFGGAELDDLSLNSLAFSLSLFLSLWQPMKIRLGRCLNLNKF

SEQ ID NO: 203302 - protein, 67 aa, Glycine max
  Coding DNA Sequence Number=SeqID_86524
MGDQATNIFRQLQCFKGSLDVLASECSLSETSSLSKRFPNLLSELYASLSGFHLLSVSGSLSKTSAT

SEQ ID NO: 203303 - protein, 158 aa, Glycine max
  Coding DNA Sequence Number=SeqID_86525
  Gene Ontology: Mol. function=monooxygenase activity; Cellular component=membrane; Biological process=electron transport
  Homolog annotation: Hit_ID=Q1SDU6; Match level="QueryCoverage=94%, HitCoverage=63%, E-value=7e-50, Identity=65%"; Hit description=E -class P450, group I
MAKEVMNTHDIIFSNRPYVLAADVITYGSKGMTFSPQGTYWRQMRKICTMELLAPKHVDSFRSIREQELTIFVKEISLSEGSPINHSEKISSLAYVLISRIAFGIKSKDQQAYREFMKGVTDTGAGFSLADLYPSIGLLHVLTGIRTSVEKIHRSRNG

SEQ ID NO: 203304 - protein, 507 aa, Glycine max
  Coding DNA Sequence Number=SeqID_86526
  Gene Ontology: Mol. function=monooxygenase activity; Cellular component=membrane; Biological process=electron transport
  Homolog annotation: Hit_ID=Q1SDT7; Match level="QueryCoverage=94%, HitCoverage=95%, E-value=0.0, Identity=68%"; Hit description=E-class P450, group I
  Pfam annotation: Domain name=p450; Domain location=39-498; Score =331.0; E_value=2.1e-96; Accession=PF00067.12; Description=Cytochrome P450
MGLELHISLSIILPFFLLVFILIITLWRSKTKNSNSKLPPGPRKLPLIGSIHHLGTLPHRSLARLASQYGSLMHMQLGELYCIVVSSPEMAKEVMNTHDIIFANRPYVLAADVITYGSKGMTFSPQGTYLRQMRKICTMELLAQKRVQSFRSIREQELSIFVKEISLSEGSPINISEKINSLAYGLLSRIAFGKKSKDQQAYIEHMKDVIETVTGFSLADLYPSIGLLQVLTGIRTRVEKIHRGMDRILENIVRDHREKTLDTKAVGEDKGEDLVDVLLRLQKNGDLQHPLSDTVVKATILDIFSAGSDTSSTIMVWVMSELVKNPRVMEKVQIEVRRVFDGKGYVDETSIHELKYLRSVIKETLRLHPPSPFLLPRECSERCEINGYEIPTKSKVIVNAWAIGRDPNYWVEAEKFSPERFLDSPIDYKGGDFEFIPFGAGRRICPGINLGIVNVEFSLANLLFHFDWRMAQGNRPEELDMTESFGLSVKRKQDLQLIPITYHTARS

SEQ ID NO: 203305 - protein, 715 aa, Glycine max
  Coding DNA Sequence Number=SeqID_86527
  Gene Ontology: Mol. function=binding; Cellular component =mitochondrion; Biological process=protein metabolic process
  Homolog annotation: Hit_ID=Q7XHS8; Match level="QueryCoverage=90%, HitCoverage=96%, E-value=0.0, Identity=40%"; Hit description =Putative pentatricopeptide (PPR) repeat-containing protein
  Pfam annotation: Domain name=PPR; Domain location=146-180; Score =18.5; E_value=0.025; Accession=PF01535.11; Description=PPR repeat
  Pfam annotation: Domain name=PPR; Domain location=181-215; Score=7.3; E_value=1; Accession=PF01535.11; Description=PPR repeat
  Pfam annotation: Domain name=PPR; Domain location=216-250; Score =14.5; E_value=0.14; Accession=PF01535.11; Description=PPR repeat
  Pfam annotation: Domain name=PPR; Domain location=258-292; Score =35.8; E_value=1.5e-07; Accession=PF01535.11; Description=PPR repeat
  Pfam annotation: Domain name=PPR; Domain location=293-327; Score =39.5; E_value=1.2e-08; Accession=PF01535.11; Description=PPR repeat
  Pfam annotation: Domain name=PPR; Domain location=328-362; Score =40.6; E_value=5.3e-09; Accession=PF01535.11; Description=PPR repeat
  Pfam annotation: Domain name=PPR; Domain location=363-396; Score =28.2; E_value=2.9e-05; Accession=PF01535.11; Description=PPR repeat
  Pfam annotation: Domain name=PPR; Domain location=397-431; Score =42.8; E_value=1.1e-09; Accession=PF01535.11; Description=PPR repeat
  Pfam annotation: Domain name=PPR; Domain location=444-478; Score =36.1; E_value=1.2e-07; Accession=PF01535.11; Description=PPR repeat
  Pfam annotation: Domain name=PPR; Domain location=479-513; Score =21.1; E_value=0.0041; Accession=PF01535.11; Description=PPR repeat
  Pfam annotation: Domain name=PPR; Domain location=514-548; Score =35.9; E_value=1.4e-07; Accession=PF01535.11; Description=PPR repeat
  Pfam annotation: Domain name=PPR; Domain location=549-583; Score =45.9; E_value=1.3e-10; Accession=PF01535.11; Description=PPR repeat
  Pfam annotation: Domain name=PPR; Domain location=584-618; Score =35.2; E_value=2.3e-07; Accession=PF01535.11; Description=PPR repeat
  Pfam annotation: Domain name=PPR; Domain location=619-653; Score =42.6; E_value=1.4e-09; Accession=PF01535.11; Description=PPR repeat
  Pfam annotation: Domain name=PPR; Domain location=654-688; Score =39.6; E_value=1e-08; Accession=PF01535.11; Description=PPR repeat
  Pfam module annotation: Pfam domain module=PPR::PPR::PPR::PPR::PPR::PP R::PPR::PPR::PPR::PPR::PPR::PPR::PPR::PPR::PPR; Domain location=146 -180::181-215::216-250::258-292::293-327::328-362::363-396::397 -431::444-478::...
  Pfam module annotation: Domain location=479-513::514-548::549 -583::584-618::619-653::654-688
CGLVRGGGCGGVCVKILSRAQVLNLRSVFKCGKIDPLSCKFSSSFSNGSPPEMYGKVKVNSFMDDASHSQDNAFKSEGMRKTVHDVCRVLDTYPWGPALEDAFNTFDEMPQPELVVGVIWRLNDVRVALHYFRWVERKTEQPHCPEAYNALLMLMARTRNLEYLEQILEEMSMAGFGPSNNTCIEMVASFVKLRKLGEAFGVIETMRKFKLRPAYSAYTTLIGSLSAAHEADPMLTLLRQMQEIGYEMKSNSFNADLVLYNVCIDCFGKVGKVDMAWKFFHELKSQESVPDDVTYTSMIGVLCKAERVDEAVEMLEELDSNRSVPCVYAYNTMIMGYGSVGKFDEAYSLLERQKRKGCIPSVIAYNCILTCLGRKGKVEEALRTLEEMKIDAVPNLSSYNILIDMLCKAGELEAALKVQDSMKEAGLFPNIMTMLDSGQTPNAVVYTSLIRNFFKCGRKEDGHKIYKEMMHRGCSPDLMLLNNYMDCVFKAGEIEKGRALFEEIKAQGLIPDVRSYSILVHGLGKAGFSKETYKLFYEMKEQGLHLDTCAYNIVIDRFCKSGKVNKAYQLLEEMKTKGLQPTVVTYGSVIDGLAKIDRLDEAYMLFEEANSKGVDLNVVVYSSLIDGFGKVGRIDEAYLILEELMQKGLTPNTYTWNCLLDALVKAEEIDEALVCFQNMKNLKCPPNEADCLEQAAIVGAVLREMAKSQHATRLT

SEQ ID NO: 203306 - protein, 407 aa, Glycine max
  Coding DNA Sequence Number=SeqID_86528
  Homolog annotation: Hit_ID=Q51GF2; Match level="QueryCoverage=64%, HitCoverage=17%, E-value=3e-08, Identity=25%"; Hit description=Viral A-type inclusion protein repeat, putative
MAFQLKPEPGSPPMSTSTTQKNYKEMSISQLVSVLRVSFQTEDFDKVEEELANRDAKLKAEIEPLREKIEVERLKRIEAEEKLKNRDEQCEKGKRAQQNYEQLLKEVKKNGLVEKNTIEELRQMSLALQRENCELKGLKKKWLDDGKSVGELRSRISVLEEEKSALDALSTKNSELKEAIKIKLTAIEGLRTENCKLADEKRRLETLMENLERKFAEIGVKIVKLEDATQSLLDGLKAEGITVNVEEVGDYKLENDTGGHVPFQRNEDTRHSIDAQSLSKGNKDALGASGFKLELENEIINLDDDDDDDDDDDDDDDGCTSKGLHGKKVISQIIAENEHPSSSDAIQHKSIFTEAQRFEAIKRKCLSDTQSSTSTSSDDDDSFEFDEGNPPKRRKTAPDSSGVNSLP

SEQ ID NO: 203307 - protein, 88 aa, Glycine max
  Coding DNA Sequence Number=SeqID_86529
  Gene Ontology: Mol. function=monooxygenase activity; Cellular component=membrane; Biological process=electron transport
  Homolog annotation: Hit_ID=Q1SDT3; Match level="QueryCoverage=96%, HitCoverage=20%, E-value=4e-27, Identity=58%"; Hit description=E -class P450, group I
MGRDPNYWIEAEKFNPERFLDSSIDYKGAEFEFIPFGAGRRTFPGINLGIMAQGNSPQELDMTESFGLTVKRKQDLQLIPITYHSATS

SEQ ID NO: 203308 - protein, 109 aa, Glycine max
  Coding DNA Sequence Number=SeqID_86530
MEIVGKLVSKVIFNLGTKVEGGREYGEFRGMAYESKPFGHLVYKFCIFTMNTRWWFRGPAHHLSRECHSWISPDLLWPYRNHLKIIFGYTRALEGLQLNAIYGWLYGVQ

SEQ ID NO: 203309 - protein, 47 aa, Glycine max
  Coding DNA Sequence Number=SeqID_86531
MVIWLRNNKNQHSSSDSSISLLIIDPGIPSLEEVETSAFSKAINWIR

SEQ ID NO: 203310 - protein, 222 aa, Glycine max
  Coding DNA Sequence Number=SeqID_86532
  Homolog annotation: Hit_ID=Q1SKD7; Match level="QueryCoverage=97%, HitCoverage=56%, E-value=8e-10, Identity=24%"; Hit description =Ankyrin
MESKKRKAPSTPSKIRFDRSIFHSQEAWERYIDIIMPSKLLPERNVVVYYTEFDEFNEELERRHWDEELTSFADGNIDVAIVKEFYTNLYDPEDKSPKQVRVRGHLIKFDEDTLNTFLKTSVILEEGENLCAYSRFALLRLDPQELAAKLYIPGRGFELNADGQPLKILRKNMTMLAQTWSVLSFSNLIPTSHTFDVTLDRAKLIYGIIIKMDMNVGYLISH

SEQ ID NO: 203311 - protein, 113 aa, Glycine max
  Coding DNA Sequence Number=SeqID_86533
  Homolog annotation: Hit_ID=Q69R94; Match level="QueryCoverage=41%, HitCoverage=3%, E-value=5e-10, Identity=65%"; Hit description =Putative symplekin
MRFLVVYSCNQLPPAQLENALNRIAALKAPLIAHASQPDIQSKLPRAVLVVLGLASDSQVSSQAQTSQTQTSQTQTSQTQTTQTQTSQTQTGETSSSDKDTATEKSKESSTAS

SEQ ID NO: 203312 - protein, 273 aa, Glycine max
  Coding DNA Sequence Number=SeqID_86534
  Gene Ontology: Mol. function=threonine endopeptidase activity; Cellular component=proteasome core complex (sensu Eukaryota); Biological process=ubiquitin-dependent protein catabolic process
  Homolog annotation: Hit_ID=Q7DLS1; Match level="QueryCoverage=98%, HitCoverage=89%, E-value=1e-122, Identity=80%"; Hit description =Proteasome subunit beta type 7-B precursor
  Pfam annotation: Domain name=Proteasome; Domain location=35-241; Score=182.7; E_value=9.1e-52; Accession=PF00227.16; Description =Proteasome A-type and B-type
MSPSLDLPPKGGFSFDLCRRNAMLQNKGLKAPTFLKTGTTIVGLVFQREYGEPSLALDILISEVSHLINLPQDGVILGADTRATEGPIVADKNCEKIHYMAPNIYCCGAGTAADTEAVTDMVSSQLQLHRYHTGRESRVVTALTLLKKHLFNYQGHVSAALVLGGVDITGPHLHTIYPHGSTDTLPFATMGSGSLAAMSVFESKYKESLSRDEGIKLVVEAICAGIFNDLGSGSNVDVCVITKGHKEYLRNHLLPNPRTYVNPKGFDFPKKTG

SEQ ID NO: 203313 - protein, 255 aa, Glycine max
  Coding DNA Sequence Number=SeqID_86535
  Homolog annotation: Hit_ID=Q69R94; Match level="QueryCoverage=69%, HitCoverage=14%, E-value=2e-33, Identity=48%"; Hit description =Putative symplekin
GLYSSDLDGALESAWAWMLKFKDKVYSIAFQHGSGGAKLLALKFVEAVIRLYTPDPNGSSEPTSHQGITLRLVGRGHPVLNIGDLKIEASHRLGLLLDQLRFPTVKSLSNSVIIVLIKSLSAIAFDRPAFYGRILPVLLSLEPSSSVVNGVCVSATHFALKNAFVTCSKCTHPSAAPEMQSEGKADRVFHLISASNGTIEREKDDQPVIKAKIPPYRHAIAAYGAAMVGLPSQIAYGGWQKSAMPFRYSSHGATI

SEQ ID NO: 203314 - protein, 826 aa, Glycine max
  Coding DNA Sequence Number=SeqID_86536
  Gene Ontology: Mol. function=molecular_function; Cellular component =tight junction; Biological process=biological_process
  Homolog annotation: Hit_ID=Q69R94; Match level="QueryCoverage=90%, HitCoverage=55%, E-value=1e-160, Identity=47%"; Hit description =Putative symplekin
MSSRADFVLSLKEEEEPATNSGDSVQNNLARKRSGSQIGGDLAEDEETPGKRVRTTVVALEEPKELDECTTTYSQDETPTVPTSSKGDVDNGPVRQLVATFGALIAQGERAVGHLEILISSISADLLAEVVMANMQNLPPNYPNAEGNDEQLQDISMIGSDDKAKYPPSFVAAVMSLSSTFPPIASLLDAHQSVSNEKSQVEEEISATAANSGAVDSGMNIESENIPSPIDFPSSDASIPGVENGCTTMPPDIHDVGNSESGIPGLDSFGRSDSVSQTSAPSLLVSTETCLEDGSQEQVTSLDQRSPLNVAPSISTDRSEELSPKAAVRDVNSLVSSTATSVVPPRLVLPKMIAPVVDLEDEQKDHLQKSCFMRIIDAYKQIAVAGGTNIRFSILAYLGVEFPLELDPWKLLQKHILIDYISHEGHELTLRVLYRLFGEAEEEPDFFSSTTAASVYENFLLTVAEALRDSFPPSDKSLSKLLGESPYLPKSVLKILENMCSPGNGDKGEKELHSLNADRVTQGLSTVWSLILLRPPIRDTCLQIALQSAVHHLEEVRMKAIRLVANKLYPLSSISKQIEDFAKEMLFSVMSGDASEATDIEGSIADSEKGPDVEKVPNEQSSLSGSTKDVTSDNRQSCTSESVSPDSVSEAQRCMSLYFALCTKKHSLFRQIFVIYRSTSKAVKQAVHRQIPILVRTMGSSSDLLEIISDPPNGSENLLMQVLQTLTDGTIPSKDLICTVKRLHDSKLKDAEFLIPILPFLSNDEVMPIFSHIVNLPLEKFQAALGRILQLNLTKSDCKVKVAPLLIYSILAISLITQGLRGGLWR

SEQ ID NO: 203315 - protein, 77 aa, Glycine max
  Coding DNA Sequence Number=SeqID_86537
MYLLSDEFANGAETIRVKEEEQGDELGEKVEVFGESLRQSWHNDSRMEGSGWPTWRCSQDMGAFRGKSLPWTLLFRS

SEQ ID NO: 203316 - protein, 153 aa, Glycine max
  Coding DNA Sequence Number=SeqID_86538
  Pfam annotation: Domain name=HEAT; Domain location=110-146; Score =19.1; E_value=0.016; Accession=PF02985.12; Description=HEAT repeat
MAATSREKLASLVNAAKLAIDIPSKLESLRQLRHELPPEDPVLLTEFLPSLFLFHSDRFGPVRKFLTEIDSGSYPSLTLPLPLQCLGPVCKFVTEDTFFPMLGEIGLKNTEFLSNIVPVLIDLLDDDTPAVVRQVLLCGTDLFRATLEKIVVQ

SEQ ID NO: 203317 - protein, 77 aa, Glycine max
  Coding DNA Sequence Number=SeqID_86539
MYLLSDEFANGVETIRVEEEERGDELGEEVEVFGESLRQGWHNDSRMEGSGWPTWRCSQDMKAFRGKSLPWTLLFQP

SEQ ID NO: 203318 - protein, 110 aa, Glycine max
  Coding DNA Sequence Number=SeqID_86540
  Homolog annotation: Hit_ID=Q1S175; Match level="QueryCoverage=98%, HitCoverage=32%, E-value=2e-27, Identity=51%"; Hit description=MtN19- related
MGLGSIAAKTFEDIKFPKGHIGIKSFDAELVNQEGNSIPSYETYLYHWFAIKYHKNITMSLNPKLHRPEDAFFKRNEGTCNGGILSHYWGFRVESRGTSSNILDPFAIEQ

SEQ ID NO: 203319 - protein, 38 aa, Glycine max
  Coding DNA Sequence Number=SeqID_86541
MENGILRVYLTPKHYVGRLLDFQVLAPINLFQLRIISS

SEQ ID NO: 203320 - protein, 58 aa, Glycine max
  Coding DNA Sequence Number=SeqID_86542
  Homolog annotation: Hit_ID=O64438; Match level="QueryCoverage=62%, HitCoverage=15%, E-value=3e-13, Identity=89%"; Hit description=ARG10
CFYSTTVGGLRCYENPKNKITAVPSEEEEIWGVLFKVILELKKLELNIHYVTRIANCD

SEQ ID NO: 203321 - protein, 71 aa, Glycine max
  Coding DNA Sequence Number=SeqID_86543
MDGPRMKLGYDNITWQKSSLKLLCHHGPHVSKANTNGNDADVAPEFSPFKTVQFGNPSQDTVDPRDGGFEG

SEQ ID NO: 203322 - protein, 259 aa, Glycine max
  Coding DNA Sequence Number=SeqID_86544
  Gene Ontology: Mol. function=oxidoreductase activity; Cellular component=membrane fraction; Biological process=negative regulation of transcription
  Homolog annotation: Hit_ID=Q9LSQ5; Match level="QueryCoverage=81%, HitCoverage=94%, E-value=1e-86, Identity=76%"; Hit description=1,4 -benzoquinone reductase-like; Trp repressor binding protein-like
  Pfam annotation: Domain name=FMN_red; Domain location=35-247; Score= -37.8; E_value=0.025; Accession=PF03358.6; Description=NADPH -dependent FMN reductase
  Pfam annotation: Domain name=Flavodoxin_1; Domain location=45-194; Score=44.8; E_value=2.9e-10; Accession=PF00258.15; Description =Flavodoxin
  Pfam module annotation: Pfam domain module=FMN_red::Flavodoxin_1; Domain location=35-247::45-194
MAIVKALVFYIRINIISVINLRIWLWGSLIAILMYKTIAIWSHRYYSMYGHVEKLAEEIKKGASSVEGVEAKLWQAFSWSKTMLPNSFLLNLRRNVPETLLDEVLGKMSAPPKSDVPVITPNELSEADGFVFGFPTRFGMMAAQFKAFLDATGGLWRAQQLAGKPAGLFYSTGSQGGGQETTALTAITQLVHHGMIFVPIGYTFGAGMFEMEKVKGGSPYGAGTYAGDGSRQPSELELQQAFHQGKYIAGITKKLKQAA

SEQ ID NO: 203323 - protein, 119 aa, Glycine max
  Coding DNA Sequence Number=SeqID_86545
  Gene Ontology: Mol. function=sequence-specific DNA binding; Cellular component=intracellular; Biological process=regulation of transcription, DNA-dependent
  Homolog annotation: Hit_ID=Q1STS2; Match level="QueryCoverage=73%, HitCoverage=73%, E-value=4e-37, Identity=88%"; Hit description =Transcription factor CBF/NF-Y/archaeal histone
  Pfam annotation: Domain name=CBFD_NFYB_HMF; Domain location=25-90; Score=83.9; E_value=4.8e-22; Accession=PF00808.13; Description =Histone-like transcription factor (CBFNF-Y) and archaeal histone
  Pfam annotation: Domain name=Histone; Domain location=19-93; Score =42.8; E_value=1.2e-09; Accession=PF00125.14; Description=Core histone H2AH2BH3H4
  Pfam module annotation: Pfam domain module=CBFD_NFYB_HMF::Histone; Domain location=25-90::19-93
MAYITLKLDTDATTKRLLKLKTGPHSLPLARIKKIMKNSGEDVKMISGEAPIIFSKACELFIEELTRRSWIMAIQGKRRTLHKEDLASAVIATDIFDFLITLVSSSESHAVGGATNVME

SEQ ID NO: 203324 - protein, 785 aa, Glycine max
  Coding DNA Sequence Number=SeqID_86546
  Gene Ontology: Mol. function=protein serine/threonine kinase activity; Cellular component=membrane; Biological process=protein amino acid phosphorylation
  Homolog annotation: Hit_ID=Q1S7H1; Match level="QueryCoverage=86%, HitCoverage=78%, E-value=0.0, Identity=52%"; Hit description=Protein kinase; EGF-like, subtype 2; S-locus glycoprotein; Curculin- like (Mannose-binding) ...
  Homolog annotation: Hit description=lectin; N/apple PAN; Type I EGF
  Pfam annotation: Domain name=B_lectin; Domain location=78-191; Score =135.0; E_value=2e-37; Accession=PF01453.15; Description=D-mannose binding lectin
  Pfam annotation: Domain name=PAN_2; Domain location=348-416; Score =108.9; E_value=1.5e-29; Accession=PF08276.2; Description=PAN-like domain
  Pfam annotation: Domain name=Pkinase; Domain location=517-740; Score =134.9; E_value=2.2e-37; Accession=PF00069.15; Description=Protein kinase domain
  Pfam annotation: Domain name=Pkinase_Tyr; Domain location=517-740; Score=123.6; E_value=5.6e-34; Accession=PF07714.7; Description =Protein tyrosine kinase
  Pfam annotation: Domain name=S_locus_glycop; Domain location=205-331; Score=185.8; E_value=1e-52; Accession=PF00954.11; Description=S-locus glycoprotein family
  Pfam module annotation: Pfam domain module=B_lectin::PAN _2::Pkinase::Pkinase_Tyr::S_locus_glycop; Domain location=78-191::348- 416::517-740::517-740::205-331
MKNHIMPFMRIIFLCYHILVYLSGISLALDSISQDLSLSDDGKNTTLVSKDGTFELGFFTPGNSQKRYLGIWYRKIPIQTVVWVANRLNPINDSSGILRMNPSTGTLVLTHNGTVIWSTASIRRPESPVALLLNSGNLVIRDEKDANSEDYLWESFNYPTDTFLPEMKFGWDLRTGLNRKLIAWKSPDDPSPSDFSFGMVLNNYPEAYMMKGDQKFYRSGPWNGLHSSGSPQVKANPIYDFKFVSNKDELYYTYSLKNSSMISRLVLNATSYVRKRYVWIESKQRWEVYTSVPLDLCDSYSLCGANANCVISDSPVCQCLQGFKPKLPEAWSSMDWSHGCIRNKELSCENKNKDGFNKLTLLKTPDTTHSWLDQTIGLEECKAKCLDNCSCMAYANSDISGQGSGCAMWFGDLIDIRQFAAGGQDVYVRIDASELEHANEGHKKGGVLVAVTVTLALAAVAGILIILGWCYRKKSRCSVKERSDFSIKSNQNSGMQVDDMDLPVFDLSTIAKATSNFTVKNKIGEGGFGPVYRGSLTDGQEIAVKRLSASSGQGLTEFKNEVKLIAKLQHRNLVKLLGCCLEGEEKMLVYEYMLNDEQRSGSLDWSKRFNIICGIAKGLLYLHQDSRLRIIHRDLKASNVLLDSELNPKISDFGMARIFGVDQQEGNTKRIVGTYGYMAPEYATDGLFSVKSDVFSFGVLLLEIISGKRSRGYYNQNHSQNLIGHNPEDRPGMSSVLLMLVSELELPEPKQPGFFGKYSGEADSSTSKQQLSSTNEITITLLEAR

SEQ ID NO: 203325 - protein, 58 aa, Glycine max
  Coding DNA Sequence Number=SeqID_86547
MCLKEKESEMTVQKIAIVGPTTFRIMLDAFSHAFVLYTEWPHRCPSIGSMCRKKRGNS

SEQ ID NO: 203326 - protein, 460 aa, Glycine max
  Coding DNA Sequence Number=SeqID_86548
  Gene Ontology: Mol. function=transcription regulator activity; Cellular component=nucleus; Biological process=regulation of transcription
  Homolog annotation: Hit_ID=Q9LHQ8; Match level="QueryCoverage=99%, HitCoverage=91%, E-value=4e-77, Identity=40%"; Hit description =Arabidopsis thaliana genomic DNA, chromosome 3, BAC clone: F3H11
  Pfam annotation: Domain name=HLH; Domain location=352-390; Score=7.3; E_value=0.024; Accession=PF00010.16; Description=Helix-loop-helix DNA- binding domain
MADNDQFQASGNWWETARSVRYESGASQSSSSAITNIGNNFGWQQGSDMADMKPRSSMDSSSVVFHDTQNNKLQQPDSATSTDPNLHMMGLGLSSQTMDWNQASLLRGEKGTENSFRSMLQENLSSSRTNFQQETGNMGLSQQVQWRSEKMFSSESSTNEFKQVNNRGGGGFSLDQSQFSPQYSSGDSTVTSQGLPSSNFQIDSSALYGTPSILQGLLGPDHNNQPQQQQPMSFPYQTTSYGLNSNELVPSWSKVPQFLRASPPKQPPNNQLHFTNNATFWNDSEAANNKDVRPSFFPSLQPPFSTPNFEVQSKNISEVRESGTVVKKSGNEPAPKRTRNESPSPLPAFKVRKEKMGDRITALQQLVSPFGKTDTASVLSEAIEYIKFLHEQVTALSTPYMKSGAPMQIQQNSGKSKEAEGPKQDLRSRGLCLVPVSSTFPVTHETTVDFWTPTFGGTSR

SEQ ID NO: 203327 - protein, 239 aa, Glycine max
  Coding DNA Sequence Number=SeqID_86549
MGGAAEDSGVRLVGVTNLEVHVLEGEDIGGMHMLSHGNMVSGDDGLREEAWGEGEGEGGKEETQNLNVNPTTLPSEDFEAYPNTQEGWVSDHGGVVFVVGEIDRGFGREVGAPTGAEAHVHKYTRYKEKVDHGKLIRRNNEPIVGVDKEYKHTTYDAGKASIPYQIVDTRRQGEMVGEEGSSGYEWLKNLKDFGKLQGMKVQEVQKWDPDIASANKVGSLEGVDEDTLTLKYVEYARIW

SEQ ID NO: 203328 - protein, 152 aa, Glycine max
  Coding DNA Sequence Number=SeqID_86550
  Gene Ontology: Mol. function=protein serine/threonine kinase activity; Cellular component=membrane; Biological process=protein amino acid phosphorylation
  Homolog annotation: Hit_ID=Q5JNK2; Match level="QueryCoverage=84%, HitCoverage=34%, E-value=1e-41, Identity=60%"; Hit description =Putative Nod-factor receptor 1b
  Pfam annotation: Domain name=Pkinase_Tyr; Domain location=33-151; Score=-129.8; E_value=0.00017; Accession=PF07714.7; Description =Protein tyrosine kinase
MATKRLKKLLEARKSSSRDTSGLEEVFSTTNGFSVTSLLRHGTYGSVYYSLLHDQEVAIKRMTTTKTKEFMSEMKVLCKVHHANLLVMRSFSLYMNMLRMGSLKSHMHDPQNKVQIALNVARGLEYIHEHTKTHYVHRDIKTSNILLDASLR

SEQ ID NO: 203329 - protein, 116 aa, Glycine max
  Coding DNA Sequence Number=SeqID_86551
  Gene Ontology: Mol. function=catalytic activity; Biological process =metabolic process
  Homolog annotation: Hit_ID=Q01CB8; Match level="QueryCoverage=89%, HitCoverage=34%, E-value=1e-12, Identity=39%"; Hit description =Homology to unknown gene
MDAKRREDMVDVLPKRRILMRHEKSQGNRNTTAYTTILDYNIQSTTQGMTQALCTGEHLHRMIGSDGFSPDLRVQFYMSPYACTRSTLPKLKLSKKRIIGMREESRVREWDFGNFQ

SEQ ID NO: 203330 - protein, 91 aa, Glycine max
  Coding DNA Sequence Number=SeqID_86552
  Gene Ontology: Mol. function=DNA binding; Cellular component=nucleus; Biological process=regulation of transcription
  Homolog annotation: Hit_ID=Q2LME4; Match level="QueryCoverage=91%, HitCoverage=24%, E-value=5e-36, Identity=79%"; Hit description=MYB20
  Pfam annotation: Domain name=Myb_DNA-binding; Domain location=11-58; Score=34.2; E_value=4.4e-07; Accession=PF00249.21; Description=Myb -like DNA-binding domain
MNNNIKSNLRKGLWSPEEDEKLIRYMITKGQRCWSDIARNGGLQRCGKSCQLRWINYFRPDLKRGVFSPQEEELIIHLHSILGNNYLLDLN

SEQ ID NO: 203331 - protein, 94 aa, Glycine max
  Coding DNA Sequence Number=SeqID_86553
  Homolog annotation: Hit_ID=Q10MY4; Match level="QueryCoverage=61%, HitCoverage=27%, E-value=1e-14, Identity=62%"; Hit description =Rhodanese-like family protein, putative
MFVEDTDNSPITLLKKWVHFGYIGLWTGQYLTTLNSEFLSQVENSIPTGKETKLLVACGGGLSLRRRALPRGLPRFVRRAFRYLLRPKLWKFGE

SEQ ID NO: 203332 - protein, 105 aa, Glycine max
  Coding DNA Sequence Number=SeqID_86554
MSRSRIGKSHKKCSKTPTKWDQIELNWPNGIQSSQTGAGDICGDKFGGALAMLQSLDEEDTDGLVRPIKRKHNGGQEALAAIALLFIRMRKVLWREKKKDKGFET

SEQ ID NO: 203333 - protein, 177 aa, Glycine max
  Coding DNA Sequence Number=SeqID_86555
  Gene Ontology: Mol. function=nucleic acid binding
  Pfam annotation: Domain name=zf-CCHC; Domain location=102-119; Score =8.7; E_value=0.036; Accession=PF00098.13; Description=Zinc knuckle
MLILGVIKEGDDPKIVSLFCIPFLVQIHNLPMGFMSQMVGESIGNFIDQYLDYDEKNNVNYLRSFMRIGVLMDVQKPFMKSKIKKPGGEFKEFCYKYEYLGPFCYFCGILGHTEDHCRTLLFMQQDDGKCGLGPKIQVEACPNDGASGSRYLWDTGDPKPWQFSSEKKTTNVDNKMQ

SEQ ID NO: 203334 - protein, 48 aa, Glycine max
  Coding DNA Sequence Number=SeqID_86556
MDASEPYIEAMKDTMHKPQANLGANQRFSPSRFPTARLKTQKGSLSKN

SEQ ID NO: 203335 - protein, 193 aa, Glycine max
  Coding DNA Sequence Number=SeqID_86557
MARGDDYDHPYPFCHPETIKYDGIQRPSWSFALIVFKTILISFSIQRQSSLMAYGDHHDNVFSHCTPSKGDNDHHFHFEDDNVFSHCMPSKGDNDLHPHFEDDNVFSHCIPSKGDNVIIFILKTTMSLVLACLQKAIMTIICISKTTMSSVIACFQKATMTFIYILKTTMSSVIARLQKATMSSFAFRRQQCL

SEQ ID NO: 203336 - protein, 151 aa, Glycine max
  Coding DNA Sequence Number=SeqID_86558
  Homolog annotation: Hit_ID=Q1SL03; Match level="QueryCoverage=57%, HitCoverage=26%, E-value=5e-08, Identity=31%"; Hit description =Ribosomal protein S2; Nucleic acid-binding, OB-fold
  Pfam annotation: Domain name=DUF223; Domain location=1-95; Score= -9.6; E_value=0.023; Accession=PF02721.5; Description=Domain of unknown function DUF223
MVLMDQTGSKIGATLWQELFTELRDKLQCGSSYLIQNLRIVDNQSEYRVSLAPYLVYFLKTTSVKEIHRPKIPSNVYLITPFTDIISGLAPRHTLVDIVGVIVDLIDVKTVNPPHRMIVRLRDNSNYDILITVWEDYAIQLHDAIDKNLLL

SEQ ID NO: 203337 - protein, 65 aa, Glycine max
  Coding DNA Sequence Number=SeqID_86559
MGSSQKPSLKKKFYQVKIKSLEVTSLGKLGQLMGQLQWQAFRKAYGIRPPKASRKWGGRNTDVIP

SEQ ID NO: 203338 - protein, 141 aa, Glycine max
  Coding DNA Sequence Number=SeqID_86560
  Gene Ontology: Mol. function=transition metal ion binding
MQKSRVTLRAESQHFASVHDDNSCVASIPYSGFIDEIWELNYVKFTVCVFKCKWVDNNTGVRTDDVGFMFVDLNKLAYHNDPFIMAEQAKQVFYVQDPCDERPMATPPASCPPPPPLPPPLPIVASVSPSTLKRTRKATRL

SEQ ID NO: 203339 - protein, 81 aa, Glycine max
  Coding DNA Sequence Number=SeqID_86561
MASYGVVSPFIFLLLHSTAIRPQEAKESIDEEDPRPTSSTLIYIIREPWRMTGGRSLELMFWSPNGSSQYILTSMGDKGTL

SEQ ID NO: 203340 - protein, 343 aa, Glycine max
  Coding DNA Sequence Number=SeqID_86562
  Gene Ontology: Mol. function=inorganic phosphate transporter activity; Cellular component=membrane; Biological process=phosphate transport
  Homolog annotation: Hit_ID=Q3K848; Match level="QueryCoverage=69%, HitCoverage=44%, E-value=1e-75, Identity=63%"; Hit description =Phosphate transporter
  Pfam annotation: Domain name=PHO4; Domain location=170-342; Score= -59.7; E_value=2e-08; Accession=PF01384.11; Description=Phosphate transporter family
MHTFNHANRAIACADHHLRPAPDPQRRILRAALLFTEGDVIQHRQQRIVLLRQSGARRGRMNLIEKIVIYAEVVLNPALGAGMIQVNVQPEKAAVGFPASSSDRGRPNLHPRSGRASRVLFLLLLVAGLVFTGINLFNDVEETGAVVTSYTPFLLLGVALLIALGFEFVNGFHDTANAVATVIYTHSLSPGVAVVWSGLCNFLGVLLSSGVVAFGIISLLPVELILQAGSGHGFAMVYALLCSAIVWNLGTWYFGLPSSSSHTLIGSIIGVGVANALLHGRSGTSGVDWDQAIKVGYALLLSPVIGFICAAVLLLAMKALVRNRQLYQAPEAISRRQRGFVAC

SEQ ID NO: 203341 - protein, 115 aa, Glycine max
  Coding DNA Sequence Number=SeqID_86563
  Subcellular localization annotation: CTP_CleavageSite=33; ConfidenceScore=5.28e-01
MASPPALPPPPPPPSPPPPPPPPPPPPPPSPPPPSDGKPHVYAPCLLDQLVLRDQWSTLILLLARPTVDVTYENWKEVPTAQKDLIWEDIQAEFDILEASDSRTKKKLLKTVGER

SEQ ID NO: 203342 - protein, 74 aa, Glycine max
  Coding DNA Sequence Number=SeqID_86564
IYMSSIFGPDVLDIVSDIVDPAASILHLTFILPSSIFGQDVLDIVSDIVDPAASMLLAIPVFSSRMSWTLYPTS

SEQ ID NO: 203343 - protein, 100 aa, Glycine max
  Coding DNA Sequence Number=SeqID_86565
MVCMHMKGKRRITIATCPSAGVRKGLLGWAKGASSVEGKCVESPPIFIQGKRQKNQNGKGQKSTYFKNEGSGVVYTQGRLILIVNKSHLRRWTFERPLDF

SEQ ID NO: 203344 - protein, 163 aa, Glycine max
  Coding DNA Sequence Number=SeqID_86566
  Gene Ontology: Mol. function=RNA-directed DNA polymerase activity; Biological process=RNA-dependent DNA replication
MAMKKEARGILEILPYSEYTVQKAYHNIMENILDNTHLRCEGDWMLIWKLQAPPKIKHFLWRLLRGCLLTRSNLRKKQILCPLIGLCLLQNKIIENEWHLFLACDHAQHIWLEAILGNLIEQKWDNVENFHSLIFHLLQDFLSQNSQNWCGSLVHLKDPQHKN

SEQ ID NO: 203345 - protein, 107 aa, Glycine max
  Coding DNA Sequence Number=SeqID_86567
MPGLGWDWSSLVLGNSTPLTSLRSRDPRDISPGGGQAMVQVDYPDPQITHESTIPSYPPSTELTYSHVALILVPLNTGSPSIPPSFHNIQEISTSKHHELSKPSKTG

SEQ ID NO: 203346 - protein, 67 aa, Glycine max
  Coding DNA Sequence Number=SeqID_86568
  Subcellular localization annotation: CTP_CleavageSite=29; ConfidenceScore=5.63e-01
LSLAHQWTKRASTAKRSFSALSASQESSRASISRSHAKREISVLSASFVFSQAQHTTGAKLKSTYAR

SEQ ID NO: 203347 - protein, 62 aa, Glycine max
  Coding DNA Sequence Number=SeqID_86569
MGRSKQMLTNLLGSLKLIKREKIACLEELKPLNLREFHGKEENKGRGMMQKDEAQANERKKE

SEQ ID NO: 203348 - protein, 42 aa, Glycine max
  Coding DNA Sequence Number=SeqID_86570
  Homolog annotation: Hit_ID=Q1SJP8; Match level="QueryCoverage=97%, HitCoverage=3%, E-value=9e-07, Identity=50%"; Hit description=D -galactoside/L-rhamnose binding SUEL lectin; Integrase, catalytic region; ...
  Homolog annotation: Hit description=Galactose-binding like; Peptidase aspartic, catalytic
MDVVEWILRYLKSAPGKAYDKRFTADYFTFVEGNLVTWRSKK

SEQ ID NO: 203349 - protein, 35 aa, Glycine max
  Coding DNA Sequence Number=SeqID_86571
MKNRSNKSDSAKNMQDLSSILTPEHLDEYIYEGED

SEQ ID NO: 203350 - protein, 139 aa, Glycine max
  Coding DNA Sequence Number=SeqID_86572
MHERQSIHGAPNKSGEWRIALGNHYAWLQTHWWKMHERQSIHGAPNKSGEWKIALGDHFAWLQTHWWKMHERQLILGAPNKSGEWTIALRNHFAWLQTHWWMMHERQSIHGAPNRSGEWRIALGNHYAWLKTHWWKMHA

SEQ ID NO: 203351 - protein, 68 aa, Glycine max
  Coding DNA Sequence Number=SeqID_86573
GGQGDTVPNVEALWQTAMLRVGSCHIKFLDKGLDGEEGRDNNCGEGASIERNLVSQNKALRLDSVQNQ

SEQ ID NO: 203352 - protein, 145 aa, Glycine max
  Coding DNA Sequence Number=SeqID_86574
  Gene Ontology: Mol. function=hydrolase activity, hydrolyzing O -glycosyl compounds; Cellular component=beta-galactosidase complex; Biological process=carbohydrate metabolic process
  Homolog annotation: Hit_ID=Q1SJP8; Match level="QueryCoverage=77%, HitCoverage=10%, E-value=7e-28, Identity=41%"; Hit description=D -galactoside/L-rhamnose binding SUEL lectin; Integrase, catalytic region; ...
  Homolog annotation: Hit description=Galactose-binding like; Peptidase aspartic, catalytic
MENRTNESDFAPHMQNLSLILEYLDGTSYPEWHQKGKKMESSKDNSTATTGFVAKSVIINANGVSFPVMGSATISVSPLLSISNVLFVPSLNCNILFNIYTKEKINNGKRSEGLYYLEGNSKYTKGKALAHSISDETQVKNKKYI

SEQ ID NO: 203353 - protein, 56 aa, Glycine max
  Coding DNA Sequence Number=SeqID_86575
MESTPTNEITVAKSAEPESYIVIIKCNCRLRSVYRPMNAKRTKKKGPIFIDLPRPN

SEQ ID NO: 203354 - protein, 213 aa, Glycine max
  Coding DNA Sequence Number=SeqID_86576
  Gene Ontology: Mol. function=phosphoglycolate phosphatase activity; Biological process=metabolic process
  Homolog annotation: Hit_ID=Q5H3J7; Match level="QueryCoverage=72%, HitCoverage=67%, E-value=5e-26, Identity=48%"; Hit description =Hydrolase
HCRAQKPAEASVEPSITLARSGCQATGSEHGLGSSSASCDPIALQHLAQSPSIAHGFRVQAGSACAAHIGEQVIDEQSCVKAPRRVPQACAGRLPVRVCAGRNRRCRTHAAAGPGTVPAAGWARPAASARRCWSAPPSAVAGAAAAATRQLADGWRPAVPRSMQPHRQSCPDAPPAAPDRPGHPACHCHAPLPVRCHTARPARPAPEPAAPGP

SEQ ID NO: 203355 - protein, 71 aa, Glycine max
  Coding DNA Sequence Number=SeqID_86577
MKKDVQNFCERCIFCKKAKSKVMPHELGYIHTIFSKQYRIPEQGHRSAKFEIKALEAARGIALQRSLGFIN

SEQ ID NO: 203356 - protein, 107 aa, Glycine max
  Coding DNA Sequence Number=SeqID_86578
MICALCGERPTPTCPGKINPLTELPEMSCHIGEEEKGLHRCDAKVQGVMSSANIQDFGSERERLDATDILTFEGEERLPMITMMIGMVKMWGMPMMMVVVGRNYRYR

SEQ ID NO: 203357 - protein, 147 aa, Glycine max
  Coding DNA Sequence Number=SeqID_86579
MGDLEEVQEQMKADMLAFKEQMASMMDAMLGMKQLMESNMAIAAAVSSAAEADPTLSTTAHHPIPNMVGREGSTSRHINNPHSWYNRGTYPYGLPPNYTPPAIHEDVGHVPTLILEGEPPRHPDGVHENPQEHAQGDINSYCRSKAS

SEQ ID NO: 203358 - protein, 45 aa, Glycine max
  Coding DNA Sequence Number=SeqID_86580
NVYTDNHSGISARQHDSKVSITDLVSAEDDVNLRASTGLSAAIDE

SEQ ID NO: 203359 - protein, 42 aa, Glycine max
  Coding DNA Sequence Number=SeqID_86581
MSEIRRFGGLGMEERRKEEGAAQGFLENVIFIEQDAWPSVLV

SEQ ID NO: 203360 - protein, 126 aa, Glycine max
  Coding DNA Sequence Number=SeqID_86582
  Subcellular localization annotation: CTP_CleavageSite=52; ConfidenceScore=5.88e-01
MAESSKKRKGSSASASASSASASASSASASVSRAHRSGAISASTAPIPPSLSSSTLFSSEEQQKRYSNLFSSRSIIDPKFIDMELFSAETFDCIQAFQNLGLIPFMSLQLPVYPELVKAFYCNLEI

SEQ ID NO: 203361 - protein, 45 aa, Glycine max
  Coding DNA Sequence Number=SeqID_86583
MTQSDIHRDEHQIPTNTTQDDQFVGDDNSDSTDNDVNMTQENINI

SEQ ID NO: 203362 - protein, 382 aa, Glycine max
  Coding DNA Sequence Number=SeqID_86584
  Homolog annotation: Hit_ID=Q3R2D4; Match level="QueryCoverage=97%, HitCoverage=88%, E-value=1e-142, Identity=65%"; Hit description =Transcription factor jumonji, jmjC
  Pfam annotation: Domain name=Cupin_4; Domain location=3-315; Score =458.1; E_value=1.2e-134; Accession=PF08007.2; Description=Cupin superfamily protein
MAPATFLRDFWQKRPLLIRNAFPDFQTPVQPEDLAGLACEEGVLARLIEHDKAQDGWRVRTGPFQEDVFPALPDHDWTLLVQDVDKWDPDVRALIEHFSFLPRWRMDDVMISFAATGGSVGAHVDQYDVFLLQAHGHRRWQIDASESIKGRQPPLGFRPDVELKLLKVFKPTHDWVLAPGDMLYLPPNVPHHGVAEDPCLTFSFGMRAPSSAELISDYLDTLIADADENIRYQDADLKVPADPNEIDTVAMARVITALNAIRMNDPDKLGDWFGRFITTYRAAGEVMAHQAAPAPEEVAQALASGLLLQRHPWARLAWRRAKRGASLYVSGQDFALPVKDAQRLAGAEQLDATAYRGLSDKGRAVVQQLLVGGVFQLIDPNE

SEQ ID NO: 203363 - protein, 319 aa, Glycine max
  Coding DNA Sequence Number=SeqID_86585
  Gene Ontology: Mol. function=nucleoside-triphosphatase activity; Biological process=defense response
  Homolog annotation: Hit_ID=Q1SI90; Match level="QueryCoverage=99%, HitCoverage=55%, E-value=2e-31, Identity=27%"; Hit description =Disease resistance protein; AAA ATPase
MVKLLASLETIGVSNCGSLEEIIKIPDNSDKIEFLKLKSLSLESLSSFTSFYTIEGSSTDRDEIQITVAENEHSEMAPPLFGELVEIPNLENLNLISMNKIQKIWSDQPPSNFCFQNLIKLVVKDCHNLRYLCSLSVASSLRKLKGLFVSNCKMMEKIFSTEGNSADKVCVFPKLEEICLDQMDELTDIWQAEVSADSFSSLTSVYIYRCNKLDKIFPSHMEGWFASLNCLKVWFCKSVEVIFEIKDSRQVDVSGGIDTNLQVVVVGFLPKLKQVWSRDPGGILNFKKLQSIPVSHCERLRNVFPASVAKDVPKLEYLS

SEQ ID NO: 203364 - protein, 135 aa, Glycine max
  Coding DNA Sequence Number=SeqID_86586
  Homolog annotation: Hit_ID=Q1SKA8; Match level="QueryCoverage=42%, HitCoverage=21%, E-value=6e-08, Identity=50%"; Hit description=Zinc finger, CCHC-type
MAAGSTTIEKPRDQWSKEEKKLVQYNLKAKNIITSALGMDEYFRVSNCRSAKDMEWQPKVTTIIESRDLSNMSLATLFGKLLEHEMELMRLNQHEENDKKKKGIALKASSSIQEENDKEDLIEIDEDDDLSLFVK

SEQ ID NO: 203365 - protein, 115 aa, Glycine max
  Coding DNA Sequence Number=SeqID_86587
  Gene Ontology: Mol. function=ribonuclease H activity; Biological process=DNA integration
MNGVVEAANRNIKKIVQKMIISYKDRHEMLPFALHGGDSSLRSLAESGLEEAEWAQARFDQLNLIEGKRLAAIKDFQTQGKGCPCVVQSFVKGLYKDSGNLKRVAWGLDIGTGRG

SEQ ID NO: 203366 - protein, 139 aa, Glycine max
  Coding DNA Sequence Number=SeqID_86588
MGLGAAFPRPLPFSLKELTLERLPKLENVWNEDPHGILTMQLLQHVIVAEDNADPREANLELTFPCPCVSSLKLHGLPKFKYFYYCSPQTPTEDEMPTSNLQCLSLGEKGLEMIKRGEFQRNFLHKLQVLTLCFHIGSN

SEQ ID NO: 203367 - protein, 88 aa, Glycine max
  Coding DNA Sequence Number=SeqID_86589
MVEFVSGMLRWLRNVMFYVPQQRWMNPCASWMILSFGEVIEDFDYQQLLKILIGFVGGDLVEKQVRYEDWKFWEKGSAITRDFCDCSF

SEQ ID NO: 203368 - protein, 115 aa, Glycine max
  Coding DNA Sequence Number=SeqID_86590
MEIKRCYSIEEIVSKDGDESHEEEVSIKEVSIFPQLNCLKLEELPNLRSFYKGSLLSFPSLEELSVISCQWMETLCPGTLKADKLVQVQLEKYSDAIKLENDLNSTMREAFWEKR

SEQ ID NO: 203369 - protein, 202 aa, Glycine max
  Coding DNA Sequence Number=SeqID_86591
  Homolog annotation: Hit_ID=Q9FGR0; Match level="QueryCoverage=49%, HitCoverage=7%, E-value=3e-16, Identity=44%"; Hit description =Probable cleavage and polyadenylation specificity factor 160 kDa subunit
MGTIMFEAQWHTKCEHLSLLKIKPWFATFIGVTLYARPNPCCKWTEAEPVVAHEFEGGPGDAVEEGTTAGVGGGLGRLVPLEADDIDFEDGDDEVGEGADVVARAGGPLGVDVVGLEKDEVRARVGEEPGGTIVDVGGALHHLVRRETHGGRNSVSCSSISAVKEKREYESVRVRGRLSGGQLQELGFAKGRTTYRPKRLFE

SEQ ID NO: 203370 - protein, 82 aa, Glycine max
  Coding DNA Sequence Number=SeqID_86592
MEIIGCDSIEEIVSSTEEGDESDENEIIFQQLNCLVLEHLGKLRRFYKGSLIKTDKLLEVNINWGGDVIPLETDLNSAMQNR

SEQ ID NO: 203371 - protein, 139 aa, Glycine max
  Coding DNA Sequence Number=SeqID_86593
  Subcellular localization annotation: CTP_CleavageSite=44; ConfidenceScore=5.20e-01
MVIFGEEGGSNLHFLQRSTPSPLMNTSRLFRISKPKPHFDSRKRVSPKPNKVLVFSIVIFHCLRLFLHLLVLEAALVVEVEELQGACGVELATVVFKVNGEHSGLRLGTHAEDEGLGSFITGNSGKQNEEENDGRKGIQ

SEQ ID NO: 203372 - protein, 131 aa, Glycine max
  Coding DNA Sequence Number=SeqID_86594
  Homolog annotation: Hit_ID=Q1S208; Match level="QueryCoverage=46%, HitCoverage=17%, E-value=3e-12, Identity=56%"; Hit description =Tetratricopeptide-like helical
MGISSLDDSPKVAWSAVAIGVVVVLGVVVRADYVKAEEYCERAILANPNDGGVLSMYADLIWQTQKDTCGAEGYFDQAVKASLDDCYVIASCAHFLWEAEKEEEEEEDPSKESSSFFHGTLQSSTPLAAAS

SEQ ID NO: 203373 - protein, 663 aa, Glycine max
  Coding DNA Sequence Number=SeqID_86595
  Gene Ontology: Mol. function=protein binding; Cellular component =nucleus; Biological process=negative regulation of ethylene mediated signaling pathway
  Homolog annotation: Hit_ID=Q2PQJ1; Match level="QueryCoverage=97%, HitCoverage=100%, E-value=0.0, Identity=63%"; Hit description=EIN3 -binding F-box protein 1
  Pfam annotation: Domain name=F-box; Domain location=79-127; Score =21.6; E_value=0.0029; Accession=PF00646.23; Description=F-box domain
  Pfam annotation: Domain name=LRR_1; Domain location=263-290; Score =9.0; E_value=6; Accession=PF00560.23; Description=Leucine Rich Repeat
  Pfam annotation: Domain name=LRR_1; Domain location=315-337; Score =0.3; E_value=2.5e+02; Accession=PF00560.23; Description=Leucine Rich Repeat
  Pfam annotation: Domain name=LRR_1; Domain location=368-395; Score =1.9; E_value=1.3e+02; Accession=PF00560.23; Description=Leucine Rich Repeat
  Pfam annotation: Domain name=LRR_1; Domain location=420-441; Score =6.3; E_value=19; Accession=PF00560.23; Description=Leucine Rich Repeat
  Pfam annotation: Domain name=LRR_1; Domain location=474-497; Score =6.7; E_value=16; Accession=PF00560.23; Description=Leucine Rich Repeat
  Pfam annotation: Domain name=LRR_1; Domain location=500-524; Score =2.9; E_value=82; Accession=PF00560.23; Description=Leucine Rich Repeat
  Pfam annotation: Domain name=LRR_1; Domain location=527-550; Score =4.5; E_value=41; Accession=PF00560.23; Description=Leucine Rich Repeat
  Pfam annotation: Domain name=LRR_1; Domain location=554-581; Score =8.0; E_value=9.2; Accession=PF00560.23; Description=Leucine Rich Repeat
  Pfam annotation: Domain name=LRR_1; Domain location=606-629; Score =9.4; E_value=5.1; Accession=PF00560.23; Description=Leucine Rich Repeat
  Pfam annotation: Domain name=LRR_1; Domain location=632-656; Score =3.9; E_value=54; Accession=PF00560.23; Description=Leucine Rich Repeat
  Pfam module annotation: Pfam domain module=F-box::LRR_1::LRR_1::LRR _1::LRR_1::LRR_1::LRR_1::LRR_1::LRR_1::LRR_1::LRR_1; Domain location =79-127::263-290::315-337::368-395::420-441::474-497::500-524::527 -550::554-581::606-629::632-656
FSAAPVVPFVEPVMPTLVNYSGDDELYHGGSFCQNPIDLGRLCTYGSIVDEYYYTPSKRARINALDAFEFLGREQDQKPTIDVLPDECLFEVFRWLSSGKERSSCAYVSKRWLMLMSSICKAEIHKSDKMIEGSASGYVEMASVDEDQGIEDNGYLTRCLEGKKATNVRLAAIAVGTSARGGLGKLSIRGSNSVRGVTDVGLSAVAHGCPSLRSFSLWNVSSVGDEGLSEIAKGCHMLEKLDICQASFISNKSLIAIAKGCPNLTTLNIESCPKIGNEGLQAIARSCPKLQCISIKDCPLVGDHGVSSLLSSAIHLSKVKLQDLNITDFSLAVIGHYGKAILNLVLCGLQNVTERGFWVMGVAQSLQKLMSLTVSSCRGITDASIEAMGKGCVNLKQMFLRRCCFVSDNGLVAFSKVASSLESLHLEECNNINQFGIICALSNFKSTLKSLTLLKCKGVKDIDLEVSMFPPCESLRHLSIHNCPGVGNASLAMVGKLCPQLQHVDLTGLYGLTDAGLVPLLENCEAGLVKVNLVGCWNLTDNIVSVLATLHGGTLELLNLDGCRKITDASLVAIADNCLLLNDLDVSKCAITDAGIAVLSSAKQLTLQVLSLSNCSGVTNKSAPSLKKLGQTLVGLNLQNCNSIGCNTVEFLVENLWRCDILA

SEQ ID NO: 203374 - protein, 234 aa, Glycine max
  Coding DNA Sequence Number=SeqID_86596
MKPYFCATIPEFEFNQEESPIREQQKLLELFNYRHGLNGGFGPEEKGKREVEEDDDDSSELHDLVAHLGEGGTRERSKVQSLASLMRKRKTRWRKKVSGGGGSGSGSSSSLGKDKLIFMVHNASSPARNDEVFLGVLSLFMGFPCSLFSKFHFCSPLCYTLEWRFQSPFLLLHYAAIDLQEAKDSIDEEDPRPTSSTWSYVTHRLAILSHSSRLPHQKPNVFYTDSYAPLIDMK

SEQ ID NO: 203375 - protein, 98 aa, Glycine max
  Coding DNA Sequence Number=SeqID_86597
MQVLNANNEPPRKGNDAGRRRSSKTKEARTHGQVNETAQGGDRTYIGAEDNRARRLGSGEERSTGAGVRVAGWVSQGVLAKQAMGFTIPTDEIAYDCA

SEQ ID NO: 203376 - protein, 198 aa, Glycine max
  Coding DNA Sequence Number=SeqID_86598
  Gene Ontology: Mol. function=nucleic acid binding; Cellular component= nuclear speck; Biological process=RNA splicing
  Homolog annotation: Hit_ID=Q6K9C3; Match level="QueryCoverage=67%, HitCoverage=50%, E-value=3e-33, Identity=55%"; Hit description =Putative splicing factor RSZp22
  Pfam annotation: Domain name=RRM_1; Domain location=4-70; Score=71.0; E_value=3.9e-18; Accession=PF00076.12; Description=RNA recognition motif. (a.k.a. RRM, R
  Pfam annotation: Domain name=zf-CCHC; Domain location=119-136; Score =34.7; E_value=3.2e-07; Accession=PF00098.13; Description=Zinc knuckle
  Pfam module annotation: Pfam domain module=RRM_1::zf-CCHC; Domain location=4-70::119-136
MSRVYVGNLDSRVTERDLEDEFRVFGVIRSVWVARRPPGYAFIDFDDRRDAQDAIRELDGDLHCYRELHFCCIMGLFYEICASTLNLWGPCKNGWRVELSHNSRGGGGGRGGRSGGSDLKCYECGEPGHFARECRMRGGSGRRRSRSPPRFRRSPSYGRRSYSPRGRSPRHRSLSPRGRSYSRSPPYRGREEVPYANG

SEQ ID NO: 203377 - protein, 94 aa, Glycine max
  Coding DNA Sequence Number=SeqID_86599
  Gene Ontology: Cellular component=integral to membrane
  Homolog annotation: Hit_ID=Q1RYA5; Match level="QueryCoverage=98%, HitCoverage=21%, E-value=1e-17, Identity=53%"; Hit description=Auxin Efflux Carrier
MRISSSRIQKEDNTSKDSNMLKASADISESHPHNFSETLYPTKDTMDDAYTILLPETNSEEKVSFPSKIKHCLRMISRNLNFKSMFAPSTLGAV

SEQ ID NO: 203378 - protein, 72 aa, Glycine max
  Coding DNA Sequence Number=SeqID_86600
  Homolog annotation: Hit_ID=Q1RZ85; Match level="QueryCoverage=60%, HitCoverage=6%, E-value=3e-16, Identity=88%"; Hit description =Asp/Glu racemase; Polynucleotidyl transferase, Ribonuclease H fold
MTCISLVSSSSSGELVKPNANNGDMGMEKMSLIQGVELHHTIIAPNNTTSRHFSEPGISHRDLQPGDILRSS

SEQ ID NO: 203379 - protein, 128 aa, Glycine max
  Coding DNA Sequence Number=SeqID_86601
MVPKKLTSKRARKTTVGEGSKTTPLVEFEFDGHHFHSEEHQRRFEVIKDWSFLKERRVQLAEEPMPKYDPEVVMEFYANAWPTEEGVMDKRSKVWGQWIPYDTDAINQFSGNPLILEDGQQCEYTTRR

SEQ ID NO: 203380 - protein, 80 aa, Glycine max
  Coding DNA Sequence Number=SeqID_86602
AANHRAHVQTHDCLYQLSLSLQSQGFTSFPCPTPDQFRAEVAWPGDWPEAPAEAPDEADEAREDEEMTDLLDFLGVSGAT

SEQ ID NO: 203381 - protein, 136 aa, Glycine max
  Coding DNA Sequence Number=SeqID_86603
MSDEVKGQKADMTKQITIITFHMSGITGCETLLWILIADFMWYCMINLLLFGLSHSAARLLLQLHQSAAARVTRSHLDQIPNMELQPLQAQFYIAGLPISSKGASFLANIGQNSIERPSSTIRDALSGEFWGKHIE

SEQ ID NO: 203382 - protein, 286 aa, Glycine max
  Coding DNA Sequence Number=SeqID_86604
MKEFYANLYVPEDKYPKKVRVRGHPIKFDVDSLNNFLETPVVVEQGESLPSYSRFAILRPDPQELAARLCIPGRGFVLIAEGLPWNLLRKDLTTLAQTWSVLSYSNLAPTSHTSDLNLDRARLVYGLVMKMNMNLALITALCKPRGVTSDSLTFESLSPAINLAYMKKNCWNLDELSVSFLGTQKSRARRSKAPSSSATPAPTTSASSTSILPLPPVAPVPPESAPRLAPDHAEFAGCGPVVASYERGGVSADGDEASAAQEPQLDQEDGILEASDDAILPRKGIG

SEQ ID NO: 203383 - protein, 146 aa, Glycine max
  Coding DNA Sequence Number=SeqID_86605
MAWRFQEDWARDAGEGPRALMSLRWRLQLPFLLLHSVAIGLQEAKDSIDEEYPRPTSSTWSYITTPNTKTSLAHGAKIYLKAHENFRTFSSISGPIFLKSPGHGSGDGSPWKDCIKRLVALGAPSLGACGGPFTDCLGDFKGGFSQ

SEQ ID NO: 203384 - protein, 472 aa, Glycine max
  Coding DNA Sequence Number=SeqID_86606
  Gene Ontology: Mol. function=sodium:dicarboxylate symporter activity; Cellular component=membrane; Biological process=dicarboxylic acid transport
  Homolog annotation: Hit_ID=Q4J4L3; Match level="QueryCoverage=51%, HitCoverage=54%, E-value=8e-67, Identity=51%"; Hit description =Sodium:dicarboxylate symporter
  Pfam annotation: Domain name=2-Hacid_dh_C; Domain location=32-210; Score=212.7; E_value=8.5e-61; Accession=PF02826.9; Description=D -isomer specific 2-hydroxyacid dehyd
  Pfam annotation: Domain name=SDF; Domain location=220-472; Score =47.4; E_value=4.9e-11; Accession=PF00375.9; Description =Sodium:dicarboxylate symporter family
  Pfam module annotation: Pfam domain module=2-Hacid_dh_C::SDF; Domain location=32-210::220-472
YDCIDTDYCRERGIVVSNVPGYSTRSVSESVIASVFALRRNLVEYCCSSHTEWSLSSHFCLHKSPIGDIQEATLGIIGRGDIGCAVARLARALGMNVLFAERPGQNSVREGYTLFDDVISQSDILTLHCPLTPETYQIINQDVLVRMKPSALLINTARGALISEDDLADALTRGEIAGAALDVLAKEPPSPENKLLHVRHKNLLITPHIAWASQTGVNNLIKGINYNLAGIGHFYPNVGVDLKPLGDTFIKLIRLLIAPIIFCTIVSGIASMKSLKSVGQVGWKSLVYFEVLTTLALIIGLIGVNLMEPGKGMHINPASLDGGAIASYTKAAHEQSVTGFLTHIIPETVFGAFAEGNILQVLFISILFAFGLQLLGDLGKPLLNTIDLVAKTFFRMLKIVMYVAPLGAMGAMAFTIGKYGVASLSSYGALLVCYYLTGLFFVFVVLNIVAKLCGFSLWRFLRYIREELALVL

SEQ ID NO: 203385 - protein, 690 aa, Glycine max
  Coding DNA Sequence Number=SeqID_86607
  Gene Ontology: Mol. function=transporter activity; Cellular component= membrane; Biological process=transport
  Homolog annotation: Hit_ID=Q35BK7; Match level="QueryCoverage=51%, HitCoverage=81%, E-value=1e-136, Identity=68%"; Hit description =Natural resistance-associated macrophage protein
  Pfam annotation: Domain name=HTH_1; Domain location=5-64; Score=76.5; E_value=8.1e-20; Accession=PF00126.17; Description=Bacterial regulatory helix-turn-helix protein, lysR family
  Pfam annotation: Domain name=LysR_substrate; Domain location=88-294; Score=142.2; E_value=1.4e-39; Accession=PF03466.10; Description=LysR substrate binding domain
  Pfam annotation: Domain name=Nramp; Domain location=376-690; Score =386.1; E_value=5.4e-113; Accession=PF01566.9; Description=Natural resistance-associated macrophage protein
  Pfam module annotation: Pfam domain module=HTH_1::LysR_substrate::Nram p; Domain location=5-64::88-294::376-690
MTMELRHIRYFLAVAEERHFTRAAARLGIGQPPLSQQIKDLENELGAVLFRRMPYGAELTEAGEAFLEVVRDMPATAERASRAAQRAVRGELGLLRVGFTASAAFNSVVPAAIRAYRRAYPEVRLQLEEGNTSRLVDGLNEGSLDAVFLRPGFAGSDRFQLRMLSEESMVLVLPESHPAASKPSIALSTLRDDDFLLFPRNIGPTLYDSVIDACRSSGFEPIIAQLAPQIASVINLVAAEMGVSIVPASMGQVKVKGVVFRQIDDEAPVAKLALAFRRADTSPCGLKYTPLICQPVFHLGVTSGFTVRLTTPSLITMNSSVDRIGDISNRLSNLTERTNRAIAEVLSGRQHRFMTPLLFAGPAVIASIAYMDPGNFATNIQAGAGYGYTLLWVVVMANIIAMLFQALSAKLGIVTNKNLAEMCRDQFPYPVVWGMWVVSEIAAMATDLAEFLGGALALSLLFHLPLLVGMSITALITYVMLMVEKRGFRPLELMIGGLAVVIALCYLIEMFIAPVNWAAAGIGMVIPQMPDAQALTISVGIIGATVMPHAIYLHSGLTQNRSPAQNPAERRKLLSFSNIEVVIALSIAGLVNIAMVIMAASAFHAGHSDVAEIETAYHTLTPLLGIGAAGVFMLSLIASGISSSVVGTLAGQMIMQGFVGFYVPVWLRRLITMLPAFIVVSMGVNATDAL

SEQ ID NO: 203386 - protein, 440 aa, Glycine max
  Coding DNA Sequence Number=SeqID_86608
  Gene Ontology: Mol. function=transferase activity; Cellular component= mitochondrion; Biological process=acetyl-CoA metabolic process
  Homolog annotation: Hit_ID=Q9ZC36; Match level="QueryCoverage=99%, HitCoverage=100%, E-value=0.0, Identity=80%"; Hit description =Similar to 4-hydroxybutyrate CoA transferase
  Pfam annotation: Domain name=AcetylCoA_hydro; Domain location=3-196; Score=13.2; E_value=2.6e-05; Accession=PF02550.6; Description=Acetyl- CoA hydrolasetransferase
MDIIALYAEKLTTPEDAVSGIPSGSHLSMGMYAGEPPALLNALAHRAERGDVGDLRVYYYETAKIAGDTILRYELNDRIKPYSMFVTGVERALIRRGIEDGERKIINYVPSNFHQAPRLLADEIGIDTFVHTVSPMDQHGYFSLGTGNDYSSRIARSARSLILEVNSHMPRVQGDGAEIHISEVDAIVENNVPLIELPTRSANPEDEAISNIIAGLVQDGACLQMGVGALPNLVCAALRERNDLGIHTEALNPGLVELVRSGVVTNRRKSIDRGKSVFTFAMGQKAMYDYLDGNPSVFSRPVDYVNDPRIIAQNDNVVSVNATLQIDKTGACNSEHMLGHQYSASGGQLDFVRGAYASKGGRSIIAARSTAAKGVVSRIVPRLDGPVTTPRIDTHYIVTEYGSANLKGLSSTERAMRIIELAHPDFREELTLAARKMHLI

SEQ ID NO: 203387 - protein, 227 aa, Glycine max
  Coding DNA Sequence Number=SeqID_86609
  Gene Ontology: Mol. function=DNA-directed DNA polymerase activity; Biological process=response to DNA damage stimulus
  Homolog annotation: Hit_ID=P23832; Match level="QueryCoverage=99%, HitCoverage=58%, E-value=1e-83, Identity=64%"; Hit description =Protein samB
  Pfam annotation: Domain name=IMS; Domain location=1-227; Score=83.6; E_value=6.1e-22; Accession=PF00817.11; Description=impBmucBsamB family
MTPKVEQYSIDEMFLDLTGIDGCEDFEHFGRRLRAHVLATTGLTVGFRGVLALTPDNPKRTATLLENQPVEEIWGVGRRIGRRLNLMGIENALQLARAHPALIRKNFSVVLERTVRELNGESCIPLEEFAPAKQQIVCSRSFGERITTKVAMQEALCHYATRAAEKLRNERQFCRRISVFIRTSPHAQGEVFYGNSAGENLTLPTQDTRDVIGVAMRSLDRIWLDGR

SEQ ID NO: 203388 - protein, 479 aa, Glycine max
  Coding DNA Sequence Number=SeqID_86610
  Homolog annotation: Hit_ID=Q3W3V4; Match level="QueryCoverage=33%, HitCoverage=79%, E-value=3e-19, Identity=39%"; Hit description =Regulatory protein, TetR
  Pfam annotation: Domain name=HIRAN; Domain location=50-162; Score =15.0; E_value=0.0086; Accession=PF08797.1; Description=HIRAN domain
WTDWVADDGVQSRDPLHPQGRALSDSRAATEGASSPQRGTRTGYLLVGSDGYANTEVAGEFARVDSIHKAIGRKPKLDEEIELTELVAALVPEPSNPHDRNAVMVQINGQHVGYLEKEDAVRYLPVIRQVWDAGYVAATGARVWASARESWESKKLKYVARVTLALNEPHLLLPLNDPPVEEHSILPWGHGLQVTGEELHQDVLANYTNAQGDGVVLATLSIIGGGTAKAPKDVVEVRFDGRRIGQLTPGSSQHFVPTIRHLASEGDASGDEVLTNSPLTGSRSPIRCRDSTAGSRPSIQPAAEQKTAACVDAEGVARGIEQRLDAQAIDHGQNERHLLVGSEQLAVARGEGAVGEARPHALAATEEELVRGVLGVRRGHGEGQPVALELGVREFIGEHRTQNLLTRDVRRHDPRGEGLLVLLSLRECCRKQLLLPGEVTEKSGVREPGAGGDVAQGRALVSVLSEAGECGVDDLSASR

SEQ ID NO: 203389 - protein, 201 aa, Glycine max
  Coding DNA Sequence Number=SeqID_86611
  Gene Ontology: Mol. function=oxidoreductase activity; Cellular component=cytoplasm; Biological process=electron transport
  Homolog annotation: Hit_ID=UPI0000E696E9; Match level="QueryCoverage =97%, HitCoverage=99%, E-value=3e-59, Identity=55%"; Hit description =nitroreductase family protein
  Pfam annotation: Domain name=Nitroreductase; Domain location=9-178; Score=-1.3; E_value=0.00027; Accession=PF00881.14; Description =Nitroreductase family
MSDNFLSLAKKRRTIYALGKDVPVSENELISTIKEAVKQAPSAFNSQSSRIVILLNGEHRRFWELTREQLKKIVPAENFSGTSEKVNGFAAAAGSILFFEDQDVVAKLQEQFATYADNFPVWSEHSTGIAQYAVWLALADKGIGANLQHYNPLIDEDVRKTWNVPSSWKLRAHMNFGSVISSAGEKTYMEDDKRFIVAGSL

SEQ ID NO: 203390 - protein, 168 aa, Glycine max
  Coding DNA Sequence Number=SeqID_86612
  Gene Ontology: Mol. function=signal transducer activity; Cellular component=membrane; Biological process=signal transduction
  Homolog annotation: Hit_ID=Q3SIF6; Match level="QueryCoverage=86%, HitCoverage=26%, E-value=4e-28, Identity=46%"; Hit description =Chemotaxis sensory transducer precursor
  Pfam annotation: Domain name=MCPsignal; Domain location=1-168; Score =150.1; E_value=5.9e-42; Accession=PF00015.11; Description=Methyl -accepting chemotaxis protein (MCP) signaling domain
MSRISLASERIRDINRVINDIAFQTNILALNAAVEAARAGEHGRGFAVVASEVRSLSQRSAQAAKEISVLIDESVSEIAVGALLAENAGGTMSKIVDNATSISRILQDIALASSEQSAGLTQINAAIGQLEGGTQQNASLVQQATVASESLKKSARKLADTTGQFRTE

SEQ ID NO: 203391 - protein, 287 aa, Glycine max
  Coding DNA Sequence Number=SeqID_86613
  Gene Ontology: Mol. function=transcription factor activity; Biological process=regulation of transcription, DNA-dependent
  Homolog annotation: Hit_ID=UPI0000686626; Match level="QueryCoverage =99%, HitCoverage=87%, E-value=6e-75, Identity=44%"; Hit description =transcriptional regulator, LysR family protein
  Pfam annotation: Domain name=HTH_1; Domain location=1-50; Score=52.7; E_value=1.2e-12; Accession=PF00126.17; Description=Bacterial regulatory helix-turn-helix protein, lysR family
  Pfam annotation: Domain name=LysR_substrate; Domain location=74-281; Score=158.5; E_value=1.8e-44; Accession=PF03466.10; Description=LysR substrate binding domain
  Pfam module annotation: Pfam domain module=HTH_1::LysR_substrate; Domain location=1-50::74-281
METGSFAAAAQRLKVSPGQASKMITRLEHDLNVNLIRRSTRSLTLTEVGQAYYEQITQLIASYDALNDSVRNSSSTPSGTLRISAPVTFGTFQLPELLMKFSKRYPDIELDVRFSDRLVNLIDEGFDLSLRIGQLEDSSLIARKLCDIRIVLVASPAYVDAKGMPEQCEKLSMHDCVVDTNFREPYIWPFVRKDRKIVIQSVKGKMNFSNAEVCLKACIAGFGISRLPLFVVSDAIKTGKLITILSDYEAPPLGLYAVYPSAKYIANKSRVFIEFLANAFSEKPQWE

SEQ ID NO: 203392 - protein, 59 aa, Glycine max
  Coding DNA Sequence Number=SeqID_86614
MTSQEPSWGQWRWEIAGGTPIITKYGMRDFYRISRFAGPANKTVMRANNADNSELKSLS

SEQ ID NO: 203393 - protein, 87 aa, Glycine max
  Coding DNA Sequence Number=SeqID_86615
  Homolog annotation: Hit_ID=Q35GT7; Match level="QueryCoverage=75%, HitCoverage=45%, E-value=5e-21, Identity=66%"; Hit description =Hypothetical protein precursor
MAMELIGGVALILGVYSRYVALMLIPVLLGAIFTVHAHAGFFFTNPNGGWEFPAFWIVGLIALSLTGDGRTFHNKPETLNAENKPSP

SEQ ID NO: 203394 - protein, 74 aa, Glycine max
  Coding DNA Sequence Number=SeqID_86616
  Pfam annotation: Domain name=DUF1471; Domain location=1-69; Score= -0.8; E_value=0.0015; Accession=PF07338.3; Description=Protein of unknown function (DUF1471)
MKKIRIVLVASFFSMISLSALADNITATDTTLDGAEEKIAAEARRENAHYKIIQASTNNRIHITAKIYKSGSAQ

SEQ ID NO: 203395 - protein, 394 aa, Glycine max
  Coding DNA Sequence Number=SeqID_86617
  Homolog annotation: Hit_ID=Q5QBE8; Match level="QueryCoverage=46%, HitCoverage=52%, E-value=3e-39, Identity=48%"; Hit description =Tyrosine recombinase
  Pfam annotation: Domain name=Phage_integrase; Domain location=1-180; Score=-11.1; E_value=0.0067; Accession=PF00589.13; Description=Phage integrase family
QRRDLTFLHVAYSTLLHISELGRLRVREVSRAADGRIILDLAWTKTIVMTGGLIKALGDLSSQRLTEWLTLSGLAGEPAAFIFGPVHRVNRAMAVTEKPLSARTLEDIFARAWQEAGDAGAVRPNKNRYRTWSGHSVRVGAAIDMAMKKYSTAQIMQEGTWKKPETVMRYIRHVDAHAGAMIDLMKQHQPVRSLSISARIMKHERGMTLTPDVNLVVSDADRSDSAMSEAKRQHIGPSICWPPDAISLSNKVSAPGSLHCRSDEARDHHRPLLAILFTSEYFGHLKKTDTRDVIGVAMRSLDRIWLNGQRYMEAGMMLNDFTPNGASQLNLFDEDTPRASSVQLMKVLDGFDQSGLGDLPPPASGISAMNEAFLPKATVETLSKSVLRWLARLD

SEQ ID NO: 203396 - protein, 108 aa, Glycine max
  Coding DNA Sequence Number=SeqID_86618
IAPARHPVDPEKSNRVLGFPALITGLCQFYGVPVAPNKVIRPPTNRAFIKKYCAPRQAQGETLQQPGDVRQRVIDTPPPPPKPLSSSTKAGALPTTRGRPAGDQVQSQ

SEQ ID NO: 203397 - protein, 138 aa, Glycine max
  Coding DNA Sequence Number=SeqID_86619
MLMCNDQFSCVGPIELLCTIGRTPDDILNLLQATITSTYDVLRYYNGRWNMSRQHDFVGHYEYSDKVIKFEIIELKIDDDMLKVLVQSNYWKQFGPIEILAVFSKQTNLYNAAFYLCTEWATALPENDNVYSTTTPLV

SEQ ID NO: 203398 - protein, 137 aa, Glycine max
  Coding DNA Sequence Number=SeqID_86620
  Gene Ontology: Mol. function=chitin binding; Cellular component =extracellular region; Biological process=chitin metabolic process
  Homolog annotation: Hit_ID=UPI00006A17C9; Match level="QueryCoverage =71%, HitCoverage=100%, E-value=4e-14, Identity=33%"; Hit description= UPI00006A17C9 related cluster
MALSLTPSCLGELCSPGLHTLAFVVLHALSFRGQHVLAFRGLHALAFRGLHVLPFRGLHILAIRGPHLLAFRGLHVLTFRGLHALTFRGLHALTFKGLHVLAFKGLHVHMNGSGMEKEEREETPLQGEDESSISSPP

SEQ ID NO: 203399 - protein, 203 aa, Glycine max
  Coding DNA Sequence Number=SeqID_86621
  Subcellular localization annotation: CTP_CleavageSite=54; ConfidenceScore=5.12e-01
MARMCSPLKGRTCSPLKARACNPLKARTCCPLKERACSTTKARVCSPGEHNSPRQAGYFTMKLFGDPGELEDLAMIEVSVEAIASLTQYYDQSLRCFTFRDFQLAPIIEEFERILGWIPRKRLEEKVEALASKGEWAAFIDVLALLVFGTVLFSNVDGLVDLVTIDAFLAYHHSKESSVIPVWADAYDTFNLRCEKSSARIVY

SEQ ID NO: 203400 - protein, 295 aa, Glycine max
  Coding DNA Sequence Number=SeqID_86622
  Homolog annotation: Hit_ID=Q9LT22; Match level="QueryCoverage=99%, HitCoverage=25%, E-value=3e-71, Identity=50%"; Hit description =Genomic DNA, chromosome 3, P1 clone: MPN9
  Subcellular localization annotation: CTP_CleavageSite=80; ConfidenceScore=5.06e-01
IYLRMLVCIPGKKLRDILNLGDTILGISQSSHPTSFFNVQSPRPSQKLKTFKNLSSCIHLERLVPLLVKQFWSLSLSNLVVSNTKPAYLESIRDLKAPVEENEFSDSSNTQIIPESGRINHPQEPLRVMDSRVAEILNTLRKYFSCIPDFRYIPGLKVRISCCLRFESNTFNRMLGKDKTATSLEEVDALPAIYATVLKFSSSAPYVSIPSYRIPFLLGEPYNKDSASQDASLSIVPVDVGNDSQEEEKYRAIVEIDLEPREPTPGIVDVHIETNAENSQIIQGQLQGITVGIED

SEQ ID NO: 203401 - protein, 486 aa, Glycine max
  Coding DNA Sequence Number=SeqID_86623
  Gene Ontology: Mol. function=RNA polymerase II transcription factor activity; Cellular component=nucleus; Biological process =transcription from RNA polymerase II promoter
  Homolog annotation: Hit_ID=Q9LT25; Match level="QueryCoverage=91%, HitCoverage=57%, E-value=1e-116, Identity=47%"; Hit description =Similarity to transcription factor CA150b
  Pfam annotation: Domain name=FF; Domain location=134-183; Score=41.9; E_value=2.1e-09; Accession=PF01846.10; Description=FF domain
  Pfam annotation: Domain name=FF; Domain location=201-251; Score=15.4; E_value=0.053; Accession=PF01846.10; Description=FF domain
  Pfam annotation: Domain name=FF; Domain location=269-318; Score=41.4; E_value=3e-09; Accession=PF01846.10; Description=FF domain
  Pfam annotation: Domain name=FF; Domain location=382-442; Score=0.9; E_value=1.8; Accession=PF01846.10; Description=FF domain
  Pfam module annotation: Pfam domain module=FF::FF::FF::FF; Domain location=134-183::201-251::269-318::382-442
DGDVTKDHLMSVSNTNVLSDRGSGMVTLNAPAINTGGRDAAALKPSSLQNSPSALDLIKKKLQDSGTPVASSSIPAPSVQTGPESNGSKTVDSTAKGLQVDNNKDKAKDTNGDANVSDTSSDSEDEDNGPSKEECIIQFKEMLKERGVVPFSKWEKELPKIVFDPRFKAIPSYSARRSLFEHYVKTRAEEERKEKRAAQKAAIEGFKRLLDEASEDINYNTDYQTFRKKWRNDPRFEALDRKEQEHLLNERVLPLKKAAEEKAQAMRAAAAASFKSMLKERGDISFNSRWSRVKENLRDDPRYKCVRHEDREVLFNEYISELKAAEHAAERETKAKMEEQVSWTESKPKLEKDAQRRATNPDLDPLDTEKLFREHVKMLQERCAHEFRVLLAEVLTSDAASQETDDGKTVLNSWSTAKRLLKSDPRYNKVPRKEREALWRRYAEDMLRRQKASHDSREEKHTDAEGRNYLESSKHPFESGRSYERR

SEQ ID NO: 203402 - protein, 384 aa, Glycine max
  Coding DNA Sequence Number=SeqID_86624
  Gene Ontology: Mol. function=DNA-directed DNA polymerase activity; Cellular component=mitochondrion; Biological process=nucleobase, nucleoside, nucleotide and nucleic acid metabolic process
  Homolog annotation: Hit_ID=Q6QZN8; Match level="QueryCoverage=42%, HitCoverage=23%, E-value=2e-33, Identity=44%"; Hit description=DNA -directed DNA polymerase
  Subcellular localization annotation: CTP_CleavageSite=33; ConfidenceScore=5.03e-01
MLFKTHGVRHNVPYTTYSRTRSTSTCILLNRIQSNSSKTLIFPHPKLLIPSLEYREPVSVQDTALLSHSVMSLLVSYVYPVLLGYAKANIIFYFKNREVGDIAKPLNKQSIPLTFDDGSPISKSEIYASVFSSIFKLIDIYDGFGVVRIAIRAHFEENIPGPLQPLKEELLEEALSECIKPSSGEIDISNLPVKSLSSTSRKYPKNITVPRKSGNISLRPFLVADTETIINKNSQHVPYAVGVMVVNPGIPVSRRERIDTYFSEDYSSRIFPTFEERSCQMLKSFIFRVAAITRQNRSAKTIYFHNLGRFDGIFLLKHLALYHPNYTVTPLMRDNRLYEVAVYSKKRLLFTFRDSLHLLPGKLDDLAKNLCPELGSKGSISYED

SEQ ID NO: 203403 - protein, 241 aa, Glycine max
  Coding DNA Sequence Number=SeqID_86625
  Gene Ontology: Mol. function=protein binding; Cellular component =nucleus; Biological process=protein amino acid phosphorylation
  Homolog annotation: Hit_ID=Q39LI9; Match level="QueryCoverage=97%, HitCoverage=97%, E-value=3e-97, Identity=72%"; Hit description=Pirin- like protein
  Pfam annotation: Domain name=Cupin_2; Domain location=44-120; Score =19.5; E_value=0.0033; Accession=PF07883.2; Description=Cupin domain
  Pfam annotation: Domain name=Pirin; Domain location=3-119; Score =197.7; E_value=2.8e-56; Accession=PF02678.6; Description=Pirin
  Pfam module annotation: Pfam domain module=Cupin_2::Pirin; Domain location=44-120::3-119
MIEQRLSEQRGLGDHGWLHSRHTFSFASYWDPQQTGFSDLLVINDDQVAPGRGFGAHPHNNMEIISYVLEGALEHKDSMGTGSVIVPGDVQLMSAGSGVTHSEFNHSKQDNVHFLQIWIVPAERGTEPGYQQVSVAEADKRGQLRLIVSPQGDNGSLRVRQDMRIYAGLFDGAEQQTLELANDRYAYIHVARGSIEVNGVSFKAGDGARVRNETALQFANGNNAEVLVFDLRPVEVNHPQR

SEQ ID NO: 203404 - protein, 158 aa, Glycine max
  Coding DNA Sequence Number=SeqID_86626
  Gene Ontology: Mol. function=hydrolase activity, acting on glycosyl bonds; Cellular component=mitochondrion; Biological process=response to DNA damage stimulus
  Homolog annotation: Hit_ID=P12295; Match level="QueryCoverage=99%, HitCoverage=68%, E-value=8e-72, Identity=80%"; Hit description =Uracil-DNA glycosylase
  Pfam annotation: Domain name=UDG; Domain location=49-158; Score =103.7; E_value=5.6e-28; Accession=PF03167.9; Description=Uracil DNA glycosylase superfamily
MAEKLTWHDVLAEEKEKPYFVETLKAVAEERAAGVTVYPPQKDVFNAFRLTELGDIKVVILGQDPYHGPNQAHGLAFSVLPGVAIPPSLLNMYKELEQDIPGFQRPQHGFLESWAKQGVLLLNTVLTVEAGKAHSHARFGWETFTDNVISAINSNREG

SEQ ID NO: 203405 - protein, 231 aa, Glycine max
  Coding DNA Sequence Number=SeqID_86627
  Gene Ontology: Mol. function=catalytic activity; Biological process =metabolic process
  Homolog annotation: Hit_ID=P18953; Match level="QueryCoverage=54%, HitCoverage=99%, E-value=7e-56, Identity=84%"; Hit description =Autonomous glycyl radical cofactor
MSCVRETRAPSAKVTGKPSKKALEKRKEKKAKEEEKPRVKKRHRDTKNIGKRRKPSGSSTPESALSRRKISQPALFALQEIKKAAPAFGKGTGDNVTLLFWRQRVKAHRIARHANGQLRIFFRMLHRIFQRFTAQHVNVEVLTAFNAHLRFLLQWNFTVSNLAKVADCNNLIFREIAFCAQAAGFGFLIVQQPERVQQLRILCLSNLNTGNHRGLQGLALRQEHSAVLRVM

SEQ ID NO: 203406 - protein, 104 aa, Glycine max
  Coding DNA Sequence Number=SeqID_86628
MHETQCGPLRVHRMNRKAWFEQNRGGGCRPARPGEPGVASSRSNSLLEEYSGRAQVGLGAICTPFLLNAPPSTFFAFEEVTKTHGLRKIPPFDFLHITEFSRIA

SEQ ID NO: 203407 - protein, 66 aa, Glycine max
  Coding DNA Sequence Number=SeqID_86629
MVAHVLVVKIKIMKSDKKENDADFPFFKSQVSFFSTFDLNNHCVEEALLLQAVVATFALQGSGRTC

SEQ ID NO: 203408 - protein, 140 aa, Glycine max
  Coding DNA Sequence Number=SeqID_86630
MLFPEFGSIAAGMSGEVFDGQDAGYVPENPVSWLTMINEETLKKLCFNTLVVAVVAGPWPAPVAQMILLGLQEVADIIRLLFSDNSNRRLMHEGDLDSGDVPSSLASLVPIVIAALQIEEENPRVAYLCEYFSLNFNYFF

SEQ ID NO: 203409 - protein, 126 aa, Glycine max
  Coding DNA Sequence Number=SeqID_86631
  Gene Ontology: Mol. function=catalytic activity; Cellular component =membrane
  Homolog annotation: Hit_ID=Q2XH47; Match level="QueryCoverage=97%, HitCoverage=38%, E-value=5e-29, Identity=50%"; Hit description =Xanthine dehydrogenase accessory factor, putative
  Pfam annotation: Domain name=XdhC_CoxI; Domain location=2-73; Score =88.6; E_value=1.9e-23; Accession=PF02625.7; Description=XdhC and CoxI family
MAQQWAEAQPVWLCTVLSTYGSSPRPPGAMMVIRADGRYSGSLSGGCVEENFITRVQQQAFSAASQLVRYGEGGDTPDRALPCGGVLDILVERLPAGTATLRYLRQLEDALTGARAITKRLTLPQP

SEQ ID NO: 203410 - protein, 230 aa, Glycine max
  Coding DNA Sequence Number=SeqID_86632
MCLLRLLKSKMHLSEVPVYMRNLQVWLTVSPLQQTLIQKRILQKTKINLCQSHCCANILVPAESDNRYHRVRGAIATLEQEPSSRNWLLAVKKDALTWCTFNSEKSMMSSTSKKYNNRRFFFLDNGWRLEFASNKDWKAFKALYKDCFGRNFAVRDAKAISIPGVRDASDYEETYSAPFHRPKVYISRKGDDQLFRAVTWKSSANYDMDSEDEKWLSKFNNINKKNKESQ

SEQ ID NO: 203411 - protein, 389 aa, Glycine max
  Coding DNA Sequence Number=SeqID_86633
  Gene Ontology: Mol. function=oxidoreductase activity, acting on NADH or NADPH, quinone or similar compound as acceptor; Cellular component=1-2nm peptidoglycan-based cell wall; Biological process =sodium ion transport
  Homolog annotation: Hit_ID=Q8ZBZ5; Match level="QueryCoverage=51%, HitCoverage=49%, E-value=2e-80, Identity=72%"; Hit description=Na(+)- translocating NADH-quinone reductase subunit F (EC 1.6.5.-) (Na(+) -translocating ...
  Homolog annotation: Hit description=NQR subunit F) (Na(+)-NQR subunit F)
  Pfam annotation: Domain name=Fer2; Domain location=225-303; Score =39.3; E_value=1.3e-08; Accession=PF00111.17; Description=2Fe-2S iron- sulfur cluster binding domain
  Pfam annotation: Domain name=Rnf-Nqr; Domain location=1-209; Score =254.8; E_value=1.8e-73; Accession=PF02508.5; Description=Rnf-Nqr subunit, membrane protein
  Pfam module annotation: Pfam domain module=Fer2::Rnf-Nqr; Domain location=225-303::1-209
  Subcellular localization annotation: CTP_CleavageSite=65; ConfidenceScore=5.16e-01
MAHYLSLFVRAVFVENMALAFFLGMCTFLAVSKKVSTAFGLGVAVTVVLGLSVPINNLVYNVVLRDGALVEGVDLSFLNFITFIGVIAALVQILEMILDKYFPSLYNALGIFLPLIAVNCAIFGGVSFMVQRDYNFSESVVYGFGLRYRLDAGDCYHGGDPRKNEICQRACGSAWLRDHLYHHRPDGMEIILGVVMFTLIVLVLSGLILAARAKLVNSGDVVIDINDDPQNQIRTPAGDKLLNTLSGNGIFVSSVCGGGGSCGQCRVTVKEGGGDILPTELSHITKREAKEGCRLACQVAVRQNMKIELPEEIFGVKKWECEVISNDNKATFIKELKLRVPEGESVPFRAGGYIQIDCPAHTVAYADFDVPEEYRADWDKFNLFRFVSE

SEQ ID NO: 203412 - protein, 69 aa, Glycine max
  Coding DNA Sequence Number=SeqID_86634
MSYDAAIEVRNHVSPEPEVEDAGVASLSNPKTYDISLNDRNFWTNDTNPAVGVKGHVVTFYSYFLMSKV

SEQ ID NO: 203413 - protein, 359 aa, Glycine max
  Coding DNA Sequence Number=SeqID_86635
  Gene Ontology: Mol. function=RNA-directed DNA polymerase activity; Cellular component=intracellular; Biological process=RNA-dependent DNA replication
  Homolog annotation: Hit_ID=Q1SMK1; Match level="QueryCoverage=43%, HitCoverage=9%, E-value=2e-51, Identity=59%"; Hit description =Integrase, catalytic region; Peptidase aspartic, active site; Ribonuclease H
MAPDRDQLRAMTQKEKETFKEYAQRWREVATQIVPPLEEREMTKIFLKTLSQFYYEKMVASAPTDFTEMVNMGVRLEEGVREGRLAVESTPAASNAKKFGGHFAKKKDQEVGMVAHGKPQQNFTPYRQVANVASTIPNPSYHQQRPHYPYPYPPQQYPPQQYPPQQYPPQQYPPQQYPPQQYHQPQYPQKQQHRPQTPQQPYHSQNRQKTTFDPIPMKYADLLPALLAKNLVQVRTPPRTPDVLPPWFRHDLTCAFHQGAPGHDVENCYVLKNEVQKLVRANLLSFKDQNPNVQANPLPNHGPAVNMIQDCDEDGVILNVQHVRTPLVPIHIKMCEAALFDHDHAACEICPVNVKGCPK

SEQ ID NO: 203414 - protein, 180 aa, Glycine max
  Coding DNA Sequence Number=SeqID_86636
  Homolog annotation: Hit_ID=Q1T493; Match level="QueryCoverage=77%, HitCoverage=26%, E-value=5e-15, Identity=32%"; Hit description =Nucleic acid-binding, OB-fold, subgroup
MSLLGILWLACWLVLFRHVSSKNTKVVFRMKDLSGEVLSCTLWENYCMQFLAYMNERGNDGPIVIILTHARIKDAQGSYPASVSNSFKASKLLINEPILEIKEFRERLLDLGVEVNLVLPPGDQGSSQLSGAIQLSSKDAFLSKAEAKTISKINGIFKVVLLFVFTVYSLQLKVQFVYTC

SEQ ID NO: 203415 - protein, 46 aa, Glycine max
  Coding DNA Sequence Number=SeqID_86637
LDMGDVRVTLVVLRLGLVRHGGAQTIYWCLDLEWRGSGVVWGEEGF

SEQ ID NO: 203416 - protein, 179 aa, Glycine max
  Coding DNA Sequence Number=SeqID_86638
VSVTEIDCAEKLLVYLRTSPNFRVSVTEIDCAEKLLVYLRTSPDFKHFVSKQAFRGNAGSNQKIEENHSKCINLTRCEANKSPTHEILVGNQRERTTLGRGLTFSTWVKIYDKLGFWLKACGKAGHDICQVFGQQFGGKGDVPHYFHGTHATMMIRRFYAKLVMHAPMWTLKHRVFTVM

SEQ ID NO: 203417 - protein, 123 aa, Glycine max
  Coding DNA Sequence Number=SeqID_86639
  Gene Ontology: Mol. function=nucleic acid binding
MLTRKNKYIHSDNIIVEGNCSAVIQRILPPKHKDPGNVTIPCSVGEVSVGKALIDLGSNINLMSLSMCRRIGELEIIPTRMTLYFRIVEAMPSKVILMMPKNQESNKFQESRSRFKIQDSRFK

SEQ ID NO: 203418 - protein, 113 aa, Glycine max
  Coding DNA Sequence Number=SeqID_86640
MPPTNHPLDLDKSNRALGFPALITGLCQSFGVPITPSKATNHRGQVQKHECLYQLSISQQSQGFAPFACPTPDQFKAKVAWSGDWPEAQAGVAPAEDEKMTYLLSFLGGSGAT

SEQ ID NO: 203419 - protein, 110 aa, Glycine max
  Coding DNA Sequence Number=SeqID_86641
MACTHIPVEAKMLFAAKFLPWLVFWFVLKVVFSIGCVEKGCYWLSDDVVELVGDFPCRNGSRSMGFSFILALFICPSFLIRPSKMIKLPLFRPTSILLLAKTKSAKLEGV

SEQ ID NO: 203420 - protein, 123 aa, Glycine max
  Coding DNA Sequence Number=SeqID_86642
AGVVLAEVLLADSRFTRPDMGFHPTKLNFVPSDADEAPLDVSICLHAFGIVGCGSFSGVKSCEREDPFHPGLFVGDAGGFQSPTREPLNVGGLVPPHCSLKSVVSDDACPGACFVQRDATTLS

SEQ ID NO: 203421 - protein, 165 aa, Glycine max
  Coding DNA Sequence Number=SeqID_86643
  Gene Ontology: Mol. function=transition metal ion binding; Biological process=protein amino acid phosphorylation
MKFMIGLKDVVTIFGKTQKKALSETNIWKKRQDKGCFEKSSRPSWHGYTRAATSDIARLANVFAPSMSYNVNKREEKFLSMSTESKSPSHDCHMLMQQLLTIAIHGILPDEVKGYTKNQYLPEASIVERYIAEESIEFCSQYNEIVQSIGLPETRHDRTHGGKGT

SEQ ID NO: 203422 - protein, 128 aa, Glycine max
  Coding DNA Sequence Number=SeqID_86644
MSWVNLITVMPQNHRDHFLQHGMEVADGVRSKTWKCWWIALTWTIWHHRNKVVFQDTTFHGIKLLEDALFLLWSWIKAMDKDFTLHFNQWSSNLKEEEHNKGKGNFIKEKKHKVVTMLELNMRYPIHV

SEQ ID NO: 203423 - protein, 208 aa, Glycine max
  Coding DNA Sequence Number=SeqID_86645
  Homolog annotation: Hit_ID=Q27SW7; Match level="QueryCoverage=86%, HitCoverage=59%, E-value=2e-08, Identity=25%"; Hit description=PssV
MDAGPQKRVSLRALLVAVLVVCSAISATVLLANDKKHLRSLLTYLNLAPAPLSAVPSARAKPIKRQKPAARTIYLPPYLLKFERNGARASFARDFIISGKDLCDRFTAEGFSSPQGWHPSPVNNRSFECMADLGEATTADPADAASLFLEIRGEVSGEIRSVRLKAVAPQTSAGRAVNAKLAAALAMIIEQTRWRDIGSVLEPAQKMQ

SEQ ID NO: 203424 - protein, 172 aa, Glycine max
  Coding DNA Sequence Number=SeqID_86646
  Homolog annotation: Hit_ID=Q8UHX5; Match level="QueryCoverage=53%, HitCoverage=44%, E-value=2e-34, Identity=82%"; Hit description=Maf -like protein Atu0533
MSSVGGILVTIPSAGAALIIRYGNGVGPVQPAGEIERAAAIRAERVVFPCRWSAAFRARLGFAERRNVSSAFGGGFCHSLSLQPARRHLEPLTGKKRHGLIERQTDDIGVRARQFLHERTGDALNAISARFAAPLPGSDIGIDLTGRQAFEAYLGLRHLLPDLAARGYEADA

SEQ ID NO: 203425 - protein, 294 aa, Glycine max
  Coding DNA Sequence Number=SeqID_86647
  Gene Ontology: Mol. function=transferase activity, transferring phosphorus-containing groups; Cellular component=membrane; Biological process=two-component signal transduction system (phosphorelay)
  Homolog annotation: Hit_ID=Q8UHY1; Match level="QueryCoverage=100%, HitCoverage=26%, E-value=1e-140, Identity=87%"; Hit description=Two component sensor kinase/response regulator hybrid
  Pfam annotation: Domain name=HisKA; Domain location=188-253; Score =47.7; E_value=3.9e-11; Accession=PF00512.15; Description=His Kinase A (phosphoacceptor) domain
  Pfam annotation: Domain name=PAS_4; Domain location=51-145; Score =10.0; E_value=0.021; Accession=PF08448.1; Description=PAS fold
  Pfam module annotation: Pfam domain module=HisKA::PAS_4; Domain location=188-253::51-145
LLGSAIGSSSARLVLSIILQKAEDTSADTAWLLDQASEALQYNQDMLQTALAQMDQGIAVFDSSQQLTIWNRRFRTLMDLPEQFGQERGDMPAGDTEQLITSFLTMDLPFPLVLAGGERIIEVRSNTMPDKGIVATFTDITQRVASDQALKQANETLEQRVVERTAELTRVNRALAEARAAADEANIGKTRFFAAAGHDILQPLNAARLYSSSLVERLGESGESELVQNIDSALESVETILGAVLDISRLDTGSMKARMTSVPLNDLLKRIETDFAPMAQEKNLDLVVMPTSLT

SEQ ID NO: 203426 - protein, 198 aa, Glycine max
  Coding DNA Sequence Number=SeqID_86648
AHQMQTWLLLALARPSTASTADAADLDLDVPSIAKEVAELVLWDLDSDFPYSSLNPIGNPSLSAPEPNESVWYAEASPSPEAEVERKEVACAWRALSSEADTFCSIVCCLSWEEGWNLSLPSPRIECDLFLSTPPPRLELKPAHDNANETADKPITGYGEKILTNGRLKDSYSFFTIADQMLGIDCSEKPLLAKKQEF

SEQ ID NO: 203427 - protein, 109 aa, Glycine max
  Coding DNA Sequence Number=SeqID_86649
  Subcellular localization annotation: CTP_CleavageSite=37; ConfidenceScore=5.22e-01
MHETQCGPPWVHRMNRKTWFEGRWLPPSSPRRAQLAQASQVASSRSNSLLEESSRGPKWAWVLFAPPFLLSTETYEFRNDTCFLSVMLRNLADYIIIPFLTYGMLRNLT

SEQ ID NO: 203428 - protein, 117 aa, Glycine max
  Coding DNA Sequence Number=SeqID_86650
MKLKKELKESRASLPNAPKSNGNLAKELSNLKVDIKKLKEKEAKDSSLARDGNEAGQVQVVILVMATRRGRIFSTNTHEYRFFFIPILDSEVSLQGTPLKKTKDSSLAKMYLRQRIC

SEQ ID NO: 203429 - protein, 72 aa, Glycine max
  Coding DNA Sequence Number=SeqID_86651
MDANPVSTPMSMSINLAISDDMPTYCGGDSADMKFMTAYIICLGPTAISWSSKKQKTWPSPPLKSSTTPSGL

SEQ ID NO: 203430 - protein, 47 aa, Glycine max
  Coding DNA Sequence Number=SeqID_86652
MAKEPIRKNNRITCFPVTRGFTLDNGGHMNSASSKLENGGHMNSPKQ

SEQ ID NO: 203431 - protein, 252 aa, Glycine max
  Coding DNA Sequence Number=SeqID_86653
  Homolog annotation: Hit_ID=Q1SIQ0; Match level="QueryCoverage=47%, HitCoverage=36%, E-value=3e-07, Identity=33%"; Hit description=Zinc finger, CCHC-type
MGSKIAKVIVSLEMVVEVGKVVERMEVVLVSEPRVVVKVQERTTPRLENCVYGILQREAKLLILLPLAFGKGLHCLANHFLNLAMSVEGGLMREGEFLPMVRTLRAANKVSNGGEQLLLAEFTKGRTKAIEGSDDEVEVINKVTDERNAFGGAGKMFLEKHHPSTRVIAIVLVYPCPSIGRRCCGSHDNLCIRVALANKSKEYVVVLPFLKTVGRVGSNSGTVANGCRTARFCAINTAIDVISSRKCVICAC

SEQ ID NO: 203432 - protein, 251 aa, Glycine max
  Coding DNA Sequence Number=SeqID_86654
  Homolog annotation: Hit_ID=Q1SDG1; Match level="QueryCoverage=45%, HitCoverage=11%, E-value=5e-08, Identity=27%"; Hit description =Integrase, catalytic region; Zinc finger, CCHC-type
MEEGFATNKPPLFRGIKDDYWKECMISHFEFIHIDLWDVMNEILRSMWTKQQKLKFLLNSKGRKVMLCTLSEEKYTKDTLAITYEGTLQVKRNKLSLLTRKFMNKSSSKIEVLEDKSLGLSVVKRTRKNHRPKNKDSYEYEFAFISRKINKIWRNKSGSKCISSSRRMPRDKMVKEKSSIIDYECEKSGPFKLECPDLEKSQDKKKFIKTKDDKRLMSTWEDLDDTPSDEDDEEANICLMENTTSEGSKLD

SEQ ID NO: 203433 - protein, 101 aa, Glycine max
  Coding DNA Sequence Number=SeqID_86655
MDKSLKVGEDEWREREGRTQLEGEKRENKLWFSPLIQDQVQDSPPSVLRSHELMGPKSTLRLMRTLGPSPASLAQSFLESPSHGSGDGSPHWEDCIRNTCT

SEQ ID NO: 203434 - protein, 91 aa, Glycine max
  Coding DNA Sequence Number=SeqID_86656
MMAHQDDHNNSRHITSVFLGKMVGYAPSSFADLVFAGERVEADLKRGKFNHPAWTNEKIGANEEGENERETHPATAVSTWELPHQLNNVIT

SEQ ID NO: 203435 - protein, 219 aa, Glycine max
  Coding DNA Sequence Number=SeqID_86657
  Homolog annotation: Hit_ID=O04892; Match level="QueryCoverage=46%, HitCoverage=24%, E-value=9e-17, Identity=47%"; Hit description =Cytochrome P450 like_TBP
RCGCSVEPRHGIESSKWAIFGKQNWRCGMNRKLGYGAQLRANLDPTKGVGRLRQQDGGHGSRNPLRRRGGRCKTQGASPGGAVVGADLGGTGEARLIALCARTPKGNRPAHPGNGSAGGRVQRLEEHRTSRGVRAGHGGPSPEPVGCRWTARAASAARAGRRVPVGGRIGNGPFGASSPGVEQSTQNCALNVKVKKFNQARVNGGSNYDSLKVAKCLVI

SEQ ID NO: 203436 - protein, 95 aa, Glycine max
  Coding DNA Sequence Number=SeqID_86658
MACEHRWIFNLHFTPPLEQQACGRPLLAARMHAWTLELTQALLGDLKPLMLPPLAAIHLPSCGFHMTILRRLDPPLQWPVLSVGPGFHGKHVAQP

SEQ ID NO: 203437 - protein, 46 aa, Glycine max
  Coding DNA Sequence Number=SeqID_86659
APGVVPGAGAPPVEPNGRPPPCCSLVRRACAMCSAINGDACLGGAL

SEQ ID NO: 203438 - protein, 180 aa, Glycine max
  Coding DNA Sequence Number=SeqID_86660
CKIDVRPYHPKRVLRQFGYVQIFHANHLFILRIIFEIKHGWSGNNISFLLRMLYYLEIVRPTPPTIYLNFTRFLMPFSQRRDNYHVVLYVYLLVEYNYSMRSHWQTMYQVETTLVSVRSYVELVEPRSCVTGHKSSLDLGSSSSMDSFASSKMNDSGMEKEEREETPLQGEDESRRSSPP

SEQ ID NO: 203439 - protein, 210 aa, Glycine max
  Coding DNA Sequence Number=SeqID_86661
GALLVESLTPFITRGFSDPNARVLQGVCKAWEVVQRKDRELRGSSNGTVSSYHRWLRAYTQGLDWLPKLRAAKEEEVEALEESEEVQALKAELEKAQVNEELRDINSATTKALEQETKRARKEEHDRNKFRRALWGNNNELKLQREERNQSRVEGMILKDELKTCLRSKRSLSQQLSETEENMLAIISKYKEELELATAHEHKVADEYAQ

SEQ ID NO: 203440 - protein, 118 aa, Glycine max
  Coding DNA Sequence Number=SeqID_86662
MEEYNPENKYGFLPLSGHPKIPSNSSTVVDISLSELNALSECHPLSEAPARLADRRNLEGNLSRRHVLSASLAHSASHLSPSRLNASLARSENSLTRAKRENDAKRDVEVSEPFLSLE

SEQ ID NO: 203441 - protein, 97 aa, Glycine max
  Coding DNA Sequence Number=SeqID_86663
MRQFFALLLPVKSPYHCKYMHGLRELGRGAVPVLEVKMTQGNAQMKSGQRRDEHELQMAKCQRWWCTWRYPVLLHIMRTETHTSCTHINHNLTAATH

SEQ ID NO: 203442 - protein, 466 aa, Glycine max
  Coding DNA Sequence Number=SeqID_86664
  Gene Ontology: Mol. function=transcription regulator activity; Cellular component=nucleus; Biological process=regulation of transcription
  Homolog annotation: Hit_ID=Q5ZAK6; Match level="QueryCoverage=33%, HitCoverage=41%, E-value=4e-26, Identity=46%"; Hit description=BHLH transcription factor-like protein
  Subcellular localization annotation: CTP_CleavageSite=47; ConfidenceScore=5.03e-01
NPNSSSSCEEDISVSTSFTNASNHSSLTVESSRRLIEPPAPSSNELMGEHASDNQLWSHVLSGVGSNGELHNGQEIGENFLDALSSKSMTSTMFQPVCDYLKKLDHTSWEYNGPTSLNSFEKHLNGFSEAMIENNERLTKLSNLVSTWSIAPPDPEVSSHFDPQTNNMSLSSNSMDHHFPQSEHFKQPFRDSTSSCSLGGASRSSGVIPNCYDHDMKVKQEYHASEVPPGAVFGKTLNANGFNSLSVGDSCKLYHGMPNISSCTRNFSDVISFNSRLGRPVIGVHSQKPSMKYLNVSESKKQGLQTPSPPIRTNVNGKGEGTTREVKKKRSEESSDAMLKKPKQDTSTASSSKVQAPKVKLGDKITALQQIVSPFGKTDTASVLFEAIGYIKFLQEQVQLLSNPYLKANTHKDPWGSLDRKDKEDTKLDLRSRGLCLVPTSCTPLVYRDSSGPDYWTPAYRGCLYR

SEQ ID NO: 203443 - protein, 272 aa, Glycine max
  Coding DNA Sequence Number=SeqID_86665
  Gene Ontology: Mol. function=DNA binding; Cellular component=nucleus; Biological process=regulation of transcription, DNA-dependent
  Homolog annotation: Hit_ID=Q9ATD3; Match level="QueryCoverage=72%, HitCoverage=64%, E-value=7e-47, Identity=51%"; Hit description =GHMYB36
  Pfam annotation: Domain name=Myb_DNA-bind_2; Domain location=15-70; Score=-8.4; E_value=0.082; Accession=PF08914.1; Description=Rap1 Myb domain
  Pfam annotation: Domain name=Myb_DNA-binding; Domain location=16-63; Score=52.8; E_value=1.2e-12; Accession=PF00249.21; Description=Myb -like DNA-binding domain
  Pfam annotation: Domain name=Myb_DNA-binding; Domain location=69-114; Score=49.5; E_value=1.1e-11; Accession=PF00249.21; Description=Myb -like DNA-binding domain
  Pfam module annotation: Pfam domain module=Myb_DNA-bind_2::Myb_DNA -binding::Myb_DNA-binding; Domain location=15-70::16-63::69-114
MKRKGRSCDNQDAVNRGPWSAEEDQILINYVQVHGEGNWRELSKRAGLKRLGKSCRLRWLNYLKPDIKRGNISSDEEDLIIRLHSLLGNRWSLIAGRLPGRTDHEIKNYWNTYLRKKVEQNHNYNNLPGHNNIPIKLRIESPRCSKNSLGIVIDPTKSSHPVTIKSMSCTEVMMPTRTVNDFTTSWDKNPFASTPQDGHGHCSEGFLKHFDISDVLMPYEDCRFNEYACVEVPQHFGDEAYKVINAVGETRYDNWKIDDYFPLDYDVGFSLF

SEQ ID NO: 203444 - protein, 50 aa, Glycine max
  Coding DNA Sequence Number=SeqID_86666
MHEQELLLHHESGFEGMLENLRYQRGGKKGLLLCAVAGIRPLSLALFNEW

SEQ ID NO: 203445 - protein, 91 aa, Glycine max
  Coding DNA Sequence Number=SeqID_86667
  Subcellular localization annotation: CTP_CleavageSite=12; ConfidenceScore=5.12e-01
MWRSLSWKCSVKAERPKSKTLRSPMASRTSLSNKDVVSSCAHSHLAEFYLLSHNEAGSLSELSRAKKSKSLQNTEVGGNEKGNWSRATRRV

SEQ ID NO: 203446 - protein, 105 aa, Glycine max
  Coding DNA Sequence Number=SeqID_86668
MVAFFQGKQFEDMGGSSRKILEEPQSKQLLDTSTGGKIKLKTPEEAMKLIENMTASDHAILRDRTHIPTKRSMLELSSQDTLLAQNKLLAKQLESLAETLNKLPT

SEQ ID NO: 203447 - protein, 294 aa, Glycine max
  Coding DNA Sequence Number=SeqID_86669
  Gene Ontology: Mol. function=DNA binding; Cellular component=nucleus; Biological process=regulation of transcription, DNA-dependent
  Homolog annotation: Hit_ID=Q9ATD2; Match level="QueryCoverage=72%, HitCoverage=76%, E-value=6e-52, Identity=51%"; Hit description =GHMYB38
  Pfam annotation: Domain name=Myb_DNA-binding; Domain location=35-82; Score=49.4; E_value=1.2e-11; Accession=PF00249.21; Description=Myb -like DNA-binding domain
  Pfam annotation: Domain name=Myb_DNA-binding; Domain location=88-133; Score=50.9; E_value=4.2e-12; Accession=PF00249.21; Description=Myb -like DNA-binding domain
  Pfam module annotation: Pfam domain module=Myb_DNA-binding::Myb_DNA -binding; Domain location=35-82::88-133
MHNTFQNPRIERQRGREIEKMGRKANCDNQYAMNRGPWSAEEDKILMNYVQVHGEGKWRELSKRAGLKRCGKSCRLRWLNYLKPDIKRGNISSDEEDLIIRLHKLLGNRWSLIAGRLPGRTDNEIKNYWNTYLRKKAEHKHDKIPSHNDNIPIKLRIESPGCSKNSFGNVLDPTKSPHPMRCTKVMMPVNDSVNTTNLITTSWDNHNPSSASMQLDDYNHCLTGVLQEFDISDLLMSYEDDFRFNGYACVEIPQHIFEDETCRLDDSLGEEAWYENWKNDPYFPQDQDMGFSSF

SEQ ID NO: 203448 - protein, 128 aa, Glycine max
  Coding DNA Sequence Number=SeqID_86670
MWLLCNPLHCSTIIPTLFLNFTQISRLVYPNSTFGTHLIPSKPLILKPINPPQHGGVAIAVEEGVVGTAADGSCGVARRGAGVAGGNSNTVEEMTYKPENTTKTISTFDLRERDLERPNFSTAKPKLQ

SEQ ID NO: 203449 - protein, 510 aa, Glycine max
  Coding DNA Sequence Number=SeqID_86671
  Gene Ontology: Mol. function=nucleic acid binding; Cellular component= intracellular; Biological process=chromatin modification
  Homolog annotation: Hit_ID=Q8RXE0; Match level="QueryCoverage=94%, HitCoverage=79%, E-value=4e-88, Identity=42%"; Hit description =Putative C2H2-type zinc finger protein
  Pfam annotation: Domain name=RS4NT; Domain location=68-105; Score =16.0; E_value=0.025; Accession=PF08071.2; Description=RS4NT (NUC023) domain
  Pfam annotation: Domain name=zf-C2H2; Domain location=6-28; Score =26.0; E_value=0.00013; Accession=PF00096.16; Description=Zinc finger, C2H2 type
  Pfam annotation: Domain name=zf-C2H2; Domain location=83-105; Score =21.1; E_value=0.004; Accession=PF00096.16; Description=Zinc finger, C2H2 type
  Pfam module annotation: Pfam domain module=RS4NT::zf-C2H2::zf-C2H2; Domain location=68-105::6-28::83-105
MATNRFICEVCNKGFQREQNLQLHRRGHNLPWKLKQKSTTKEPKRKVYLCPEPTCVHHDPSRALGDLTGIKKHYYRKHGEKKWKCEKCSKKYAVQSDWKAHSKTCGTREYRCDCGTLFSSGGIWQETARTRDSFITHRAFCDALAQESARFPSGLNSLGTHLFGTNHTTSLSLSQVGNQLSQVQKQNQTATTNSIFLLGNNVGAAATKFEHLIPPLNQSSFGHSPQSMPSSAFFMNNNTNQSLFEEHHSQHGPLFSTKQLQGLMQLQDLQGNTNNSDSSSVAAPNNSNLFNLSFFPSSNISTGTIIPDQFNNISGGDQGTTTTTTLYGNSIENVSSPHVGSSFSSIFGNSMENVSSPHMSATALLQQAAQMGSTTTTTTNCSSLLRGMCTNNGCKAENDHHHNLQGLMNSIANGNTSLFGSMQGNENNLCGFHNVDESNNKLPQNLSVNFGGSDKLTLDFLGVGGMMRNMSSGGFSQREQQQHDIGTMSSLDHDLKSAQPNRHFGKSTLQ

SEQ ID NO: 203450 - protein, 103 aa, Glycine max
  Coding DNA Sequence Number=SeqID_86672
  Gene Ontology: Mol. function=DNA binding; Biological process=DNA integration
  Homolog annotation: Hit_ID=Q1SIT1; Match level="QueryCoverage=89%, HitCoverage=31%, E-value=4e-14, Identity=44%"; Hit description =Integrase, catalytic region
ERKLQLSELDEFHLEPYENSKFYKEKTKKFHDSLIAKKDFMVGQKVLLYNSRLGLMSVEIKSESTDKSFKVNGHRLKPFLTNPSLVDVVVEETSLLHPTSLPP

SEQ ID NO: 203451 - protein, 67 aa, Glycine max
  Coding DNA Sequence Number=SeqID_86673
MIYNYSSGASGGGGGDLWWWWGWVLVGLLWRWWKRVVLIRGMEMDDDKASWVVEERGSGLLKFQMGD

SEQ ID NO: 203452 - protein, 46 aa, Glycine max
  Coding DNA Sequence Number=SeqID_86674
MGHEGGRSRTKPEGIKSKVERESHMREQVYKVRKAREAHKDVNVIE

SEQ ID NO: 203453 - protein, 98 aa, Glycine max
  Coding DNA Sequence Number=SeqID_86675
  Subcellular localization annotation: CTP_CleavageSite=64; ConfidenceScore=5.17e-01
MASLKAEKPVEKSCCSQPSAGQVKKESSAKPSSGTSKAPVSKPTPKKIPSQTRKKGEKDEAVPKASDGASSKSKSKGPASKSATKKVPVQKPQESKKK

SEQ ID NO: 203454 - protein, 173 aa, Glycine max
  Coding DNA Sequence Number=SeqID_86676
  Homolog annotation: Hit_ID=Q39872; Match level="QueryCoverage=88%, HitCoverage=85%, E-value=6e-70, Identity=81%"; Hit description=PGmPM3
  Pfam annotation: Domain name=AWPM-19; Domain location=18-135; Score =243.7; E_value=4e-70; Accession=PF05512.2; Description=AWPM-19-like family
MASQCHPQQATEHDVREIVNWCLNKFINGQTYHPSFGGNGATMFFLIFSILAAVLGIVSKLLGANHIRTWRSDSLASAGATSIVAWAVTALAFGLACKQINIGGHRGWRLRVVEAFIIILTLTQLLYLILIHAGLYSSRYGPGYRDTDYGNAHGVGGTTGDPMHKSAAAGTRV

SEQ ID NO: 203455 - protein, 100 aa, Glycine max
  Coding DNA Sequence Number=SeqID_86677
  Subcellular localization annotation: CTP_CleavageSite=59; ConfidenceScore=5.17e-01
MGATQWESTCILSTPVSVSGFDGSSWLKKTSYSIFKELSSRFPLFPAALSLVRGGSKVECSGEGEISGVKLCGGRWRQTRYADGVCASRTYGWLPDQVDP

SEQ ID NO: 203456 - protein, 138 aa, Glycine max
  Coding DNA Sequence Number=SeqID_86678
  Gene Ontology: Mol. function=peptidyl-prolyl cis-trans isomerase activity; Cellular component=mitochondrion; Biological process =protein folding
  Homolog annotation: Hit_ID=Q94A16; Match level="QueryCoverage=97%, HitCoverage=46%, E-value=4e-19, Identity=40%"; Hit description =Peptidyl-prolyl cis-trans isomerase CYP21-3, mitochondrial precursor
MARIKPQALLQQSKRKKGPSRISAVTVIFYFLILALVGFFLFASYRHWSSRMCPTSHIDWELQKNIVCYLIIHFLYAFRSRLQSEDHLSVSEGENTFVDSKKSELPGYAVLNTSKGSIIIELYKESAPEVVDEFIDLW

SEQ ID NO: 203457 - protein, 152 aa, Glycine max
  Coding DNA Sequence Number=SeqID_86679
  Subcellular localization annotation: CTP_CleavageSite=36; ConfidenceScore=5.09e-01
MPQYVPPPIQQQQQQQPQKQQTVEAPPQPSLEELVRQMTMQNMQFQQETRASIQSLTNQMGQLATYLPSQSVQNPKNVTAISLRSGKQCQGPQIVAASSFANEPAQPYSTPEKDDDKNLKKATYPSSIPSKSNFQQKKWKRQRRRSWKHLEK

SEQ ID NO: 203458 - protein, 201 aa, Glycine max
  Coding DNA Sequence Number=SeqID_86680
  Homolog annotation: Hit_ID=Q47522; Match level="QueryCoverage=25%, HitCoverage=64%, E-value=7e-24, Identity=100%"; Hit description=LacZ protein
MLQQKSGGASSGLGGALGGLLGGGAGKASGGGDLAGAQGRWQGGGVWRPGRAWRAGLQSLWQLAGAASPAGRRAAGRSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 203459 - protein, 96 aa, Glycine max
  Coding DNA Sequence Number=SeqID_86681
MTKPRLQCTSCSSFMLLGLFTPNRPVAAREFCALAVLHVVLRGSEIATLHLARVSEIGLSASLELSLLKAPDVLSTLILRLVRNFDADALLDSPLR

SEQ ID NO: 203460 - protein, 213 aa, Glycine max
  Coding DNA Sequence Number=SeqID_86682
  Gene Ontology: Mol. function=protein-disulfide reductase activity; Cellular component=integral to membrane; Biological process =cytochrome complex assembly
  Homolog annotation: Hit_ID=Q9XDB2; Match level="QueryCoverage=84%, HitCoverage=32%, E-value=3e-59, Identity=59%"; Hit description =Thiol:disulfide interchange protein dsbD precursor
  Subcellular localization annotation: CTP_CleavageSite=22; ConfidenceScore=5.06e-01
MAARFSRLLSLCLALLFCLSAQASLFSPTTNNRFVPVDQAFGFDFSQQGHQLTLSWKVKDGYYLYRQQFHISAQHAQLAPVTLPPGQPHEDEFYGKSEIYPQDVQLPITLRQADAGATLSVTYQGCAAAGFCYPPETRSVPLTAIAADSATPAIAASPAADRTPLPFSPLWALLIGIGVAFTPCVLPMYPLISGIILGGQRRYSLGRLFALAL

SEQ ID NO: 203461 - protein, 69 aa, Glycine max
  Coding DNA Sequence Number=SeqID_86683
  Subcellular localization annotation: CTP_CleavageSite=46; ConfidenceScore=5.45e-01
MARWFMTRQKNQLSITGDVSLPARRKFSAAVLSGFLVEQSKRSATRGMAEARREVNRDSIESLLLLDIR

SEQ ID NO: 203462 - protein, 84 aa, Glycine max
  Coding DNA Sequence Number=SeqID_86684
MSLRRFLGYSDGGVMRSDAKPCFRLMRHIAAIFSVGGAFGFWVLCRMHYVTMKSHKFVWSYLSQLNSRRKEDQERHNFGKIIVE

SEQ ID NO: 203463 - protein, 101 aa, Glycine max
  Coding DNA Sequence Number=SeqID_86685
MVHCRVWKNYICEVSSSDICKTPGRMTPTVYGQMEAAVNVHYGSQSFILQNTYTGVEMFMRKKQFIWCKKLRLFDSNSRLGGLKGFHSNLFSAMQLLNFVE

SEQ ID NO: 203464 - protein, 60 aa, Glycine max
  Coding DNA Sequence Number=SeqID_86686
  Homolog annotation: Hit_ID=Q67XQ0; Match level="QueryCoverage=85%, HitCoverage=10%, E-value=2e-17, Identity=73%"; Hit description=MRNA, complete cds, clone: RAFL25-31-I24
MAHHSGANFAWLVRILMIVCYPVSYPVGKVLDHLVGHNEALFRRAELKALVSIHGQELLD

SEQ ID NO: 203465 - protein, 304 aa, Glycine max
  Coding DNA Sequence Number=SeqID_86687
  Gene Ontology: Mol. function=serine-type endopeptidase activity
  Homolog annotation: Hit_ID=Q1RW49; Match level="QueryCoverage=76%, HitCoverage=46%, E-value=4e-49, Identity=42%"; Hit description=IMP dehydrogenase/GMP reductase
  Pfam annotation: Domain name=Tetraspannin; Domain location=67-242; Score=-61.7; E_value=0.1; Accession=PF00335.10; Description =Tetraspanin family
MDGVEDGGEGEYYHEVLPWKTRRSMAEEEATSNTSLILAQRRTTRKDPLDNYNHYTGGWNISNRHYIASVVFTAVPFFVVAAVWFVIFGLSLSFICLCYCCCPREPYGYSRLAYALSLIFLVLFTLAAIVGCVLLYTAQGKFHGSTTNTLKSLVSQADFTAENLRNVSDYLDAAQKIGVEAVFLPADVQKNIDEVQMKINSSAADLSSKTKKNSETIKDVIDAMRRDLVILAAVMLFLAFLGFLFSIFGLQGLVYLFVLLNLQSVNIFPSMAAVWSLSGGFLLPAHLYFVVCFSFFTTEIARVV

SEQ ID NO: 203466 - protein, 70 aa, Glycine max
  Coding DNA Sequence Number=SeqID_86688
MERRGSCSGGRREEGNREKGEKKEEKRGVWCEAWHNGVTVCELVLVFQRNAEKEKRERQCCVRCEKVVVV

SEQ ID NO: 203467 - protein, 141 aa, Glycine max
  Coding DNA Sequence Number=SeqID_86689
MPISWTSQKSGADVAEEEPKNLRSNPLQGRGDDAILPKKGLVPRAVSKRLQEDWARAAEEGPRVVMNLRAILVVKLLLPWLISSRWCLLSPLLLCLLLQLHGGKSPLKDLIEAQRSSLHRSPTSKLPSSGIRAQELQVGAH

SEQ ID NO: 203468 - protein, 153 aa, Glycine max
  Coding DNA Sequence Number=SeqID_86690
MAIPEICIEDGYFNKMSDEVNMLEDMDEDTRMPFREDIKYHDCSTNVFDTQDGLLKWVRAIAFGLGFAIVILRLDTINIQPRRKTYVVLGWEKDDKYRKYKKDIDKNQKCCVPKHISSEKETQHNFEAPISQKPNTHTGNPTPQQTRAFVTKK

SEQ ID NO: 203469 - protein, 58 aa, Glycine max
  Coding DNA Sequence Number=SeqID_86691
MADSVRILESSQMSSMLVEVVVEVVQKLQPREASAVFIEVKSENHFIPFCFGFSLKPC

SEQ ID NO: 203470 - protein, 65 aa, Glycine max
  Coding DNA Sequence Number=SeqID_86692
MVGTQTINKNYLAWFVVCGKKGDDEQSEKRFWGFTCNGSDDNGDDDLRVALRDSARRVCERLSVK

SEQ ID NO: 203471 - protein, 332 aa, Glycine max
  Coding DNA Sequence Number=SeqID_86693
TLCPLDSVGGADLQGHRDMERFHDLLSQGNLHDMGFQGDRLTWRKEELGVKLDRCLINMNCRLKLQEATLDMGFQGASRDFPGFVKRTWRHGFRNSSWFGNINHFSNQVKPQNKEDVFQNYHKVAEVNKTFVTLIPKKEESSFVPVRQSGDNIIAAQEIFHSMRSNTGNGSSIKFWHDYWVEGFSSLASIALLDIPKSLLETCVEEFVDLVDGRMLDNVKEYLPKPTIRAATYMNPSKSHDDPNRLRWKGNADGSFSLNIDEMRWHPHALGHYALNCNAHHQLVEEIHRVVVAFDNGIWDHVFIKANCVADKMAKQALKISSYFVVHEIAPD

SEQ ID NO: 203472 - protein, 196 aa, Glycine max
  Coding DNA Sequence Number=SeqID_86694
MDLSHPQSNLSLKFSSSHTSLPPHSDPPVPLQLMEQQMENDNLDVESDDDEDKEVEEFHILGHSMCLKRQRDCDSSSSSSAAMKVSVEPDLDARKVAVRAWGCQPLYIGVVDDDHAMPMDMVIVGDERGSFDFVHKSGNDSRIICSKKGNIEDLALVFAQNRDRSLGTSCYLFGSPCNLMHAIHVTATVHTTLFHC

SEQ ID NO: 203473 - protein, 166 aa, Glycine max
  Coding DNA Sequence Number=SeqID_86695
MPLRSVLVEAESDEPCGVLIAEIERNWKILEATLTLELEAKLTIMDSRPHPILSSECGWYATSFSAIAFSSSSLTDFLRAEERGGFASTDFHAAILLFVSDADVTAEALNEELEEAIGEGGGVWGVDGVGAPERMTTAGLRSMMVEREDLVHSLFPPQSAWIKKKR

SEQ ID NO: 203474 - protein, 94 aa, Glycine max
  Coding DNA Sequence Number=SeqID_86696
  Subcellular localization annotation: CTP_CleavageSite=33; ConfidenceScore=5.10e-01
MGSKSTLRLMRTLGPSLGSLTQSTWSLLSNALAGSTKKVKEGLEVFAPGISASFIDKLLHPAGSGEKVMNMGDDVNREVIGEVPKEKGGSRNDG

SEQ ID NO: 203475 - protein, 181 aa, Glycine max
  Coding DNA Sequence Number=SeqID_86697
  Homolog annotation: Hit_ID=Q5BN47; Match level="QueryCoverage=37%, HitCoverage=1%, E-value=2e-26, Identity=83%"; Hit description =SPLAYED splice variant
MGDKKYTRSGELRQVLGISFGNTLEDYAFGTANLKPPPPVAMEELKRFKASVQEASVRARKQLQNDLVPNERLGGSKFSKMGTQTHRSPSELVNQRPEDRPKNVILNKVENELSEKIEKLIRCEASSYQKLLMKRVEENLGSIGNSKALSVHNSVMELHNICNHPYLSQLHAEEHHRKIIF

SEQ ID NO: 203476 - protein, 97 aa, Glycine max
  Coding DNA Sequence Number=SeqID_86698
MKKCGVKNRIFRCNKNTEDGEGNENLRRVRLCMYHTLFQHSKHELHRSRGAAFVGSANVDATNEYARQGEVAAATKDSVELVAKAIVAEVGDALVWP

SEQ ID NO: 203477 - protein, 119 aa, Glycine max
  Coding DNA Sequence Number=SeqID_86699
MNTSSSSTSDVEFRRTHGIYESVIMHFVAWDKNTNFNVDVVGPLHRQTHQRSTTTTRPHVFTIDVSEDMIQHNYQLVADSHLKPGDEVVFFYNFDQHLWEVLYRKQVKWNQEEDEADST

SEQ ID NO: 203478 - protein, 78 aa, Glycine max
  Coding DNA Sequence Number=SeqID_86700
  Homolog annotation: Hit_ID=Q5XM22; Match level="QueryCoverage=97%, HitCoverage=58%, E-value=1e-09, Identity=35%"; Hit description =Resistance-like protein HAAS-2
MHVAFLDAFYDLIQTRSYSWGAAALVYMYENLNDASKRSTKQLVGYITLLQCWIYEHFPIIAMCVADEDYHERKPCAC

SEQ ID NO: 203479 - protein, 75 aa, Glycine max
  Coding DNA Sequence Number=SeqID_86701
MKREMLDSTGNDGSTTPNHKLFTTVLYYTVTGVAKFVGEVFLDLYDLSEGATRYEWLLKEEAQSKQRKASFFPRH

SEQ ID NO: 203480 - protein, 191 aa, Glycine max
  Coding DNA Sequence Number=SeqID_86702
  Homolog annotation: Hit_ID=UPI00006A17C9; Match level="QueryCoverage =57%, HitCoverage=58%, E-value=1e-07, Identity=30%"; Hit description =UPI00006A17C9 related cluster
  Subcellular localization annotation: CTP_CleavageSite=55; ConfidenceScore=5.59e-01
ARVKSCPGMHSSCVIASLSGCARTVGPPPISGGGPGTVWMSSTLKMRTRSPLKVRACSPLKARRCSPLEMRACSPLLARTCSPFKVRACSPLTARACNPLMVRTCSPLKARTCSPLNGEGRVVLSRRGRVVLSTVRVTSTQVLSRRGRVVLSAVRARTYSPLEVRACSPLMVRTRSPLKARTCSPLSGEGN

SEQ ID NO: 203481 - protein, 79 aa, Glycine max
  Coding DNA Sequence Number=SeqID_86703
MDSSMAGVTCSLCYGARSYLLSLRATLTSQMPRCIRHHRYLKVIGCRSESSAPRMPQRPGNRDIVKSGRIFYDGCQGPM

SEQ ID NO: 203482 - protein, 98 aa, Glycine max
  Coding DNA Sequence Number=SeqID_86704
  Subcellular localization annotation: CTP_CleavageSite=6; ConfidenceScore=5.04e-01
MVTRTRGSKEKSRGLTLLQPTTFKFKRCRGSRALYELSIVVTPVRFVARDIVLSWRSKLAHPVQVTEDRGDHIDMMPEEEEEYRGLLRDLEPSSKEKD

SEQ ID NO: 203483 - protein, 109 aa, Glycine max
  Coding DNA Sequence Number=SeqID_86705
  Gene Ontology: Mol. function=signal peptidase activity; Cellular component=signal peptidase complex; Biological process=signal peptide processing
  Homolog annotation: Hit_ID=Q84KA8; Match level="QueryCoverage=50%, HitCoverage=33%, E-value=4e-23, Identity=89%"; Hit description =Signal peptidase protein-like protein
  Pfam annotation: Domain name=SPC22; Domain location=1-109; Score= -38.7; E_value=0.00083; Accession=PF04573.3; Description=Signal peptidase subunit
MENGKRASFFSWFSDCEQKNDVDEIHDEVAELIKDDLWPNPLTYFNNVLNINWFQKQPNGNDEVSMTMNISADLQSLFTWNTKQVFVFLAAKYETPKNSLNQVLVSISK

SEQ ID NO: 203484 - protein, 68 aa, Glycine max
  Coding DNA Sequence Number=SeqID_86706
MIPTFIVGICEIIFVEGEKGIAQRQYKWRLQSLLILSNIWEPYQSNQRKKLRNPRNLLEMLLSLLEDT

SEQ ID NO: 203485 - protein, 89 aa, Glycine max
  Coding DNA Sequence Number=SeqID_86707
  Subcellular localization annotation: CTP_CleavageSite=37; ConfidenceScore=5.67e-01
MTTPPSSLLPPKSTPFPSTPKKTSKTTRLRSFATRPVGMERPVVHLDPATWKADAEFDISEASGQRTKKKILKTVGKRWKQFKSHLTSK

SEQ ID NO: 203486 - protein, 101 aa, Glycine max
  Coding DNA Sequence Number=SeqID_86708
  Gene Ontology: Mol. function=actin binding; Biological process =cytoskeleton organization and biogenesis
WMYPVERYMKILKGYKKNLHRPEASIVERKLADRPKINVSTSQRYDIDKYSFYIKSQDNKSKMQNSGWVDSNLGVQTDDFIFTLADLKKLTYQDEPFIMAE

SEQ ID NO: 203487 - protein, 455 aa, Glycine max
  Coding DNA Sequence Number=SeqID_86709
  Gene Ontology: Cellular component=chromosome, pericentric region; Biological process=meiotic chromosome segregation
  Homolog annotation: Hit_ID=Q7XDP3; Match level="QueryCoverage=82%, HitCoverage=87%, E-value=1e-15, Identity=25%"; Hit description =Expressed protein
  Pfam annotation: Domain name=Shugoshin_C; Domain location=412-438; Score=15.0; E_value=0.04; Accession=PF07557.2; Description=Shugoshin C terminus
  Subcellular localization annotation: CTP_CleavageSite=65; ConfidenceScore=5.48e-01
MHSSLVLITFISISLSPSVSLSECRASPLPPTSTPPPTLFIRYNTVPFGAKAKRVKVVKGDFIPVANVGASQNKILADISNLPQQPKQHIFVDHHLREKEILIKHLATRDAVIESCKAELHKCQTNFQKLRKQNAELALTNSQMLVELNSSRQKQRELQLELGSKNGVLNAMRLELTVSLTHLKAVKLQLKKQTVKSKHETDANEVRACQSKQSDQSLQEDNKGNAKRKRVSKSQCSVVDLIHMCVSSAPAVIKQVKSTKKVENQRYSLRRQSAGLKAEKPEPTKDFLEVVDISHLQENSANENGPASLGSKVHEEAREATESSRPTNPEQVHVKKNVEKKRQSMRRQTNRFRPENPEPAEDCFKTDDAKFNVSQLSDNMSEKNCPTTSTVTSEQENDACIFEPQETRRSSVGRPLRRTVEKIVSYKEVPVNRKMRRDKLGIFISGSHSVTNNSV

SEQ ID NO: 203488 - protein, 686 aa, Glycine max
  Coding DNA Sequence Number=SeqID_86710
  Gene Ontology: Mol. function=structural constituent of ribosome; Cellular component=intracellular; Biological process=translation
  Homolog annotation: Hit_ID=Q2R0M4; Match level="QueryCoverage=98%, HitCoverage=98%, E-value=1e-124, Identity=38%"; Hit description =Expressed protein
  Pfam annotation: Domain name=DUF594; Domain location=608-668; Score =92.7; E_value=1.1e-24; Accession=PF04578.4; Description=Protein of unknown function, DUF594
MKSYDMIPDLTKAVWNVLELRLLVLISFFLQVFLIVFGNRRKCIADARLQVSVWLTYLSADWIATVALGMLSKDSKNPENDPDFIIMAIWAPFLLVHLGGPDTITAYSLEDNELYLRHFLGLLYQLSVAGYVVYISWNGNKLNYVTIPVMVAGIIKYAERTWSLWLGSSQKFRKSILPPPDPGPNYAKFMDDYTAKKAEGYKVKLKVEPTSIVLDHSPGAIANHNVADASSLHDGFYFFTIFERLFADLILSIQDHQNSQHFFKNISWNDAFQVIEVELGLMYDKLYTKAVVTYSRLGFFLKFVSTFCTLSAFVTFCCLIHKAHIDYERIITLVLFAGAIFLEIYAVIVLLSSSWAMLWLSKRKNWKVDLLHRSISCFQRCFKLSHTKRWSNLVSQFNLISFCLKDEPVRCIKIQKFLRIYQFFEKSYYQHTQTVPGELKKLIFEQLLEKSGDAKDTKACKKLCANRGDRVLDKWNCHSIAWSTEVEFDHSLLLWHITTDLCYYSDVTANSNCAELENCQISKLLSNYMLYILVMCPFMLPNGIGQIRFEDTCAEAREVLQERKYISDRDQVLEVILRVKTDVLPSEVKGDRSKSVLFDARRLAKSIESLEREKKWSKEEKWEMMSHVWVEMLCHAASQCRGFHHAKQLSRGGELLTHVWFLMAHLGITEQFQISQGHARAKLILS

SEQ ID NO: 203489 - protein, 1355 aa, Glycine max
  Coding DNA Sequence Number=SeqID_86711
  Gene Ontology: Mol. function=protein binding; Cellular component =membrane; Biological process=defense response
  Homolog annotation: Hit_ID=Q19PK7; Match level="QueryCoverage=62%, HitCoverage=91%, E-value=1e-54, Identity=26%"; Hit description=NBS -LRR type disease resistance protein
  Pfam annotation: Domain name=LRR_1; Domain location=1044-1065; Score =9.0; E_value=6; Accession=PF00560.23; Description=Leucine Rich Repeat
  Pfam annotation: Domain name=LRR_1; Domain location=1067-1088; Score =5.7; E_value=24; Accession=PF00560.23; Description=Leucine Rich Repeat
  Pfam annotation: Domain name=LRR_1; Domain location=1089-1119; Score =2.0; E_value=1.2e+02; Accession=PF00560.23; Description=Leucine Rich Repeat
  Pfam annotation: Domain name=LRR_1; Domain location=1226-1248; Score =9.8; E_value=4.3; Accession=PF00560.23; Description=Leucine Rich Repeat
  Pfam annotation: Domain name=LRR_1; Domain location=1299-1321; Score =8.3; E_value=8; Accession=PF00560.23; Description=Leucine Rich Repeat
  Pfam annotation: Domain name=NB-ARC; Domain location=614-896; Score =77.7; E_value=3.7e-20; Accession=PF00931.13; Description=NB-ARC domain
  Pfam module annotation: Pfam domain module=LRR_1::LRR_1::LRR_1::LRR _1::LRR_1::NB-ARC; Domain location=1044-1065::1067-1088::1089 -1119::1226-1248::1299-1321::614-896
MADLAASFILTKVTDELADFLVKESARALKFVRSRVEWIEKELRCMLAFIEHLEHREGPNPNQLELVEDIRIVALDAQDVIETFQRRRRKGVMYWSYKYNLGSELDKISNRMRQISERIRNAESEQTNIVPTVETPGVGATTIVAPALEKLDHILTQNLIIRDEELIEIVEHVRDDVLGDIKNAVSNLNSTTGELSQRENVWLEEVKEVCDYTVGVAEKFIARRDKRLSMGRLCQVLYLFELYASKNEFMRQMKYICTQFEMHFTEGGLLGKTSEPKRDRDQHLFQVCHQWHCAIQGREPRTTVRNPLMTFLYCIFVDAMLVVASLVLPFKAFITLLVGYELTKVIAWIEFMLRSLEPNLKNTERYLALICALFSDIDSVEGLILNERQKVWVDQLRSVTRKGHCLVAGAPKDGFLFTINRIRFAWYVEELLREIIDISDRKNNYAIANIQGRKESLLSIQGSQSETIVEHNDTSGTGVNSRAPPAASSYRHITGLKRKFQLITGEKQLMDALSRDVQEIGELEGRSKIWVQQMEDLARETEPVITKCASELEHKSMIICIMRYYRRHVMMDEIKKIRKKIEDASTRKKAYGLGQLQSQAELSLSTVQILRPKKQPSLILNKQPSPIEIVGFDEEVEVLMNQLLSDEKSRCITSIVGIEGTGKTTLASLIFDNQVVKDNFDCRVWVSVPPSCTVEQLLQEVAEEAAKQIMGGQQDRWTTQVVFTTLANTKYLIVVDGIKTSHVLDTLRETIPDKSTRSRFLLTTCNANVLQQAGTRSFVLPIQLLDDENSWILFTRILRDVPLEQTDAEKEIVNCGGLPSEILKMSELLLHEDAREQSIIGQNPWSETLNTVCMNLPSYLRRCLFYFKLFPADFGIPVRRLIVLWVAEGLVHQGEDQGPPELIAEKYLAELIDLNMVQIAKRKPNGKVKTCRLPNPFREFLLNAAVPTNSRIRQVADRFDENDTWHRHIHGNTTTSDSASLLTNYKDVLSFLSFDAREGSKPGQDISNFLNLCISSNCLLLLRVLDLEGVYKAKLPKNIGRLTRLRYLGLRWTYVESLPSSISSLLKLQTLDLKYTYIHTLTSSIWKMELRHLFLSETYRTKFPPKPKGIRIGSSLSDLQTLWGLFVDEETPVKGGLDKLVNIRKLGITCQSMSKKQEAMESQLDVVADWIVKLDYLQSLRLKSRDEEGRPWNIHLKSLKNHINLTDVYLLGCLSSPSILNQLPSSLVELTLSHSKLEDDPMQTLKDLPNLHSLSLLAESYLGKDLVCSSQSFPQLHVLKFWKLEQLEEWNIEPEALPSLRQLEIRSCPGMKMLPDGLKHVNTLLELKLTNMPTEINTDKHSIPPKCEVHRDDSQ

SEQ ID NO: 203490 - protein, 51 aa, Glycine max
  Coding DNA Sequence Number=SeqID_86712
MSAFIYSCTSSWSPIVLDLDLESVDLLGCGVGVRQCSGLGQQSGKFLTPIQ

SEQ ID NO: 203491 - protein, 59 aa, Glycine max
  Coding DNA Sequence Number=SeqID_86713
MAHMVSIGDVYIFTGEFHFGNLGDAGENKELEGATAVPGDGEVTNQRGEAMVEKGNFRI

SEQ ID NO: 203492 - protein, 67 aa, Glycine max
  Coding DNA Sequence Number=SeqID_86714
  Subcellular localization annotation: CTP_CleavageSite=71; ConfidenceScore=5.36e-01
MASTTMIAKATLAKVGSLASMEGDVFSRNPRDRAQNGLSSPFKRNSKSHHTSRLQISNNSMKTSDNF

SEQ ID NO: 203493 - protein, 440 aa, Glycine max
  Coding DNA Sequence Number=SeqID_86715
  Gene Ontology: Mol. function=hydrolase activity, hydrolyzing O -glycosyl compounds; Cellular component=membrane; Biological process =carbohydrate metabolic process
  Homolog annotation: Hit_ID=Q41386; Match level="QueryCoverage=92%, HitCoverage=48%, E-value=1e-139, Identity=54%"; Hit description =Pullulanase
  Pfam annotation: Domain name=Isoamylase_N; Domain location=110-195; Score=68.7; E_value=1.9e-17; Accession=PF02922.8; Description =Isoamylase N-terminal domain
VFLQYYTGAFTVHCCNSTTLLLELLTAVGLNMLMSQMQNGLLYSRAYWVAESLIAWDVDVGNGFSCYLLASKNASLTIANCQIQADGECMNCTGLQLPGVLDDLFSYSGPLGALFSEEAVSLYLWAPTAQAVHAYIYKDPSGDDPIEIVCLEEENGVWRTKGPKSWEGCYYVYEVCVYHPSTMRIEKCYTSDPYARGLSSDGRRSFLLNLDSVKLKPDGWDNLANKKPTIHSFSDISIYEMHIRDFRILDDLGALVTAMMEFGVTVSICLKDSAGVLHLKKLSSAGITHVHLLPTFQFAGVDDQKEDWRFVDQQQALITAIQNFDGYNWGYNPVLWGVPKGSYASNPNGPYRTIEFRKMVMALNHIGLRVVLDVVYNHLQGSGPFDEHSVLDKIVPGYYLRRNSDGLIEHSTCINNTASEHFMVERLILDDLVHWAVNYK

SEQ ID NO: 203494 - protein, 75 aa, Glycine max
  Coding DNA Sequence Number=SeqID_86716
  Homolog annotation: Hit_ID=Q8GTR4; Match level="QueryCoverage=39%, HitCoverage=3%, E-value=2e-09, Identity=93%"; Hit description =Pullulanase-like protein
FNDRIRDAILGGSPFGHPLQQGFVTGLLLQYWSEFPAKRGNEKLLQKVGLLVCQGKKEIINTGIWGKGLIESCII

SEQ ID NO: 203495 - protein, 250 aa, Glycine max
  Coding DNA Sequence Number=SeqID_86717
  Gene Ontology: Mol. function=hydrolase activity, hydrolyzing O -glycosyl compounds; Cellular component=membrane; Biological process =carbohydrate metabolic process
  Homolog annotation: Hit_ID=Q8GTR4; Match level="QueryCoverage=98%, HitCoverage=28%, E-value=6e-99, Identity=67%"; Hit description =Pullulanase-like protein
MVKGSEILTYGGTPVAYASCPIETINYVSAHDNETLFDIVSLKTPMDISVSERCRINHLATSIIALSQGIPFFHSGDEILRSKSLDRDSYNSGDWFNRIKPRLANPSFRPQKTDILATVDNFLNLLRIRYSSPLFRLKTANTIQERVRFHNTGPSWVCGVIVMSIEDGHNGFPGLSQLDPIYSFIVVVFNASPKEVSFVSPALQLRNLQLHPIQVSSSDDLVKSSRYEASSGCFVVPRRTTAVFVEPRKT

SEQ ID NO: 203496 - protein, 73 aa, Glycine max
  Coding DNA Sequence Number=SeqID_86718
MVSEGENGMTSDKDFHVDDDALKKDYDLNNSDIIRRNLGKQHKNIKQNWWKVSMLILSLLVITRKVQVAVCPL

SEQ ID NO: 203497 - protein, 164 aa, Glycine max
  Coding DNA Sequence Number=SeqID_86719
KVYTDNHSGISARQRDSNVSMTDLVSAEDDTAKKNVYTDNHSGISARQRDSNVSMTDLVSAEDDTAKKNVYTDNHSGISARQRDSNVSMTDLVSAKDDTAKKNVYTDNHSGISARQRDSKVSMTDLVSAEDDVNLRVSTGLSVAIDERAQKTTLVSACYQLFVL

SEQ ID NO: 203498 - protein, 352 aa, Glycine max
  Coding DNA Sequence Number=SeqID_86720
  Gene Ontology: Mol. function=RNA methyltransferase activity; Biological process=RNA processing
  Homolog annotation: Hit_ID=UPI00005FA276; Match level="QueryCoverage =53%, HitCoverage=52%, E-value=1e-61, Identity=64%"; Hit description =COG0566: rRNA methylases
  Pfam annotation: Domain name=SpoU_sub_bind; Domain location=288-352; Score=22.4; E_value=0.00072; Accession=PF08032.2; Description=RNA 2'- O ribose methyltransferase subs
HIDHFALTEHHDGRDAADAETGAQLRLGFGVHFHEAHFAGALFGHVFKDRRKAAARAAPRRPEIDHDRQIVLQQLVQRGGGGVDHFTVEELMAAAAAFRVVRQTLFRHAVGGIASCTNCIHVDLGYRESMVPATRWELLAQVGGFVHQHQVIFAPCALVEKTMNDSFSGKNGKVKVMYVRSDDDNGDDRNKNKRPAGKGRPADGARSGRTGQDKARGGNDRRGADSRRSESDRPRRPARSEDRGGNESPWRTVSRAPNEEPAFDHGGISGKSFIDPEQLRRQRAEETRVYGENACQALFASRPEAIVRAWFVQSVTPRFREALRWMAANRKAYHVVDEEELAKASGTEHHGG

SEQ ID NO: 203499 - protein, 225 aa, Glycine max
  Coding DNA Sequence Number=SeqID_86721
  Gene Ontology: Mol. function=chitin binding; Cellular component =extracellular region; Biological process=chitin metabolic process
  Homolog annotation: Hit_ID=UPI000044A8F0; Match level="QueryCoverage =87%, HitCoverage=100%, E-value=4e-29, Identity=29%"; Hit description= PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
LYAFAIRRLHGLTFRGLHVLTFRGLHVLTFRGLHALAFRGLDVLAFRGLHVLHVRGLHVLAFRGLHVLTFKGLHVLAFKGLHALTFRGLHVLALRGLHALAFRGLDVLAFRGLHALTFRGLHVFPFRGLHALAFRGLHVLAFKGLYAFAIKRLHGLTFRGLHVPTFRGLHVLTFRGFHALTFRGLDVLAFKGLHVLHVRGLHVLAFKRATRSRLQWAPHPHLKRI

SEQ ID NO: 203500 - protein, 415 aa, Glycine max
  Coding DNA Sequence Number=SeqID_86722
  Gene Ontology: Mol. function=RNA-directed DNA polymerase activity; Cellular component=nucleus; Biological process=RNA-dependent DNA replication
MTSFFRAPSAVIKRLTSIQRNFLWGGGAEGKKIAWVAWDQVCVPRDKGGLGIKAIKDFNRALLIKWKWQLFQQTDQFWNRILLSKYKGWRGLEEASHKQHHSFWWSDLKSVMLHSSMAGVLNQFQWRLGRGDQILFWEDSWLSDGRTLRDNYPDLYQITSDKSQLVGNMGFFGEEGWQWQFSWRRNLFDNELGSALEFIDQVSALSPTADTKDYWVWGADPKGTFTTSTVYLCIKGDQPSPFSNHDFNQLWDVKAPPRALTLVWRLLWHRLPTKENLLRRQVPLDNDLCTFCQNQVESASHLFFTCIKIMPLWWEFNSWVKEARVLHCRPVDNFTQHFSMAASKATNRKWKIWWIAAIVSIWYYRNDMIFNNQQLSISKLVDNAIFRTWSWLRGWEKGFVVPFQQWSSSMSFAFT

SEQ ID NO: 203501 - protein, 68 aa, Glycine max
  Coding DNA Sequence Number=SeqID_86723
MKLGPVSGPVKVVGQWSNRSSHQVYSKSAESDQVIMDKMHDRSNNQIDLVMPSGHDWTHSTDWVVPDF

SEQ ID NO: 203502 - protein, 199 aa, Glycine max
  Coding DNA Sequence Number=SeqID_86724
MASRKRRIILPERKVEIYHTELDDFKTELERRNLNKRLTNLADGTIDLALVKEFYANLYSFEDPSPKQARVRGHLVKIDADNLNTFLETLVVLEEGETLPIYSRYCRLPTDHREIETALCIPGKWFILNAEGHPGRILRKDLTTLAQMGIRVCFVYHSPEYQSCDIIHCCCMRFMLLEDLGNVNPKHEFICIYMECDCL

SEQ ID NO: 203503 - protein, 157 aa, Glycine max
  Coding DNA Sequence Number=SeqID_86725
  Homolog annotation: Hit_ID=Q1SKD7; Match level="QueryCoverage=95%, HitCoverage=38%, E-value=1e-12, Identity=28%"; Hit description =Ankyrin
MALKKLSMKRSRKEATGEGSSATSEFDSHRFQSAEHQQRFEAIRGWSFHMERRVQHREDEYSDFQEEIARRHWTPLVTPMAKFDPEIVLEFNANAWPTDEGVRDMRSWVRGQWIPFDADALSEFLGDPLILEEDQQCEFSQRRSQADDFDEEAIAQL

SEQ ID NO: 203504 - protein, 108 aa, Glycine max
  Coding DNA Sequence Number=SeqID_86726
MTSPATGTIPGGGIIPTLDGRILHNSSNKNLIFKMLLVEAKLHDESRLIQRCFDDNKDDDKKLKGQSKNEFKMFKDRIKNTSRFKRKVEEHFKIQEEVEEHFKIQEES

SEQ ID NO: 203505 - protein, 119 aa, Glycine max
  Coding DNA Sequence Number=SeqID_86727
MTEARQKGVRKVNEKGNKRLWEFYGSIMGVLKSHFLTKLGRWLPPSSPRRVRLRNLADYIIIPFLTYGMLRNLTNCATMLPFEFRHVTELHELPNDGCQVPQNGQMKVACHQAKVPGRN

SEQ ID NO: 203506 - protein, 384 aa, Glycine max
  Coding DNA Sequence Number=SeqID_86728
  Gene Ontology: Mol. function=RNA-directed DNA polymerase activity; Cellular component=chromatin; Biological process=chromatin assembly or disassembly
MKFGLCNVPSSFQATMNGTFRPYLCKFIIVFFDDILVYSRTLQDHLHNLEQTLCALEHGQFFLKLSKCSFAQSQIEYLGHVVSTNEVTPVEEKVDAIQQWSASRSFRALRGSRGVILSQLGHPIAFFSKQFSQKLRHASTYVRELVAITAAIKKWRQYLLRHQFIILIDHHSLKEIMSQVIQTLKQHMYLSRLMSTPTSGHMGVKKTLARLGENFTWANMGNDVRQFFVACLDCQHTKYESKKPGGLVCPLPVPSWLWEDLSMDFIVNLLPYRGNTTILVVVDKFSKEVHLGLLLPSYTALTVASLFMEIVATNVSPFEITFRRKQPSIPHNLTRTSNVVAVDDILNDREVVFTSLKKKLLKSQERMKAIVDSHRRDINFEPGE

SEQ ID NO: 203507 - protein, 68 aa, Glycine max
  Coding DNA Sequence Number=SeqID_86729
MKWIFGRLKSKRLPSIKAPLPSKGTTLIVVEAVVIVAHRLTGKRKENSEDSQHVKTSNGALTVSNITE

SEQ ID NO: 203508 - protein, 96 aa, Glycine max
  Coding DNA Sequence Number=SeqID_86730
MLILIVEMSISLLVIGHYLPEARKALLWSTLDHGGHWSCFLQDSTWEEWAELKSTYHLEDKVLLKAEGNDNIQNPMGGFRPKRISKRPKGWEAYIQ

SEQ ID NO: 203509 - protein, 89 aa, Glycine max
  Coding DNA Sequence Number=SeqID_86731
MPKWTPFENRSTTNKTTVAPWKLGNPVMKSKATFYGACKPWIFFINEVICFLKFDGSGMEKEKYDWRRHFKKKMSLEEAHHHRKPWIRA

SEQ ID NO: 203510 - protein, 190 aa, Glycine max
  Coding DNA Sequence Number=SeqID_86732
  Gene Ontology: Mol. function=RNA-directed DNA polymerase activity; Cellular component=integral to membrane; Biological process=RNA -dependent DNA replication
MHLKKRKTSTNLNFFNEFHRHARLPKGISASFLALIPKTSNPQGLGEYRPISLIGCLYKMLSKVLAGRFKKVLKCVISSVQSAFLTGRNILDGVVVVNEVMDMAKRQRKKCVILKADFEKAYDSVSWSYLDYMLDRLGFGVKWRGWMRTCFSSNSISILVNGSPTEEFVAQKGLKQGDPLAPFLFLVAAE

SEQ ID NO: 203511 - protein, 214 aa, Glycine max
  Coding DNA Sequence Number=SeqID_86733
  Homolog annotation: Hit_ID=Q1SNL3; Match level="QueryCoverage=53%, HitCoverage=23%, E-value=1e-09, Identity=33%"; Hit description =Immunoglobulin/major histocompatibility complex
MQQNFEYMQQLLLSVTPNATVDDCWFWTLDAARGFTVKRCYAWLCDFFAGGRVVVADQQRAMWLKLWKNNAPSKILIFAWRVLINKIATRDALSRRGVLRDDSDRRWEDIQAHFMAFGKLIKGKKQKRVKHLIWMAGELVGLDGRTGIIAQWDIYFHCNVKFGGRSSRILVLEMCCIINTDRRGSMEELVGVCFIVGWVLMRPPFSPEYTLYFG

SEQ ID NO: 203512 - protein, 98 aa, Glycine max
  Coding DNA Sequence Number=SeqID_86734
  Subcellular localization annotation: CTP_CleavageSite=48; ConfidenceScore=5.06e-01
MKDSGIRMSLKTVQWSRQLPQPTLRREGDARAHGCVFHRRKMRGVATNANKRKSSEKSERCGLRTLSVKGSGVVFTHGEGCFPRSYVFINCDKEIRPT

SEQ ID NO: 203513 - protein, 91 aa, Glycine max
  Coding DNA Sequence Number=SeqID_86735
  Homolog annotation: Hit_ID=Q1T5S5; Match level="QueryCoverage=89%, HitCoverage=30%, E-value=7e-07, Identity=39%"; Hit description =Ribonuclease H
MAHFMIEFTILKVFVVDIHPYKPFLVKWVNWFPLLSDTIKCNTDDSFKGSPGHARSGGIFWGHTCRRGWKKIWLKSVIQVLKNSSVVPWSI

SEQ ID NO: 203514 - protein, 149 aa, Glycine max
  Coding DNA Sequence Number=SeqID_86736
RGYIYLGLTENKRGYISCGSVLVEGTSTRFKENKGGYPYVTGSSVVAIKYKDGILMASNMGVAIKYKDGILMAVDMRDMGGCCSCHVSFVGKGHVKRVLYVCVNVQPKGSKGANQNALTVWQELPFSFVKDPRWFSLCWCKIFDSSIYS

SEQ ID NO: 203515 - protein, 260 aa, Glycine max
  Coding DNA Sequence Number=SeqID_86737
  Gene Ontology: Mol. function=methyltransferase activity; Biological process=metabolic process
  Homolog annotation: Hit_ID=Q1SW51; Match level="QueryCoverage=76%, HitCoverage=44%, E-value=2e-43, Identity=44%"; Hit description =Generic methyltransferase
MKSAVKEDHVINFFITEEIRKYISPKENRVGKINLYGADKVYNTIGHACVLYKKELEKYMDYDIGSYCDDDWNLAQKLMLNGCDPLPRRRCLTRASKDYQKPHPIHESLWRLPDRRNVRWGNYQCRNFECLSSQNPKRGYSKCIGCFEMEKEKLKWVSNTSLVVDFLISDVLAIKPGEVRIGLDYGIGSGTFAARMREQNVTIVSTALNLDRSFCYRKNLEDYMYMFLQLRYKKHKWVISPKSKDEVFLSALLEKPPRAI

SEQ ID NO: 203516 - protein, 104 aa, Glycine max
  Coding DNA Sequence Number=SeqID_86738
MGAAKATYEQLWKHKMQQIKDINEAAYHWLYNLERTTWCEVMPKPLKSLDYKVEKSGNWVATWGGDRHFEVTHIASVEEVEFKLVLFSIKRMTSHKSNVQTKTI

SEQ ID NO: 203517 - protein, 101 aa, Glycine max
  Coding DNA Sequence Number=SeqID_86739
  Subcellular localization annotation: CTP_CleavageSite=82; ConfidenceScore=5.52e-01
MRPRHFRIASVINSYTVLHRSSSLLRSSIVKMNLSESLKSTLRVTFSLLKNYVGLSSSSHLRIRRSKSHTLVDPKRLSSLVRDTWGANTFPARKQLSNPYS

SEQ ID NO: 203518 - protein, 134 aa, Glycine max
  Coding DNA Sequence Number=SeqID_86740
TLLEQLEESQELVRGVSITVGRHVNPLRGRQVNAKTLQGRRVNAKTHQGRRVNAKTLQGEQMNRWMTMKNLMLEDTGTQRSDRMGRECHKLHSLPQKLLRGGARRRRSWTHPNQRPPMTQGLRDPLQSPPWRNC

SEQ ID NO: 203519 - protein, 153 aa, Glycine max
  Coding DNA Sequence Number=SeqID_86741
MVYNRLIIEPYGLNALSPSCRGSFSRPNSLPGMPIMEVSFSRDDDDNQHIHSGEATKRAFSSFFVNLLFSVPKIDPLDNSNESIMGFISQFEEGDIKNTSVEYALGGPTMMKLLIIYFDDIRDAFDGETRYKGNGIEDVEGTNKDVPIDIGYS

SEQ ID NO: 203520 - protein, 63 aa, Glycine max
  Coding DNA Sequence Number=SeqID_86742
MAESIMGSSSIVGTNIHFGEHQGERIKGSSSKPTPTSPLALPKHEPKVSSLRHNPVHDNLQEL

SEQ ID NO: 203521 - protein, 412 aa, Glycine max
  Coding DNA Sequence Number=SeqID_86743
  Gene Ontology: Mol. function=protein binding; Cellular component =integral to membrane; Biological process=protein amino acid phosphorylation
  Homolog annotation: Hit_ID=Q9LUN3; Match level="QueryCoverage=91%, HitCoverage=93%, E-value=6e-96, Identity=53%"; Hit description =Leucine-rich repeat disease resistance protein-like
  Pfam annotation: Domain name=LRRNT_2; Domain location=27-71; Score =39.5; E_value=1.1e-08; Accession=PF08263.3; Description=Leucine rich repeat N-terminal domain
  Pfam annotation: Domain name=LRR_1; Domain location=125-146; Score =13.6; E_value=0.71; Accession=PF00560.23; Description=Leucine Rich Repeat
  Pfam annotation: Domain name=LRR_1; Domain location=148-170; Score =19.3; E_value=0.014; Accession=PF00560.23; Description=Leucine Rich Repeat
  Pfam annotation: Domain name=LRR_1; Domain location=172-193; Score =7.6; E_value=11; Accession=PF00560.23; Description=Leucine Rich Repeat
  Pfam annotation: Domain name=LRR_1; Domain location=194-213; Score =7.6; E_value=11; Accession=PF00560.23; Description=Leucine Rich Repeat
  Pfam annotation: Domain name=LRR_1; Domain location=216-238; Score =6.8; E_value=15; Accession=PF00560.23; Description=Leucine Rich Repeat
  Pfam annotation: Domain name=LRR_1; Domain location=240-262; Score =9.2; E_value=5.4; Accession=PF00560.23; Description=Leucine Rich Repeat
  Pfam annotation: Domain name=LRR_1; Domain location=264-283; Score =1.6; E_value=1.4e+02; Accession=PF00560.23; Description=Leucine Rich Repeat
  Pfam annotation: Domain name=LRR_1; Domain location=312-335; Score =7.6; E_value=11; Accession=PF00560.23; Description=Leucine Rich Repeat
  Pfam annotation: Domain name=LRR_1; Domain location=339-361; Score =6.1; E_value=21; Accession=PF00560.23; Description=Leucine Rich Repeat
  Pfam module annotation: Pfam domain module=LRRNT_2::LRR_1::LRR_1::LRR_ 1::LRR_1::LRR_1::LRR_1::LRR_1::LRR_1::LRR_1; Domain location=27 -71::125-146::148-170::172-193::194-213::216-238::240-262::264 -283::312-335::339-361
  Subcellular localization annotation: CTP_CleavageSite=92; ConfidenceScore=5.08e-01
MSTPYYTLVLLLLLLIVLISPSSSSLHPTDLNALLSIKNTLTEVSPTKPFFSTWNLTAPDPCSSFSGVTCFLSRVSILSLGTPSLPLAGTLPAESISQLTELTQLILSPGIVTGPIPPQLARLTKLRVISLPSNRFTGTIPSFSSLIKLHTLDLSHNQLAGSLPPSLTELPQLKVLILASNTLTGTLPRTINSPLLHLDLKNNQFTGPLPIALPSSLRYLSFSQNLMWGPLTNGLEALSELVFLDLSMNHFSGPIPAQLFSFPALSNIFLQRNNLSGELGLGPRSGFGPKPGSIVDLSHNALGGELSTVLEGVESLFLNNNRFVGSVPEVYIKSVCRGSTRTLYLQHNYLTGIPIRDGTVVPDTASLCLSYNCMVPPPTVMMTCPASAGGVSARPEAQCSVFNHQRRLIGLE

SEQ ID NO: 203522 - protein, 108 aa, Glycine max
  Coding DNA Sequence Number=SeqID_86744
MLKIEITRFRVSDIVATRRVVTFPIIPSLVEVKLVIDYHLFVPGDEEKPKKMRLVGAYKVLLFFNTKSACVSRWIDKEYRPWEEQRQRLPCLLEHNKKEMDNLKFEVA

SEQ ID NO: 203523 - protein, 77 aa, Glycine max
  Coding DNA Sequence Number=SeqID_86745
MPPFPQQDPSPPIVGFANKSMDIEDLCGFCEIDNHRGKTGDGRLRVEEGKAVEGFNKGRLGLWRAFLVEGRRGKKKK

SEQ ID NO: 203524 - protein, 257 aa, Glycine max
  Coding DNA Sequence Number=SeqID_86746
  Gene Ontology: Mol. function=nucleic acid binding; Cellular component= beta-galactosidase complex; Biological process=DNA integration
  Homolog annotation: Hit_ID=Q1T4S3; Match level="QueryCoverage=76%, HitCoverage=14%, E-value=1e-52, Identity=50%"; Hit description=Zinc finger, CCHC-type
  Subcellular localization annotation: CTP_CleavageSite=11; ConfidenceScore=5.45e-01
MRFPYFDLFPSSSSLVQNLDSYFNLDSKQPASSIVSTPQPSQLSSSHSPFAPSIPPGFSSVSSQPLYASTFVHPQSSNARSHSKSVPAPTSIPVNTHPMQTRSKSEIHNPRLHPSLFLGHSEPKTIKQALENSNWFAAMQEECDALLKNRTWNSVPLPLNRQAIRCKWVFMVKENPDGSINKFKTKLVAKGFHQVHGFDLHETFFPQVKLVTIRVVLTLAFSQGFLEESVFMTQPPGFEVADKSLVYKLNKALYGLK

SEQ ID NO: 203525 - protein, 84 aa, Glycine max
  Coding DNA Sequence Number=SeqID_86747
MEREKRIARRQYIWSLQCLLRLSNVWELYRSSRRKNWRNLRKPLEMSLSLSEDTLYNHTTIRPFKGDELIRSPFKGDELMLSPF

SEQ ID NO: 203526 - protein, 62 aa, Glycine max
  Coding DNA Sequence Number=SeqID_86748
MASLLCNAHVAGKPPFVMASWCQVELATSAGERCRRGAGVGGAATVQVQEEQVDWLGNRHHD

SEQ ID NO: 203527 - protein, 101 aa, Glycine max
  Coding DNA Sequence Number=SeqID_86749
MASSSSSSSSIQIKSDPIEGDVLWMQSKHVSEHVWNGEPDRKSHIRRAVPIYQGLHVDGAPLIGQTNLDWAELCEELLGVRPQEGELQGSVVKLSWMAHHF

SEQ ID NO: 203528 - protein, 75 aa, Glycine max
  Coding DNA Sequence Number=SeqID_86750
MLGFDDGDSDSDNEQALFGKYPELQMFKWENSLIHLPSNLSSLLLPQTPLFHCEREETLRVHPPPFLPLQETLDH

SEQ ID NO: 203529 - protein, 69 aa, Glycine max
  Coding DNA Sequence Number=SeqID_86751
MEKKTERRTRQREGDETYLGMVAKEKKQRLVTMLECDEDDARVRRTRCSDAHRDGFARRRLEEEESAKA

SEQ ID NO: 203530 - protein, 227 aa, Glycine max
  Coding DNA Sequence Number=SeqID_86752
  Gene Ontology: Mol. function=protein binding; Biological process =xylan catabolic process
  Homolog annotation: Hit_ID=Q1T435; Match level="QueryCoverage=58%, HitCoverage=17%, E-value=6e-15, Identity=38%"; Hit description =Leucine-rich repeat; Leucine-rich repeat, cysteine-containing type
MDDAVALTARGDDGVTFAIAAECVHISECPVLVISGAKDVWHQGISFTTSNFQRTSLYSFQINLYTKGQGFEYRDYGLLTTLDLSYLELVQKSFHRKDIKGDWENEELGSLLIYPASNSMEKFLASSFAGNPRLCGAPLQINCTGQSGNVHVSKQHGGSNDDVFETESLYLGMVVGFAAGLWWPRGSLFLNKTWRHAYGFLNYVADEVHVLVPFKFNSFIGMQPSSL

SEQ ID NO: 203531 - protein, 186 aa, Glycine max
  Coding DNA Sequence Number=SeqID_86753
  Gene Ontology: Mol. function=DNA binding; Cellular component=nucleus; Biological process=regulation of transcription, DNA-dependent
  Homolog annotation: Hit_ID=Q6F2M6; Match level="QueryCoverage=33%, HitCoverage=35%, E-value=6e-16, Identity=60%"; Hit description =Putative myb-like transcription factor
  Pfam annotation: Domain name=Myb_DNA-binding; Domain location=120 -167; Score=47.0; E_value=6.5e-11; Accession=PF00249.21; Description =Myb-like DNA-binding domain
MKESALAVKEREREIKGFERKEKEIKNALFGKYPELQMFKWENSLIHLPSNLSSLLLPQTPLFHCEREETLRVHPPPFLPLQETLDHLSANTAPTQDITHLQQARPANPPPTSSPSPNLCKRWTNEEHRLFLEGLAYFGKGDWKNISKHAVKTRTKTQVATHAQKYFLHIKEKGKGKRKSLFDMAL

SEQ ID NO: 203532 - protein, 206 aa, Glycine max
  Coding DNA Sequence Number=SeqID_86754
MVRTCSNRKKRRVFGKGFPGSRKYLRSTRLGQERGLRIIGRFELANGRVEVIKLAYGRVEVQDSKISGLSTISDQTPQNQLRLRAIWITVLRSSYVHFFSQISGSQIIYTNPYILKVPSAERNEYARRMTGSSQILIISSPTPNSTLALRENPNPTLNPINSVFPIKIGTDPRRVLRVWTHCHAYLIVVVNSEIRVHPHPVNNFCH

SEQ ID NO: 203533 - protein, 283 aa, Glycine max
  Coding DNA Sequence Number=SeqID_86755
  Gene Ontology: Mol. function=nucleic acid binding; Cellular component= oxygen evolving complex; Biological process=DNA integration
MEYVKDVCLENTTTNHFQRKEQGKSKKCWNWCTQTYVEYTSKEFDKFCESVERQLTVGYTPQQNVPKEKRTKLEEASERCIFIGYSFMSKGYRLYNSKTKKVIISRDVVFDEKAFWNWRNDKVEEKTVPTVNLKQSSASSENRQQIPSTPSSPGSSSSSPSSTPIKMRSLSDIYTKCNYCFVEPTNFEEAIKEDAWRKTMQEEIDDALKKYRTWELVKKPKYKEAIRVKWVYKVKHNPNSSIQKNKARLVAKGYSQQPVVDYEKTFAPMDVWLHSNRYTIGCE

SEQ ID NO: 203534 - protein, 374 aa, Glycine max
  Coding DNA Sequence Number=SeqID_86756
  Homolog annotation: Hit_ID=Q2HRL0; Match level="QueryCoverage=24%, HitCoverage=16%, E-value=2e-12, Identity=39%"; Hit description=RNA -processing protein, HAT helix
  Subcellular localization annotation: CTP_CleavageSite=67; ConfidenceScore=5.35e-01
MGKSKGQKTTPNQPALVGGAVAAGNASIPSIAVVTGSEGESQGVRVSCSNTKTNTAHQVFGKMSKPSCAAVVGSGKEPISSTTVVVGVAGEGQGAHASSSTTAHQVFDNRPKSNSEVAKVNAAQVFDILSDCRTKAVLSPEDSYTLGEDDTSSDEESSSSSDSELVPPTANTEAAKPWVNLFKDNRKPSKGFGLQFSPPSAEEVLLDDSDLQPLEEAWGHSLIGYVAGRFPGKKALMECCQKWGVNFSYSTHESGWLVFRFQNEEDMNQVISAGPYFIFQRPLLLKVMPPFFDFGNEELSKIPVWVKLRNLPLELWNPQALGKILSKVGLPIRTDQLTASKGSISFARALVEVDTSMDLIEEVCFRLPNGKVFT

SEQ ID NO: 203535 - protein, 66 aa, Glycine max
  Coding DNA Sequence Number=SeqID_86757
MARDSRESSADIINITLAWATSTRGRLTLAQSAYAFWDSALALSNLSPQNSAMPQDLEAKQAVKTL

SEQ ID NO: 203536 - protein, 228 aa, Glycine max
  Coding DNA Sequence Number=SeqID_86758
  Gene Ontology: Mol. function=RNA-directed DNA polymerase activity; Cellular component=chromatin; Biological process=chromatin assembly or disassembly
  Homolog annotation: Hit_ID=Q1T2D5; Match level="QueryCoverage=74%, HitCoverage=10%, E-value=2e-39, Identity=46%"; Hit description=Chromo
MEDQRSRDQQLQDRFDQMQRSIELLIQNQAAATGGLSSSGGTLNTLVIHSVPISSTTCVKEISLGFSHFDGQSPIMEWIFKAEKFNYHHTPDQDRVNIASIHFEKDVIPWFHMLQRLQTVNTWAELRRALESQFGPLLFDCPMAELFKLQQVGTVADYYLKFMGLAHRFEGLTLEVLLNCFISGLNKDIRRDVVAQALADFLRAVSLAKLYEEKYVSVPSPCSTPFTP

SEQ ID NO: 203537 - protein, 116 aa, Glycine max
  Coding DNA Sequence Number=SeqID_86759
MSFGPFPLNYAQSATVTRDQGHDMIGQAMESFVKRQCQENEQFPLSMQNAITTQFSYLDVFLLQNTQQAQMSMLEAVVAAAFVPQPPLIPAPLDPSLPPLAPIPPPPTTFPPPSQD

SEQ ID NO: 203538 - protein, 458 aa, Glycine max
  Coding DNA Sequence Number=SeqID_86760
  Homolog annotation: Hit_ID=Q1SQU5; Match level="QueryCoverage=62%, HitCoverage=84%, E-value=4e-39, Identity=42%"; Hit description=IMP dehydrogenase/GMP reductase
MDLFCRLKLKLTGVRVEQIPISLLTFVVESWSVVRLGLCLSGGESLVHSEFWTIVMGIVFGSNTLSCVSLSRAMNNEYVKTHVEEAFGTHHRIEPENHVTEDDDVDLIQIPNIKRLISSSSCLDNLTTKGLYLLAMGSLSSAIRSVKKVVTVAELRSLQLLIELKAVISNRSIRTAFVTFFIEFLFDCGDMDSVPKSLSQTLDVINRGSNSCMNHVLFKKYIEEEVDCILNMSALTKQTVLDLLPDDEFDKDFTDAYLEQLEESDYSGSNEDDNDSQPLEDIHNSEMKHLEKESMPTKYNECKNQYLTIEDACDKTSMLAYNLIGHMLEEFVMIEGIDLNLSKSLYLSGNNHTEDVEEMTTPASTDDGGGNPPPNGVLVEPVIRGHYLHHFIVSLQIPERFATPEDRDSGCVILECHASKQQDQLLLSWLQSPIFAPMLRKFIGCTSSWLLWDNIHHA

SEQ ID NO: 203539 - protein, 50 aa, Glycine max
  Coding DNA Sequence Number=SeqID_86761
MIASNAKGSRARIILKGPNNITLEQTLKLNFRASKNQAEYEALIIGKEFG

SEQ ID NO: 203540 - protein, 339 aa, Glycine max
  Coding DNA Sequence Number=SeqID_86762
  Homolog annotation: Hit_ID=Q2QQC6; Match level="QueryCoverage=43%, HitCoverage=63%, E-value=6e-12, Identity=33%"; Hit description =Expressed protein
MVRKHAKVEYVKRLYDQVKVQIAKKNERYANQANTKRKEVVLEPDDDPGHLRTNVFLEGGNDKNHETGNPCGVYPDLSSFIGSGVYPDLSSFTGSGVNQKLYSLYQAIRAPYKLVGFMFFSSLLFTSLALLLSTFLLIFWKHKAVPNDELAEGNGFILSTTTSEEKISHGRESAVAIAPTPMHKNAETVVTQAKESEEVSDDKCQEEGLFLSTSEEVDHTLSDECSDGTISDEDSLIEIALPSGHFVGHNQNKEDSNSKYNNCCTLQQKKRELSSAHEALFNQHSLMEFLAEFNEMNEEDNLIEIDIAMGSIKCSRLVQQFEAAVVLHKLRILIKVIVL

SEQ ID NO: 203541 - protein, 84 aa, Glycine max
  Coding DNA Sequence Number=SeqID_86763
MDSKCANTWNSATSSTFHQSYPHSSLAQYEEAGGQEELSEPHLLGIIQKAKKGTFAKSGTSKDTISEEGALVDAYFHTLSDASC

SEQ ID NO: 203542 - protein, 42 aa, Glycine max
  Coding DNA Sequence Number=SeqID_86764
MADALKSDMFLRDAMIRGFVTYDIFYQGYSKNIYNDKLGYPN

SEQ ID NO: 203543 - protein, 114 aa, Glycine max
  Coding DNA Sequence Number=SeqID_86765
LRLPAIRQQLILQFKAAFHCDKDAIEIPGFYQRQWLPNYPEIVEFKRFGPPLQWNVVVLDKGIGDKYVTLPWYKFLQEGDFSHGDELSFNYRRAEKIWEVVIRRAIDWDDSDID

SEQ ID NO: 203544 - protein, 121 aa, Glycine max
  Coding DNA Sequence Number=SeqID_86766
SEEVQVLKEELERAQAVKEKFKTTAIKVRKECNKLRDVNTTTAKALEQETKRARKEEWGRNKFRGALWGSNNKLKLRRAERDQSRVKSMILEDELKACQWSKRSLSEHLSKTNENMWAIID

SEQ ID NO: 203545 - protein, 134 aa, Glycine max
  Coding DNA Sequence Number=SeqID_86767
MGGPYCVQIQNKHAFPPYGLPPNYTPPNVAYTPNEDVNNSALILIESRQPHHVHVSQPMGETHEIPHHNLAEFELCLGYATKGQAVGDIPLQNTLEGSQYHPQPHLLHSTAGKIPLIMKEMGEVGSSRGKAQGR

SEQ ID NO: 203546 - protein, 218 aa, Glycine max
  Coding DNA Sequence Number=SeqID_86768
MPSFSMLHHTPIMVEAMRRSTLYTNSASLVCFLGTVISSDGGAFSQVSYREYCETRFSKLIGKAGNFDEENREAIQVRGGLLDSCETTIQGFLVYAAESYPTVYCEDLKALAIEGDLEKVATLSEKVKEKEFEETKKLWDRVFNQPYEIDGGEVPLMLEDVISIKSPIYWEDSGTDVNTKYRSFFQDFYWRSQKHRGMLNQGKIENLLQLATMKMIEA

SEQ ID NO: 203547 - protein, 315 aa, Glycine max
  Coding DNA Sequence Number=SeqID_86769
  Gene Ontology: Mol. function=RNA-directed DNA polymerase activity; Cellular component=chromatin; Biological process=chromatin assembly or disassembly
  Homolog annotation: Hit_ID=Q1T2D5; Match level="QueryCoverage=84%, HitCoverage=17%, E-value=8e-71, Identity=47%"; Hit description=Chromo
MESPDPTIDLFATCLVGEEVRWIILLCDTLSSFQATMNDTFKLYLRKFIIVFFNDILIYNKSFDDHLHHLAQTFQLLQDHQFYLKLSKCSFAQQQVECLGHIVFASGVALVQDKVVIVQQWPIPNSFKALRGFLGLTGFYRRFIRRYSAMATPLTHLLTKEHLEWPEEAQLAFQQLKEAVSTVPILPLPNFSSGTGMGVILSEDGHSIVFFSKQFYPKLLHASTYFQELYVITATIKKWRQYLLGHSFIILMDHKSLKELMAQLIQTPEQQKYLLHLMGYDFTIQYMSGISFISSKGPKWASLRHWLGSRRVSLG

SEQ ID NO: 203548 - protein, 155 aa, Glycine max
  Coding DNA Sequence Number=SeqID_86770
  Gene Ontology: Mol. function=RNA-directed DNA polymerase activity; Cellular component=chromatin; Biological process=chromatin assembly or disassembly
MASTKGLIAIEAEPLFMVQPIPPATSVYIGWVEGKLGLVVEERKSLGRGCDHEKTDTNQGVSPLEDEAAEQKGRRETNDSIGQCLKLHEIVIDCASLSELEPGAKVGPGHDLAIERHPLKPRKCWAIHVKRGNHQAFTIRGRMVVEELGDLEDPP

SEQ ID NO: 203549 - protein, 124 aa, Glycine max
  Coding DNA Sequence Number=SeqID_86771
MVRNGNELDCLHLCNNVSIHVQGHVFIVDFHVMSLTGADLVLGVQCSFTQAGLFNYRETVTVTSTLSIPSSFNKWSQLIAQALSSIFESQLLSNSLTAFSSIPIPYRHHIPPIIPSTFFETPHL

SEQ ID NO: 203550 - protein, 538 aa, Glycine max
  Coding DNA Sequence Number=SeqID_86772
  Gene Ontology: Mol. function=RNA-directed DNA polymerase activity; Biological process=RNA-dependent DNA replication
MVRPEMQEKWHLQSSFFLLHSAAIEIQEAKDSIDEEDPRPTSSTWSYIKLTIDRCDCGAWVSPVQVVPKKGDMIVVHNEKNDLIPTLTVTGWRMCIDYCKLNDAPSKDHFPLPFMDQMLEQLAKQVFYCFLDGYSGYNQIAVEQKCIEVFMDDFSVFGPSFDCCLSNLKLVLWQCVETNLVLNWEKRHFMVQEGIVLGRKISSRGIEVDKAKIDVTEKLPPPVNVKGIQSFHGHERLVSTLMMVPLNWSQEFELMYDANDYVVGAMLGKWRDKVFHSIYYASKLYNHWGRITLRTSSSFLRRTFSPTLGFQSCRRCWGHYNVKHKVISPYHPQINGQAELSNRELKKILENTIASSRKDWAMKLDNALWAYKTAFKIPIGISRFHMVYGKTCHLPIHMEQRAYWALKFLNFDASLSREKQKLHLLELEEMKLNAYESSKIYMQKMKAYHDWKLVKRNFQPRQQVLLLKSRIQLFPRKLKSKWFGPFIIKDVKPCGAIELMDPSSTDPEHSWIVNGQRLNIYNGGNIERLTTIIHLNDP

SEQ ID NO: 203551 - protein, 178 aa, Glycine max
  Coding DNA Sequence Number=SeqID_86773
MWHLKLSTIVALSGLHALSEADTLNATLKFFKSLPCLLLYLYKKATHEGWEMAYESHVTKALYKENIEKVGDQKTIMYNLMCEKVKIWTNILNKNVLHKSCSKTTLLDVHKFILFHLMENLSFDLPHTIYITIPHNLRVLGGLDDIYYVVLMNKILWDQGFYQMFDKMDKDDDGERLE

SEQ ID NO: 203552 - protein, 193 aa, Glycine max
  Coding DNA Sequence Number=SeqID_86774
  Gene Ontology: Mol. function=nucleic acid binding; Biological process= RNA-dependent DNA replication
MARVCKTSEDNLVPLNLEIEATCRRNNVQEEEESNEKGRQIKEKEEPNPLHHPQHFLCIAWPKVQVTNISYPHSLIQLIQGNLFHVLSNEDPYAHLAIYIKICNTMKIAGVLEDAIRHNLFSFSWLVKQKDGFIHSFKGNKFLKKFFPESKIVERKVEISSFHQFPDESLSEALDRFYGLLRRTRTHGFSEPI

SEQ ID NO: 203553 - protein, 214 aa, Glycine max
  Coding DNA Sequence Number=SeqID_86775
  Gene Ontology: Mol. function=binding; Cellular component=nucleus; Biological process=metabolic process
  Homolog annotation: Hit_ID=Q9ZUW3; Match level="QueryCoverage=67%, HitCoverage=59%, E-value=1e-18, Identity=31%"; Hit description =Putative selenium-binding protein
MLLVSKFICKLKVLPLGLKLSVLLESAVSTNNYDPPYKVNGDDKMKSQSIRAVVHQDNKTINYENRTLTPIQTSSDQTQEALHLFVSQYRSGLSPDKYTIPCILNVCACSVDGTTSAHEHFQCVKSGLVRHVLVGSTLVDMYMKTGNVRDERRVFDEKGDRDVVFWTSLLAGYSLNGFNDQVWELFSLANQCKIVVGMQIHALVVKHSFEVKGR

SEQ ID NO: 203554 - protein, 106 aa, Glycine max
  Coding DNA Sequence Number=SeqID_86776
MSPKNPIPTKFMREKVYPNLKFEVPQRRGALHDSENGFLLQFGVEMVSKVWSFNGQQWWVRRGEEKQREKFQCPAFLCTRRGPFSKVVNLEGDLAHSTIENTEKVQ

SEQ ID NO: 203555 - protein, 103 aa, Glycine max
  Coding DNA Sequence Number=SeqID_86777
  Gene Ontology: Mol. function=nucleic acid binding; Biological process= RNA-dependent DNA replication
MERKPQEANINLSYFHGKDNVKAYLDLEMKVEQLFACHHTREERKVHLATLSFQGYAPYWWTSLDRKRRIHGDPPVKYWIDLKSALRKRHIPSYYERGLMDKL

SEQ ID NO: 203556 - protein, 80 aa, Glycine max
  Coding DNA Sequence Number=SeqID_86778
MTLSNEQEIWVFLEFKVPKVLGEHSLFPFSFHEATSSQPFIYLHYTSSSNTGAILPPQGHCIEDSKKIEPEMQEKALGFS

SEQ ID NO: 203557 - protein, 123 aa, Glycine max
  Coding DNA Sequence Number=SeqID_86779
LGRIDGDPVLRETRIWATWEYVSSVGGGQQGMGETSYFYSLTTEWYLEICRGGQETLGMSSGASSWQSTDKRNKDHKARRLVWWLASFESCVIYGLWPLVIDYQGLENEVRKLGELLVIDYQG

SEQ ID NO: 203558 - protein, 185 aa, Glycine max
  Coding DNA Sequence Number=SeqID_86780
  Homolog annotation: Hit_ID=Q8L8A8; Match level="QueryCoverage=75%, HitCoverage=29%, E-value=8e-13, Identity=39%"; Hit description =Transcription activator
  Pfam annotation: Domain name=QLQ; Domain location=157-184; Score =34.4; E_value=3.9e-07; Accession=PF08880.1; Description=QLQ
MDLGVVGLEGVVGSESGCVFGSSLASDPETKHKWYGSGLLKQERSAIASEDDEWRISKVAKTDHDMPSASKAMLFQQRNNSLLRSNNATLFSDGHHQSQMLNFSSPKSETLLVDKAFSNATLPFSYHQLSSYSKNTVCKGYNSGSISMHGALASVRGPFTPSQWMELEHQALIYKYITANVLDKE

SEQ ID NO: 203559 - protein, 98 aa, Glycine max
  Coding DNA Sequence Number=SeqID_86781
MVVVRLCVVLNIHVYGSKRDFQDQMTSPTSHPYSTLMLLRPSENMMTCSIWTTSSGSYIVAVPPEVDMVDLMSEDEGENLKEDMSYEEEASMMRRTPL

SEQ ID NO: 203560 - protein, 238 aa, Glycine max
  Coding DNA Sequence Number=SeqID_86782
  Gene Ontology: Mol. function=RNA-directed DNA polymerase activity; Biological process=RNA-dependent DNA replication
MKLIENMEASDQAILRDRAYMTSKKKEKEHYFARFLDIFNELKITIPFGEAPQQMLLYAKFLKELLTKKDKLPPKFNDPGSVTIPFSIEDISMGKTLIDLGASINLMNLSMLKRIGNLELKPTYMTLQLVDQSIKRPHVIIEDVLVKVQEFTFSVYFIIMDIKENVEVTLIFERPFMLIAKCVVDMKNCNLEMNEVDDVVQQFTMHSTLEKTPNLGEGNLHVEIVGLGSSSSMESFAS

SEQ ID NO: 203561 - protein, 225 aa, Glycine max
  Coding DNA Sequence Number=SeqID_86783
  Gene Ontology: Mol. function=rRNA pseudouridylation guide activity; Cellular component=small nucleolar ribonucleoprotein complex; Biological process=35S primary transcript processing
  Homolog annotation: Hit_ID=Q6YWS6; Match level="QueryCoverage=47%, HitCoverage=52%, E-value=2e-29, Identity=67%"; Hit description =Putative high mobility group-like nuclear protein 2
  Pfam annotation: Domain name=Ribosomal_L7Ae; Domain location=107-218; Score=5.4; E_value=0.0086; Accession=PF01248.16; Description =Ribosomal protein L7AeL30eS12eGadd45 family
MCDIRWYFLACTTSRIGIMKAYRGEIRRGSGTRPHGNRIEPAPTLTNKNRVDRVRGRVRVFLDNSKRGGGVHGITDIHPNPDPPQILQLSVLTPHIAKPLAGKKLCKRTLKLVHRAAEHKCLKRGVKEVVKSIRRGHKGFACFLSNFFFLTKTLEMLTLIFLYCECILCVIAGNISPIDVITHVPILCEESDIPYIYVSSKEVRNQLRIPYLDYVYVSYVFLLLL

SEQ ID NO: 203562 - protein, 413 aa, Glycine max
  Coding DNA Sequence Number=SeqID_86784
  Gene Ontology: Mol. function=glyceraldehyde-3-phosphate dehydrogenase (phosphorylating) activity; Biological process=glucose metabolic process
  Homolog annotation: Hit_ID=Q8VXD7; Match level="QueryCoverage=46%, HitCoverage=50%, E-value=8e-54, Identity=55%"; Hit description =Glyceraldehyde-3-phosphate dehydrogenase
  Pfam annotation: Domain name=Gp_dh_C; Domain location=129-273; Score =123.6; E_value=5.5e-34; Accession=PF02800.10; Description =Glyceraldehyde 3-phosphate dehydrogen
  Pfam annotation: Domain name=Gp_dh_N; Domain location=59-148; Score= -57.2; E_value=0.0001; Accession=PF00044.14; Description =Glyceraldehyde 3-phosphate dehydrogen
  Pfam module annotation: Pfam domain module=Gp_dh_C::Gp_dh_N; Domain location=129-273::59-148
MILTQKLHNAFKGTVEKITGPEPFSASKKKEFSMSLSSSPSVIISLPNAPPGPGNQYGVWQQSGLWPHIDLLLLIYKSFKDLFFKLHGLLIEGPVSNYVFVDDPRASKHIQASSKKVIITAPAKGADILMYVVEVNEGDYTHEISSIIKSVTNSRVYTDSAVALNIVLTNTGAAKAMSLVLPQLKFKLNGIALRVPTPNVSVVDLVVNVEKKGLTVEEVNATFKKVAEGRLKGVLDACDVPLVSIDFRCSDVSSTIDSSLTIWSWEMIWLKWLLGMTMNGVIESVFTTSVLAKTDVIKAHSTSRKWRPEVIALRAIKNLDSMSLEELVGIHKTHEKELAHDEGTKKRKSLVLMIQRPKHNSTSKELSSKALIVNNALEEESDDNDSEEKDEAPIRHITFEDAPLKQGFIGHIK

SEQ ID NO: 203563 - protein, 87 aa, Glycine max
  Coding DNA Sequence Number=SeqID_86785
  Subcellular localization annotation: CTP_CleavageSite=76; ConfidenceScore=5.01e-01
MEPKSTKQALADPACCHKQLTILAAAKSVICPVVFVHTALQQKQVGFMMQSYSVRALGRRLQVDWARDPREGPRVLMSLRVDFESMG

SEQ ID NO: 203564 - protein, 320 aa, Glycine max
  Coding DNA Sequence Number=SeqID_86786
GSSSTTIAVGQHRHDTSGDPPAPNPSSFSSPSQGVPFEGTLVDDWKHVYSSHDAHKMVCTNHADMTDRLLAGRQIDWAHLVRYRINKALRANAPLPYPHLVTLFLHHFNVPLEDEPFVKVNKSFAIGASALTSFGYRKDMDGQWVRKQDLPPPIPDESTPSPPPQWDTSSFLLIEVLTKLRDLRAFVSDLFDAMDSCITHLEDYHTLISPETCQKSKGSRLAQSVKFRNVAEIEKRSFLKKVVASGGSNLAHLDELSLPGRAGNYAKILDRSSTFIVRSSFSSVFNGAPVSLALARPRRARCDKDDMSFIRRCFDPSVDS

SEQ ID NO: 203565 - protein, 117 aa, Glycine max
  Coding DNA Sequence Number=SeqID_86787
MYNTTITHIRLHCSGHWQMVVILPKKNLVVYALKGLDDTPQPKSKAGARWIVVKCNRQKRTTECGYYVMHWMSTIILGTFRNNWETYFNDVRPLEVERLKALRIQWAQYYLKVRNQT

SEQ ID NO: 203566 - protein, 203 aa, Glycine max
  Coding DNA Sequence Number=SeqID_86788
  Gene Ontology: Mol. function=glycine hydroxymethyltransferase activity; Cellular component=integral to membrane; Biological process=serine family amino acid metabolic process
  Homolog annotation: Hit_ID=Q7WFD2; Match level="QueryCoverage=100%, HitCoverage=52%, E-value=2e-67, Identity=63%"; Hit description =Serine hydroxymethyltransferase 2
  Pfam annotation: Domain name=SHMT; Domain location=8-203; Score= -67.3; E_value=1.4e-12; Accession=PF00464.10; Description=Serine hydroxymethyltransferase
MFDRNLTLSKADPDVWAAVQKEDVRQEQHIELIASENYASPAVMEAPGHAAHEQVRRRLPGQALLRRLRIRRRGRAAGHRPPEADLRRRSRQRAAQLGRADTVLGMSLAEGGHLTHGASVNASGKLYNFISYGLDENEVLNYAQVEQLAKEHKPKLIVAGASAYALHIDFERMARIAHDNGALFMVDIAHYPGLVAGGAYPNP

SEQ ID NO: 203567 - protein, 244 aa, Glycine max
  Coding DNA Sequence Number=SeqID_86789
  Homolog annotation: Hit_ID=Q39JJ8; Match level="QueryCoverage=50%, HitCoverage=100%, E-value=5e-51, Identity=79%"; Hit description =HesB/YadR/YfhF family protein
  Pfam annotation: Domain name=Fe-S_biosyn; Domain location=18-109; Score=147.4; E_value=3.9e-41; Accession=PF01521.11; Description=Iron- sulphur cluster biosynthesis
MNAVTETVDLQAAPPAPLVFTDSAAAKVKDLLAEEGNPELKLRVFVQGGGCSGFQYGFTFDEVVNEDDTVLDKAGVQLLVDPMSFQYLVGAEIDYKEDLEGAQFVIRNPNASTTCGCGSSFSVGFLSCGRRASGGIQGAQDARATRTGDAGQAGGAARQEGLGQPGERQRLHLLRRDAQRVGGMHRALQAIRQLTHQSGVAGAAAADIEFAHVRAGASMALATVRAVRRCRVACTSCGAGLGPS

SEQ ID NO: 203568 - protein, 148 aa, Glycine max
  Coding DNA Sequence Number=SeqID_86790
  Gene Ontology: Mol. function=microtubule-severing ATPase activity; Cellular component=microtubule; Biological process=cell division
  Homolog annotation: Hit_ID=Q9FT96; Match level="QueryCoverage=96%, HitCoverage=30%, E-value=1e-14, Identity=34%"; Hit description =Katanin p80 subunit-like protein
MQSLCGHTSSIEAVTFDSAEVLILSGASSGVIKLSDLEEAKSSADRTMKFWDLETFELIGSTRHEVSGVRSIAFHPDGQILFAGFEDSLKLIEPYNGSLETEKKESTKQKLSLQGRQMEKVEAGVGPAFGLCSMSVDNESKEIKNVYI

SEQ ID NO: 203569 - protein, 473 aa, Glycine max
  Coding DNA Sequence Number=SeqID_86791
  Gene Ontology: Mol. function=RNA-directed DNA polymerase activity; Cellular component=chromatin; Biological process=chromatin assembly or disassembly
MAEATRSKTSMERWEDAFAKLSASMTSKFDELLNRMNQLENSHTNTHAPPSFAAPAATATANTAYRLKLEVPRFDGTDPEGWIFKVTQFFEYHATPEHDRLMIASFYLEGPALAWFQWMYQSGQLSSWSAFLHTIHARFSPSAYEDPTGVLCKLTQRTTVSAYLSEFETLANRVIGPPAPFVLSCFISGLNPAIQRDVQVMQPHSLAQVVSFVRLHEEKLLDGRRQTRKPASSLTPGTSVTRTSPSLTSSIADSPLLPSPSRPRASSIPFKKITPSELAIRREQGLCFNCDEKYSRGHKCASSLFLFVTEDEDDNREIDPGPSQLPPPLQESAPAQISLHALSGHGAPETLRLTGFICEHRVQILIDGGSTHNFLQQELVTLLQLQPQKTSTLRVTVGNTSTFFHIKMEPSMETPVTIAHPIPAVQRLLSKHASLFQPLSTLPPSRTTDHSITLLPNSTPVNVKPYRYPHFLI

SEQ ID NO: 203570 - protein, 121 aa, Glycine max
  Coding DNA Sequence Number=SeqID_86792
MTKSKGKDPLEGLGGSMTRARARKAKEALQQVLSILFEYKPKFQGEKSKVVSGSLLKSAVKLLYKLNHFINKDKLSFIQKIRVYLFYLSESDSPKFLSDSRTPWLYQRTFTTFVCCPRWKE

SEQ ID NO: 203571 - protein, 760 aa, Glycine max
  Coding DNA Sequence Number=SeqID_86793
  Gene Ontology: Mol. function=RNA-directed DNA polymerase activity; Cellular component=chromatin; Biological process=chromatin assembly or disassembly
  Homolog annotation: Hit_ID=Q947Y6; Match level="QueryCoverage=96%, HitCoverage=60%, E-value=1e-146, Identity=41%"; Hit description =Putative retroelement
  Pfam annotation: Domain name=Chromo; Domain location=672-720; Score =28.3; E_value=2.7e-05; Accession=PF00385.14; Description='chromo' (CHRromatin Organisation MOdifier
  Pfam annotation: Domain name=rve; Domain location=455-620; Score=6.9; E_value=0.0016; Accession=PF00665.16; Description=Integrase core domain
  Pfam module annotation: Pfam domain module=Chromo::RVT_1::rve; Domain location=672-720::12-181::455-620
MLRQGHIQHSSSPFSSPVLLVKKRDGTWRFCVDYRALNAITVRDRFPIPTVDELLDELGGPVWFSKLDLMQGYHQILMREFDIGKTVFRTHHGHYEFRVMPFGLCNAPTTFQATMKRLFQPHLRRYIIVFFDDILIYSHSLEEHINHLEIAFQVLEHGQFTLKLTKCSFAHKQIEYLGHIVTDNGVQPVPEKIQAIQEWPQPRSTRALRGFLGLVGFYRRFIKGYAMIAHPLSQLLTKSELVWSPEADNAFQNLKQVVTTAPVLALPDFSKPFTVEIDASGLGMGVVLSQEGHPISFFSKELAAITAAVKKWRQYLLGHSFIILTDHMSLKELMNQAAQTPEQHKYLARLLGFDYVIQYRAGKSNIVADALSRSGASTTASLFIISVPHFVFLEDLRRELQANPEFRELRRKMTAEPHAYPDHSLAQDLILYRGHCQLVKYEIAKPRGLLCPLPVPSRPWEDLSMDFIVGLSAYRSYTCILVIVDRFSKGVHLGMLPSHHTSQMVAQSFMEMVGKLHGMPRSITSDRDPFFMSKLKLQIEWWSSIYEHLYIGNPALGGASCCGQSGRITRPSTPPRGEEMFNLLHRKLQKAQARVKDIVDGRRRDHEFQRHFYGPFRIIERMGPVAYKLELPEHSHIHPVFHCSLLKPLVGSTESVKVETLPAGAVDNQPLTTPLAILGQKMVPTDQGLTRMVLVQWQGLHPDETSWEEWEGLKEQYHLEDKVLIEDRGNVTNSNFKHQVTRPKRRSNIPGHLKDYELQA

SEQ ID NO: 203572 - protein, 212 aa, Glycine max
  Coding DNA Sequence Number=SeqID_86794
  Gene Ontology: Mol. function=structural constituent of ribosome; Cellular component=ribonucleoprotein complex; Biological process =translation
  Homolog annotation: Hit_ID=Q9LYF5; Match level="QueryCoverage=50%, HitCoverage=46%, E-value=1e-44, Identity=81%"; Hit description =Ribosomal protein L19
  Pfam annotation: Domain name=Ribosomal_L19; Domain location=104-207; Score=70.2; E_value=6.6e-18; Accession=PF01245.10; Description =Ribosomal protein L19
  Subcellular localization annotation: CTP_CleavageSite=70; ConfidenceScore=5.52e-01
MASRRLSSSMLRPFLPRSPPEFQASIPSQPFSVPNFSTGVYPVAITKLFSQFESGNGLASVLRSSGLGLYQQAGGVVPPFASRFMSTEATSVDSSSQDSSTLEPEILDKEAVEDVRGQREIPDIKPGYIVQLKVEVPENKRRVSIIKGIVIARRNAGLNTTFRIRRQVAGVGIESLFPLYSPNIKEIKVLDKKRVRRAKLYYLRERMNPLKN

SEQ ID NO: 203573 - protein, 175 aa, Glycine max
  Coding DNA Sequence Number=SeqID_86795
MKNKKVAAVGVSLSETYALSEQHPLSETSARLVNKENLEENFPCMHALSAPSARPTSHLSLLAPSAPDSIEIYVREAAGQGSTKNLSFQEDSSVVERIPEFQEPLDLRSNPFQGGGNHDVAPCGACRPWIFFINGVLCFLKMNGSGMEKEDDWRRHFKGKMSQEEAHHRKPWIRA

SEQ ID NO: 203574 - protein, 129 aa, Glycine max
  Coding DNA Sequence Number=SeqID_86796
MEAMKKFKWSKPFTRMSDLSASHIETLEIEQWKLSTYSNGHNYSHGGASHIEMLEIEQRKLSRYSNGLNFSHRGPIQAHNTSRCSKLNNGSSQEIQMVETFHSDVRFRRITYRDARNRTMEALEIFKWS

SEQ ID NO: 203575 - protein, 58 aa, Glycine max
  Coding DNA Sequence Number=SeqID_86797
MENWRTALRITSRGFRLEALGNNIHGASKKVENGELANSAMHNFAGLQTRRWRMHEQC

SEQ ID NO: 203576 - protein, 96 aa, Glycine max
  Coding DNA Sequence Number=SeqID_86798
  Subcellular localization annotation: CTP_CleavageSite=69; ConfidenceScore=5.42e-01
MWDDPTVTFRGPSKARGKRSKVPTTSTPPEIVAPSSSTAPMLHSMLQSLHGGQSIIMQSLQGLGLPSIMSMAEFDAQVAWPRAQPSPSGWGGASAA

SEQ ID NO: 203577 - protein, 58 aa, Glycine max
  Coding DNA Sequence Number=SeqID_86799
  Subcellular localization annotation: CTP_CleavageSite=18; ConfidenceScore=5.17e-01
MATGSVCLSAFKLMVVLRSDSTEKRKKSSQGYSRAKGPNGTLLAVLSSVNVVSCSYSY

SEQ ID NO: 203578 - protein, 98 aa, Glycine max
  Coding DNA Sequence Number=SeqID_86800
  Subcellular localization annotation: CTP_CleavageSite=51; ConfidenceScore=5.39e-01
ALSSFGYYHHHPRFIAPSPLIVVPHGGSSSSSSGPLVRPRGGPRHNHPPMGASMGEQQNNNNIVVDDADGDVDLNLSLAHSTTTSKFRGKKIPKRRRT

SEQ ID NO: 203579 - protein, 495 aa, Glycine max
  Coding DNA Sequence Number=SeqID_86801
  Gene Ontology: Mol. function=hydrolase activity, hydrolyzing O -glycosyl compounds; Cellular component=cellulose and pectin -containing cell wall; Biological process=carbohydrate metabolic process
  Homolog annotation: Hit_ID=Q6RXY3; Match level="QueryCoverage=88%, HitCoverage=56%, E-value=0.0, Identity=82%"; Hit description=Beta xylosidase
  Pfam annotation: Domain name=Glyco_hydro_3; Domain location=8-247; Score=150.3; E_value=5e-42; Accession=PF00933.12; Description =Glycosyl hydrolase family 3 N terminal domain
  Pfam annotation: Domain name=Glyco_hydro_3_C; Domain location=319 -495; Score=160.6; E_value=4.1e-45; Accession=PF01915.12; Description= Glycosyl hydrolase family 3 C terminal domain
  Pfam module annotation: Pfam domain module=Glyco_hydro_3::Glyco_hydro_ 3_C; Domain location=8-247::319-495
MECIVCLLVSKTTFIIPVGSSAKGQRINQYKDFSFQNKKKYIYFTGTVLAIRRHALKVVSDEARAMYNGGQAGLTYWSPNVNIFRDPRWGRGQETPGEDPTLAAKYAASYVKGLQGDGAGNRLKVAACCKHYTAYDLDNWNGVDRFHFNAKVSKQDLEDTYDVPFKACVLEGQVASVMCSYNQVNGKPTCADPDLLRNTIRGQWGLNGYIVSDCDSVGVFFDNQHYTRTPEEAAAEAIKAGLDLDCGPFLAIHTDSAIRKGLISENDLNLALANLITVQMRLGMFDGEPSTQPFGNLGPRDVCTPAHQQLALEAARESIVLLQNKGNSLPLSPSRLRIVGVIGPNTDATVTMIGNYAGVACGYTTPLQGIARYVKTAHQVGCRGVACRGNELFGAAEIIARQVDATVLVMGLDQTIEAETRDRVGLLLPGLQQELVTRVARAAKGPVILVIMSGGPVDVSFAKNNPKISAILWVGYPGQAGGTAIADVIFGATNP

SEQ ID NO: 203580 - protein, 128 aa, Glycine max
  Coding DNA Sequence Number=SeqID_86802
  Gene Ontology: Mol. function=hydrolase activity, hydrolyzing O -glycosyl compounds; Cellular component=cellulose and pectin -containing cell wall; Biological process=carbohydrate metabolic process
  Homolog annotation: Hit_ID=Q6RXY3; Match level="QueryCoverage=81%, HitCoverage=13%, E-value=9e-44, Identity=80%"; Hit description=Beta xylosidase
  Subcellular localization annotation: CTP_CleavageSite=53; ConfidenceScore=5.21e-01
MVAPGKAPPNLVPGPTLETPWSASDHHSYPWMPSLGTAMALLTTSLIFSGNVSLAMRSCTLTWIGTCVLQNLNPLVSPFLGSHAKGTLPSVTLGKKVRVTQSTSPRAKGELRLSMGFWGAQKQKKLLT

SEQ ID NO: 203581 - protein, 71 aa, Glycine max
  Coding DNA Sequence Number=SeqID_86803
MDGERMSEMEEMECGHYVDHGYVSNWGMQCNSHTGEAPLGKDKSYETEKKGSMRRIHWLMKNEYGKMTHNC

SEQ ID NO: 203582 - protein, 176 aa, Glycine max
  Coding DNA Sequence Number=SeqID_86804
MGFTLVDLQKVEDPNGCRWSVVLQGRAIFIGDHIDSSTVDVSDIPPFLKDMPFITDEKPKDNVYANRTDHEEGLWENFPLLMATPPRSPSNSKNPPEVTSKRNRQSIRLKSLTTISLDNPRLVVNINPTAGRGSGPHKEKFHSYLGVVAREKIPIVHSNWNVVLDDLKKLIWEDIL

SEQ ID NO: 203583 - protein, 85 aa, Glycine max
  Coding DNA Sequence Number=SeqID_86805
  Subcellular localization annotation: CTP_CleavageSite=55; ConfidenceScore=5.10e-01
MSLPSAVHVSSTFESGAPRMSLPSTVRQFSILHFYSETHECRTKSMSYLCFPLISDERYWAPFVAQYVKSRDVPKNQKEAGLRDP

SEQ ID NO: 203584 - protein, 156 aa, Glycine max
  Coding DNA Sequence Number=SeqID_86806
  Gene Ontology: Mol. function=nucleic acid binding; Cellular component= nucleus; Biological process=DNA integration
MTYEKKSGSNVLMGNDAPFHHVPQLKRNLVSAGVMDSKGFSCEVKGGVMQITRKGKFVVMQGTKQGNLYIFLWSTMTESVFAISQSRSHVSSGSFDNSLWHLRLGNMSEKGLDILSKRGLLGNHKVFERVPSLGGARHFLTIIDDYSRMTWVFMLK

SEQ ID NO: 203585 - protein, 212 aa, Glycine max
  Coding DNA Sequence Number=SeqID_86807
  Gene Ontology: Mol. function=protein binding
  Homolog annotation: Hit_ID=P0A8D3; Match level="QueryCoverage=70%, HitCoverage=99%, E-value=2e-67, Identity=84%"; Hit description =UPF0178 protein yaiI
  Pfam annotation: Domain name=DUF188; Domain location=1-146; Score =289.6; E_value=5.8e-84; Accession=PF02639.5; Description =Uncharacterized BCR, YaiIYqxD family COG1671
MAIWVDADACPNVIKEILFRAAERVQMPLTLVANQNIRVPPSRFIRSLRVPAGFDVADNEIVRLCSADDLVITADIPLAAEVLEKGAAALNPRGERYSPSTIREKLTMRDFMDTLRASGVQTGGPDSLSQRDRQQFAAELDKWLLECDLHRVVIPYRFAVNHPASRGTPGYDPTHLFSWPPRLWENHRWSGAGTRVSSPVCGYRPQAANRGR

SEQ ID NO: 203586 - protein, 79 aa, Glycine max
  Coding DNA Sequence Number=SeqID_86808
MSHCKREEPTAERVNRVRKNETRRENESHARERVAGEKMRSMKEENDQLVATSISTATAQRIPAGDKHRLLNSLLMHYS

SEQ ID NO: 203587 - protein, 117 aa, Glycine max
  Coding DNA Sequence Number=SeqID_86809
  Homolog annotation: Hit_ID=Q6ZJ66; Match level="QueryCoverage=34%, HitCoverage=9%, E-value=4e-07, Identity=59%"; Hit description =Putative microtubule-associated protein
MQQRCLYYDANILMKYYGLSTKQYEIGVISIDSVCICLLISILQYCIFLIDGGNQFVVTLICRSNKSGKSYSRNSPAGEIDHSDLLLSMDEQISRAKEEASSRKAIMEKWVLACDEE

SEQ ID NO: 203588 - protein, 170 aa, Glycine max
  Coding DNA Sequence Number=SeqID_86810
  Gene Ontology: Mol. function=RNA-directed DNA polymerase activity; Biological process=RNA-dependent DNA replication
MSRCQANNSKEEENGRREVPSISTRGLQTNAIPIHLGGGLHQWLSKLWSKSLMVGRNLEVYVDGMVIKFNDLSIHIKDLEEVFAQLRKYSMRGKFLGLMITHKGIDANLDKCQAIFEMRSHMNLEEAQWLASCITSLFRFLPRIAKKRLIMYLLVSAEALGAVLKSMTMS

SEQ ID NO: 203589 - protein, 82 aa, Glycine max
  Coding DNA Sequence Number=SeqID_86811
MSLITSTLADFNAIDPVVISVEITNYMRIARECYMTSLKLGLLTKDKPRKAVHYVEIVTRDEGLEELEFDPRTNDDNRGQTS

SEQ ID NO: 203590 - protein, 161 aa, Glycine max
  Coding DNA Sequence Number=SeqID_86812
  Homolog annotation: Hit_ID=Q10MM5; Match level="QueryCoverage=100%, HitCoverage=18%, E-value=2e-20, Identity=38%"; Hit description =Expressed protein
MGVEKDGTKSGGGYVGGFFQLFDWSSKSRKKLFAAKSDLPESLKLGRKVDYNVVDEDEIGVGASVRGSCDHSYASSVTDDDAYGTRAPSVVARLMGLDSLPPSSFSDPYSTPYFDTRSLQDSHYFKKNLGHQHDHHTPYSGKLVEKVEGSSRNFMDPKPQK

SEQ ID NO: 203591 - protein, 587 aa, Glycine max
  Coding DNA Sequence Number=SeqID_86813
  Homolog annotation: Hit_ID=Q10MM5; Match level="QueryCoverage=98%, HitCoverage=61%, E-value=5e-40, Identity=28%"; Hit description =Expressed protein
  Subcellular localization annotation: CTP_CleavageSite=38; ConfidenceScore=5.20e-01
MTGQKEHPDVKSNQPMKATVQKNLHKKSSVQNSSGALRQNNLKQNYSIDRDKLPSKPLVTNSHNRKVPTGDSSYGRHRSSSNKSNAKSKVGSRKSAMEVTDSEKEVLYTSTNSFPRKKRSTDKDWNDRVVDNLFIEKTQKPAKSNPVSNKQSSWTEEVKKKDMDVVSFTFTTPLTRNNPGFETSGQAGQNTNGLSLDQCIKRVLLDPDNTKSPIGYNIIGGGDALGILLEQKLSELTNMEITCHDSSKVRQPAITAPMSDDQVARHNIVNLNPRLRQKKDQGVLFSDKLSSNYDSDISFTGPPELSLTRNSWIDEMESQLLNCRHPSPISVLEPSFSIESCESSLSTDITSTEGVLILNLLSGSKLSSSVQAHEVHGLSFSRKFYPCESDTELSDSASSTLAGNMMRKHTSTTFSVTRFGRSSTWELNYVKDILCNVELMYVDFSLGQASEVIDSHLFKQLEGCKGGFKRDDESRMRRKVTFDCVSECLGLRCRRYVGGGYKMWTKGFEMVKRKEWLAEDVYKEISGWSGMGDSMVDELVDKDMSSQYGRWLDYEVDASELGSEVVDQIFNSLVDDVVTEMLQLYTP

SEQ ID NO: 203592 - protein, 237 aa, Glycine max
  Coding DNA Sequence Number=SeqID_86814
  Gene Ontology: Mol. function=DNA binding; Cellular component=nucleus; Biological process=regulation of transcription, DNA-dependent
  Homolog annotation: Hit_ID=Q9FJ07; Match level="QueryCoverage=94%, HitCoverage=72%, E-value=6e-16, Identity=30%"; Hit description =Similarity to myb-related transcription factor
WSVIAGHLPGRTDNEIKNYWNSHLRRKIYCFMRSLNESLPPIDMAAINSATSKRRVRGSRNKPTTEEEKNIALSQNSFESMPSCNREEGEEISMMDACYEMEGITVSSKAASYPSLEDSLGPYHHWSDDEIMKLSNMFENGVLVNPCGNDLTLKEEPNGNECGQMNVDVMGTDQSKNNGVWNSSNGESGEWYPNCSSVNSVIDYQWSDWDMGGSVQSNNQWNLCDDQVMNCLWSTGI

SEQ ID NO: 203593 - protein, 88 aa, Glycine max
  Coding DNA Sequence Number=SeqID_86815
  Gene Ontology: Mol. function=transcriptional activator activity; Cellular component=nucleus; Biological process=regulation of transcription, DNA-dependent
  Homolog annotation: Hit_ID=O22264; Match level="QueryCoverage=98%, HitCoverage=23%, E-value=2e-40, Identity=81%"; Hit description=Myb family transcription factor
  Pfam annotation: Domain name=Myb_DNA-binding; Domain location=14-61; Score=44.7; E_value=3.1e-10; Accession=PF00249.21; Description=Myb -like DNA-binding domain
MGRSPCCEKVGLKKGRWTAEEDKILTDYIQENGEGSWKILPKNAGLLRCGKSCRLRWINYLRADVKRGNITPEEEEIIVKLHAVLGNR

SEQ ID NO: 203594 - protein, 60 aa, Glycine max
  Coding DNA Sequence Number=SeqID_86816
MAGYDKEDYFSAPNAESDIAARVYFHWCTVYITLYPCTLSSFIVVVPCYSHVKQIIARNI

SEQ ID NO: 203595 - protein, 228 aa, Glycine max
  Coding DNA Sequence Number=SeqID_86817
MASTTCLLPRLLFTMLQDCYCLTVGTVGEIIIDAPWSYDSCPNCTTTFDPSKGGSACRSCHTSVVDTVPRMEHNGDKGNFVLWDATCIKLFGKTAGECQDELIVAGDDIKVFPTCVDEILLKTWAVRFKFRSQLCQSSVLDVSEELHHIQSLIATLGLKEQSNKGKGIAVEPESSPPIFVPTSSDYDPGNSTCLTPTKRISCQQTSSDFDSDEHAQYQLSTNKHIKAE

SEQ ID NO: 203596 - protein, 249 aa, Glycine max
  Coding DNA Sequence Number=SeqID_86818
MEKSLKVQDKKSTKNNISRDLLQKHRKDPLQEVEPPKNEFQKKISREIDIKMVAEKVSPRLSVWDAVKKKGFKLYYNEEMPSRKMKKLFRIPDDAYDVKTFWNQTVWMDPQKSSTYGYDRGDNVEHHDVIQELHPVRKNHFYDACVCFTKDMLPQSKLKHLLKLWTTLLYVGSSFTNNGVMNETPEESNAAIVDEVEHTVIELASKLSTTSNEATSRGKGEPDVVIIYSTSLGPTPLNYAQPAIVTRDQ

SEQ ID NO: 203597 - protein, 184 aa, Glycine max
  Coding DNA Sequence Number=SeqID_86819
MENLTFDLPHTIYINILRNLKGLGGLDNIYYTTLINTMLRDQGVYHVFNKIDEDSKHTLINKGLVVAKQQKFRKTKLKPMKVALEQSHKEDLLVDLDTINKRKLKRLAKTIADENQGLNSFSISKKIRRFWLSNRRDKRQGSNPKMKKRRKSYLPGNIGQRKDIIYLLHPPLCVQQLQPQSHKG

SEQ ID NO: 203598 - protein, 124 aa, Glycine max
  Coding DNA Sequence Number=SeqID_86820
MQQGQAYIPIVRFPDPPTMEKGLEVKITLEKLQNEGLGIFSIESLRRILRIPLGLQRSSWCGGSSASNGGSWWPSVVVGGGEEGVRIWISLNELVSLSGSPLFALSATIHAKRNSLYTNSRLAC

SEQ ID NO: 203599 - protein, 205 aa, Glycine max
  Coding DNA Sequence Number=SeqID_86821
MAGKRLQIKRKNMITLTQIWMSFILSNVLLSDHNSDLTLPKCQLIYNIMEHISVHVVQLISDALHQFVIIEPPGHPVDPEKSNKALGFPALVIGTVTGASSSASGSSRCPTTTTIAILGVHLSTPAKDGALDAHLHASFSLSTSIKSQGLDADPNPYPWPTPEKFRATVAWLEDMPIFQEEAGPADVQEAAQGDGARVEEDEDMA

SEQ ID NO: 203600 - protein, 118 aa, Glycine max
  Coding DNA Sequence Number=SeqID_86822
MHYYFVVSSHKADLNLSHLCMLGSLLGSSVEVWLDSTDNKPHFPVDNHQVLNSGYSNGHHHRSHILELVELDELGVFSMIHLVDIVEEVGLFVWLRPLFAESRVYSEQELHSKYLAPL

SEQ ID NO: 203601 - protein, 102 aa, Glycine max
  Coding DNA Sequence Number=SeqID_86823
MVARGGHRWSWVVEKEVLGFGWRFGEESEKSCFHAEESGQFSRSAIPSPVEIALSAPFMLRETSKVVIFKLPTARLWINVLGSSRQNLKMIQRLTNPGSRFY

SEQ ID NO: 203602 - protein, 184 aa, Glycine max
  Coding DNA Sequence Number=SeqID_86824
  Homolog annotation: Hit_ID=Q9AVH2; Match level="QueryCoverage=44%, HitCoverage=29%, E-value=3e-26, Identity=85%"; Hit description =Putative senescence-associated protein
AQGGGGAWSSVRPGTHLVSTRQAKRERADERVCWRFGGEGRIKATRAESQWIVAARPLCHLQYPVAYLSRLQGFYPPLDGNCASRRLVGLIRLTRVTNGTTKGSIGHAFTVRIRTGNQNQTSFYPFVPHEISVLVELILGHLRYLLTDVPPQPNSPPDNVFRPDRPAEADLGSKKRGSAPLPIL

SEQ ID NO: 203603 - protein, 205 aa, Glycine max
  Coding DNA Sequence Number=SeqID_86825
  Gene Ontology: Mol. function=inositol or phosphatidylinositol phosphatase activity; Biological process=abscisic acid mediated signaling
  Homolog annotation: Hit_ID=Q1SGC6; Match level="QueryCoverage=100%, HitCoverage=37%, E-value=2e-72, Identity=61%"; Hit description =Inositol polyphosphate related phosphatase
MKARRGKRSEAFWPSIVMKKWLNIKPKVNDFSEDEVDTETESEDDDASPCKGRKTRHRRGKSETLRAQYINTKEMRVTIGTWNVAGRHPCEDLEIDDWLCTEDPADIYIIGFQEVVPLNAGNVLGAEDNTPIPKWEAIIRRSLNKSSEPDSKHKSYSAPPSPVLRTSSAADLLADTIDADNPIPIDMMIEEYVATVDNNEMEQQE

SEQ ID NO: 203604 - protein, 65 aa, Glycine max
  Coding DNA Sequence Number=SeqID_86826
MSFGFIGRSGYNFLVIITGHKGPTFLGFVARSGNNFLVVITEHKEGDSFVFWSSLVQQEESEDDA

SEQ ID NO: 203605 - protein, 88 aa, Glycine max
  Coding DNA Sequence Number=SeqID_86827
MEAWGSVKDCPTRSKYEGHVKMFEIICSPWEYFLEVESAHWSLKRLIHNSIGNLCKCWDAINNLIILQHTEINASFEKSDVPLFSPIS

SEQ ID NO: 203606 - protein, 112 aa, Glycine max
  Coding DNA Sequence Number=SeqID_86828
MENNGGLWWIMVVMGDGESPWDVRNGFGRKKEEEMTFFLSYTKAKADTLNCKPNVEKLQRLTKAGQRFYRGCYTNHHRRPWIRAWRKKEMNEWRGREEHKILCSKRALKSEV

SEQ ID NO: 203607 - protein, 500 aa, Glycine max
  Coding DNA Sequence Number=SeqID_86829
  Gene Ontology: Mol. function=RNA-directed DNA polymerase activity; Biological process=RNA-dependent DNA replication
MERRQEEELTKLKADYGRLEACAKCPQDDDQSSYTLPKRTQGESHPRRTGNTADDLSPSYMHHLAAQTVCQHPFVDLIMEEDIPLGWKPLNLEWYDGTTDPDEHLDAFLTQTNLYTNNDAILCCVFLRSLKGATLTCTPLVGLTAWPQLPWPVYDKQTMSLSESSWTDLGARPSRSKISILRQKHDKREAHTKPDSHKLDKRHKPNKHQPLSKGPSIQLGVTYPATLDETSLAGLDATKCYRYLHGIGHNIEDYWALKDKIEELIHAEYLAQFVKRSDNHQVGPRHGRHPEEQNRNQEVDRRRAEDKGKPRQQQQRRERQPPPEQESAQHIRGVINSIVGGFSYGGQSSQDFKGINPVNQDDLVVVSIIIENFMVSKVLIDQGSSTDILKTLNELRAIVSTPHLTMKFPTLTWEIATVKVDQKQTRQCYTKSLKVTLYPPIWEPSMPHPTATEGTQVMTVDEGSQIRALTVYQSSLNREFDIDPQDETSDRDPKPIKELV

SEQ ID NO: 203608 - protein, 75 aa, Glycine max
  Coding DNA Sequence Number=SeqID_86830
  Subcellular localization annotation: CTP_CleavageSite=31; ConfidenceScore=5.21e-01
MTNEEQCRSRLRSPFGSASTSFFFYFFFFSRISLNFSQCWTLEPLTQPPSHLFIAKDGIRGHGSLPRRARVQKKA

SEQ ID NO: 203609 - protein, 283 aa, Glycine max
  Coding DNA Sequence Number=SeqID_86831
  Homolog annotation: Hit_ID=Q1SP02; Match level="QueryCoverage=39%, HitCoverage=24%, E-value=9e-15, Identity=41%"; Hit description=IMP dehydrogenase/GMP reductase
MVRTRELRRALGRVIGQGLGTQVSGDVDEAPQRLRSIAFATDAVHEQPREAVINDVHAEAQGFASGPPRYISFDGICSSCGSHSLEHPKLKLSSHERKVQKFERSTPKIEGIVVTTRLSPLIACSLDIGDRGLIFAFGERWHKETSSFHLLPNWKLLMGSSYTGPYCWIYKHFPTIVSCIVNEDYHERKPCVCCWKSGKALSVSTYRKRLDKLTSKVVCRIPYGYHRTFREFELISLFFGQIRWGPSIVIHQPERVMQQFGYVQTIPPHPVVLSLSIKEIDDK

SEQ ID NO: 203610 - protein, 143 aa, Glycine max
  Coding DNA Sequence Number=SeqID_86832
  Subcellular localization annotation: CTP_CleavageSite=83; ConfidenceScore=5.55e-01
MKLSLKFQAENAAKGTHHHTQQPLSLRRHSHRLPQPTLPSSSTSNPNSVISLSTKHPEFSPMDLPPRLLKGMCFWMGRDLEIVEKENREMKRLLDEMKLGRNNRLEESKGGGRKLSESNGEVQRWRSYKSERQECNNQTNRKV

SEQ ID NO: 203611 - protein, 541 aa, Glycine max
  Coding DNA Sequence Number=SeqID_86833
  Gene Ontology: Mol. function=transporter activity; Cellular component= membrane; Biological process=oligopeptide transport
  Homolog annotation: Hit_ID=Q1SGD4; Match level="QueryCoverage=99%, HitCoverage=89%, E-value=0.0, Identity=85%"; Hit description=TGF -beta receptor, type I/II extracellular region; Major facilitator superfamily MFS_1
  Pfam annotation: Domain name=MFS_1; Domain location=2-479; Score =13.9; E_value=7.3e-05; Accession=PF07690.6; Description=Major Facilitator Superfamily
  Pfam annotation: Domain name=PTR2; Domain location=60-463; Score =300.3; E_value=3.5e-87; Accession=PF00854.12; Description=POT family
  Pfam module annotation: Pfam domain module=MFS_1::PTR2; Domain location=2-479::60-463
  Subcellular localization annotation: CTP_CleavageSite=24; ConfidenceScore=5.08e-01
NQALATLAFFGIGVNLVLFLTRVVGQNNADAANNVSKWTGTVYIFSLVGAFLSDSYWGRYKTCAVFQGLMSLSLSSYLFLLKPKGCGNESVNCGKHSKLEMGMFYLSIYLVALGNGGYQPNIATFGADQFDEEHSKEGHNKVAFFSYFYLAFNIGQLFSNTILVYFEDEGMWALGFWLSAGSAFAALVLFLVCTPRYRHFKPSGNPLSRFSQVLVAASRKSKVQMSSNGEDLFNMDAKEASNNANRKILHTHGFKFLDRAAFISSRDLGDQKGLGYNPWRLCPVSQVEEVKCILRLLPIWLCTIIYSVVFTQMASLFVEQGAAMKTKVSNFRIPPASMSSFDILSVAVFIFFYRRVLDPFVGKLKKTDSKGLTELQRMGVGLVIAVLAMVSAGLVECYRLKYAKQGCIHCNDSSTLSIFWQIPQYAFIGASEVFMYVGQLEFFNAQTPDGLKSFGSALCMTSISLGNYVSSLLVSVVMKISTEDHMPGWIPGNLNKGHLDRFYFLLAALTSIDLIAYIACAKWYKSIQLEANTGEIDEPEV

SEQ ID NO: 203612 - protein, 141 aa, Glycine max
  Coding DNA Sequence Number=SeqID_86834
  Gene Ontology: Mol. function=peroxidase activity; Cellular component =vacuole; Biological process=response to oxidative stress
  Homolog annotation: Hit_ID=Q1SGC7; Match level="QueryCoverage=98%, HitCoverage=43%, E-value=7e-68, Identity=86%"; Hit description=Haem peroxidase, plant/fungal/bacterial
SHTIGRARCLSFRQRIYDAKEEYHYGYDHYKRYTSFRRILRSICPVEGRDNKFAPLDFQTPKRFDNHYFINILEGKGLLGSDNVLISHDLDGKITEQVWAYASNEKLFFASFAKSMIKMGNINVLTGNEGEIRRNCRFVNA

SEQ ID NO: 203613 - protein, 243 aa, Glycine max
  Coding DNA Sequence Number=SeqID_86835
  Gene Ontology: Mol. function=metal ion binding
  Homolog annotation: Hit_ID=Q9C965; Match level="QueryCoverage=57%, HitCoverage=34%, E-value=4e-35, Identity=53%"; Hit description =Putative RING zinc finger protein; 53384-54880
MKIALIPSPLSRYSIFGGLPLCATTHFTSYISYEAAKPLFFLHHRMKTLVEYFKISLDCFFAVWFVVGNVWIFGGHSSVEEAPNLYRLCIVFLAFSCIGYAMPFILCSTICCCLPCIISILGVREDMSQNRGAASESINALPIYKFKTKKNKRNGDSNSAAAEGGVVAAGTEKERVISGEDAILPWHPLPWWFSTLRTPAIRWHPTAGRADLDEEESLRRRTLSPLPKTPTRMEMGMMRERGQ

SEQ ID NO: 203614 - protein, 83 aa, Glycine max
  Coding DNA Sequence Number=SeqID_86836
MKLECWSSCTAQNYVLMMMLWDLDNILQGSGNTQRNEAGGAVDSDDDEMDLDDDPSKINKGNKRKNANNGNALGGSNNFFADL

SEQ ID NO: 203615 - protein, 84 aa, Glycine max
  Coding DNA Sequence Number=SeqID_86837
  Homolog annotation: Hit_ID=Q5ZEA1; Match level="QueryCoverage=45%, HitCoverage=4%, E-value=5e-07, Identity=66%"; Hit description=Beta adaptin-like
MSMRKLHSFGNVPNGIVKDLIKTLREVIHEEYHEVVERHDVRDRTLFYYKFLQYNVSMANSVVNPAKQAVSVIVDTQGSEIIIQ

SEQ ID NO: 203616 - protein, 75 aa, Glycine max
  Coding DNA Sequence Number=SeqID_86838
MTQLVSRGHLRVGPLRFLEARLMSQVYESKKDHVEGRGLDSRKKESHGDSTSGGFNLFSVSLTFENSIGAVGGKT

SEQ ID NO: 203617 - protein, 84 aa, Glycine max
  Coding DNA Sequence Number=SeqID_86839
  Homolog annotation: Hit_ID=Q1SWK0; Match level="QueryCoverage=89%, HitCoverage=18%, E-value=1e-08, Identity=34%"; Hit description =Nucleic acid-binding, OB-fold
MDKRLSLISGIVVGKVPWKLKDHVIRRWALLESRIANQFNSIEMLLPDEKSGKIHATIRKHLVDRFKNVLLEGSCYINENLLVS

SEQ ID NO: 203618 - protein, 92 aa, Glycine max
  Coding DNA Sequence Number=SeqID_86840
MEITIIHIDNEPSIYVEDFFDIPEPEKGTKVVLSNDSIAKAIRCLHKGGVDNIYYVAMINKVLWNQGIYRIVERMDKDSKHTIVAKGSVVAK

SEQ ID NO: 203619 - protein, 92 aa, Glycine max
  Coding DNA Sequence Number=SeqID_86841
  Gene Ontology: Mol. function=RNA-directed DNA polymerase activity; Biological process=DNA integration
  Homolog annotation: Hit_ID=Q1SMW8; Match level="QueryCoverage=80%, HitCoverage=4%, E-value=1e-20, Identity=60%"; Hit description =Integrase, catalytic region; Zinc finger, CCHC-type; Peptidase aspartic, catalytic
MVGSLRRGDFKLKSFCDADYVGDKVERKNTSGSCHSIGGNLVIWICKKQGSIALSIAEVEYMSTASYYAQLLWIKNLLEDYNIYEFPFIVIK

SEQ ID NO: 203620 - protein, 67 aa, Glycine max
  Coding DNA Sequence Number=SeqID_86842
MEEQLAFVSTAKEEGATIQVEAFVKVVDDNIVNKVIIDLINTGVMNESPEVSNAAIADEVVHQDKEY

SEQ ID NO: 203621 - protein, 45 aa, Glycine max
  Coding DNA Sequence Number=SeqID_86843
MMINIVTSIIPDEEAFNEDFVKGILQESGNLKRVAWGLDVGTGRG

SEQ ID NO: 203622 - protein, 240 aa, Glycine max
  Coding DNA Sequence Number=SeqID_86844
  Gene Ontology: Mol. function=phosphoric monoester hydrolase activity; Cellular component=chloroplast; Biological process=amino acid biosynthetic process
  Homolog annotation: Hit_ID=O82796; Match level="QueryCoverage=73%, HitCoverage=57%, E-value=7e-76, Identity=80%"; Hit description =Phosphoserine phosphatase, chloroplast precursor
  Pfam annotation: Domain name=Hydrolase; Domain location=82-238; Score= 7.1; E_value=0.012; Accession=PF00702.16; Description=haloacid dehalogenase-like hydrolase
  Subcellular localization annotation: CTP_CleavageSite=54; ConfidenceScore=5.33e-01
MEGLVSSGINTVRVFSITNHQSRFLPSSTLHLRNNSLCGFGIGVEKKNKQCSVVAASVGGSKVGHFENTLPSKEVLELWRNGDAVCFDVDSTVCLDEGIDELAEFCGAGKAVAEWTARAMGGSVPFEEALAARLSLFNPSLSQLQNFLEQKPPRLSPGIEELVQKLKANGIVVYLISGGFRQMINVQRILPVASILGIPQENIFANQLLFGSSGEFLGFDKNEPTSRSGGKAVAVQQIKK

SEQ ID NO: 203623 - protein, 115 aa, Glycine max
  Coding DNA Sequence Number=SeqID_86845
  Gene Ontology: Mol. function=RNA-directed DNA polymerase activity; Cellular component=chromatin; Biological process=RNA-dependent DNA replication
VDLGESLALGLEVVQQITEKCQIDSGEDESSPELVALPPSLSNLHSVFHIPQLKKYVHDSSHEIELDDVQVKENLTYETLPLRIDNHKVKQLRGREIPLVKWYGEMLMARMLLGS

SEQ ID NO: 203624 - protein, 518 aa, Glycine max
  Coding DNA Sequence Number=SeqID_86846
  Gene Ontology: Biological process=regulation of GTPase activity
  Homolog annotation: Hit_ID=Q1SD19; Match level="QueryCoverage=89%, HitCoverage=70%, E-value=5e-19, Identity=24%"; Hit description=Arf GTPase activating protein
MAKFSPEEVTALQAGGNERAKQIYFKEWNPLRHSHPESGPHSCPGASSDDKNLRFLYDESRSPRYTQKYSRNAGLTKSPIKIEVVDDRFRDKEHRNRRLSNIESKLKQISIDDQKNVDKSQLPVARPSGEILREKASSLQVSHSGGKGSVEENPSEQKNNNPERSINLSTKSQPTNSVAGGGPESPPHITQSNENNWAIFGASTENKDPKSPNTNTSKPSTTNAASEAATPAKNPLDLLLFELSGPVTPVTGEMSQAASGTNNDPTTTTVDNANIWDFPPTSVGKTGPSPNNTSVWSSTLTPATESAQPSNEVLPHSEVSHAHKPSSMHYLPSVSSGCSKTTPLINSPVKDVASNNQPSVAPSTNDSLWALTEQSPQTTSSMQCLPPVPAVAPSTNNSSWGFTELSSQATSKPTQETKPDAGSQLSKVETRSSGRMELPEDLFTSSYLSGPASLAGWQNVQPYGMGYGMQYYQNAAPPSALPNAPKYSNPFDVTDGRSLMHVSSLVSAIKPEASDAIR

SEQ ID NO: 203625 - protein, 101 aa, Glycine max
  Coding DNA Sequence Number=SeqID_86847
MARTKNGARTLSWKSNVNSTISTNVLDKHNINADIHSLVDLVKLRVDHLPPMLRYVDLRLCGYGDLDPKCHKEGKSSQIHEGFGKMKKIGRIFAIIVLLRS

SEQ ID NO: 203626 - protein, 433 aa, Glycine max
  Coding DNA Sequence Number=SeqID_86848
  Gene Ontology: Mol. function=transporter activity; Cellular component= integral to membrane; Biological process=transport
  Homolog annotation: Hit_ID=Q6Z1Z0; Match level="QueryCoverage=91%, HitCoverage=92%, E-value=1e-111, Identity=50%"; Hit description =Putative sulfate transporter-like
  Pfam annotation: Domain name=BenE; Domain location=57-408; Score= -290.6; E_value=0.037; Accession=PF03594.4; Description=Benzoate membrane transport protein
  Pfam annotation: Domain name=Sulfate_transp; Domain location=130-413; Score=-103.6; E_value=0.00031; Accession=PF00916.10; Description =Sulfate transporter family
  Pfam annotation: Domain name=Xan_ur_permease; Domain location=53-401; Score=-162.6; E_value=0.046; Accession=PF00860.11; Description =Permease family
  Pfam module annotation: Pfam domain module=BenE::Sulfate_transp::Xan _ur_permease; Domain location=57-408::130-413::53-401
  Subcellular localization annotation: CTP_CleavageSite=38; ConfidenceScore=5.32e-01
MANQNPSIPISTHETTQTTSTTRFSFKVILQKVKTNLVLRSKWGELNGAMGDLGTFIPITLSLTLSRDLNLGTTLIFTGIYNIITGAIYGVPMPVQPMKSIAAEALSDSGFGVAEIMAAGILTGVVLFLLGVTRLMQLVYTLIPLCVVRGIQLAQVCLCFIVIVSGAGEKDQCDGESESLGKRVEEARNMRKNRVRRLVFSLPSAFIVFMLGVVLAFIRRPKVVHEVKFGPSSMEVVKFSKHAWKKGFVKGTIPQLPLSILNSVIAVCKLSKDLFPEREFSATSLSVSVGLMNLVGSWFGAMPCCHGAGGLAGQYKFGGRSGGCVALLGVAKLVLGLVLGTSLAHILRQFPVGILGVLLLSAGIELATCCRDIRTKEDSFVMLVCTAFSLVGSSAALGFSCGMAVYVLIKLRSWTINDKPFSTIWVHKSSEQL

SEQ ID NO: 203627 - protein, 94 aa, Glycine max
  Coding DNA Sequence Number=SeqID_86849
MVFLRTITPQNGLNLVHKLQHFATIALGLDNDKAGVVKFVCHGGAREEGEVGKTEGSEEGRGYTVVGDMEGALVGARTCKGILIEVERESESEK

SEQ ID NO: 203628 - protein, 161 aa, Glycine max
  Coding DNA Sequence Number=SeqID_86850
  Homolog annotation: Hit_ID=O22784; Match level="QueryCoverage=59%, HitCoverage=32%, E-value=4e-13, Identity=39%"; Hit description =Expressed protein
  Pfam annotation: Domain name=DUF26; Domain location=33-89; Score =13.1; E_value=0.00014; Accession=PF01657.8; Description=Domain of unknown function DUF26
  Subcellular localization annotation: CTP_CleavageSite=20; ConfidenceScore=5.17e-01
MQGQYSQNVKTLLDSLMSVSAQKSFTATTPNALTRAYQCRGDLSNSECYNYINKIPNMLGHLCSDDDVVAAWVQLSKCYLRYEVVEFKVVPATQLLYKIMEVVSRVLRNWLCLARNHYINLFNTPPRVLDCLLERAPTPPLVASMVTILPFASLTTDLPRI

SEQ ID NO: 203629 - protein, 60 aa, Glycine max
  Coding DNA Sequence Number=SeqID_86851
MALLSRDRSLTYWLEDPTEPNTTLSWNVIHGIGMITHDILSSPSYYVALGNLDEDAEVFL

SEQ ID NO: 203630 - protein, 119 aa, Glycine max
  Coding DNA Sequence Number=SeqID_86852
MVRRQATAARGSHRWSWVVEKKVLEFGWAFGEEERGKNRVFHAEEHIYNLQISLSKLVSLSESSLFTLSVRIHAECNSLYSNSHSVQFPLRVYAGKREGVGRARRKNEFERKRKSRDVS

SEQ ID NO: 203631 - protein, 257 aa, Glycine max
  Coding DNA Sequence Number=SeqID_86853
  Gene Ontology: Mol. function=protein serine/threonine kinase activity; Cellular component=integral to membrane; Biological process=protein amino acid phosphorylation
  Homolog annotation: Hit_ID=Q2HV99; Match level="QueryCoverage=81%, HitCoverage=36%, E-value=1e-59, Identity=48%"; Hit description =Protein kinase; Type I EGF
  Pfam annotation: Domain name=Pkinase; Domain location=1-207; Score =53.3; E_value=7.9e-13; Accession=PF00069.15; Description=Protein kinase domain
  Pfam annotation: Domain name=Pkinase_Tyr; Domain location=1-207; Score=9.7; E_value=4.6e-13; Accession=PF07714.7; Description=Protein tyrosine kinase
  Pfam module annotation: Pfam domain module=Pkinase::Pkinase_Tyr; Domain location=1-207::1-207
MMKRSTIGSGGYGTVFKGILANNKVVAIKKFKVVDHNQVEQFINEVVILSQINHRNVVKLLTCLRIAIEAAGALSYLHFDASTSIIHRDVKNANILLDENYTPKVSYFGASRLVPIDQVELASLGQGTFGYVDPEYMQTSRLTKKSDVYSFGVVPVELLTGQKAPSFQRSEEEKKNKEIKKVAILASKCLNLKGEERPSMKEVAMELEGTRVTENHPSNTNLDLEEAQCLNGNSNGDRSPWCDNIIEQVRVVLHVPR

SEQ ID NO: 203632 - protein, 276 aa, Glycine max
  Coding DNA Sequence Number=SeqID_86854
MGFGARFALCLRSNSHFNNSISFFSFFCSQSLTLYESDPQYQNHLQKVQKLEILLNHGRTIIAKKKTLIVFVDVVDFGILLDTVTYGKVVLAAVMLKDLNKGFELTKFMEKDGMGPSVLALTKSTKGERESLKYRLLVPRVTLVPRATSMLASSDGARLMLLVESGRIVCEAKLVDDIFQVLRPYKVVPAIALDKTGLAAVGVRFQSLSNLGSRLPSPSKTSVMSSCSSRGVSPSQSRPSIPPRRASPSRMRPSNSSNQSNNAFSVLNKMLALHIE

SEQ ID NO: 203633 - protein, 134 aa, Glycine max
  Coding DNA Sequence Number=SeqID_86855
  Homolog annotation: Hit_ID=Q8L5W5; Match level="QueryCoverage=97%, HitCoverage=22%, E-value=5e-08, Identity=35%"; Hit description =VERNALIZATION INDEPENDENCE 4
MQDAQHDQAHLFLRHDKVNFFILMDFLMNYCFPSMVYVYMLTGNPPITRKVIKENEVFKVKNCITDIDPNREKEEKEKRKKVNQKYTPVVERRHQLSPGFLEDALDEDEANIMISIILSRIEDDLEAEARAHKS

SEQ ID NO: 203634 - protein, 105 aa, Glycine max
  Coding DNA Sequence Number=SeqID_86856
MPCTSGAGEARHFGARSSRIVSTLLPKCGLGRVALTISNSTDEDMTKSKGKDPLEGLGGPMTRARARKAKEALQQVFSILFEYKPKFQGEKSKVVSCIMAQMEED

SEQ ID NO: 203635 - protein, 54 aa, Glycine max
  Coding DNA Sequence Number=SeqID_86857
MRKLIKERMENKLVNFVGLNKVVLGIKWMNGMNKGEDERKEILTLSSEGNTQRL

SEQ ID NO: 203636 - protein, 128 aa, Glycine max
  Coding DNA Sequence Number=SeqID_86858
MAVHGGKSKIYHKNMADGATENGRSFVFAIVLLFALLFVTAVRGAAGGYDAAGCGCWSLLRGVVLLPVVIAGSGGCWVWVLVRCCSVSVRGCCAFQNILSGRVRSGQTNTYREKNKKGRYSAFPAIPS

SEQ ID NO: 203637 - protein, 80 aa, Glycine max
  Coding DNA Sequence Number=SeqID_86859
  Gene Ontology: Mol. function=ATPase activity, coupled to transmembrane movement of substances; Cellular component=integral to membrane; Biological process=anthocyanin accumulation in tissues in response to UV light
  Homolog annotation: Hit_ID=UPI0000162D0F; Match level="QueryCoverage =76%, HitCoverage=55%, E-value=1e-15, Identity=65%"; Hit description =ATPase, coupled to transmembrane movement of substances
  Pfam annotation: Domain name=DUF1602; Domain location=27-59; Score =20.8; E_value=0.005; Accession=PF07673.4; Description=Protein of unknown function (DUF1602)
  Subcellular localization annotation: CTP_CleavageSite=26; ConfidenceScore=5.36e-01
MVVLPTIVLSSASCTTCSDCTSRALVASSRSSIFGLRIMALAIAILCFCPPDSCTPLSPYSVVSLDKQREVCYMNTSPFI

SEQ ID NO: 203638 - protein, 117 aa, Glycine max
  Coding DNA Sequence Number=SeqID_86860
  Subcellular localization annotation: CTP_CleavageSite=57; ConfidenceScore=5.02e-01
MGLFHQSAGPQVSSNGNVEKVTQLSEGSWTKRKQVLGWIAPAFGSLVRVLSGVLLVCCLLPNSFVYDETYNYIQPSMNSKIVPYISVIKWRLWRRHGGKAWRNFVKTPPNNGGVAGC

SEQ ID NO: 203639 - protein, 248 aa, Glycine max
  Coding DNA Sequence Number=SeqID_86861
  Gene Ontology: Mol. function=RNA-directed DNA polymerase activity; Cellular component=chromatin; Biological process=chromatin assembly or disassembly
MKEEDVSKTTFRTHHDHYEFHRMPFGLCNAPSSLQATKNSVFQPYLCKFIIVFFDDIVIYSRTYEEHLFHLEQTFQTLLAGQFFLKQSKCSFAQTQVEYLGHKFTWTTEAHNAFEQLKNAISKAPVLLLPNFAFPFVVEIDVSRVGMGVVLSQQGHPIAFFSKCFFPKLLSSSTYVREFAAITAAVKKWRQCLLGHPELRLEGHQLSHNHSVQPSLPIHTRELNMEGIHTNKEPHNNHNHPKFLLNYS

SEQ ID NO: 203640 - protein, 297 aa, Glycine max
  Coding DNA Sequence Number=SeqID_86862
  Homolog annotation: Hit_ID=Q1SQ46; Match level="QueryCoverage=38%, HitCoverage=18%, E-value=5e-13, Identity=40%"; Hit description=IMP dehydrogenase/GMP reductase
  Pfam annotation: Domain name=Alg14; Domain location=53-203; Score= -56.8; E_value=0.00094; Accession=PF08660.1; Description =Oligosaccharide biosynthesis protein
  Pfam annotation: Domain name=BRF1; Domain location=114-226; Score =30.2; E_value=1.4e-06; Accession=PF07741.3; Description=Brf1-like TBP-binding domain
  Pfam module annotation: Pfam domain module=Alg14::BRF1; Domain location=53-203::114-226
  Subcellular localization annotation: CTP_CleavageSite=46; ConfidenceScore=5.51e-01
MDKSNGCSFSSISSIAVFSSVVFVVSLIFVRLLYVLYCSSKPLSKRASKPFSTLIILGSGGHIAEMLNLLAVLQKGRFNPRFYIVVAIDNMSLQKAQLLENSLAAEYVHDESETLSDIDDEEVDLYIHDEEGKHIKKILWETANREHLEEQAAKEAAAAASKKAFEAKFENCSEDILAARELAASSTEAVAKSKKEMRQKRAYEAKNTRPAQSAAEAFGQMSNKKREQAAKEAAAAANKKAFEAKFGNCSEDILAARELAASSTEAVAKSRKVRGVHVRGYGVHVRFIVIDHFLAST

SEQ ID NO: 203641 - protein, 35 aa, Glycine max
  Coding DNA Sequence Number=SeqID_86863
MVGAFLQNRVTLTGLPMISLSEPAYDESHTGDGEA

SEQ ID NO: 203642 - protein, 183 aa, Glycine max
  Coding DNA Sequence Number=SeqID_86864
  Homolog annotation: Hit_ID=Q9LIN9; Match level="QueryCoverage=43%, HitCoverage=11%, E-value=4e-21, Identity=83%"; Hit description =Similarity to the auxin-independent growth promoter
MGLFFTARMLKNHHHFGKILSLPQHLGSPVLSARMVFYQGVPLQLLIVFLYLHVELPPENETNGYIFIHAEGGLNQQRIALRLFFFSEIHLEFDILLHSHRSLVDCCTLVGEFPSACAIPSLFYSEEIAVHDFLQHNPIVENKAKDNSFDDNVDFVVGNVKLITTKEVWDQYLEEARRDDKIV

SEQ ID NO: 203643 - protein, 118 aa, Glycine max
  Coding DNA Sequence Number=SeqID_86865
MNAHGTSQCRPLSQPLHFVRGEGPSTVLEKERIEHMEEMLCAIEGGGNYAFANMAESCLVLDMVIPPKFKVPDFDKYKGTSCPKNHLKMYCRKMGAYAKDEKLLMHFFQESFAGAAIT

SEQ ID NO: 203644 - protein, 67 aa, Glycine max
  Coding DNA Sequence Number=SeqID_86866
MQTNDVQAPLFPFIASCKQNVEFEGSSQNGRKQGTDETATAKNSASYIGKRLLESLVAVAGLIIWLS

SEQ ID NO: 203645 - protein, 72 aa, Glycine max
  Coding DNA Sequence Number=SeqID_86867
FTGVRYSVLTVLYYLCDPVHLPEAEQVLGVVAEELLFIWEGGMNILTAHDQEWEQELSPYDQYEEERTPNLE

SEQ ID NO: 203646 - protein, 107 aa, Glycine max
  Coding DNA Sequence Number=SeqID_86868
MLHSMLQSIHRGQSIIMQSLQGLGLPTIMSMEEFETQVALPGDQPSSSGRGGAFAAQEPVTEEPPAPALAPAEEETTPDQTPQSSPSFALAPEETQPLALDPNEDQP

SEQ ID NO: 203647 - protein, 219 aa, Glycine max
  Coding DNA Sequence Number=SeqID_86869
APATHSQVRYDRSRFSSLEAWERYTDIVVPRKILPERNVVIYHTKFDEFKEELEISKWDEELTSFDEGSIDVAIVRVRGHLVKFDEDTLNTFLKTPVIIEEGETLSAYSRFALLRLDPQELAAKLCIPGRGFELNLDGQPRKILRKKMTTLAQTWSVLYCSNLVPTFHTSDITLERAKFIYGIIMKMDMNLGYLISHQISIIAQHDSSRLGFLALITAL

SEQ ID NO: 203648 - protein, 85 aa, Glycine max
  Coding DNA Sequence Number=SeqID_86870
MVGAFLQNSMTLTGLPMILPSESDLTYQWMVYLVICKFNPSTELKMGQQSLGLASCVVKRGNENIGCMEILSKGINISNSIELYK

SEQ ID NO: 203649 - protein, 138 aa, Glycine max
  Coding DNA Sequence Number=SeqID_86871
  Gene Ontology: Mol. function=RNA-directed DNA polymerase activity; Biological process=RNA-dependent DNA replication
  Homolog annotation: Hit_ID=Q1SKV6; Match level="QueryCoverage=66%, HitCoverage=22%, E-value=8e-10, Identity=37%"; Hit description=RNA -directed DNA polymerase
MEKCLVKLKTKFREDPTVNEGWAAFLPRHLHGSRARYSHTMSIQRRFMWSVCKAKADGGLGEKNLAIFDASLLAKWRWRFLVEKDALWCGFLTHRYGRLDQLGERQAQSGSGGQCKGDVNGGQRSWGGVELEMAESFI

SEQ ID NO: 203650 - protein, 109 aa, Glycine max
  Coding DNA Sequence Number=SeqID_86872
MLIDVGNALACACCVCSWGALCTDLPGSLALAFGHDHTSYGVYVMGGGLSPGREHLWAPRLITYGRGAVTCTTGWSRQTQHSSLSESVVWTRLGYFLRFGCCWYVPHCI

SEQ ID NO: 203651 - protein, 80 aa, Glycine max
  Coding DNA Sequence Number=SeqID_86873
MGFEAISKSWELGQSHATIYCWIKALVKFGSCQHQNINFWSKGVIKLALNEKQLPSLIVTSKHYVHDDIRQVQGPKASNN

SEQ ID NO: 203652 - protein, 478 aa, Glycine max
  Coding DNA Sequence Number=SeqID_86874
  Gene Ontology: Mol. function=transporter activity; Cellular component= integral to membrane; Biological process=transport
  Homolog annotation: Hit_ID=Q6Z1Z0; Match level="QueryCoverage=88%, HitCoverage=92%, E-value=1e-132, Identity=56%"; Hit description =Putative sulfate transporter-like
  Pfam annotation: Domain name=MFS_1; Domain location=55-452; Score= -50.9; E_value=0.067; Accession=PF07690.6; Description=Major Facilitator Superfamily
  Pfam annotation: Domain name=Sulfate_transp; Domain location=130-458; Score=-120.0; E_value=0.0017; Accession=PF00916.10; Description =Sulfate transporter family
  Pfam module annotation: Pfam domain module=MFS_1::Sulfate_transp; Domain location=55-452::130-458
MAYQNPPSIPISDPEAPEITPTHTPSTTTPLANGFSTKGVVEKIKNNLVFHSKWGELNGAMGDLGTYVPIVLALTLARDLNLGTTLIFTGVYNIITGVIYGVPMPVQPMKSIAAQALSDTDFGVPEIMTAGLMQLVYMLIPLCVVRGIQLAQGLSFALTAVKYVRKIQDLPKSKSLGERHWFGLDGLVLAIVCLCFIVVVNGAGEKSRGCCDVVESGGGDDDLGGQKRNNEVVARSRTSRVRKVIFSLPSAFMVFVLGVVLAFIRRHEVVHEIKFGPSSIEVVKFSKHAWKKGFVKGAIPQLPLSILNSVVAVCKLSSDLFPGKDFSATSLSVTVGLMNLIGSWFGAMPSCHGAGGLAGQYKFGGRSGGCVALLGVAKLVLGLVLGTSLAHILKQFPVGILGVLLLFAGIELAMCARDMNTKEDSFVTLVITAVSLVGSSAALGFLCGMVVYVLLRLRNWTRGKPLSTIWMQKSPEQV

SEQ ID NO: 203653 - protein, 288 aa, Glycine max
  Coding DNA Sequence Number=SeqID_86875
  Subcellular localization annotation: CTP_CleavageSite=51; ConfidenceScore=5.35e-01
MAEPLKKQKGVSTSSAVTGTQSHGSSKAQTTQIPPSISSPTFFSLEEQHIRYNYLFSSHSIIDPKFVDLAFFDDEVFDCFQAFQNSGLIQFISMKLPFYPELVKAFYSNLEIPEDSLISEVYGIKMVIDQSLFFELTQLSSDGVPFEDTLDDEWKFDFSVFDARRMVCTNQADMTGRLLAGSLAFECHIMHNLIVRILLPRSSNLAQVSEEDLIIMWVFLTGHQIDWAHLAFSSTPLDSEPFVKVKRSFSIGAYVVTSFGYRKERDGSWVKKDALVQAAEDRSPSPPP

SEQ ID NO: 203654 - protein, 109 aa, Glycine max
  Coding DNA Sequence Number=SeqID_86876
MSRKKSTTLGLECRSDEVELQSVRSVVKVSCDPEGAFPIGVKLFHSGIFSGFTSDSPYKSSSFHRSLDLSSLVHRVEAIMWGPELHTSAWRCTFDRKGKPTKQMTSTLK

SEQ ID NO: 203655 - protein, 73 aa, Glycine max
  Coding DNA Sequence Number=SeqID_86877
MDDHDGLHMPTDLIVSERNKPPNRSEQHIFLKKNNVTTGEGKPADRISHNHKSDLGHLHFISKRTLEESTGFN

SEQ ID NO: 203656 - protein, 41 aa, Glycine max
  Coding DNA Sequence Number=SeqID_86878
MNEPMTKEKKEQEFVPKLLGLKFETEQDQEKKQWRRSNNSN

SEQ ID NO: 203657 - protein, 392 aa, Glycine max
  Coding DNA Sequence Number=SeqID_86879
  Gene Ontology: Mol. function=GTP binding; Cellular component =intracellular; Biological process=RNA-dependent DNA replication
  Homolog annotation: Hit_ID=Q5QN81; Match level="QueryCoverage=90%, HitCoverage=66%, E-value=1e-49, Identity=28%"; Hit description =Pentatricopeptide (PPR) repeat-containing protein-like
  Pfam annotation: Domain name=PPR; Domain location=121-155; Score =31.2; E_value=3.6e-06; Accession=PF01535.11; Description=PPR repeat
  Pfam annotation: Domain name=PPR; Domain location=156-190; Score =39.2; E_value=1.4e-08; Accession=PF01535.11; Description=PPR repeat
  Pfam annotation: Domain name=PPR; Domain location=17-51; Score=15.5; E_value=0.11; Accession=PF01535.11; Description=PPR repeat
  Pfam annotation: Domain name=PPR; Domain location=191-225; Score =42.2; E_value=1.8e-09; Accession=PF01535.11; Description=PPR repeat
  Pfam annotation: Domain name=PPR; Domain location=226-260; Score =34.4; E_value=4.1e-07; Accession=PF01535.11; Description=PPR repeat
  Pfam annotation: Domain name=PPR; Domain location=261-295; Score =29.8; E_value=9.3e-06; Accession=PF01535.11; Description=PPR repeat
  Pfam annotation: Domain name=PPR; Domain location=296-330; Score =13.7; E_value=0.18; Accession=PF01535.11; Description=PPR repeat
  Pfam annotation: Domain name=PPR; Domain location=86-120; Score=37.1; E_value=6e-08; Accession=PF01535.11; Description=PPR repeat
  Pfam module annotation: Pfam domain module=PPR::PPR::PPR::PPR::PPR::PP R::PPR::PPR; Domain location=121-155::156-190::17-51::191-225::226 -260::261-295::296-330::86-120
MVAKLEEMGEKGLLTMETFSIAIKAFAEAKQRKKEVGIFDLMKKYGFKVGVDVINFLLDSLSTAKLGKEAQAVFEKLKDRFTPSLQTYTILLSGWCRLKNLLEAGRVWNEMIDRGFNPDIVAHNVMLEGLLKCKKKSDAIKLFEIMKAKGPSPNVRSYTIMIQDFCKQKLMGEAIEYFDVMVDRGCQPDAALYTCLITGFGRQKKMDMVYSLLKEMRERGCPPDGRTYNALIKLMTSQHMPDDAVRIYKKMIQSGIKPTIHTYNMIMKSYFVTKNYEMGHEIWDEMHPKGCCPDDNSYIVYIGGLIRQDRSGEACKYLEEMLEKGMKALKLDYNKFASDISKTGNAVILEELARKMNFVGKFEVSNVLASWADMMKKSAKRKEPTTSARQFT

SEQ ID NO: 203658 - protein, 76 aa, Glycine max
  Coding DNA Sequence Number=SeqID_86880
  Subcellular localization annotation: CTP_CleavageSite=40; ConfidenceScore=5.38e-01
MGLSMPFFQPKLPGLLFHPCKNVLSSPPLPVLKTLGLQIYEGALSALASLSTRFFFMLGGCSPKFEPNISFKTMLS

SEQ ID NO: 203659 - protein, 95 aa, Glycine max
  Coding DNA Sequence Number=SeqID_86881
  Subcellular localization annotation: CTP_CleavageSite=47; ConfidenceScore=5.42e-01
MAYIQKNYWNPDDSSITFPGSRKAKAQAPSNTPPVAPPPARVAPSTSSDTTSDQIVLMLQSIHHGLCLSSLPFLGGGGEAPEAQGVEDTPDAQGT

SEQ ID NO: 203660 - protein, 162 aa, Glycine max
  Coding DNA Sequence Number=SeqID_86882
  Gene Ontology: Mol. function=binding; Cellular component=thylakoid; Biological process=photosynthesis
  Homolog annotation: Hit_ID=Q9SIN1; Match level="QueryCoverage=63%, HitCoverage=16%, E-value=4e-20, Identity=51%"; Hit description =Expressed protein
MVLVYDMGKHGISFTKSSLSNVPKLEGCPPECSQTKFFGMVDEAYVPFVCAQNVVAVAKKASMLDCTNVEVGRIVNVVKMVARACSRGNELFSSGKFSESCSTYEEGLKYDNSKYVLYSNRAISEGTEIMHKIEDGEQDKQLKDIILTLLVAGHDTTTILVM

SEQ ID NO: 203661 - protein, 68 aa, Glycine max
  Coding DNA Sequence Number=SeqID_86883
MVVALGQQTLEVSTLVTPVAQDNSFDSLAPLSNQRTYRDTRRSRYPSLNKARDAIIIQEIHAKIITHS

SEQ ID NO: 203662 - protein, 121 aa, Glycine max
  Coding DNA Sequence Number=SeqID_86884
MGYVKIKSVAKAKKHQKVPIMSIMGLKNYFGVEGKFDESHSTGEEKKASVRQNPPIMEELGNLSFNLQFLSMQLSIGSIKIGVVASLAGKKVIQEKEVDPIQDKNVKGKKSGHMDAPNNFA

SEQ ID NO: 203663 - protein, 397 aa, Glycine max
  Coding DNA Sequence Number=SeqID_86885
MSCRFWKLLYGGNHFIRTSKSAAFYLNSMFYHSSKEALNLQWYQNEFPKVKELTHLLANVDSVNGRLVDINSNSTVFCDDVEREMCTFKSLVREFVESPFVHHRMKHVLASFITNAKHESFTPFGKATEREPMVVDSLTKVTQHRIWTGALKKVLNGFAVDLDSLASRGLDNNALLGGQIVHSCLRFLSEIGDFLDPESSSWMKLSPSKTVYSSNSRKWKDVLVMFNDLAKCCRNERRLKMNVAKAEIMKEGLLHIRDVLVDNNVGYKEAQHQESLVKKKLSKMLGHSSRCLFTLLLYYLYGRVADIEVDMCGGVYANGSDGKFCLFMGRILTSDSEKMIGRGVKQLDQALGIFKFVWKMAGMKGHLDLQGHMWCVGADNRMLRYRGNKYFVHEICL

SEQ ID NO: 203664 - protein, 191 aa, Glycine max
  Coding DNA Sequence Number=SeqID_86886
  Gene Ontology: Mol. function=chromatin binding; Cellular component =chromatin; Biological process=chromatin assembly or disassembly
  Homolog annotation: Hit_ID=Q1SAV4; Match level="QueryCoverage=91%, HitCoverage=53%, E-value=1e-32, Identity=37%"; Hit description =Integrase, catalytic region
MHYAIGFSLFQDIYGKTPPSIPAYIVGSSSVATCDSTRISHDEDFTLFRINFLKVQNHMKKWVDQHRREVDLPVESWAYVKLWPYRQTSLFGAKYHKLAKHFYGPYLILAKISLVAYKLDLPSTSKIHNDFHCSALRPLDVVPTRQTLVQWLGLSLDNTSWENWDELCVIHNLKNKFASDGASIDMDQTSS

SEQ ID NO: 203665 - protein, 140 aa, Glycine max
  Coding DNA Sequence Number=SeqID_86887
  Homolog annotation: Hit_ID=Q9ZPW2; Match level="QueryCoverage=39%, HitCoverage=29%, E-value=7e-17, Identity=75%"; Hit description =Anaphase-promoting complex subunit 10
  Pfam annotation: Domain name=APC10; Domain location=23-140; Score= -68.5; E_value=0.0021; Accession=PF03256.7; Description=Anaphase -promoting complex, subunit 10 (APC10)
  Subcellular localization annotation: CTP_CleavageSite=35; ConfidenceScore=5.15e-01
MHSRFSFSSHLKSARNRSVDTHIAPHSFRYYRKPLAGTHRTSYRRKVEENPTLLLELCGSKKPYTALGTVVDAQSSKLSTLPVNKLIVLFLVFKLDESDTPRKVSIRAGDGFHNLKEIKTVELMKATGWVYLSLSGAHPR

SEQ ID NO: 203666 - protein, 88 aa, Glycine max
  Coding DNA Sequence Number=SeqID_86888
MDKSFKLKFKEELSDVWKINDNYRNVQEDNVIKTKTEILILQNGWGQVTINNEVNEDKEMTKFREALTKDTATCSKINFRKEFAAFIH

SEQ ID NO: 203667 - protein, 246 aa, Glycine max
  Coding DNA Sequence Number=SeqID_86889
  Gene Ontology: Mol. function=beta-galactosidase activity; Cellular component=beta-galactosidase complex; Biological process =carbohydrate metabolic process
  Homolog annotation: Hit_ID=Q1RTL3; Match level="QueryCoverage=99%, HitCoverage=33%, E-value=3e-54, Identity=37%"; Hit description=D -galactoside/L-rhamnose binding SUEL lectin; Galactose-binding like
MVMKDSKSDNEEEPHSTLNWQWMHEPHVQLKDGQVLGLVSRKAAQLLDQKVVTNDTSDYLWYITRLPYGQNGKYSFTYEAKIKLKKGTNEISRLSGTDGLPNYGAHFSNVSVGVCGPVQLVTLQNNTEVVKDITNNTWNYKVGLHGEIVKLYSPENNNGWNTNGLPTNRVFVWYKTLFKSPKGTDPVVVDLRGLKKGQAWVNGNNIGRYWTSYLANENGCTSTCNYRGPYSSDKCITKCGRPTQRW

SEQ ID NO: 203668 - protein, 121 aa, Glycine max
  Coding DNA Sequence Number=SeqID_86890
  Gene Ontology: Mol. function=hydrolase activity, acting on glycosyl bonds; Cellular component=beta-galactosidase complex; Biological process=carbohydrate metabolic process
  Homolog annotation: Hit_ID=Q4QYX3; Match level="QueryCoverage=95%, HitCoverage=14%, E-value=1e-46, Identity=75%"; Hit description=Beta -galactosidase
  Pfam annotation: Domain name=Glyco_hydro_35; Domain location=28-121; Score=-123.5; E_value=2.9e-07; Accession=PF01301.10; Description =Glycosyl hydrolases family 35
MTWALLLLSFTLVNLAINAFEVSYDSRAITIDGKRKVLFSGSIHYPRSTAEMWPSLINKAKEGGLDVIETYVFWNAHEPQPRQYDFSGNLDLVKFIKTIQKEGLYAMLRIGPYVCAEWNYG

SEQ ID NO: 203669 - protein, 116 aa, Glycine max
  Coding DNA Sequence Number=SeqID_86891
  Gene Ontology: Mol. function=nucleic acid binding; Biological process= DNA integration
AVIQKILPPKHKDPGSVTIPCSIGEVNVEKALIDLGANINLMPLSMCRRLGELEIMPTRLTLQLADRSITRSYRVIEDMLVRPFMLTASCIVNTGKRKLELGFKDQKIDFDLFVED

SEQ ID NO: 203670 - protein, 174 aa, Glycine max
  Coding DNA Sequence Number=SeqID_86892
  Gene Ontology: Mol. function=transporter activity; Cellular component= integral to membrane; Biological process=transport
  Homolog annotation: Hit_ID=Q0WP36; Match level="QueryCoverage=98%, HitCoverage=39%, E-value=1e-46, Identity=55%"; Hit description =Sulfate transporter like protein
  Subcellular localization annotation: CTP_CleavageSite=21; ConfidenceScore=5.06e-01
GFVKGAIPQLPLSILNSVVAVCKLSSDLFPGKDFSATSFWFGAMPSCHGAGGLAGQYKFGGRSGGCVALLGVAKLVLGLVLGTSLAHILKQFPVGILGVLLLFAGIELAMCARDMNTKEDSFVTLVITAVSLVGSSAALGFLCGMVVYVLLRLRNWTRDKPLSTIWTMKSPEQV

SEQ ID NO: 203671 - protein, 65 aa, Glycine max
  Coding DNA Sequence Number=SeqID_86893
AAPGGGYLEQHKHRCLPLSENAPTMWDRHKLKGALKPGVFTPKAYTPKSPSGPFPPDSSPTQKTF

SEQ ID NO: 203672 - protein, 146 aa, Glycine max
  Coding DNA Sequence Number=SeqID_86894
  Gene Ontology: Mol. function=transcription factor activity; Cellular component=nucleus; Biological process=regulation of transcription
  Homolog annotation: Hit_ID=Q1SA40; Match level="QueryCoverage=79%, HitCoverage=77%, E-value=3e-37, Identity=56%"; Hit description =TAFII55 protein conserved region
  Pfam annotation: Domain name=TAFII55_N; Domain location=1-80; Score= -8.6; E_value=5.9e-06; Accession=PF04658.4; Description=TAFII55 protein conserved region
MIGNEHFPASLLDLPCVVESYNKTYDDNSLTKTADIGQMIMVRESGDAAPDVIEYRHGLTPPMRDARKPEQEEGDENARGANKKPAPKPAPKHDAPENLTNAGELDRSDSKESDDSVRPNEYLYHNDEMKICIVYILQLNLNSIHS

SEQ ID NO: 203673 - protein, 485 aa, Glycine max
  Coding DNA Sequence Number=SeqID_86895
  Gene Ontology: Mol. function=hydrolase activity, hydrolyzing O -glycosyl compounds; Cellular component=membrane; Biological process =carbohydrate metabolic process
  Homolog annotation: Hit_ID=Q1S8W5; Match level="QueryCoverage=98%, HitCoverage=97%, E-value=0.0, Identity=69%"; Hit description =Glycoside hydrolase, family 17
  Pfam annotation: Domain name=Glyco_hydro_17; Domain location=26-347; Score=305.2; E_value=1.2e-88; Accession=PF00332.9; Description =Glycosyl hydrolases family 17
  Pfam annotation: Domain name=X8; Domain location=360-472; Score =148.0; E_value=2.5e-41; Accession=PF07983.3; Description=X8 domain
  Pfam module annotation: Pfam domain module=Glyco_hydro_17::X8; Domain location=26-347::360-472
MKLKRWLGSVLFLIVATVSNAAGAFVGVNIGTDVTDLPSASNVVAILKSHQITHVRLYNANGHMLQALSNTGIEVIVGVTDEEILGIGESASVAAAWISKNVAAYMPSTNITAISVGSEVLTSVPNVAPVLVPAMNHLHTALVASNLNFRVKVSTPQSMDVISRPFPPSTATFNSSWNSTIYQLLQFLKNTNSSYMLNAYPYYGYTKGDGIFPIEYALFRPLSPVKQIVDPYTLFHYNSMFEAMVDATYYAIEAFNVNNIPIVVTETGWPSFGGANEPDATTKNSETYNNNLIKRVINGSGPPSQPKIAINTYLYELFNEDKRKGPISERNWGVFYANGSSVYSLSFSASNMSNANSQGSFCVAKDDADTDKLQAGLSWACGQGQANCIAIQPGRPCYSPNNVKNHASYAYNDYYQKMHNAGGTCDFDGTATTTTEDPSKSIANTRNGGRSSSSTALGLGPVSPVGADLCAILYGLYGVIVAYIL

SEQ ID NO: 203674 - protein, 155 aa, Glycine max
  Coding DNA Sequence Number=SeqID_86896
MQKMLISNISNIHLLKQPPNVLNLQKFRVIRCLVSVVLAIPGGAGRKSQLELEGGGGDDSFEPKKPCGRENTRIGEWGSRTNVELVAVVAPRRRWSKGNGKRRGEEDEKTTSEWGEEQTRDLWREERARGKKRNLREGLKIKMARIQRRFLRNRP

SEQ ID NO: 203675 - protein, 66 aa, Glycine max
  Coding DNA Sequence Number=SeqID_86897
LPCYTGGDPHHNAIKDVPYILLKSWRNTNGLQPTIARSKKEAKVKIALFKSTMTIREGSGSVEQRN

SEQ ID NO: 203676 - protein, 39 aa, Glycine max
  Coding DNA Sequence Number=SeqID_86898
MAIKYLCDNTSVLQEIKDEHFAIQQKKMPEERITTCCLE

SEQ ID NO: 203677 - protein, 358 aa, Glycine max
  Coding DNA Sequence Number=SeqID_86899
  Homolog annotation: Hit_ID=Q6V8P1; Match level="QueryCoverage=23%, HitCoverage=54%, E-value=6e-09, Identity=43%"; Hit description =Putative senescence-associated protein SAG102
  Pfam annotation: Domain name=DUF581; Domain location=322-358; Score =11.7; E_value=0.00059; Accession=PF04570.5; Description=Protein of unknown function (DUF581)
MLRKRTRSIQKDQHHTGQMAISDTNSESHALGSNGKSNSIFNSPLLFVGMGHKGLLDSDSVKSPTSPLDFGFLSNLSNPFRTPSSLSNEGQHRSWNCAKVGLSIIDSLEECSKFSGKILQASESKKTSLCPPMITKAPKCKSYMDSAQASKSLPKDFCKITCTQNGSIFPKGESTVLSEIGEAPLEYESFGKTVSFSLDSCSPIRNLSGLTGSDFDSDSENFALKQMCSPPHFIGGSQNNTKFLLPSEVHSNPVAAVSSNEFIESLSASEIELSEDYTCVISHGSNPKTTHIFCDCILESHVNDSERHYKAEEEGTGLPLFSVNILHTPSQYPSHDFLSVCHHCNKKLEDGKDIYIYR

SEQ ID NO: 203678 - protein, 216 aa, Glycine max
  Coding DNA Sequence Number=SeqID_86900
  Gene Ontology: Mol. function=protein binding; Cellular component =chromatin; Biological process=protein amino acid phosphorylation
  Homolog annotation: Hit_ID=Q1SEH1; Match level="QueryCoverage=92%, HitCoverage=88%, E-value=2e-39, Identity=36%"; Hit description =Leucine-rich repeat, plant specific
  Pfam annotation: Domain name=LRR_1; Domain location=115-137; Score =5.6; E_value=25; Accession=PF00560.23; Description=Leucine Rich Repeat
  Pfam annotation: Domain name=LRR_1; Domain location=139-161; Score =11.1; E_value=2.4; Accession=PF00560.23; Description=Leucine Rich Repeat
  Pfam annotation: Domain name=LRR_1; Domain location=18-40; Score=7.5; E_value=11; Accession=PF00560.23; Description=Leucine Rich Repeat
  Pfam annotation: Domain name=LRR_1; Domain location=42-64; Score=7.0; E_value=14; Accession=PF00560.23; Description=Leucine Rich Repeat
  Pfam annotation: Domain name=LRR_1; Domain location=66-89; Score=4.7; E_value=38; Accession=PF00560.23; Description=Leucine Rich Repeat
  Pfam annotation: Domain name=LRR_1; Domain location=91-113; Score =7.0; E_value=14; Accession=PF00560.23; Description=Leucine Rich Repeat
  Pfam module annotation: Pfam domain module=LRR_1::LRR_1::LRR_1::LRR _1::LRR_1::LRR_1; Domain location=115-137::139-161::18-40::42-64::66 -89::91-113
MEDNRIGIILIAFGKFQKMQVLDVSVNKLSGEIRAFISNLSQLFHLEIGENVLGGNIPPSIGNCLKLQYLNPSQNNLTRTIPLEVFNLFCLTNLLDLSDNSLSSSIPEEVGNLKHINLLDVSENHLSGYILGNLRECTMLDSLYLKGNTLQGIIPSSLASLKEYFNVFFNMLNGEVPTEGVFQNASGFVMTGNSNLCGGIFELHLPPYPVKDEKKE

SEQ ID NO: 203679 - protein, 56 aa, Glycine max
  Coding DNA Sequence Number=SeqID_86901
  Subcellular localization annotation: CTP_CleavageSite=31; ConfidenceScore=5.01e-01
MDWNPDDPMITFPGTRKDQARGPSDGSTSAPASTSAPTPAPAPVPPAITAPIGPYS

SEQ ID NO: 203680 - protein, 122 aa, Glycine max
  Coding DNA Sequence Number=SeqID_86902
  Homolog annotation: Hit_ID=UPI000065E5DE; Match level="QueryCoverage =47%, HitCoverage=4%, E-value=5e-08, Identity=48%"; Hit description =Homolog of Homo sapiens "Vpr-binding protein
MVIINSEVWDLRKFRLLHSVPSLDQRTITFNAHGDVIYAILRRNIENVMSAFHPCNALDFATDPTDSFVGFVTITKRGNYVEGRDEEGTLGCVRIFELVIEYPSKERMTIDDEDGDFIMDDV

SEQ ID NO: 203681 - protein, 392 aa, Glycine max
  Coding DNA Sequence Number=SeqID_86903
  Gene Ontology: Mol. function=beta-galactosidase activity; Cellular component=beta-galactosidase complex; Biological process =carbohydrate metabolic process
  Homolog annotation: Hit_ID=Q1RTL3; Match level="QueryCoverage=95%, HitCoverage=45%, E-value=1e-103, Identity=46%"; Hit description=D -galactoside/L-rhamnose binding SUEL lectin; Galactose-binding like
  Pfam annotation: Domain name=Gal_Lectin; Domain location=306-385; Score=77.1; E_value=5.6e-20; Accession=PF02140.8; Description =Galactose binding lectin domain
MSPMFQMKDGQVLGSVSRKAAQLLDQKVVTNDTSDYLWYITSVDISENDPIWSKIRVSTNGHVLHVFVNGAQAGYQYGQNGKYSFTYEAKIKLKKGTNEISLLSGTVGLPNYGAHFSNVSVGVCGPVQLVALQNNTEVVKDITNNTWNYKVGLHGEIVKLYCPENNKGWNTNGLPTNRVFVWYKTLFKSPKGTDPVVVDLKGLKKGQAWVNGNNIGRYWTRYLADDNGCTATCNYRGPYSSDKCITKCGRPTQRWYHVPRSFLRQDNQNTLVLFEEFGGHPNEVKFATVMVEKICANSYEGNVLELSCREEQVISKIKFASFGVPEGECGSFKKSQCESPNALSILSKSCLGKQSCSVQVSQRMLGPTGCRMPQNQNKLAIEAVCESIAKKY

SEQ ID NO: 203682 - protein, 111 aa, Glycine max
  Coding DNA Sequence Number=SeqID_86904
MSFLGVDEVENVGAPYEPGVVHRGNGYAHVRQHVLRVMHVASRFTLVGYDKQGNILSYRMGPVSIAKVIEDRGDHFDITIEEIELFKEILCQLEHLSKEEYHDFPKVMPSI

SEQ ID NO: 203683 - protein, 73 aa, Glycine max
  Coding DNA Sequence Number=SeqID_86905
MSRVSRERKVQVPESFERFCYVKICRDQSWKQELEPVMYDYHEKERAPDLESILADFMTYQASYKGYCYSMQQ

SEQ ID NO: 203684 - protein, 394 aa, Glycine max
  Coding DNA Sequence Number=SeqID_86906
  Gene Ontology: Mol. function=chitin binding; Cellular component =extracellular region; Biological process=chitin metabolic process
  Homolog annotation: Hit_ID=UPI000044A8F0; Match level="QueryCoverage =60%, HitCoverage=100%, E-value=4e-38, Identity=29%"; Hit description= PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
MAQSNSSRLGFPAVITTLCRSRGVASDNLVFERLSPVINLAYIRKNYWNPDDLTVIIRGARRARARPAEAPSTFAAPPPARTSATPSTPPSARTFHLKRTRESCVALPSKELHELPNDGCQVPRSGQTRVASQQTGGPRTKLGYDNVLIIRGLHVLAFRGLHILAFRGLHVLANRGLHALTFRGLHVLTFRGMHALTFRGQHALAIRGLHALAIRELHVLTFIGLQVLAFRGLHVLPSEGCTPSPSKGYIGLDVLSFRGLHVFTIRGLHFLAFRGLHVLAFRGLHVLTFRALHVLTFIGLHVLTFRGLHALAFRGLHVLTIRGLHVLTIRGLHVLAIRGLHVLAFRGLHALAFGGLHVLTFIGQHVLAIRGLHVHTIRGLLVLAIRGYTFSPSE

SEQ ID NO: 203685 - protein, 73 aa, Glycine max
  Coding DNA Sequence Number=SeqID_86907
MGTTTDRELSKELKDLETLHELKGSTMVVLEFASETIRTKCPWLGLHQLHHNPSSKGLANHSHNIAKQHTRLH

SEQ ID NO: 203686 - protein, 45 aa, Glycine max
  Coding DNA Sequence Number=SeqID_86908
MEQVKEFHRRDGFEVASTIIVVEDDKGAERGMSSFNSELPNSNSW

SEQ ID NO: 203687 - protein, 102 aa, Glycine max
  Coding DNA Sequence Number=SeqID_86909
MGQTLYGPVMTVTFFSWNARLQAFVLHLTIVFGWRGENSYEAWIPLLFKVLPCWANSSEEIPVLSPLVPVSLLGSSKGEDQKQKVVTKQVKVQAVLKAIKHV

SEQ ID NO: 203688 - protein, 101 aa, Glycine max
  Coding DNA Sequence Number=SeqID_86910
MHAKVNISIITKSKEGQLGCCSGSWYLLVKDASMQLELTIKRAAKTVYQGILISNCPRLCSEILDKLNHPFLPALSICFLPEENYSCFLIGNQLRFSRKMP

SEQ ID NO: 203689 - protein, 44 aa, Glycine max
  Coding DNA Sequence Number=SeqID_86911
MCHIYDGVATSPSNDPLHEIEDPMTRSKTKRMKQALQDLILKIK

SEQ ID NO: 203690 - protein, 135 aa, Glycine max
  Coding DNA Sequence Number=SeqID_86912
  Gene Ontology: Mol. function=hydrolase activity, hydrolyzing O -glycosyl compounds; Cellular component=anchored to membrane; Biological process=carbohydrate metabolic process
  Homolog annotation: Hit_ID=Q1SM62; Match level="QueryCoverage=85%, HitCoverage=39%, E-value=1e-40, Identity=68%"; Hit description =Glycoside hydrolase, family 17
MIVPDLQIIQSALVKAGLGHPFISLYSDRSFPIDYAFFNGFQSPINEDGRIYDNVFDTNHDTLVQALWKNGFGNMHIIVREVGWPAYGERIANLRYGQRFNQGFMSCYIGKGTPMRHGPMDAYLFSLTDEDNKSI

SEQ ID NO: 203691 - protein, 114 aa, Glycine max
  Coding DNA Sequence Number=SeqID_86913
MEQVKEFHRRDGFEVASADKMAKSCMVYFEMHLSLRKKIITKAFNGTIIVVEDDKGAERGMSSFNSELPNSNSWSSFVEGNWKGGLMSYLEEFESRSKGSTTIGALLSETSKIE

SEQ ID NO: 203692 - protein, 65 aa, Glycine max
  Coding DNA Sequence Number=SeqID_86914
MGLVDTVVELHYPKTENRKEKLDSRPAPPDKVRVEVLNCIMVFFKSVYYANEKGYVHCTFKIHLC

SEQ ID NO: 203693 - protein, 139 aa, Glycine max
  Coding DNA Sequence Number=SeqID_86915
  Gene Ontology: Mol. function=hydrolase activity, hydrolyzing O -glycosyl compounds; Cellular component=membrane; Biological process =carbohydrate metabolic process
  Homolog annotation: Hit_ID=Q1SM61; Match level="QueryCoverage=70%, HitCoverage=62%, E-value=3e-35, Identity=75%"; Hit description =Glycoside hydrolase, family 17
MGCGKLRGCLVLVLFGALLVGLVSGIGINWGTQLTHPLPASTIVKMLKDNGIQKVKLFDADPDILNALKKSGIQVMVGIPNDMLYTLANSMQAAEKWVSKNVSAHVSVDIRRTILEEIIATGSGILHGILSNVLGIIRK

SEQ ID NO: 203694 - protein, 83 aa, Glycine max
  Coding DNA Sequence Number=SeqID_86916
MVERTHVAQKKVETGSRRSSQTAKTHDGAVAVSMMDITTNSALHYPVRNSGSVNGRMIYLTASSLRTLVGCRSRSRNSSPLGQ

SEQ ID NO: 203695 - protein, 87 aa, Glycine max
  Coding DNA Sequence Number=SeqID_86917
MVEVGSGFVEEIWVCGGGWWRDDARWWWCLFGLNLWRLVVAEFMEELGHKRDLSVEPKLSKECDLNRDLPVEPILSILNPTTRKKLK

SEQ ID NO: 203696 - protein, 220 aa, Glycine max
  Coding DNA Sequence Number=SeqID_86918
  Gene Ontology: Mol. function=nucleic acid binding; Biological process= DNA integration
  Homolog annotation: Hit_ID=Q1SIY6; Match level="QueryCoverage=99%, HitCoverage=20%, E-value=2e-64, Identity=56%"; Hit description =Integrase, catalytic region; Zinc finger, CCHC-type
  Pfam annotation: Domain name=zf-CCHC; Domain location=149-166; Score =0.1; E_value=0.94; Accession=PF00098.13; Description=Zinc knuckle
  Pfam annotation: Domain name=zf-CCHC; Domain location=170-187; Score =15.4; E_value=0.0028; Accession=PF00098.13; Description=Zinc knuckle
  Pfam module annotation: Pfam domain module=zf-CCHC::zf-CCHC; Domain location=149-166::170-187
MTINSPKEIWDYLKEENEGDEYVCGMQALNLMREFEVQKMKESKTIKWYSDRLLDITNKVRLLESRIVEKILVTVLERYEASITTLEITKDLTKISLTERRLKREESTVEGTLPTKHQNAIKYKKNRNFDGTGSSSTSNAKGNWKKSYPPCQHCRKKGHPPFRCWKRLDAKCYDCNQMGHEAIICKNRNQPHSEAAKAADPEEEYLFATTCFSSIESSQN

SEQ ID NO: 203697 - protein, 366 aa, Glycine max
  Coding DNA Sequence Number=SeqID_86919
  Gene Ontology: Mol. function=hydrolase activity, hydrolyzing O -glycosyl compounds; Cellular component=anchored to membrane; Biological process=carbohydrate metabolic process
  Homolog annotation: Hit_ID=Q9M088; Match level="QueryCoverage=92%, HitCoverage=70%, E-value=1e-149, Identity=73%"; Hit description =Putative glucan endo-1,3-beta-glucosidase 5 precursor (EC 3.2.1.39) ((1->3)-beta-glucan ...
  Homolog annotation: Hit description=endohydrolase 5) ((1->3)-beta -glucanase 5)
  Pfam annotation: Domain name=Glyco_hydro_17; Domain location=3-230; Score=78.9; E_value=1.5e-20; Accession=PF00332.9; Description =Glycosyl hydrolases family 17
  Pfam annotation: Domain name=X8; Domain location=249-333; Score =123.4; E_value=6.4e-34; Accession=PF07983.3; Description=X8 domain
  Pfam module annotation: Pfam domain module=Glyco_hydro_17::X8; Domain location=3-230::249-333
MTILGNEPFLSTYNGTFEATTLPALQNIQLALVKAGLGNQVKVTCPLNADVYQSAQVPSDGDFRQDIHDLMVQIVKFLSQNNAPFTVNIYPFISLYSDPNFPVDYAFFNGFQSPISDNGRIYDNVFDANHDTLVWALQKNGFGNMPIIVGEVGWPTDGDRNANLQYAQRFNQGFMSRYIAGKGTPMRPGPMDAYLFSLIDEDFKSIQPGNFERHWGLFYYDGQPKYQLNIGSRANGLVAATGVAYLPKKWCILKTSANLNSDQVAPSVSYACQNADCTSLGYQTSCGGLDIRGNISYAFNSYFQVNDQIDSACKFPGLSVVTDKDPSTGDCKFKIMIQTDSAGLHGNGRIWSLRIVLFVLLFFTLM

SEQ ID NO: 203698 - protein, 53 aa, Glycine max
  Coding DNA Sequence Number=SeqID_86920
MKHTAGRRLETAVPDDVMATAGISSHHQTKSCAFFNNKRCPNSVNIGTFFQGV

SEQ ID NO: 203699 - protein, 173 aa, Glycine max
  Coding DNA Sequence Number=SeqID_86921
  Homolog annotation: Hit_ID=Q15KJ0; Match level="QueryCoverage=63%, HitCoverage=51%, E-value=3e-10, Identity=32%"; Hit description =Truncated PHYLLO protein
MTTKEPIIRDNVSDFSDDEQQHDFDEHGEPSNYIVSKSIGGGTLEEGLEKLKEALQILNSPSPSSPTGFLRFQVALPPCPKTFTLFCSQPHSSSVFPLIYVSKNDADSKSLYVNLDDNVSHQKESRSQIELDELESVSILSMTLAWDEFSFSTFQEAHYSLQDSLDQVPDMPF

SEQ ID NO: 203700 - protein, 68 aa, Glycine max
  Coding DNA Sequence Number=SeqID_86922
MEHHHEDELRKLKADHDQLEARGRLLVSIPLSTTDYLLYRSTSSGMMGPQIQMSTWIPYCWIKWPQNN

SEQ ID NO: 203701 - protein, 149 aa, Glycine max
  Coding DNA Sequence Number=SeqID_86923
  Gene Ontology: Mol. function=nucleic acid binding; Cellular component= nucleus; Biological process=DNA replication
  Homolog annotation: Hit_ID=Q7XZT4; Match level="QueryCoverage=88%, HitCoverage=47%, E-value=4e-41, Identity=62%"; Hit description=RPA 32kDa
  Pfam annotation: Domain name=RPA_C; Domain location=36-144; Score =90.2; E_value=6.4e-24; Accession=PF08784.1; Description=Replication protein A C terminal
MILLLEYWWFVGFMDWWPVTNFDEIPFHFIDCIHNHLRSKIKMEGITSSNPSSGSSLNTPGKSAPNGSQAPSSNPVSAQHSVDGLKGIDKLIMDYLEQHSDMSDGRGIHVDELSRELKLPMEKIKLSLKTLADDGEIYSTIDDDHYKKA

SEQ ID NO: 203702 - protein, 539 aa, Glycine max
  Coding DNA Sequence Number=SeqID_86924
  Gene Ontology: Mol. function=protein kinase activity; Cellular component=plastoglobule; Biological process=protein amino acid phosphorylation
  Homolog annotation: Hit_ID=Q01FN3; Match level="QueryCoverage=83%, HitCoverage=31%, E-value=1e-147, Identity=56%"; Hit description=[R] KOG1235 Predicted unusual protein kinase
  Pfam annotation: Domain name=ABC1; Domain location=92-212; Score =160.5; E_value=4.5e-45; Accession=PF03109.7; Description=ABC1 family
MGLIIPVGRRDVEIVWNLGLYWSNLVYDFLVGRDEEVVPYRARQLRNLLCDLGPSFIKAGQVLANRPDIIREDYMNELCILQDDVPSFPNEEDLGQPLEAVFSKISSETIAAASLGQVYRATLRATGEDVAIKVQRPGIEPIIYRDLFLFRTLASFLNGISIQKLGCNAELIVDEFGEKLLEELDYTLEARNLEDFLENFKNDPTVKIPQVYKQFSGQRVLVMEWIDGIRCTNPQAIKEAGIDVDGFLTIGVSAALRQLLEFGLFHGDPHPGNIFAMRDGRIAYVDFGNVAVLSQQNKQILIDAVVHAVNEDYAEMANDFTRLGFLTPGTDVTPIIPALEAIWQNSAGKGLSDFNFRSVTDGLFQWKRLENLIVLAKENVAKMSNNPALQVKNTQSQRDLKVERKLDLTGTIKDGARLFFVDEGIRRQLLLALTEDSKLHIEEVYDDNMTLSTSLKVHNLVLENSDLCSLQLVDVYRLVEDQIDIPSVAVEVARVLEVFSPYSHLDFCLVYLLSVCMALKNEESNAKCVIFKDGNIDKS

SEQ ID NO: 203703 - protein, 101 aa, Glycine max
  Coding DNA Sequence Number=SeqID_86925
  Pfam annotation: Domain name=DUF1218; Domain location=1-65; Score= -5.9; E_value=0.011; Accession=PF06749.3; Description=Protein of unknown function (DUF1218)
MVSSLRFTAGLAAAMLLWPTITEHIHLTRNVHQNLSYECPTAKTGLLGGGAFLSLDSSLLWLIALMLADNAREDFFGEEEEDGDKGEFGAASSDSGLKGSA

SEQ ID NO: 203704 - protein, 131 aa, Glycine max
  Coding DNA Sequence Number=SeqID_86926
  Gene Ontology: Mol. function=DNA binding; Biological process=DNA integration
MNYTIKQVLRKQELRGRMLGSRAEIILEGPNNITLEQALKLNFRASNNQEEYEALMQLVQGQVANIYQTKEIVLLKYYHIAKTLIDNFECFKLYYILRESNTRADLFSELAITKKAGHLKTIIQENSKHPP

SEQ ID NO: 203705 - protein, 329 aa, Glycine max
  Coding DNA Sequence Number=SeqID_86927
  Gene Ontology: Mol. function=RNA-directed DNA polymerase activity; Cellular component=signal recognition particle, endoplasmic reticulum targeting; Biological process=RNA-dependent DNA replication
LYGQIERLDNRLNQNVGQPYGGNTGGNDGPRQNRMKRQNRIQGVKLNIPPFKGRSDLDTYLDWEMNIEHRNAKKGRARDRYMDWDEKGYAKEYYKEMEMTLVRANIEEETEDTMAHFLNGLNPDIRDVVELQEYVELDDLLLKAVQVEQKLKRKSAARRNSSNTFNQNWTNKSKKEGGNSSSPSTMSLHGKSTVSNARTKHNFALSNIGTRKDDGEIISEYEISEEEVEEELKEEAMQDDMLMVRRLLGSQIQPLDDTQRENIFHTKRTINGKICSLIFDGGSCTNVASSRLVSKLNLETKPHPRPYRLHWLSEDEGRRPRGTPKNLDC

SEQ ID NO: 203706 - protein, 90 aa, Glycine max
  Coding DNA Sequence Number=SeqID_86928
  Gene Ontology: Mol. function=metal ion binding; Cellular component =extracellular region; Biological process=cobalamin biosynthetic process
  Homolog annotation: Hit_ID=Q1SC37; Match level="QueryCoverage=82%, HitCoverage=37%, E-value=1e-27, Identity=74%"; Hit description =Cobalamin (Vitamin B12) biosynthesis CbiX protein
  Pfam annotation: Domain name=CbiX; Domain location=3-84; Score=55.8; E_value=1.5e-13; Accession=PF01903.8; Description=CbiX
MTHLLVEPTHMELAEPSIRDAFESCIEQGVHHIIVCPFILFPGRHWSQDIPSLSAEVVKEHPDVSYNVTAPVGLHELFVAQGKNIDSKVF

SEQ ID NO: 203707 - protein, 66 aa, Glycine max
  Coding DNA Sequence Number=SeqID_86929
  Gene Ontology: Mol. function=peptidase activity
  Homolog annotation: Hit_ID=Q67VK9; Match level="QueryCoverage=98%, HitCoverage=14%, E-value=5e-12, Identity=73%"; Hit description=Cgi67 serine protease-like
MTILDTGSHQGSLCLYEMVIRPSKQNTYSDIVAAYKCLEESYRAKQEGIIVYRQSVGSGPTLDLAA

SEQ ID NO: 203708 - protein, 76 aa, Glycine max
  Coding DNA Sequence Number=SeqID_86930
MEKPDKMNFKEKKEKKGYITWEDDVINYSSDSEKKIISLDIMMKDYENGEEQSRYIDSNFSKHMACIKVYSYFSLR

SEQ ID NO: 203709 - protein, 147 aa, Glycine max
  Coding DNA Sequence Number=SeqID_86931
  Gene Ontology: Mol. function=pectinesterase activity; Cellular component=cell wall; Biological process=cell wall modification
  Homolog annotation: Hit_ID=Q42534; Match level="QueryCoverage=70%, HitCoverage=17%, E-value=7e-19, Identity=50%"; Hit description =Pectinesterase-2 precursor
  Pfam annotation: Domain name=Pectinesterase; Domain location=36-142; Score=-131.9; E_value=1.2e-11; Accession=PF01095.10; Description =Pectinesterase
MVNSHIDDNRPPEGTISKSDYAGILESWSESSYKPDFTVAQDGSGTHGTIQAAVNALAAMGHNRPARAVIHVKSGVYHEKVEIGQKLHNVMLVGDGIDKTIVTGNRNVVQGSTTLNSATFGKTMKILSNDLTKQNKNLIRIDIANVF

SEQ ID NO: 203710 - protein, 74 aa, Glycine max
  Coding DNA Sequence Number=SeqID_86932
MADTYSAPEEIHGLLGYLLAIEIAIPWVMGLNQAHAFSKKVHQIKLKNGSNYLAKIGAKDESSHITASSTAKHI

SEQ ID NO: 203711 - protein, 130 aa, Glycine max
  Coding DNA Sequence Number=SeqID_86933
FKIAPCVASLVNVRIYTRFSSNFSQHQLDLAPYTSEPYNAQWNALGLLRDKHTLRSSRILEEMEVDEPWLGLWLPLNYQVDMGSSLAYDNGIWGEPYRLFAAKFLFVGVFFLFVLKVVFVIGSAVDRLCG

SEQ ID NO: 203712 - protein, 73 aa, Glycine max
  Coding DNA Sequence Number=SeqID_86934
MFEEEVAAIGEEFPQDPPNFVRPCHPDSQVGNWRVISQSEVSSPGRATPAPNYKKRGRGTFSAPKNSPPPPPI

SEQ ID NO: 203713 - protein, 62 aa, Glycine max
  Coding DNA Sequence Number=SeqID_86935
MVIFNHGVAAEDKGEEPSTWEASFRSKEGSFLRKIEEESFLEKLEGATHTRPIAKLTLCQNT

SEQ ID NO: 203714 - protein, 301 aa, Glycine max
  Coding DNA Sequence Number=SeqID_86936
  Homolog annotation: Hit_ID=Q1EPA6; Match level="QueryCoverage=42%, HitCoverage=17%, E-value=3e-26, Identity=51%"; Hit description =Kinesin light chain-related
  Subcellular localization annotation: CTP_CleavageSite=33; ConfidenceScore=5.23e-01
MASASCTSCTLGLPFPKLASQTCGFSSSDELVSASGEMPFHVKSPAVLAVCPDMCRVAAKLLLAMVLSGPIPKALKEKTDLQLSLNDTGIEVIEVLDLDLEDLVVAGDGSVNLVEHGEGVVELHVAGEGGEGVIGAAFNVGDLDRVFEDGDGFFEASEAAVDGGEDVEANGEVEVGLSLDGAALEGLGGPDGEVEGLRRPIARGNGVMGQPKRSGGVSRVFFLEEREGDVVGGRGCTLLALTRMAREAVINGEDEQCKLGNATVSYSKTVIYNCLRMYDVKTNFCSPNYKIVTVPYSKTVL

SEQ ID NO: 203715 - protein, 140 aa, Glycine max
  Coding DNA Sequence Number=SeqID_86937
  Gene Ontology: Cellular component=chloroplast envelope
  Homolog annotation: Hit_ID=Q9LHC4; Match level="QueryCoverage=93%, HitCoverage=49%, E-value=2e-13, Identity=39%"; Hit description =Arabidopsis thaliana genomic DNA, chromosome 3, BAC clone: T13O13
  Subcellular localization annotation: CTP_CleavageSite=70; ConfidenceScore=5.70e-01
MVLSVSLMQLGCVSLLHNNPSSSPVTLLPKSLFPCGISLKLKGLVFWCKSSSVCGRRRRRRVRVGSISVNASLVEAPVLWAGRLFIFYALLKAGLAGSQANPLVLDLEIGDTNDESAAAATDLGFSKWAQAILGKPRLSN

SEQ ID NO: 203716 - protein, 191 aa, Glycine max
  Coding DNA Sequence Number=SeqID_86938
  Gene Ontology: Mol. function=zinc ion binding; Cellular component =intracellular; Biological process=regulation of transcription, DNA -dependent
  Homolog annotation: Hit_ID=Q9ZTK7; Match level="QueryCoverage=81%, HitCoverage=50%, E-value=5e-33, Identity=50%"; Hit description =CONSTANS-like protein 2
  Pfam annotation: Domain name=zf-B_box; Domain location=23-70; Score =17.6; E_value=0.0017; Accession=PF00643.14; Description=B-box zinc finger
MALCIWLNQYRVHAANKLESRHPRVALCELREQALAHMTSKADAAALCLACDRDIHSANRLASCHECIPITLFFESEHSVKASSPINFHHRFFSDIDADADANVSIEEAEAASWLLANPKTDLNSSQYLFSETKLVPYIDLDYAAMDPKTEQKSSATADDVVLMQSNFKSFTYEHQTSFFTATSLDLEPSE

SEQ ID NO: 203717 - protein, 237 aa, Glycine max
  Coding DNA Sequence Number=SeqID_86939
  Homolog annotation: Hit_ID=Q2HUR9; Match level="QueryCoverage=39%, HitCoverage=16%, E-value=7e-30, Identity=71%"; Hit description=TGF -beta receptor, type I/II extracellular region; Major facilitator superfamily MFS_1
MDEVGEPDLKPVVFRDGHGGLEDGEAPRGDEAIVDGTIGAVEAVSEVEEEAGEGTNKEEEVDHEGVNVGALAVLVYGGEDHLKSEEGSCGEEVSEEGGLEEGFSVSCSGGGVALLLYTLMPICCSFRSIFLPWVTFAHVIGLKSFGSALCMTSISLGNCVSSLLIAIVMKISATDEMPRWIPGKLNKGHLDMFYFFLAALTTAYLVIYVLMARWYKYIKFQGNNDNGINKEDTEVGL

SEQ ID NO: 203718 - protein, 149 aa, Glycine max
  Coding DNA Sequence Number=SeqID_86940
  Gene Ontology: Cellular component=chloroplast envelope
  Homolog annotation: Hit_ID=Q9LHC4; Match level="QueryCoverage=76%, HitCoverage=46%, E-value=2e-55, Identity=86%"; Hit description =Arabidopsis thaliana genomic DNA, chromosome 3, BAC clone: T13O13
MSHHAVKWYDTSVLETSLLVEWTTEEKAKEAANGRKLVSKWHPTTKGTLRRNYRVPSKPEGRRLLKAIASLLSDDDHFVDATSHKGCQIRRESAHGESVCCNNVRALFDELPTPHIIVEITPFPAGPLNDNDYIKAEKLEKVLRSSPSV

SEQ ID NO: 203719 - protein, 62 aa, Glycine max
  Coding DNA Sequence Number=SeqID_86941
  Subcellular localization annotation: CTP_CleavageSite=53; ConfidenceScore=5.13e-01
MVSSNVLKQAIACCNSQVASYTFFITSRINNAECLASACGVLNVLILKVSQVFASLVMEASY

SEQ ID NO: 203720 - protein, 247 aa, Glycine max
  Coding DNA Sequence Number=SeqID_86942
  Gene Ontology: Mol. function=transporter activity; Cellular component= membrane; Biological process=oligopeptide transport
  Homolog annotation: Hit_ID=Q2HUR9; Match level="QueryCoverage=94%, HitCoverage=47%, E-value=4e-75, Identity=57%"; Hit description=TGF -beta receptor, type I/II extracellular region; Major facilitator superfamily MFS_1
KAAFITSKDLEQLEENKCNPWCLSTVTQVEEVKCILRLLSIWLCTILYSVVFAQIASLFVVQGDAMATGISSFKIPPASMSIFDILGVAFFIFIYRHAPDPFVAKVTKSKLTELQRMGIGLVLAIMAMVSTGLFTFHFLASATFNAQTPDELKSFGSALYMTSISLGNYVSSFLIAIVMKISTKGDILGWIPGNLNLGHLDRFYFLLAALTTANLVVYVALAKWYKYINFEGNNEEDIKKENHEVMV

SEQ ID NO: 203721 - protein, 154 aa, Glycine max
  Coding DNA Sequence Number=SeqID_86943
MIRGDTLRLFAPFCHPEAAGPMIREDPYGYPHLWSSRGGGPDDTRGYLTVIRTLVSSRGGGPDDTRRYLTVIRTLVSSRGGGPDDTRRYLTVIRTLVSSRGGGPDDTRRYLTVIRTLVSSKGGGPNDTRKYPSCYPYKHSFAICKTERLIACRG

SEQ ID NO: 203722 - protein, 80 aa, Glycine max
  Coding DNA Sequence Number=SeqID_86944
MSHAVKDNRGKWAPNYEGPFVVKRAFTGGALVLRNGRKWRIGSRPTDSHPFLALDKQRTSLQGSPLSFEFTVIITIVCFK

SEQ ID NO: 203723 - protein, 88 aa, Glycine max
  Coding DNA Sequence Number=SeqID_86945
  Gene Ontology: Mol. function=ribonuclease H activity; Biological process=DNA integration
  Homolog annotation: Hit_ID=Q1SAS4; Match level="QueryCoverage=97%, HitCoverage=5%, E-value=2e-26, Identity=48%"; Hit description=RNase H, putative
MEAVLSFEVEVPSQKILVESGLEESEWAQTRYDQLNLIEDNRGKWAPNYEGPFVVKRDFSGGALVLTDMDGEELPSPVNSDVVKRYYA

SEQ ID NO: 203724 - protein, 135 aa, Glycine max
  Coding DNA Sequence Number=SeqID_86946
MGEVEEVQEQIKANMEAMKEQMATMMEAMRSMKKIMEANVVAVAATSVVAKENPMPPSGLNQMNHPTSAMRTLPVRMTITPLPYSLRADNLVMYMSLNPWGRHMKIPHHNLADFEPCLGYATEGQAVGGIPLQNT

SEQ ID NO: 203725 - protein, 168 aa, Glycine max
  Coding DNA Sequence Number=SeqID_86947
  Subcellular localization annotation: CTP_CleavageSite=59; ConfidenceScore=5.27e-01
MGVFPSVTGEIPYSKKSQISHQGSAEFAKRFRLQYPMKRFSTFCRVGLPRSLSRIGHVRSLKEVDAGLASVCPQELSVKRCILLKPEVTQNSYTASRRGYSLTKTGILVEGRAPQLLYPEVGTSKMVIPSQTTKRTQNQSNHSRLLIQLKDKTTRKGDLSRKYELGYF

SEQ ID NO: 203726 - protein, 119 aa, Glycine max
  Coding DNA Sequence Number=SeqID_86948
MGDSQENNKGKSRDKDNYVSWTMEDTNELLHLLMDAMNRGLRDANGSLSKQNVERIILPQLNAKTKFPKTYSHYLSRMKWFRNQYNMMSTLMRNNSGFGWDPIGKTFTAHEDVWKDYLK

SEQ ID NO: 203727 - protein, 241 aa, Glycine max
  Coding DNA Sequence Number=SeqID_86949
MTTMMEAMMSMRKMIEVNAAAVATTSATTKVDPTHPSGMNQVSHLVPNMVGQGGKVLGSTGGPHFAQVQSKHPFPPYSLPPNYTPPNVAHTPDENVDNSAPIPIESQHLESGHAQVSQPMGETHEAPRDHNLVEFKPHIGYAAKGVPPAMVESEILDHIEERPRAIEGGGDYAFVDMAELCLVPDVVIPLKFKVSDFDKYKGTTCPKNHLKMYSRKMGAYSKSEKLLMHFFQESLTGAAVT

SEQ ID NO: 203728 - protein, 89 aa, Glycine max
  Coding DNA Sequence Number=SeqID_86950
  Homolog annotation: Hit_ID=Q8LP96; Match level="QueryCoverage=42%, HitCoverage=9%, E-value=1e-11, Identity=78%"; Hit description=Moco containing protein (Os08g0530400 protein) (Moco containing protein(OsMCP))
  Pfam annotation: Domain name=Mo-co_dimer; Domain location=8-85; Score= -50.9; E_value=0.021; Accession=PF03404.6; Description=Mo-co oxidoreductase dimerisation domain
MSPFCPRLPAMWDLQHTPLFRGDHNLDGFSNIEVALVHFLLILNYCFISSLVDSAANVQPEKVEDIWNLRGILNTSWHRVKVQASYSNL

SEQ ID NO: 203729 - protein, 99 aa, Glycine max
  Coding DNA Sequence Number=SeqID_86951
  Subcellular localization annotation: CTP_CleavageSite=81; ConfidenceScore=5.18e-01
MARLGPQKTSGLSLSSPGRAVMVLNAFFSINRREGELRKGFQHLVVKELRKRERRRKKKRKQSRGVTGSRLGSISTSFFVRCSSCDCHKSHFLSILTDH

SEQ ID NO: 203730 - protein, 149 aa, Glycine max
  Coding DNA Sequence Number=SeqID_86952
MVLNASYSAKQGTIQCFDQECEKYQKKKGKRVFSLSFLDPNSPRLASSSYGPPNYFRVKEPAQLGEPVTSGVSINSPGQAAIALSAHFPINSHAKGVEERFQGSVLEGIERNKREEEERRGNEAEALLNRYCDQSLHRSSFGVLSATVD

SEQ ID NO: 203731 - protein, 177 aa, Glycine max
  Coding DNA Sequence Number=SeqID_86953
MAELCLVPDVIIPPKFKVSDFDKYKGTTCPKNHLKMYCRKMGAYTKDEKLLMHFFQEFGWGGYHLLHQSRIFPSPFLERPNGCLPQLQNMFKREHESLKEYVQRWRDLAAQVAPLMMGREMITMIMDTLPVFYYEKMVGYMPSSFANLVFAGERIEVGLRRGKFDYVALMNKKPGAN

SEQ ID NO: 203732 - protein, 152 aa, Glycine max
  Coding DNA Sequence Number=SeqID_86954
MEKMNVHKETRETPKGKWALRAMVARPGEMMLTPEVTGSPRTIIKRKERALRRLYRIHAKARVMSEIEEVQEQMKADMEAMKEQMTTMMEAEAKMSMRKMMEVNTSTVVAASIAIEVDPTHPSGLNQLNRTVSDKVGQGGEALGSTGGPRFV

SEQ ID NO: 203733 - protein, 55 aa, Glycine max
  Coding DNA Sequence Number=SeqID_86955
MATIVLLSRYGRWCFASDEHQVGFVADLGATFMDDWVFLTGRVFLTGRVMGNKKD

SEQ ID NO: 203734 - protein, 58 aa, Glycine max
  Coding DNA Sequence Number=SeqID_86956
MKERIREAQSCPFGFSTYRVRTSDLPLGSLEAHAVGPCCLNNLKRDRLRMQKKQQQSV

SEQ ID NO: 203735 - protein, 196 aa, Glycine max
  Coding DNA Sequence Number=SeqID_86957
MESRQPQSDHAHVSQPMGETREVPHHNLADFEPGLGYAAEGQAIGGVPLPNTLEDPQYHPQSQPLHFAMGRVPPAMVEMEKLDRIEERLRVTEGGRDHAFADMAELCLVPDVTIPPVATYPSAGGRRETRGMRVPRKEYARSRHQRLFEENVGKTGKDAIYELLSERFGSCIYARGRVFPFAPTYSSIWDEKIRPT

SEQ ID NO: 203736 - protein, 103 aa, Glycine max
  Coding DNA Sequence Number=SeqID_86958
MTPLKEILVVIHHHGQIANDLVHGSAYSCENTIFPYVSRSIAVVVEMMVVVEPWVVFGDVSGKAMRVSNRGYFCEDVVMCDALSNGGIIYRVRKFGRRVRWED

SEQ ID NO: 203737 - protein, 162 aa, Glycine max
  Coding DNA Sequence Number=SeqID_86959
MSFLRRFLMDCIEQHPHKSNPQETQRKDAHAKVEYVKRLYDQVKVQIAKKNESYAKQANKKRKEVVLEPGDDPGQLRTNTYQGNLCGVYPDLSSFTGSGVYPDLSFFTGSGVYPDLSSFTGSGVYPDLSSFTGSGVIQTFVACIKRSVPTQVHISKRCGIVR

SEQ ID NO: 203738 - protein, 86 aa, Glycine max; identical to SEQ ID NO: 124518
  Coding DNA Sequence Number=SeqID_86960

SEQ ID NO: 203739 - protein, 330 aa, Glycine max
  Coding DNA Sequence Number=SeqID_86961
MRGAPTEESLSPFLVRDFGAQSLKVIQRVHKAWRSPLRKDKELRGIRNGIIGGYHGWLRVHTRGLDWLPKLKVINEENFEAPEEDEEVQALKLELGKARLAKEKFKSTATNIRKECTDSNNELKLQREERDQSRVHGMILKEELAACARSKRSLAQHLEATEQSMLAIIGQYKEELNQSVTHEQKLVEDFAQVYTEKEARGRVIDALHQEATMWMDREFTITKKAQRHPYNTRSRKMDNEEGVQEQMKADLSALKDQMASIMKAMLKLQKTIEDNATTTASNAVREAEPVLQPAINLGRDRNTTVFGRRYSLQAYPYGLPPDFTPRAAPE

SEQ ID NO: 203740 - protein, 52 aa, Glycine max
  Coding DNA Sequence Number=SeqID_86962
MHMTQMQFTNTGARETVSFLDTTSRGSKVPQQGIKTEPMFDAYAKGATRECT

SEQ ID NO: 203741 - protein, 85 aa, Glycine max
  Coding DNA Sequence Number=SeqID_86963
MAALRCIQVYIDFTYTSYHNLLMEACSLTSYLFQIPIFEKGYEKDHVIVSKESIREALCNGSDVIIVDTVDFDFVQWKPLQRMAP

SEQ ID NO: 203742 - protein, 53 aa, Glycine max
  Coding DNA Sequence Number=SeqID_86964
MMIRKQRAKLVMATARWALKHPVYGIVILRTKFLNEKLYTVPEFQQTLLKTTK

SEQ ID NO: 203743 - protein, 61 aa, Glycine max
  Coding DNA Sequence Number=SeqID_86965
MKAKCNQMWLGGAKTGKHKHGPLRVGPRLFEPTQAAFFACPELGRDDNRSVMTLASICVRS

SEQ ID NO: 203744 - protein, 186 aa, Glycine max
  Coding DNA Sequence Number=SeqID_86966
MGGYVGARASLLSTTPPFVVMTEELVARGDTLRLSAPRHSVTPSVIDEQRPIWSSAPFPEMSTSSGGDFFKSHKIRRSKSLAFVGRPTRSFILTLRSCDMRRQNLVILHPFAIQTQSCPMARRDKIWSFCTLCHPEAAGPMTCGDKIWSFCTLCHPEAAGPMTCGDKIWSFHTPLPFRHSRVRWHA

SEQ ID NO: 203745 - protein, 218 aa, Glycine max
  Coding DNA Sequence Number=SeqID_86967
  Gene Ontology: Mol. function=helicase activity
  Homolog annotation: Hit_ID=Q1SRJ5; Match level="QueryCoverage=98%, HitCoverage=27%, E-value=2e-46, Identity=40%"; Hit description =Probable helicase [imported]-Arabidopsis thaliana-related
YDRVTAVVIHDDNGTLENAISQNDEIKEYVDCRYISPCESTWRIFCFPIHARKPDVERLHFHIPGQHNVFYEDDDDIDDILSKPSILESKFLAWMNSNKCFSEGRNLTYSQFVSKFVYNQKARSWNLRKKGNTIGRLIWVPPTTGELFYLRMMLTACKGATSFEDIRTVENVLYPTYRETCFAMGFLQDDREFVEAIKEAKDQGVLTKPEELWNQTWN

SEQ ID NO: 203746 - protein, 85 aa, Glycine max
  Coding DNA Sequence Number=SeqID_86968
MWVYVLETSSKIFESIQRLTNWNEGNVTGVFKVFCVCPVFLVVILQRIDGDPVLRETRIWATWEYVSSVGGGQQGMVGLCAICGC

SEQ ID NO: 203747 - protein, 111 aa, Glycine max
  Coding DNA Sequence Number=SeqID_86969
GQIILLQSLQLVAPPNFIPTVEQFNEWVAWPGTQPPLHRDDEDPAAQVPHQPADESSESSTPEPLIRKRRVVVTQEAAATPEKSHEATPEPPAPVADTTSPQQSCLQTPLL

SEQ ID NO: 203748 - protein, 86 aa, Glycine max
  Coding DNA Sequence Number=SeqID_86970
MSTVQPTDDKKERQLMHKLFIKEIATWQREGDIFGSDTLGMTLGEIEGKMESDPTSHHKHSAIFNGDDATRAYQNSDGVKPGICSN

SEQ ID NO: 203749 - protein, 73 aa, Glycine max
  Coding DNA Sequence Number=SeqID_86971
MKTIYNAIHISCTYFLSNFPTLLNSLSFGQLDIYPVPMDRPFVNKEWQFISRSGSLSTRTLESRNQGRYSNNN

SEQ ID NO: 203750 - protein, 127 aa, Glycine max
  Coding DNA Sequence Number=SeqID_86972
  Subcellular localization annotation: CTP_CleavageSite=30; ConfidenceScore=5.42e-01
MEAHTRTPQTRTRQCGCSHGSAAQFATNTNSGRRRNNNNALGVPFPGLFPFLLFFDLRNHGSAGQFDTKTISGRRRKKKNDRVQERGLCNFRSLIYNDNNIGFLKITDVNINYLTSVLIKPMLTSTR

SEQ ID NO: 203751 - protein, 562 aa, Glycine max
  Coding DNA Sequence Number=SeqID_86973
  Gene Ontology: Mol. function=RNA-directed DNA polymerase activity; Cellular component=nucleus; Biological process=RNA-dependent DNA replication
MRGGPQLSMEQREQLVAPITDQEIRKALNGIGDTKSPGIDGFGAKFFKTSWNIIGKDVVAAVRDFFENDRIYKAFNCTLVILIPKNEEAKTIKEYRPIAGCTTIYKIISKIITARMGRVMDSIVGKNQAAFVPGQKIHNHILLAYELIKGYSRKGGTPCCMMQIDLQKAYDMVNWDALECILKEIGVPQQFIRWIMIAVTTVSYRFNVNGCHSNLLQAKRGLRQGDPMSPLLFVIVMEYLNRILYDMQKNPNFNHHAKCEKLSITNLAFADDLLLFSRGDPISVDLMVKAFKNFSESTGLIANPSKCKIYFGGVGDDNKRNILNLTGFNEGPLPFRYLGVPLTSKKLSIHHYMPLVDKIVGRINHWSTNLLTYAGCVQLIRSVTFAIANYWMQCFPIPKYVVHKIEAICRSFLWTGGQEIKRKSLVAWDSVCKPKDYGGLNIIDLSVWNKVTMLKLLWNLSGKSDSLWVKWVNAYYLNKDTLMNVSVKIHNSWIMKSILKHRSSILDIQSIWDSMLEKNRFGMKEVYKSLCTNTSKVRWRNLFRGNTARPRALMTLWLACHG

SEQ ID NO: 203752 - protein, 72 aa, Glycine max
  Coding DNA Sequence Number=SeqID_86974
MKTTGKRVTARAPLHTIDVAERVRFRGSFRGMVFKIGRDGFEGEREFIPLIIKMPPRHILKRFFRTVVDLAS

SEQ ID NO: 203753 - protein, 197 aa, Glycine max
  Coding DNA Sequence Number=SeqID_86975
MEFLLRSSVPNSFIKKTLTALPLSPVEPRLKKTLLLRILQTLLRTTTVSEIVLDILEDLSPISNVNTARTAQSPWSAPSSTSPRALTLSMASTPAPYGGFGAATWQRCRRVRWHDEIEDALGEDSKETRERLAGLNSRRDAMNEVRVYLKEAWEMMGPSFLETVAATEKKNDDGACMEDVAMHYENQEPLEESVDVN

SEQ ID NO: 203754 - protein, 162 aa, Glycine max
  Coding DNA Sequence Number=SeqID_86976
  Gene Ontology: Mol. function=protein binding
  Homolog annotation: Hit_ID=Q09HM7; Match level="QueryCoverage=73%, HitCoverage=29%, E-value=5e-27, Identity=53%"; Hit description =Putative F-box and leucine-rich repeat protein
MDGDAILGLRVCINDALTDDDVLHLILGRVERQEDKEVFRLSLAKYCGNLETLLIGGGLDVSTDVIEWLVIAFQLKILWVEYCQNISYSTVRCILSQCRNLEALSISGGIELTDATFQLIGNEEAGLSLKILDVSHCPNNTVTSIGILMDKCSSQEYLDVTI

SEQ ID NO: 203755 - protein, 96 aa, Glycine max
  Coding DNA Sequence Number=SeqID_86977
  Pfam annotation: Domain name=TMA7; Domain location=40-91; Score=5.7; E_value=0.095; Accession=PF09072.1; Description=Translation machinery associated TMA7
MQSVVERDYSNYKEVSGANNDEGLAIANLRIALQIIDALAKKGIAELFPIQVDMANIQKKKEEAKALKELKAKAQQKGSFEVLGSRKVERNKGSLS

SEQ ID NO: 203756 - protein, 85 aa, Glycine max
  Coding DNA Sequence Number=SeqID_86978
MIMKGQDIYSSQDEVTTSPSSSESEEAKGEESSEEIDSQEERDLLMVRRLLGGQSCDLVNWIDAIKLHLISKFYLLLNDSKVIFN

SEQ ID NO: 203757 - protein, 120 aa, Glycine max
  Coding DNA Sequence Number=SeqID_86979
MGIIVRLKEATTDDKFGPLVVDVSDVARLLPQCQLNGEKETKFRYESKNLKVREALNQMLFLIAVSLTWTKLFQMKSDRMYGRQELWKRLDKLQGKSQYEQNFEKSMEVKGELERLLKQE

SEQ ID NO: 203758 - protein, 108 aa, Glycine max
  Coding DNA Sequence Number=SeqID_86980
  Gene Ontology: Mol. function=threonine endopeptidase activity; Cellular component=proteasome core complex (sensu Eukaryota); Biological process=ubiquitin-dependent protein catabolic process
  Homolog annotation: Hit_ID=O48551; Match level="QueryCoverage=53%, HitCoverage=19%, E-value=7e-13, Identity=92%"; Hit description =Proteasome subunit alpha type 6
MIKRNRLFLKIDGFTDNVVTHLLAGLGVEFCAVYAGSPVDVSMLSRLLRPLKSPQLVSEERIRFVLLLRRRFRMLTLVCSMQDKLLDNTSVTHLFPITKKIFCHHYYY

SEQ ID NO: 203759 - protein, 94 aa, Glycine max
  Coding DNA Sequence Number=SeqID_86981
MGCMLSTLVLILLPISSLLILESQSACALTGKYTPDKPPSGRAKGQNLYSRITDSSSPQEPQHASQAPPVSNTNKNHNQEVSFSLSNNFVSCIT

SEQ ID NO: 203760 - protein, 174 aa, Glycine max
  Coding DNA Sequence Number=SeqID_86982
  Gene Ontology: Mol. function=transcription regulator activity; Cellular component=nucleus; Biological process=regulation of transcription
  Homolog annotation: Hit_ID=Q9LSL1; Match level="QueryCoverage=99%, HitCoverage=58%, E-value=3e-36, Identity=49%"; Hit description =Arabidopsis thaliana genomic DNA, chromosome 5, TAC clone:K21L13
  Pfam annotation: Domain name=HLH; Domain location=30-82; Score=18.0; E_value=0.0017; Accession=PF00010.16; Description=Helix-loop-helix DNA-binding domain
MEPTQSSEMLVFNMGTGLERKNRSNKLQGQPSKNLMAERRRRKRLNDQLSMLRAIVPKISKVCTMQTSILGDSTIDYMKELLEKINNLQQEVEVDSNMASIFKDVKPNEILVRNSPKSCIDFYIFLYWSLQFEVERSVDTRSSCSEESEQRTMLSSKDIKQALFRSAGYGGRCL

SEQ ID NO: 203761 - protein, 655 aa, Glycine max
  Coding DNA Sequence Number=SeqID_86983
  Gene Ontology: Mol. function=UDP-glucose 4,6-dehydratase activity; Cellular component=integral to membrane; Biological process=UDP -rhamnose biosynthetic process
  Homolog annotation: Hit_ID=Q9SYM5; Match level="QueryCoverage=99%, HitCoverage=99%, E-value=0.0, Identity=75%"; Hit description =Probable rhamnose biosynthetic enzyme 1
  Pfam annotation: Domain name=3Beta_HSD; Domain location=8-278; Score=- 42.7; E_value=7e-10; Accession=PF01073.9; Description=3-beta hydroxysteroid dehydrogenaseisomerase family
  Pfam annotation: Domain name=Epimerase; Domain location=7-249; Score =201.4; E_value=2.2e-57; Accession=PF01370.11; Description=NAD dependent epimerasedehydratase family
  Pfam annotation: Domain name=NAD_binding_4; Domain location=9-233; Score=-9.6; E_value=5e-08; Accession=PF07993.2; Description=Male sterility protein
  Pfam annotation: Domain name=Polysacc_synt_2; Domain location=7-292; Score=-109.4; E_value=9.8e-07; Accession=PF02719.6; Description =Polysaccharide biosynthesis protein
  Pfam annotation: Domain name=RmlD_sub_bind; Domain location=6-319; Score=-115.3; E_value=2.9e-06; Accession=PF04321.7; Description=RmlD substrate binding domain
  Pfam annotation: Domain name=adh_short; Domain location=5-176; Score=- 62.5; E_value=0.072; Accession=PF00106.15; Description=short chain dehydrogenase
  Pfam module annotation: Pfam domain module=3Beta_HSD::Epimerase::NAD _binding_4::Polysacc_synt_2::RmlD_sub_bind::adh_short; Domain location=8-278::7-249::9-233::7-292::6-319::5-176
MYEPKNILITGAAGFIASHVTTRLIDSYPSYKIVALDKVDYCSTFKNLQSCASSPNFKFIKGDIATADIVNHILIEEEIDTIMHFAAQTHVDNSFGNSMEFTYNNIYGTHVLLEACRVTNCVKRFIHVSTDEVYGETDLEADIGNHEASQLLPTNPYSATKAGAEMLVMAYHRSYGLPIITSRGNNVYGPNQYPEKLVPKFILLAMKGEKLPIHGDGSNVRSYLHCEDVAEAFDVILHKGEIGQVYNIGTKKERSVLDVAEDICKLFKLNPKDVIEFVQDRPFNDKRYFLDDQKLKQLGWEERTPWEEGLKMTIDWYIKNPDWWGDVSTALNPHPRFSAINLSDEAQWSFQYGYSRLARSYTEVGRKNSGLKFLIYGRTGWIGGLLGKLCEEERIDWEYGRGRLEDRKSLMEDMRRVMPTHVLSAAGVTGRPNVDWCESHKVETIRTNVVGTLTLADVCKEHGLYMMNFATGCIFEYDKEHPLGSGIGFKEEDKPNFIGSFYSKTKAMVEDLLKNYDNVCTLRVRMPISSDLSNPRNFITKISRYNKVVNIPNSMTVLDELLPISIEMAKRNLKGIWNFTNPGVISHNQILELFRDYIDPKFKWENFDLGEQAKVIVAPRSNNEMDASKLKNEFPDLLSIRDSIIKFVFEPNKKT

SEQ ID NO: 203762 - protein, 222 aa, Glycine max
  Coding DNA Sequence Number=SeqID_86984
  Homolog annotation: Hit_ID=Q1SDY9; Match level="QueryCoverage=43%, HitCoverage=17%, E-value=1e-30, Identity=68%"; Hit description =Peptidase S8 and S53, subtilisin, kexin, sedolisin; Zinc finger, CCHC- type
MKESESVKEITDRLLKVVTQIRLVGEELSDQHVVEKILVCLLERFKSKISSLEENKDFSQISIPKLVNVLQATEHRRSLRMEESMESALVAYTKGKAQGRSSPSKKSYGGKEKEEEATRKEELDQTYFSKVTIGNGGHVDVKGKGVVVETPSGGEGQSLRGVVGELAKLLQLNGFICPTPSTPPASDSPTRTCGSNPMMVFGFTLGSSSSSLIVEVLFLLFS

SEQ ID NO: 203763 - protein, 165 aa, Glycine max
  Coding DNA Sequence Number=SeqID_86985
  Homolog annotation: Hit_ID=Q3IA99; Match level="QueryCoverage=46%, HitCoverage=10%, E-value=8e-23, Identity=66%"; Hit description =Disease resistance protein
  Pfam annotation: Domain name=TIR; Domain location=91-165; Score=17.7; E_value=1.2e-06; Accession=PF01582.10; Description=TIR domain
AEELKGQGGERLTLTEPQEVKVACMDCGEGRVPVLRGGAGFGWRWRCAAVLQDKGGDVEHIEFEMAEQQMTNVVASSSNSSSMLSLEKYDVFLSFRGEDTRRNFTSPLYEALLQKKIETYIDYQLEKGDEITPALIKAIEDSCISIVIFSKNYASSKWCLDELSK

SEQ ID NO: 203764 - protein, 206 aa, Glycine max
  Coding DNA Sequence Number=SeqID_86986
  Gene Ontology: Cellular component=integral to membrane; Biological process=intracellular protein transport
  Homolog annotation: Hit_ID=Q9LRP1; Match level="QueryCoverage=100%, HitCoverage=78%, E-value=2e-79, Identity=74%"; Hit description=Novel plant SNARE 13
MASNLQMSPQVEQIHGEIRDNFRALANGFQKLDKIKDANRQSNQLEELTDKMRECKRLIKEYDREIKDEEGRNPPEVNKQLNDEKQSMVHISSISAFDTIASFEGYGTNQIANTGASVSTAEENVQLASEMSNQELINAGTKTMDETDQAIERSKQVVHQTIEVGTQTAATLKGQTEQMGRIVNELDSIQFSIKKASQLVKEIGRQ

SEQ ID NO: 203765 - protein, 258 aa, Glycine max
  Coding DNA Sequence Number=SeqID_86987
  Gene Ontology: Mol. function=calcium ion binding; Cellular component =intracellular; Biological process=guanosine tetraphosphate metabolic process
  Homolog annotation: Hit_ID=Q84LE6; Match level="QueryCoverage=96%, HitCoverage=55%, E-value=3e-93, Identity=58%"; Hit description=RelA -SpoT like protein RSH4
  Pfam annotation: Domain name=RelA_SpoT; Domain location=83-178; Score= 110.2; E_value=6e-30; Accession=PF04607.7; Description=Region found in RelA  SpoT proteins
  Pfam annotation: Domain name=efhand; Domain location=190-218; Score =35.8; E_value=1.5e-07; Accession=PF00036.22; Description=EF hand
  Pfam annotation: Domain name=efhand; Domain location=224-252; Score =15.5; E_value=0.2; Accession=PF00036.22; Description=EF hand
  Pfam module annotation: Pfam domain module=RelA_SpoT::efhand::efhand; Domain location=83-178::190-218::224-252
MEVMKIHAPLAHAVGTTYLSLELEDLSFQYLFPYSYLYVDFLWLQSHETGGVSLIDIYKEELLQNLKADPLLAELVDDVLIKGRYKSRYSTMKKLLKDGRKPEDVNDIIQSMWKEVPYRTKDYIARPKANGYKSLHLAVEVIENGKTRALMEIQIRTTEMDRLAVGGTAAYSLYKAGLTDPEEVGIEIDQRDRVFRLLDKNGDGKISIEELTQVMEELGAPGEDAREMMQLLDSNSNGPLSSDEFHMFQEQTYDGDQD

SEQ ID NO: 203766 - protein, 257 aa, Glycine max
  Coding DNA Sequence Number=SeqID_86988
  Homolog annotation: Hit_ID=Q67X36; Match level="QueryCoverage=34%, HitCoverage=14%, E-value=6e-28, Identity=60%"; Hit description =Pentatricopeptide (PPR) repeat-containing protein-like
MVHISDIKLIRTDTTLDLSQKAEKGFLLRNTFNIDEKDNNSEQLRLNLPIVFTRTLSITKIVETAPISYYYIIIINLGDHFTCLVTIFTDPQILGDAKGLSSFGLQQTISNCKFFTMVEQGILPFLLNKIMQHTIRLTSNDPTTTNIVVVVVEKKRETKQAELNEWRCCSCWVPILPFAIPFPSPPSPFLPLIHSPAALGGGSVQRVDGENERAVDELSASSVQVPQTFHSHLAEFSSRSRWSFPSLQSHIRRYAPR

SEQ ID NO: 203767 - protein, 177 aa, Glycine max
  Coding DNA Sequence Number=SeqID_86989
MGCMSCGCLSFLTVLFRWVVLSFSIGGDLPDKVSARVCDEGVAVVVDDDIIGSIDLFGGEGGEEEAAAGAEVVGDEGVERRDPRRKCCGGGVGGVLFSGNLLLCFLRVKDYNQGSPCLAGNILVYNKSQIVTIRKNIDRNSSYCWRQHNLVLLRDSGQRFLRIPQTRQMEICVSPCK

SEQ ID NO: 203768 - protein, 79 aa, Glycine max
  Coding DNA Sequence Number=SeqID_86990
MKTEVVFPQHHRTIAGLQKYQCDDPEKDTNTSVSDTQQMFVACNTFHGHAPAFFGNILPLQQSPFEIDAQMQDHVTLAQ

SEQ ID NO: 203769 - protein, 130 aa, Glycine max
  Coding DNA Sequence Number=SeqID_86991
  Gene Ontology: Mol. function=protein serine/threonine kinase activity; Cellular component=cytoplasm; Biological process=protein amino acid phosphorylation
  Homolog annotation: Hit_ID=Q1SD37; Match level="QueryCoverage=100%, HitCoverage=36%, E-value=6e-40, Identity=54%"; Hit description =Protein kinase; NAF
  Pfam annotation: Domain name=Pkinase; Domain location=23-129; Score= -89.1; E_value=0.003; Accession=PF00069.15; Description=Protein kinase domain
MVIINLVKKKKKSEREGMRLGKYDLGRTLGEGNFGKVKFARNTDSGQAFAVKIIDKNTIVDINITNQASKGKHIEGEGRKLFQQLIDGVSYCHTKGVFPRDLKLENVLVDNKGNIKITDFGLSALPQHLR

SEQ ID NO: 203770 - protein, 1527 aa, Glycine max
  Coding DNA Sequence Number=SeqID_86992
  Gene Ontology: Mol. function=RNA-directed DNA polymerase activity; Cellular component=chromatin; Biological process=chromatin assembly or disassembly
  Pfam annotation: Domain name=Chromo; Domain location=1429-1479; Score= 25.0; E_value=0.00027; Accession=PF00385.14; Description='chromo' (CHRromatin Organisation MOdifier
  Pfam annotation: Domain name=Extensin_2; Domain location=30-386; Score=-139.9; E_value=0.079; Accession=PF04554.4; Description =Extensin-like region
  Pfam annotation: Domain name=RVP_2; Domain location=363-497; Score= -43.9; E_value=0.0026; Accession=PF08284.2; Description=Retroviral aspartyl protease
  Pfam annotation: Domain name=RnaseH; Domain location=867-988; Score= -21.5; E_value=0.0059; Accession=PF00075.14; Description=RNase H
  Pfam annotation: Domain name=rve; Domain location=1123-1279; Score =109.3; E_value=1.1e-29; Accession=PF00665.16; Description=Integrase core domain
  Pfam annotation: Domain name=zf-CCHC; Domain location=294-311; Score =7.0; E_value=0.07; Accession=PF00098.13; Description=Zinc knuckle
  Pfam annotation: Domain name=zf-H2C2; Domain location=1068-1105; Score=27.3; E_value=5.5e-05; Accession=PF09337.1; Description=His(2)- Cys(2) zinc finger
  Pfam module annotation: Pfam domain module=Chromo::Extensin_2::RVP _2::RVT_1::Retrotrans_gag::RnaseH::rve::zf-CCHC::zf-H2C2; Domain location=1429-1479::30-386::363-497::610-779::106-297::867-988::1123- 1279::294-311::1068-1105
MVDPESTSLSPDKLEDVLSRLTKQQLYLGESVNAMTLKIDELIQRISPVFSTTPPTPPPLPPPVPTPIHRLKLDVPRFDGSDPLGWIYKITQFFEYHGTPDSDKLTIASFYMEGRALAWFQWMNTSEQFPSWPAFLHALRTRFASSQFEDPSGALSKLTQTGTVTQYLSDFEDLANRTTGLPSTFHLPPQLLYLRPHPGDTAGGSSPPAGHLGSSRGPRALAGGECPPSGFPSFPQINPNSPVSFPPLSPILKTPSPPPPSALPPLLPPPPPRPPPQTWKRLSPEEIASRRERGLCFNCEEKFHRGHRCSSRFFLLISDEDDPPLSHIPNFDPPITLTNDPIPTQPTDPPESPPSYSAQISLNSLAGHVAPETIRFIGAISDHPLLLLVDGGSTHNFVQQQLVTQLGLSCRTTSPLRVMVGNGQYLECHSICEAISVQIQNHNFTVDLHVLPISGANVVLGVQWLKTLGPVLTDYSTLSMQFIHNDQLITLQGDPEASLSSMSSSQFRRLCRTQPQGLYFQITILANDTPPSSPDTLPPSLQALLTKYAVLFQPSPTLPPPRPTDHHIHLLPSSTPVNVRPYRYPHFQKQEIELQVESMLQKGLIQPSTSPFSSPVLLVKKHDGSWRFCVDYRALNSLTVKDRFPIPTIDELLDELGGAQCFSKLDLLQGYHQIRMHSEDIPKTTFRTHHGHYEFRVMPFGLCNAPSSFQATMNFIFRPFLRRFVIVFFDDILIYSSSFEDHLRHLDLTFQVLLDNHFVLKKSKCSFGQSQVEYLGHLVSQRGVEPMSDKVAAIVNWPQPHSTRAVRSFLGLAGFYRRFIRGYAMIAEPLVKATSDPFRWTPQAQQAFEALKSALSTAPVLSLPDFQEPFTVETDASGNGMGAILSQRGHPIAYFSKPFPKKLLRASTYVRELFAITSALKKWRQYLLGHSFTIVTDHRSLKELLTQVIQTPEQHMYLARLMGFDYQIQYRSGKHNQAADALSRSPDFHPSLSLLLSIPCLTFLEELRQQLANNPQYCQRQQDFINSPASYPDFTLSQNFLLYKGKIWLPRELPLIQTLMQEYHATPMGGHMGVAKTTARLSENFMWPGLRSDVATFVANCTECQFTKYETKRTAGLLCPLPVPFRPWEDLSLDFITGLPSYQGKTVLLVVVDRFSKGIHLGILPTAHTAHMVASLFIDIVVKLHGQPRSLVSDRDPLFMSTFWQELFKLSGTRLRMSSAYHPQSDGQTEVMNRVIEQYLRAFVHRRPGTWGRFLPWIELSHNTSWNVGTGSTPYEITFGRKPFSFPDYITGSSKLDAVDDILKHREEVFLCIRQKLLKAQAAMKQTADAKRREVEYEVGAWVLLKLRPYRQRSAKEAPANSGKLAKRFYGPFLILEKIGKVAYRLKLPEGARIHPVFHCSLLKPFHGASVTSDTPSLPDQFLNNQPIISPLAILDTRRAATPEGSWEVLVQWKGLLPDDTSWEDWEQLKQTHHLEDKVILQGPREDDSNRATPEEEIEKAADMNTGVQTAKPKRRITRPAYLRDYA

SEQ ID NO: 203771 - protein, 640 aa, Glycine max
  Coding DNA Sequence Number=SeqID_86993
  Gene Ontology: Mol. function=hydrolase activity; Cellular component =cytosol; Biological process=metabolic process
  Homolog annotation: Hit_ID=Q9FI75; Match level="QueryCoverage=93%, HitCoverage=94%, E-value=0.0, Identity=72%"; Hit description =Similarity to 5'-nucleotidase
  Pfam annotation: Domain name=5_nucleotid; Domain location=217-631; Score=584.4; E_value=1.1e-172; Accession=PF05761.4; Description=5' nucleotidase family
  Subcellular localization annotation: CTP_CleavageSite=54; ConfidenceScore=5.52e-01
MYAAEVFRVFAVRGGNASPAVAPTTNCLKIAAFSTPTFRNSVNARWAKALTLCRCSVDSKSSVGDEVFSVTQSNKSDVDYLGESTKGDLNVKLEHLEAFGIDGHASLDGPIEEVARSEARKAEDLLQDLGIPSPSSSRNSPRGIFCSRTLNLRSISAIGYDMDYTLIHYNVMAWEGRAYDYCMENLKNMGFPVDGLAFDPDLVIRGLVIDKEKGNLVKADRFGYIKRAMHGTKMLSTRAVSEMYGRELVDLRKESRWEFLNTLFSVSEAVAYMQMVDRLDDGTIPADLALDYKGLYKAVGKALFWAHVEGRLKSEIMSKPELFVEPDPELPLALLDQKEAGKKLLLITNSDYLYTDKMMRHSFNRFLPNDMGWRDLFDIVIVSARKPEFFQTSHPMYEVVTGEGLLRPCFKAQTAFGSAAAYFTEMGMEGGLYSGGSAQMVENSLDIHGDEILYVGDHIYTDVSQSKVHLRWRTALICRELEEEYSALIGSRGYRESLVELISQKEVVGDLFNQLRLALQRRSKDRPAQTLAATNLDDEDLTDSMQKLLIVMQRLDEKIAPMLEADGELFNSRWGFLSRAGLWDKSHLMRQIEKYADIYTSRVSNFLYYTPFMYFRSQEQNLAHDSYTYYCSQLYNENSS

SEQ ID NO: 203772 - protein, 283 aa, Glycine max
  Coding DNA Sequence Number=SeqID_86994
  Gene Ontology: Mol. function=pseudouridylate synthase activity; Biological process=tRNA processing
  Homolog annotation: Hit_ID=Q0WPX6; Match level="QueryCoverage=90%, HitCoverage=87%, E-value=1e-100, Identity=63%"; Hit description =Putative tRNA pseudouridine synthase
  Pfam annotation: Domain name=PseudoU_synth_1; Domain location=145 -252; Score=106.2; E_value=9.9e-29; Accession=PF01416.10; Description= tRNA pseudouridine synthase
  Pfam annotation: Domain name=PseudoU_synth_1; Domain location=30-133; Score=73.4; E_value=7.3e-19; Accession=PF01416.10; Description=tRNA pseudouridine synthase
  Pfam module annotation: Pfam domain module=PseudoU_synth_1::PseudoU _synth_1; Domain location=145-252::30-133
MDPIVSYADCVEVEHGHGVKPIQDWYKWRLVLAYDGTKYAGWQYQQSPPTVQCTLEKALTRATKLQRKDFCLVGASRTDAGVHAWGQVAHFFTPFNYDNLEELHAALNRKIYHYKIYNDAIMDPFQRHFAYHSVYKLNSAVMREAAKYFVGKHDFSAFANASNNDGVPDPVKHVFRFDLKEMGALLQIEVEGSGFLYRQVRNMVALLLQIGREAIPPDIVPHILASRDRKELAKYSLSAPPHGLCLVSINYNESHLLPPPGCPPANSFGRHHTIRKCKVPFFL

SEQ ID NO: 203773 - protein, 67 aa, Glycine max
  Coding DNA Sequence Number=SeqID_86995
MPILKMILPLVAQFFKEKRVRDKKAHVECIGTTRAPCLPCTDGDGGGVGEEDDERMRVTRLRSSSIF

SEQ ID NO: 203774 - protein, 333 aa, Glycine max
  Coding DNA Sequence Number=SeqID_86996
  Gene Ontology: Cellular component=integral to membrane
  Homolog annotation: Hit_ID=Q4KIM9; Match level="QueryCoverage=57%, HitCoverage=85%, E-value=2e-20, Identity=35%"; Hit description =Membrane protein, putative
  Subcellular localization annotation: CTP_CleavageSite=43; ConfidenceScore=5.78e-01
MPISAARSAIACAMAGLGSSSSAMSVYGCSTRKSASSSGRKASAATAFTGGRRLDAARIARQQRHAGLLLQPAHACAGGGQRQPDALGAGGDAAGLEHRRQQPQIDKAGSAIAALCRGAAPATIGPLIRHKDRRMSLTGDRFGVADGVDGAAQPDDAAGAGRRAAAVALIDHQPVATAVRAAVGGAVPSALADDAVRHAGNLAERRHAHRHRRPPGAAGAGHLPDRLCAVGFYPFRLARFRCGGALAGAAVRPVDRRADRRHRRVRHTGGAGAVVHRLDAGAGRRISLASGAARRVARRFAVGAAAGVGRHVAGRDRASSQQPADFSSPFLYW

SEQ ID NO: 203775 - protein, 163 aa, Glycine max
  Coding DNA Sequence Number=SeqID_86997
  Gene Ontology: Mol. function=alcohol dehydrogenase activity; Cellular component=membrane; Biological process=electron transport
  Homolog annotation: Hit_ID=Q2XF97; Match level="QueryCoverage=53%, HitCoverage=7%, E-value=2e-25, Identity=61%"; Hit description =Aldehyde dehydrogenase family protein, putative/cytochrome c family protein, putative
RSAGDGQLCDVAEHQGDAECGTAGAVGGPRLAGGGATGRRAACHSAAAGGPQLFGVSPDLANNTNIFSDRPDNLIKVILQGIPKPATAELGFMPGFKDSFSDRQVTALVNYLRQRYAGDKPAWRDVEAQAKVPAIILCHGFCGIQELLLPAFAEAFVNVGFAA

SEQ ID NO: 203776 - protein, 344 aa, Glycine max
  Coding DNA Sequence Number=SeqID_86998
  Pfam annotation: Domain name=Sulfakinin; Domain location=258-266; Score=1.1; E_value=1.4e+02; Accession=PF08257.2; Description =Sulfakinin family
  Pfam annotation: Domain name=Sulfakinin; Domain location=292-300; Score=2.8; E_value=51; Accession=PF08257.2; Description=Sulfakinin family
  Pfam annotation: Domain name=Sulfakinin; Domain location=8-19; Score =5.3; E_value=12; Accession=PF08257.2; Description=Sulfakinin family
  Pfam annotation: Domain name=Sulfakinin; Domain location=98-109; Score=5.3; E_value=12; Accession=PF08257.2; Description=Sulfakinin family
  Pfam module annotation: Pfam domain module=Sulfakinin::Sulfakinin::Sul fakinin::Sulfakinin; Domain location=258-266::292-300::8-19::98-109
  Subcellular localization annotation: CTP_CleavageSite=60; ConfidenceScore=5.14e-01
MSSVIYAFKDYNVFGHLRFQRLQCLQTFILSKTSMSFVIYAFKDYNVFSLLRFQRQQCLQSFTLSKTTMSSVNYIYKTTMSSAFYIYKTTMSSVIYAFKDYNVFGHLRFQRLQCLQTFILSKTSMSFVIYAFKDYNVFSLLRFQRQQCLQSFTLSKTTMSSVNYIYKTTMSSAFYIYKTTLSSVIYTFKDYNVLSHLCFERLQCLHSFTFTRLQCLQSFTLLKTTMSYVIYAFKDYNVFSHLHLQDYNVFSFLHLQDYNVFSHLRFQRLQCLKSFTFSKTTMSSAIYALQDFNVFSHLRFQRLQYPNSPRLASGSPGPWNYLLAKQPTRLGKLQLAWASSLLQG

SEQ ID NO: 203777 - protein, 116 aa, Glycine max
  Coding DNA Sequence Number=SeqID_86999
MDGQWLKKDAKPPQDECTPSPPPQRDDSSTLMFFRSYEASTPMLVNALIPWMVVYMPLMLALKEWIPASLSLRRMKLNCHHQKRGDCRSKDFDVLMMPKDHALLKFNSRGSYASQG

SEQ ID NO: 203778 - protein, 97 aa, Glycine max
  Coding DNA Sequence Number=SeqID_87000
MDNIMSKLFNLDVYPEINEDFFNLSLYGSVITLVSSILMFLLFYSELQRKRERRCHFKEKMSLEEAHHQRRPWIRAWRKKEMNEGRGREEHEILCSK

SEQ ID NO: 203779 - protein, 277 aa, Glycine max
  Coding DNA Sequence Number=SeqID_87001
  Homolog annotation: Hit_ID=Q1SCP5; Match level="QueryCoverage=22%, HitCoverage=35%, E-value=5e-23, Identity=80%"; Hit description =Ribosomal L18ae protein
  Pfam annotation: Domain name=Ribosomal_L18ae; Domain location=61-179; Score=13.3; E_value=5e-09; Accession=PF01775.7; Description=Ribosomal L18ae protein family
MSNNTIKLQEVQLLETNNKKNQEEKFYPFHFYITYVIKEQPAETPVTLSIFSQFYITSTCQFHQYQVVGRALPMEPDQHPKIYRMKLWSINKVRAKSKFWYFLRKLKKVKKSNDQVFIINKDFCNKVGNVLRQSVAFSTKALVSSMLNYIRCMFSSKLFIGGLSYGVDDQSLKDVFSDFGDMVDSLTLASASHGMANILCCVIDFFEIFHDLNEEVRATAARGHGLMARVKQLERLKFLHWRRLFFLKLIFLILYKWMLDFSLQSPIVIIRCNCPFC

SEQ ID NO: 203780 - protein, 136 aa, Glycine max
  Coding DNA Sequence Number=SeqID_87002
MVNVPEWGLKLHMLACRVQLLRARRPRSYNRTDMEALNQLAGERGCPVLKEVSCVEGICPVLRECGNLDECKRIAGRYDLSSPRAWASVVRAASVKLSVMNMSLVCQVSKHVQRMRYTLTYMSFMEWACTGVAVRA

SEQ ID NO: 203781 - protein, 142 aa, Glycine max
  Coding DNA Sequence Number=SeqID_87003
  Homolog annotation: Hit_ID=Q1SDG9; Match level="QueryCoverage=46%, HitCoverage=30%, E-value=3e-07, Identity=43%"; Hit description=Zinc finger, CCHC-type
MAERNDRAIAYALRALTQVMENHNGGGGVVRFNKLNRRDHDPYHAYNWLQEIEKIFRAMACPDYQKVTLDEKAITSPKEVVESIREEEGSTEDVSRVLKWIKRKTLWWTEVPLEVGGRSKGNRKPKNTRTSEKVRKQEDSEQ

SEQ ID NO: 203782 - protein, 80 aa, Glycine max
  Coding DNA Sequence Number=SeqID_87004
MALGAMQSLLELRVVLEDISHHQLNAMSFAIVGGGLNNWVQLRHRDLGRGLTRMVARKVVGAVDYCIIITSFAVEDKDFI

SEQ ID NO: 203783 - protein, 118 aa, Glycine max
  Coding DNA Sequence Number=SeqID_87005
MAKRKSWFGWVKRLFTSESKDNKKPNRWGWSFGRIKQKQYPTITAPNRTLIEASEEQRKHALTVAIATAAAAEAAVAAAHAAAEVVKLTGTSRSYSYLSKGDKSLAAIKIQSTYRAHL

SEQ ID NO: 203784 - protein, 67 aa, Glycine max
  Coding DNA Sequence Number=SeqID_87006
MDRLKKLVHYLHGPWALRASPWTRAHLPIPTRDRPSFQAGAGPAGIPEDKDGAQEDDDMADVMDFFL

SEQ ID NO: 203785 - protein, 116 aa, Glycine max
  Coding DNA Sequence Number=SeqID_87007
  Gene Ontology: Mol. function=ATPase activity, coupled to transmembrane movement of substances; Cellular component=integral to membrane; Biological process=transport
  Homolog annotation: Hit_ID=Q94IH6; Match level="QueryCoverage=91%, HitCoverage=8%, E-value=3e-21, Identity=49%"; Hit description=CjMDR1
MVAEAGLEADMTSTKTTGSTSDHPPAQGPENTQEIEYMQQDCKKNKMKGESNKTVPFYKLFSFADSWDCLLMVVGAISAVGNGISMPLMTILIGDAIDAFGGNVDNKQAVVHQVSK

SEQ ID NO: 203786 - protein, 368 aa, Glycine max
  Coding DNA Sequence Number=SeqID_87008
LPAALMSHSQWRKNVVGSLQGNGVYVKGKQEHERTQGKGSGGRQRKKSKSRKCKKEKSVTNATKRGISIGNDRECVVVGMRQVQIAMDNELMEIEIPSECVRGEHEMVELHKRGLLKGIQSCKLNRPLTERAQRLRLQANLSKGFWAKVVNMGAVFDEQSTLPEIVETTMSVSTGAFPNFIEVTPIPESGSVSLGGPHQEYHLVKDKDHCSIKPVVQYGFEELANLVAFALFTSARSFYHEKDNMVKEMKSLQKNQTKDQVELPAGNKTMGYANGCTRGNLYKGAVLASVANRDMHLEQMDVKTTFLDNDVCEWIEAISKAVVWKKLESQYMSKPLRFEVKVGPCMEARKRVPHVLWQHKVLEHVGGN

SEQ ID NO: 203787 - protein, 492 aa, Glycine max
  Coding DNA Sequence Number=SeqID_87009
  Gene Ontology: Mol. function=nucleic acid binding; Cellular component= nucleus; Biological process=regulation of transcription from RNA polymerase II promoter
  Homolog annotation: Hit_ID=UPI000034F468; Match level="QueryCoverage =98%, HitCoverage=69%, E-value=0.0, Identity=73%"; Hit description =ATP binding / ATP-dependent helicase/ DNA binding / helicase/ nucleic acid binding
  Pfam annotation: Domain name=Helicase_C; Domain location=308-386; Score=78.2; E_value=2.6e-20; Accession=PF00271.21; Description =Helicase conserved C-terminal domain
  Pfam annotation: Domain name=SNF2_N; Domain location=4-273; Score= -19.6; E_value=4.5e-07; Accession=PF00176.13; Description=SNF2 family N-terminal domain
  Pfam module annotation: Pfam domain module=Helicase_C::SNF2_N; Domain location=308-386::4-273
MMCVFLLQAIAVASCIQDLWPVLIIAPSSLRLQWASMIQQWLNIPSSDILIVLSQSGGSNRGGFNIVSSSAKSSIRLDGLFNIISYDLVPKLQNMLMTHDFKVVIADESHFLKNAQAKRTTASLPVIKKAQYALLLSGTPALSRPIELFKQLEALYPDVYRNVHEYGNRYCKGGVFGVYQGASNHEELHNLIKATVMIRRLKKDVLSQLPVKRRQQVFLDLENKDMKQINALFQELEMVKAKIKAAKSQEEAESLKFAQKNLINKIYTDSAEAKIPSVLDYIGTVIEAGCKFLIFAHHQPMIDSIHEFLLKKKVGCIRIDGGTPAASRQQLVTDFQEKDAIKAAVLSIKAGGVGLTLTAASTVIFAELSWTPGDLIQAEDRAHRIGQVSSVNIYYLLANDTVDDIIWDVVQSKLENLGQMLDGHENVLEVSASLPVNSPSKQKTIDQYVRKSDNMGSLVSSPSKQKTLDQFVRRCDNTDRLEYEPNPKRPRS

SEQ ID NO: 203788 - protein, 576 aa, Glycine max
  Coding DNA Sequence Number=SeqID_87010
  Homolog annotation: Hit_ID=Q84UR3; Match level="QueryCoverage=57%, HitCoverage=37%, E-value=2e-69, Identity=42%"; Hit description =Proline-rich protein family-like
  Subcellular localization annotation: CTP_CleavageSite=71; ConfidenceScore=5.70e-01
MKQKTPSSPTTARNASKMQGDKSLQSPPPPPPPRLRASSKAPKSPPEIVNRESISSTRAKSVPPDLKNVSRAKRGVVVNKPKLNEEAKVVVVARPRRRVGDFDLQKNEDDDPDGKKKKELQEKLEVSENLIKSLQSEVLALREELDRVKSLNVELESRNTKLTQNLAAAEAKISTVDIGNNGKKGPIGEHQSPKFKDIQKLIAEKLERSRVKKEGTPEIIFAKASISAPTPSYAIPETTSIGRKSPPNTCLQPPPPVTSVGRKSPSNTCLQPPPPPPIPTRPLARLANSQKSPAIVELFHSLKNKDWKIDSKGSVNHQRPVVISAHSSIVGEIQNRSAHLLAMVTTDHPFQIRADIETKGEFINDLIRKVVDAAFTDIEEVLKFVDWLDVKLSSLADERAVLKPFKWPEKKADAMREAAVEYHELKMLEQEISSYKDDPDIPCGAALKKMASLLDKSERSIQRLIKLRSSVTHSYQMYNIPTAWMLDSGIMSEIKQASMTLVKTYMKRVTMELESIRNSDRESIQDSLLLQGMHFAYRAHQFTGGLDSETMCAFEEIRQRVPGHLAGSRELLAGIP

SEQ ID NO: 203789 - protein, 257 aa, Glycine max
  Coding DNA Sequence Number=SeqID_87011
  Gene Ontology: Mol. function=nucleic acid binding
  Homolog annotation: Hit_ID=UPI000034F468; Match level="QueryCoverage =69%, HitCoverage=23%, E-value=4e-35, Identity=47%"; Hit description =ATP binding / ATP-dependent helicase/ DNA binding / helicase/ nucleic acid binding
  Pfam annotation: Domain name=HARP; Domain location=148-207; Score =4.2; E_value=0.099; Accession=PF07443.4; Description=HepA-related protein (HARP)
MGIEFEYWSGRDPSQEGKKNFHVYEREKEGKKKRASIAFERASMEVEDDWDLSAEDLDSLERDAFQKIAQLRNPTPSSPHQRHHSATATTNHLPPKPLPDSRPQTAGTLSQAARALPTSFKSGTNNDKQSKELPKFSVKFFLHSSGNVAAKFQYDQVVIAAFRRIPRSSWNAKERLWIFPLSSLLEAEKVLGEIPSYSVQIDNLDPLVKRAVAAASAVPDLQGLQMLEVYICVFFFLKNNEVAIFVRFTERSIPQDP

SEQ ID NO: 203790 - protein, 294 aa, Glycine max
  Coding DNA Sequence Number=SeqID_87012
  Pfam annotation: Domain name=PHD; Domain location=49-106; Score=8.6; E_value=0.0079; Accession=PF00628.19; Description=PHD-finger
MNSRQASPSPCDICGATQTLSLTIHNIRYRAHTCRYCTNCVLKQHPGLFCPLCFELHDDSPLPPHHRLMCVRCPAVAHRSCAFPSTNVSAAPAPAPPFFCPSCLDSNFTYFKLPDRKSGAVDVQSAKVLVTAARIAAVSMSKAAAAARYDAERRAREAAVARKRAKDALEHLAEILAREQAEQDEEDINEQNGIVSAGRRRGAFLVRASDCIVACHVVILMMHLLSFKKFTGNCVSGYLQLRPVAVGVGKICGMHSNANPTDKSNMNARARILIRWQNLFCLKCNSAMDSQTCS

SEQ ID NO: 203791 - protein, 78 aa, Glycine max
  Coding DNA Sequence Number=SeqID_87013
MKGKIKTTYRKRIQYQQFMCGSQFAVIWSDRNARIFIGHQLTLESIQDQAVQSTERQCLKIPINCISLSTDLLYHIVA

SEQ ID NO: 203792 - protein, 218 aa, Glycine max
  Coding DNA Sequence Number=SeqID_87014
  Gene Ontology: Mol. function=transferase activity; Cellular component= cytoplasm; Biological process=auxin mediated signaling pathway
  Homolog annotation: Hit_ID=Q40480; Match level="QueryCoverage=99%, HitCoverage=99%, E-value=1e-72, Identity=58%"; Hit description=C-7 protein
  Pfam annotation: Domain name=GST_C; Domain location=103-192; Score =47.8; E_value=3.7e-11; Accession=PF00043.15; Description=Glutathione S-transferase, C-terminal domain
  Pfam annotation: Domain name=GST_N; Domain location=3-77; Score=82.5; E_value=1.4e-21; Accession=PF02798.10; Description=Glutathione S -transferase, N-terminal domain
  Pfam module annotation: Pfam domain module=GST_C::GST_N; Domain location=103-192::3-77
MADEVVLVNFNLSMFCIRVRIALEEKGVKYEIKEEDLVNTKSALLLQMNPVHKKVPVFIHNGKPISESLIIVEYIDEVWKDKAPLLPTDPYQRAQARFWADFVNNKVHEVAKRIWTGKVGEHEAEKKELIENVKQLEEVLGDKPYFGGETFGFVDIALIPFYKWFSSYEKVGNFKLHYPKLIGWANRCLERESVSKSVSDEKDVYEFVLMYRKLIGVD

SEQ ID NO: 203793 - protein, 87 aa, Glycine max
  Coding DNA Sequence Number=SeqID_87015
MTVAVWLVAGFFGDFFLGACDSEFDYGNLPKGFTEAAYLCHYYAKLSPRNSYAIGPLNFLINKVTVGTWPDMGMQKEKGKCRIRQGI

SEQ ID NO: 203794 - protein, 166 aa, Glycine max
  Coding DNA Sequence Number=SeqID_87016
  Gene Ontology: Mol. function=serine-type endopeptidase activity; Cellular component=intracellular; Biological process=protein modification process
  Homolog annotation: Hit_ID=Q22HA6; Match level="QueryCoverage=91%, HitCoverage=17%, E-value=1e-73, Identity=91%"; Hit description =Ubiquitin family protein
  Pfam annotation: Domain name=ubiquitin; Domain location=19-87; Score =132.9; E_value=9e-37; Accession=PF00240.13; Description=Ubiquitin family
  Pfam annotation: Domain name=ubiquitin; Domain location=95-163; Score= 137.1; E_value=4.8e-38; Accession=PF00240.13; Description=Ubiquitin family
  Pfam module annotation: Pfam domain module=ubiquitin::ubiquitin; Domain location=19-87::95-163
MYLVLMVWFVIEQMQIFVKTLTGKTITLEVESSDSIENVKAKIEEKEGIPPDQQRLIFAGKQLEDGRTLEDYEIQKESTLHLVLRLRGGMQIFVKTLTGKTITLEVEGSDTIENVKAKIQEKEGIPPDQQRLIFAGKQLEDERTLEDYDIQKESTLHLVLRLRGGF

SEQ ID NO: 203795 - protein, 148 aa, Glycine max
  Coding DNA Sequence Number=SeqID_87017
  Gene Ontology: Mol. function=transporter activity; Cellular component= membrane; Biological process=oligopeptide transport
  Homolog annotation: Hit_ID=Q9CAS0; Match level="QueryCoverage=57%, HitCoverage=13%, E-value=5e-21, Identity=56%"; Hit description =Putative peptide transporter; 37139-33250
MEGNKETKQYGLDSATSWFGSCISSCSSSEKVGTHGKLPRTASESSGMKHSERLAVFGLFARFMVYLTREFHLDQVYASNIISLWFGISNFIPLLGAFISDAYVGRFRTIAFASFGTLSVRSYLCGCLSHILRLDFQYKRKITLTCLL

SEQ ID NO: 203796 - protein, 135 aa, Glycine max
  Coding DNA Sequence Number=SeqID_87018
MTWTIPQLFLKPLQVMWDATVFGVFNPDFLLYIKHEDLSEIAHGGNSDVYRFLKPQSIQRSGQSQFESESYLKCWMQSSKRDVYLGAYLNGPDNYLKGIVNSALKGLHDTPQPKSNAGARWIVVKYFNDVRPLEA

SEQ ID NO: 203797 - protein, 317 aa, Glycine max
  Coding DNA Sequence Number=SeqID_87019
  Gene Ontology: Mol. function=transferase activity; Biological process= flavonoid biosynthetic process
  Homolog annotation: Hit_ID=Q94CD1; Match level="QueryCoverage=99%, HitCoverage=65%, E-value=2e-36, Identity=32%"; Hit description =Putative N-hydroxycinnamoyl/benzoyltransferase
  Pfam annotation: Domain name=Transferase; Domain location=2-317; Score=-16.6; E_value=3.8e-10; Accession=PF02458.6; Description =Transferase family
MGEIELVEKVVIAPEQPTPRKRMFLSNIDLSLVVYQDSASFFDPPSTQMSFGEICGKLYSALGKMLVQYDFMAGRLVPSLEETHRFEIDCNGAGIVVVAARTDRKLSEFGVISAPNPELRELVVFLQEEGDQETDMKERSLASLQLTQFGCGSLALASRYNHCTLDGSAIRDFEVNLGALTRGGDLIIVPNADRTLLRARNPPKISHPHFEYSKSTETHNLFTIQGKSGTNATQSAPQNQIRVLHLSPEKIASFKKKALKENTTLKNITTFQVVAAKIWKARSIATKMLEEKVSTMLFPVDVRKRVVPELPNGFAGN

SEQ ID NO: 203798 - protein, 99 aa, Glycine max
  Coding DNA Sequence Number=SeqID_87020
MQLGSTLLSLSLNNLEPPQNHEQQHLNQRDSRQEDMEKPVLSSCSQFLNTEGKFNKQVTTSQEAKTIEEQAFEASCKKARVSVRARSESSLVWISILFL

SEQ ID NO: 203799 - protein, 141 aa, Glycine max; identical to SEQ ID NO: 133090
  Coding DNA Sequence Number=SeqID_87021
  Gene Ontology: Mol. function=structural constituent of ribosome; Cellular component=ribonucleoprotein complex; Biological process =translation
  Homolog annotation: Hit_ID=Q2QD65; Match level="QueryCoverage=67%, HitCoverage=74%, E-value=7e-38, Identity=85%"; Hit description =Ribosomal protein S12
  Pfam annotation: Domain name=Ribosomal_S12; Domain location=15-140; Score=151.5; E_value=2.3e-42; Accession=PF00164.15; Description =Ribosomal protein S12

SEQ ID NO: 203800 - protein, 94 aa, Glycine max
  Coding DNA Sequence Number=SeqID_87022
  Homolog annotation: Hit_ID=Q7XLC6; Match level="QueryCoverage=42%, HitCoverage=5%, E-value=1e-07, Identity=62%"; Hit description =Probable potassium transporter 11
MASTGFDEDGDNRGGMWVLEQKIDQPMDEEAERLKNTYREKALELLSEKICIYKTIPGLPSKLKLLGSELVLDMVLKLMQFGGGAAVGQQGLDF

SEQ ID NO: 203801 - protein, 51 aa, Glycine max
  Coding DNA Sequence Number=SeqID_87023
MQVVPTREVASMRKVVSVREATVVRRGGCVRIWCCLAIWLCYNGREVEDEL

SEQ ID NO: 203802 - protein, 77 aa, Glycine max
  Coding DNA Sequence Number=SeqID_87024
MTIAGCRDDEAGHYTACILSLTQIRALCVFAFFLHLYASSVINNPNELAKRTYHAKRVHLLGMNIHLPEEILVAKRG

SEQ ID NO: 203803 - protein, 101 aa, Glycine max
  Coding DNA Sequence Number=SeqID_87025
MRYETWAPSSAMTMDKLKILSHPSQEMLRFFNCSISPTRDIRQGQSTPHEHTQHPTYETWHHQQATAAHGDHWWSWVVENEVLGFGWRFGEEESEKSCFSR

SEQ ID NO: 203804 - protein, 583 aa, Glycine max
  Coding DNA Sequence Number=SeqID_87026
MDDFAWRPLVKQVKPVGGTVPRSIVVPPTGEGGQLVIEVGHIVKVAKTIGLTPGSGHPSSLQDLPPTPSVVKASAPTIALTPPPLPILPVQEVTHTAKVSAPAALASPVVAPLSTVDAPLLSASMATTRAPVMPPSSAPPVLHSATLALVLTSTFSHPVFLSTTSTPLAIMIHRGVWNGQRHQEALNKVASFEAKHPKIANATVAFVEAVKLNHQLPPKIGSVLAKLLRTRLDGNEVFERYKVLKKEKKDLASKVERTTAEKDKLAMVVADLEAQLKESKSRLEESELRLFMEIEVNRKLEEELLMYKKETVEQHEKGFHKALNLGLFDPFKDMKDGVLLDEEDIAAEDEAGEEQGDDSNHKKQELAIVRKGRLDKSLFTHLVMLPFTLRSFSPDSCLAYQSGGSSFKLVEHGPLIVVVVVPKDAYQGWTLGFVPRADLRGLPRVDLGFDEPLEKQDSPRTNLGFYNPLEKRDSPRADLGFDEPLFSSLCCSWKSSLLVDGSPTSIGIIAFVLYVSRKGVSLVISKGLKADTIGYLCLTIGLRMINKGPRGAQAMKIVRSGAQNVNEFLASSAPLGEVEGVDQ

SEQ ID NO: 203805 - protein, 237 aa, Glycine max
  Coding DNA Sequence Number=SeqID_87027
MARASSEADSCSNIALSILFTRAINHNISSQDLEEMVLEAVKHVLIKLKQLLGHTIQGDPINLAWAQDLKGPHHGPTIGMKLRMDQVQVLKQSTLEGGVLQIGQLHLALQSNDTRCRSERGPIFQNIVLHPFKANNSRGDNETEGGRIIVMGTNSPTREVVEGCALPWRGFIVRSPTMSILLGGTTNRDDLSVHQGFLNRTPGVTTTYAYGRGHMRLKALFKTKKLKIFKMDDQDSL

SEQ ID NO: 203806 - protein, 94 aa, Glycine max
  Coding DNA Sequence Number=SeqID_87028
MVVGGGLEPSKGVSNLRSYRVLTMGEKERLWGGLLDLAHRMMNGLCKEDKRGDFPNKGLWRSSRMAAAKANCDSAEMDNAKSYCRSPKENYENM

SEQ ID NO: 203807 - protein, 142 aa, Glycine max
  Coding DNA Sequence Number=SeqID_87029
MRKLKVDHDQLEARVRRPKGDEHSAYTLPELTQGESHPFTDRIMEADIPQGWKPLNLERYDGTTTDPNEHLDAFLTQANVYTNDNAILCRVFPMSLKEVTLTWYNGLPPRSIGRFDTLVEHFNVQYAQYDICRSGQSTTSRC

SEQ ID NO: 203808 - protein, 97 aa, Glycine max
  Coding DNA Sequence Number=SeqID_87030
MPYPRRIIPLNSITQHMLSCGPIPFGKTVFYALLETLRRNCIGRCSIPRRLLGKGKGRRWSMRRFLGLLSSQVAGMGTCSNGGGGGGDGGGDPRIPP

SEQ ID NO: 203809 - protein, 84 aa, Glycine max
  Coding DNA Sequence Number=SeqID_87031
  Gene Ontology: Mol. function=ATP binding; Cellular component =chloroplast; Biological process=protein folding
  Homolog annotation: Hit_ID=Q1SF16; Match level="QueryCoverage=84%, HitCoverage=25%, E-value=3e-11, Identity=34%"; Hit description=Heat shock protein Hsp70
MSLVPAYFNDSQQKATTAAIAYGIDKRTNSIGEKNIFIFDLGCDEFKKKNKVDISENPKEGIDFYSSITRAKFEQCMQRWTRAV

SEQ ID NO: 203810 - protein, 131 aa, Glycine max
  Coding DNA Sequence Number=SeqID_87032
MDILDQLEINVPNDRNPTLRACNSSSHLKNTASDSYKSSSSSEEEVEERISVMGAKKSSSSFSFCGMFKACFSSSKDDYYCNYDDSSRRHFASDEDRGRWVAEPGIDRKASAFIARFYASRVSDSEHQIAS

SEQ ID NO: 203811 - protein, 60 aa, Glycine max
  Coding DNA Sequence Number=SeqID_87033
MEEKLGKKENKELSNLLCFHFTKEQRRLLTRPTARGPIGMRQSSRRGQQLSIPTRCDNDV

SEQ ID NO: 203812 - protein, 156 aa, Glycine max
  Coding DNA Sequence Number=SeqID_87034
MTTFTWIWMTLLFSNILPGDHSVDLPLQMYRNRAHKTPSEPEEVQQGPGVSSSGYGPLSVLQGARSPSEESHPQRHPVDPEKSNRALGFPALVTGLCSPTGCPFPRQGHGIGTAPARHPVDPKKSNRVLELSSYNYGSLSVLRSACHLQQGHQAPY

SEQ ID NO: 203813 - protein, 92 aa, Glycine max
  Coding DNA Sequence Number=SeqID_87035
MANSKATSDEDMTKSKGKDPLEGLGGPMTRARARKAKEALQQVLSILFEYKPNFQGEKSKVGAIGNLGIRLLGDQMVAGLMAVGGDFWLPQF

SEQ ID NO: 203814 - protein, 154 aa, Glycine max
  Coding DNA Sequence Number=SeqID_87036
  Gene Ontology: Mol. function=transcription coactivator activity; Cellular component=nuclear chromosome; Biological process=regulation of transcription, DNA-dependent
  Homolog annotation: Hit_ID=P93045; Match level="QueryCoverage=99%, HitCoverage=74%, E-value=4e-65, Identity=71%"; Hit description =Chromatin structure remodeling complex protein BSH
  Pfam annotation: Domain name=SNF5; Domain location=1-154; Score= -39.5; E_value=7.3e-07; Accession=PF04855.3; Description=SNF5 SMARCB1  INI1
MKTTISCFYRNPVKFRMPTAENLVPIRLDIEIEGQRYKDALTWNPSDPDSEVVVFAKRTAKDLKLPPVFVTQIAQSIQLDLRVNHTLVKDQFLWDSNNFESDPKEFARLFCKDTGIEDPEVGPAIAFAIREQLNEIAIQSVVSARESRMSKKGR

SEQ ID NO: 203815 - protein, 74 aa, Glycine max
  Coding DNA Sequence Number=SeqID_87037
  Homolog annotation: Hit_ID=Q153F8; Match level="QueryCoverage=96%, HitCoverage=33%, E-value=1e-17, Identity=43%"; Hit description =Pectin acetylesterase
IQASLAPPSADYHWNWYECRKNYARCSAPQIQYLQAVTGIAESVGNWYFDRVSVQAIGCPYPCDKTCHNLVFKR

SEQ ID NO: 203816 - protein, 561 aa, Glycine max
  Coding DNA Sequence Number=SeqID_87038
  Gene Ontology: Mol. function=transporter activity; Cellular component= membrane; Biological process=oligopeptide transport
  Homolog annotation: Hit_ID=Q1S2G7; Match level="QueryCoverage=88%, HitCoverage=90%, E-value=1e-137, Identity=48%"; Hit description=TGF -beta receptor, type I/II extracellular region
  Pfam annotation: Domain name=MFS_1; Domain location=45-466; Score= -37.4; E_value=0.016; Accession=PF07690.6; Description=Major Facilitator Superfamily
  Pfam annotation: Domain name=PTR2; Domain location=70-454; Score =266.9; E_value=4.1e-77; Accession=PF00854.12; Description=POT family
  Pfam module annotation: Pfam domain module=MFS_1::PTR2; Domain location=45-466::70-454
MGASDINDVVGSLLDLKAEAEAEANVGDVEYQARKTPRQGGYRATYFIFVCSTKANSLVLTAAMMLLDNIGFVANMGYSLLVIQSHDKTLQPDPCLKSTCVHGTKALLFYASIYLLALGGGGIRGCVPALGADQFDEKKPKEHAQLASFFNWFLFSITVGASLGVTFVVYVSTESQWYKGFIISMSCSAVGLIFIASGKRFYHARVPGESPLLRVLQVLVVTVRNWRVKVPLDSDELYEIQSHESSLKKKLIPHTNQFRVLDKAAVLPEGNEARRWKVCTVTQVEEVKILTRMMPILLSTIIMNTSLAQLQTFSIQQGTLMNTYIGKLNIPAASIPIIPLVFMTLLIPVYEFAFIPLVRRITGHPNGITELQRVGVGLVLSAISMVIAGVIEVKRKHEFNDHNQHRISLFWLSFHYAIFGIADMFTLVGLLEFFYKEAPQGMRSLSTSFSFLSLSIGYYLSTVFVELINLVTSKIGKSKKGWLEGRDLNRNHVQLFYWFLAILSLINFLIYLMCAKWYKYQSVVPFDKGMLLKDPPPRNDENVYSTSFVSTVQNIPQNEDK

SEQ ID NO: 203817 - protein, 429 aa, Glycine max
  Coding DNA Sequence Number=SeqID_87039
  Gene Ontology: Mol. function=hydrolase activity; Cellular component =endoplasmic reticulum; Biological process=nucleotide metabolic process
  Homolog annotation: Hit_ID=Q9FFI6; Match level="QueryCoverage=83%, HitCoverage=68%, E-value=1e-94, Identity=57%"; Hit description =Arabidopsis thaliana genomic DNA, chromosome 5, P1 clone:MKP11
MNRTPKRGFSLIDFGCRDFKARISRSGNDVVGGEKAWEVGIHMADVDDAVAPLHYRFSPHRNRASLSEPLLPRVPLTVSSSSFSMLSESKPWMDKRVLKNVASTRPLSARIFKAIADPPTTSLQRLKGLTTGGLPTFVDVGNSFSAPAIVEDNFINQKVVMMGDDTWTQLFPHHFERSYPYPSFNVKDLHTVDNGCIEHLLLSLYEEDWDVLIAHFLGVDHAGHIFGVDSTPMIEKLEQYNTILESGPGSSHENTMLVVMGDHGQTLNGDHGGGSAEEVETAIFAMSFKKPLSFVPPEFDSCSCQLDLSIGFLILSTLCRFAIEVGLSKQAATSAFMKDFTSWIINIASGLPVWDYAAEVIPMVVLILLAAWLYKAASGSFFDWPWKYVILGTILSYMLIIVHWITDSGGFGGALMPQSIGRSYIPRII

SEQ ID NO: 203818 - protein, 109 aa, Glycine max
  Coding DNA Sequence Number=SeqID_87040
MASMRMRIILNYTKWIRYGELPDMSIVSHTEPIDVDIGDCIECFQQAHAPFYEKLQSDSKKPLYPRCTTFTRLLAVLAFVNLKARFGWSNKSFIELLVALKKMLLEDNT

SEQ ID NO: 203819 - protein, 116 aa, Glycine max
  Coding DNA Sequence Number=SeqID_87041
  Gene Ontology: Mol. function=hydrolase activity, acting on ester bonds; Biological process=lipid metabolic process
  Homolog annotation: Hit_ID=Q1SDJ4; Match level="QueryCoverage=97%, HitCoverage=38%, E-value=2e-43, Identity=78%"; Hit description =Lipolytic enzyme, G-D-S-L
MADILLRGYYGWNSRRALQILYQVFPKLIILPTLYNFLYPTSQDAATQPSLVIVYFGGNDSMGPHFSGLGPHVPLHEYIENMRKILIHIQGLSEKTRIIVLSCPPVNEEKVRANTR

SEQ ID NO: 203820 - protein, 828 aa, Glycine max
  Coding DNA Sequence Number=SeqID_87042
  Gene Ontology: Mol. function=solute:hydrogen antiporter activity; Cellular component=integral to membrane; Biological process =regulation of pH
  Homolog annotation: Hit_ID=Q9LUN4; Match level="QueryCoverage=98%, HitCoverage=98%, E-value=0.0, Identity=61%"; Hit description=Na+/H+ exchangeing protein-like
  Pfam annotation: Domain name=C4dic_mal_tran; Domain location=220-442; Score=-81.7; E_value=0.025; Accession=PF03595.8; Description=C4 -dicarboxylate transportermalic acid transport protein
  Pfam annotation: Domain name=Na_H_Exchanger; Domain location=38-442; Score=257.3; E_value=3.1e-74; Accession=PF00999.11; Description =Sodiumhydrogen exchanger family
  Pfam module annotation: Pfam domain module=C4dic_mal_tran::Na_H _Exchanger; Domain location=220-442::38-442
MATSNNASCPAPMKATSNGAFQHENPLDYALPLLILQICLVVFFTRFIAFLCRPLRQPRVIAEIIRWEGKNVVKVDTKKSLGGILLGPSAIGRNEKFLNTVFPKKSITVLDTLGNIGLLFFLFLVGLELDMRAIRRTGHKALGIALCGITVPFVLGIGTSFALRATVSKGAEPVSFLVFMGVALSITAFPVLARILAELKLLTTDVGRIAMSAAAVNDVAAWILLALAIAISGSNGSPLVPLWVLLSGVAFVLFAVFAIRPLLVAMANRSPEGEPVKEVYICITLTLVLACSFVTDTIGIHALFGAFVLGTIMPKDGSFSGVLIEKIEDLVSGLFLPLFFVSSGLKTNVASISGGLSWAMLVLVIFNACFGKIVGTIVVSLICKVPSHEAVALGFLMNTKGLVELIVLNIGKDRKVLNDQAFAICVLMALFTTFITTPIVMAVYKPARRGAPYKHKTIQRRDPDTELRMLICFHTSRNIPTLINLIESSRGIRKRGKLCIYAMHLVELSERSSAITMVHKARRNGMPFWNKKQDDKDQMIIAFQAYEKLSSVNVRPMTAISALNSIHEDICTSAHRKCAAMIILPFHKHQRVDGSMESLGHSFHVMNQLVLSHAPCSVGILVDRGFGGTSQVPASDVSYKVVVPFFGGRDDREALCYGMRMAEHPGILLNVVKFMPPPGTSLAFGAKLVGVSSNKDKKAFEVVGGNYYDDKQQDDQLWSEFLSACNNNNQESMKHEQKLVASKGDIEAALKEMNRSNLILVGRMPSVAPLISRSDCPELGPVGSYMASSDFSNVTSVMVIQQYNPSTDIHPLVMEESDYPDMPDTPTS

SEQ ID NO: 203821 - protein, 66 aa, Glycine max
  Coding DNA Sequence Number=SeqID_87043
MTRMGNAVKRKMGRMGRKREWARGEGEKAKRERKRKSCQQQKLLLLSKKQRDALSAIAVSTLSEEG

SEQ ID NO: 203822 - protein, 79 aa, Glycine max
  Coding DNA Sequence Number=SeqID_87044
  Gene Ontology: Mol. function=FMN binding; Cellular component =transcription factor complex; Biological process=regulation of transcription, DNA-dependent
  Homolog annotation: Hit_ID=Q4SU95; Match level="QueryCoverage=68%, HitCoverage=59%, E-value=4e-11, Identity=50%"; Hit description =Chromosome 3 SCAF13974, whole genome shotgun sequence
MVGVGILVTYPVPLKLVDEKSKEAKIARNALFSKHPEMKDWPEDHHFQVFKLEIENIFLINWFGGPKPLTVEQYLHPKM

SEQ ID NO: 203823 - protein, 127 aa, Glycine max
  Coding DNA Sequence Number=SeqID_87045
  Gene Ontology: Mol. function=transmembrane receptor protein kinase activity; Cellular component=integral to membrane; Biological process=protein amino acid phosphorylation
  Homolog annotation: Hit_ID=P93194-2; Match level="QueryCoverage=81%, HitCoverage=20%, E-value=4e-28, Identity=49%"; Hit description =Isoform INRPK1a of P93194
MGLDKAFAAKKIGFAASKGKNLSMAREIQTLGKIRHRNLTPPLTLEWNVRNKITVGIAHGLVYLHYDCDPPILHRDIKPSNILLDSDMEPHIVDFGIAKLLDQSSSASDASSIYVPSTIGYIAPCWN

SEQ ID NO: 203824 - protein, 168 aa, Glycine max
  Coding DNA Sequence Number=SeqID_87046
  Gene Ontology: Mol. function=peptidyl-prolyl cis-trans isomerase activity; Cellular component=endoplasmic reticulum; Biological process=protein folding
  Homolog annotation: Hit_ID=Q9LY53; Match level="QueryCoverage=80%, HitCoverage=55%, E-value=1e-24, Identity=53%"; Hit description =Peptidyl-prolyl cis-trans isomerase
  Pfam annotation: Domain name=Pro_isomerase; Domain location=67-150; Score=-66.9; E_value=0.098; Accession=PF00160.11; Description =Cyclophilin type peptidyl-prolyl cis-
MAFRGTGTLILVSLLWLFFLCATIAFFQLHLVDNRTSNPSSRSNFIATQHDRSDTPLEQDLEGVTHKVYFDIQIHGKVAGRIVMGLFGNTVPKTAVKTTNLNSITFQERKEWEEVGSLFIIKGAHSIGLCRALWSRGVISPVVMEEVENQSMVISLPPPNFKLKHTGP

SEQ ID NO: 203825 - protein, 228 aa, Glycine max
  Coding DNA Sequence Number=SeqID_87047
  Gene Ontology: Mol. function=oxidoreductase activity; Cellular component=cytoplasm; Biological process=electron transport
  Homolog annotation: Hit_ID=Q8H770; Match level="QueryCoverage=83%, HitCoverage=18%, E-value=3e-60, Identity=60%"; Hit description =Bifunctional lysine-ketoglutarate reductase/saccharopine dehydrogenase
MGTLSRISLFNNEAHSLLMNGQRPTFRKFLFELLKVVGDNPDELLIGENDIMEQILIQGHCKDQRTAMETAKTIIFLGLLDQTEIPASCKSAFDVACFRMEERLSYTSTEKDMVLLHHEVEIEYPDSQITEKHRATLLEFGKTLDEKTTTAMALTVGIPAAVGALLLLTNKIQTRGVLRPIEPEVYNPVMELQLPFYATVRNGPHGTSIVKTLRQMPISIAAVQSNQL

SEQ ID NO: 203826 - protein, 1465 aa, Glycine max
  Coding DNA Sequence Number=SeqID_87048
  Gene Ontology: Mol. function=ARF guanyl-nucleotide exchange factor activity; Cellular component=intracellular; Biological process =regulation of ARF protein signal transduction
  Homolog annotation: Hit_ID=UPI000034EFAB; Match level="QueryCoverage =97%, HitCoverage=83%, E-value=0.0, Identity=70%"; Hit description =guanyl-nucleotide exchange factor
  Pfam annotation: Domain name=DUF1981; Domain location=1045-1121; Score=39.5; E_value=1.2e-08; Accession=PF09324.1; Description=Domain of unknown function (DUF1981)
  Pfam annotation: Domain name=HEAT; Domain location=1011-1047; Score =2.0; E_value=25; Accession=PF02985.12; Description=HEAT repeat
  Pfam annotation: Domain name=HEAT; Domain location=1056-1093; Score =9.8; E_value=2.8; Accession=PF02985.12; Description=HEAT repeat
  Pfam annotation: Domain name=HEAT; Domain location=1201-1236; Score =6.5; E_value=6.9; Accession=PF02985.12; Description=HEAT repeat
  Pfam annotation: Domain name=HEAT; Domain location=1309-1344; Score =1.7; E_value=27; Accession=PF02985.12; Description=HEAT repeat
  Pfam annotation: Domain name=Sec7; Domain location=549-734; Score =181.9; E_value=1.5e-51; Accession=PF01369.11; Description=Sec7 domain
  Pfam module annotation: Pfam domain module=DUF1981::HEAT::HEAT::HEAT:: HEAT::Sec7; Domain location=1045-1121::1011-1047::1056-1093::1201 -1236::1309-1344::549-734
MAGGAAGGFVTRAFDSILKECSSAKKFPELEKAIQNYTDITKELSQKKQSEVNQAAPSAESGSMNETEGGVATRTEADQSQKAEHASDDRAKIGNINVVLASAGNTLEGADAELILNPLRLAFETKNLKILESALDCLHKLIAYDHLEGDPGLEGGKNVPLFTDILNMVCSCVDNSSPDSTILQVLKVLLTAVASTKFRVHGEPLLGVIRVCYNIALNSKSPINQATSKAMLTQMISITFRRMETDPVEASSGSGGHAISKAASAENLNTKSDESSMGDSNEKEMTLGDALSQAKDASPTSLEELQNLAGGADIKGLEAVLDKAVHTEDGKKITRGIDLESMSIVQRDALLVFRTLCKMGMKEDNDEVTTKTRILSLELLQGLLEGVSHSFTKNFHFIDSVKAYLSYALLRASVSQSPVIFQYATGIFLVLLLQFRESLKGEIGIFFPLIVLRPLDGLEFPVNQKLSVLRMLEKVCKDPQMLVDIFVNYDCDLEAPNLFERMVTTLSKIAQGTQNTDPNSAAVSQTASIKGSSLQGLVSVLKSLVDWEQSHKELEKLKNNQQEGISAGDSSEIRSREDVTSDFEKAKAHKSTLEAAIAEATIGDYLGQHEEFPLAVMHAYVDSMKFSGFKFDTAIREFLKGFRLPGEAQKIDRIMEKFAERYCADNPGLFKNADTAYVLAYAVIMLNTDAHNPMVWPKMSKSDFVRMNARDDPDECAPKELLEEIYDSIVKEEIKMKDDTSLIGKSSRQKPEGEEGRLVSILNLALPKRKSSGDAKSESEDIIKKTQAIFRNKGVKRGVFYTAQQIELVRPMVEAVGWPLLATFSVTMEEGENKSRVVLLMEGFKAGIHITFVLGMDTMRYAFLTSLVRFTFLHAPKEMRSKNVEALRTLLVLCDSDMNSLQDTWNAVLECVSRLEFITSSPSISATVMHGSNQISKDGVVQSLKELAAKPAEQIFMNSVKLPSDSVVEFFTALCGVSAEELKQTPARVFSLQKLVEISYYNMARIRMVWARIWSVLANHFISAGSHHDEKIAMYAIDSLRQLSMKYLERAELANFSFQNDILKPFVVLMRNSQSESKRRLIVDCIVQLLQMMKWNQLLIVHLKMLSRSKSKSTIAFVVYLTHGHFTVILEHFDQVVGDCFMDCVNCLIRFANNKTSHRISLKAIALLRICEDRLAEGLIPGGALMPIDATLDATFDVTEHYWFPMLAGLSDLTSDQRPEVRSCALEVLFDLLNERGSKFSTAFWESIFHRVLFPIFDHVRHAGKEGFVSPDDDWFRETSIHSLQLLCNLFNTFYKITHEESCFQEVCFMLPPLLGLLLDCAKKTDQTVVSISLGALVHLIEVGGHQFSENDWDTLLKSIRDASYTTQPLELLNVLSFENLRNHGSIISDSEGNTGDSGTTRSIDNEVIGDHQLDVNSNEKLSPLASSNTNADGVEDSVSQTIVDQSEVGCVFKHVHVFSQISEK

SEQ ID NO: 203827 - protein, 501 aa, Glycine max
  Coding DNA Sequence Number=SeqID_87049
  Gene Ontology: Mol. function=hydrolase activity, hydrolyzing O -glycosyl compounds; Cellular component=anchored to membrane; Biological process=carbohydrate metabolic process
  Homolog annotation: Hit_ID=Q84MU5; Match level="QueryCoverage=96%, HitCoverage=97%, E-value=1e-159, Identity=56%"; Hit description =Putative 1,3-beta-glucanase
  Pfam annotation: Domain name=Glyco_hydro_17; Domain location=28-353; Score=260.4; E_value=3.6e-75; Accession=PF00332.9; Description =Glycosyl hydrolases family 17
  Pfam annotation: Domain name=X8; Domain location=371-457; Score =122.4; E_value=1.3e-33; Accession=PF07983.3; Description=X8 domain
  Pfam module annotation: Pfam domain module=Glyco_hydro_17::X8; Domain location=28-353::371-457
MGLQHFTACVLLALCILSQGLAKGANGFACNWGTRLTHPLTPQITVKLMKDNGFKQVKLFEADPAALKALGNSGIQVMVGIPNDLLATLASNVDAAIAWVNQNVSSYISKNGVDISVCKIARYVAVGNEAFLKTYNGRFVNSTFPAIQNIQAALIKAGLGRQVKVTTPLNADVYQSDSGLPSGGNFRPDIQDQMISIIKFLSQNGGPLTFNIYPFLSLDADPHFPKEFAFFDGSAAPVVDGSITYTNVFDANYDTLITALEKNGFSQMPVIIGEVGWPTDGTANANIKNAQRFNQGLIDRIVKRQGSPKRPSPPDIYLFGFIDEDAKSIEPGPFERHWGVFNFDGSIKYPLNLGGGKQLVGAKGVRYLPKQWCVMSTQANVDPNALAESMSKACTYADCTSLSPGSSCSGLDTRGNASYAFNMYFQTMNQQKDACNFNGLSVITNINPSPPQSSCKFEIMIDLGKHEKKSTPSSVAPERKLHSMVMLVSSFIFTVMFLLCV

SEQ ID NO: 203828 - protein, 174 aa, Glycine max
  Coding DNA Sequence Number=SeqID_87050
  Gene Ontology: Mol. function=zinc ion binding
MTNELKSYSMFMCRICSMFNVGHVTNGTSDRPQIDYEVTGEGLREAIKNSDVAAVKKLLNEGVDANYRDKQGLSLLHLQNCGMQNLTDCFLFRRNTFRLCTSYLAIQNAKEDGGRWSSGPKHLNNLLLLSVFFLCSPPKESFKYYHCLKLLCYQNKKFRLLYNCDRGVQFILAD

SEQ ID NO: 203829 - protein, 246 aa, Glycine max
  Coding DNA Sequence Number=SeqID_87051
  Gene Ontology: Mol. function=protein serine/threonine kinase activity; Cellular component=chromosome, telomeric region; Biological process=protein amino acid phosphorylation
  Homolog annotation: Hit_ID=Q011X9; Match level="QueryCoverage=94%, HitCoverage=86%, E-value=3e-41, Identity=48%"; Hit description=[R] KOG3087 Serine/threonine protein kinase
  Pfam annotation: Domain name=Kdo; Domain location=3-180; Score=-65.6; E_value=0.0024; Accession=PF06293.4; Description=Lipopolysaccharide kinase (Kdo)
  Pfam annotation: Domain name=RIO1; Domain location=4-162; Score= -87.5; E_value=0.016; Accession=PF01163.12; Description=RIO1 family
  Pfam module annotation: Pfam domain module=Kdo::RIO1; Domain location= 3-180::4-162
MLLRVFESSFVGRKSVVKERFSKKYRHPTLDSKLTLKRLNMEARCMTKARRLGVWTPVLYAVDPVLHTLTFEYVEGTSVKDVFLEFGSHGVNKERLDDIAFQIGDTIGKLHDGGLIHGDLTTSNMLLKSDTKQLVLIDFGLSFTSTLPEDKAVDLYVLERALISMHSSCGNVMDQILAAYRKSSKQWSSTLNKLAQGYALPLILCLNSTYFLQDIVLTYIFTTCSATKRTEEDHGWMNLYRISLEI

SEQ ID NO: 203830 - protein, 518 aa, Glycine max
  Coding DNA Sequence Number=SeqID_87052
  Gene Ontology: Mol. function=oxidoreductase activity; Cellular component=mitochondrion; Biological process=electron transport
  Homolog annotation: Hit_ID=Q8H770; Match level="QueryCoverage=96%, HitCoverage=47%, E-value=0.0, Identity=69%"; Hit description =Bifunctional lysine-ketoglutarate reductase/saccharopine dehydrogenase
  Pfam annotation: Domain name=AlaDh_PNT_C; Domain location=1-105; Score=-58.9; E_value=0.051; Accession=PF01262.12; Description =Alanine dehydrogenasePNT, C-terminal domain
  Pfam annotation: Domain name=Saccharop_dh; Domain location=292-518; Score=29.4; E_value=1.2e-08; Accession=PF03435.8; Description =Saccharopine dehydrogenase
  Pfam annotation: Domain name=Saccharop_dh_N; Domain location=181-287; Score=138.8; E_value=1.5e-38; Accession=PF04455.3; Description=LORSDH bifunctional enzyme conserved region
  Pfam annotation: Domain name=ThiF; Domain location=288-415; Score= -42.2; E_value=0.012; Accession=PF00899.11; Description=ThiF family
  Pfam module annotation: Pfam domain module=AlaDh_PNT_C::Saccharop _dh::Saccharop_dh_N::ThiF; Domain location=1-105::292-518::181 -287::288-415
MVLDKLIFLIKNHYSHLHILVNCMYWEKRFPQLLSYKQMQDLMGRGSPLVGIADITCDIGGSIEFVNRSTSIDSPFFRYDPLTNSYHDDMEGNGVICLAVDILPTEFAKEASQHFGNILSQFVVNLASATDITKLPAHLRRACIAHKGVLTSLYDYIPRMRSSDSEEVSENSENSLSNKRKYNISVSLSGHLFDQFLINEALDIIEAAGGSFHLVNCHVGQSIEAVSFSELEVGADNRAVLDQIIDSLTAIANPTEHDRFSNQDSSKISLKLGKVEENGIEKESDPRKKAAVLILGAGRVCQPAAEMLSSFGRPSSSQWYKTLLEDDFECQTDVEVIVGSLYLKDAEQTVEGIPNVTGIQLDVMDRANLCKYISQVDVVISLLPPSCHIIVANACIELKKHLVTASYVDSSMSMLNDKAKDAGITILGEMGLDPGIDHMMAMKMINQAHVRKGKIKSFTSYCGGLPSPEAANNPLAYKFSWNPAGAIRAGRNPATYKWGGETVHIDGKLLSNNSDMFP

SEQ ID NO: 203831 - protein, 168 aa, Glycine max
  Coding DNA Sequence Number=SeqID_87053
  Subcellular localization annotation: CTP_CleavageSite=29; ConfidenceScore=5.16e-01
MKNKVASSTTSQRCSHYFSIEPNKAGHPRAKRKTIYKPSPTVVSSPVIESFSCHSTNNWIKPNQPQSPDYYLSSLKSSSESNNLHEYVSSGCDKFTVPKLLNGLASKCSCRVSSSTNDINIDMKSELLTANSGNLDGFDTISQLGLAPILTKPVKFDDKAIEATELRR

SEQ ID NO: 203832 - protein, 205 aa, Glycine max
  Coding DNA Sequence Number=SeqID_87054
  Gene Ontology: Mol. function=protein serine/threonine kinase activity; Cellular component=integral to membrane; Biological process=protein amino acid phosphorylation
  Homolog annotation: Hit_ID=Q9LY50; Match level="QueryCoverage=95%, HitCoverage=28%, E-value=1e-61, Identity=56%"; Hit description =Receptor kinase-like protein
  Pfam annotation: Domain name=Pkinase_Tyr; Domain location=1-185; Score=-112.3; E_value=1.4e-05; Accession=PF07714.7; Description =Protein tyrosine kinase
LLVYQYMKNRALYDHLHDKNNVEKGSTMLNSWKMRIKISLDASRGIEYIHNHLYSIHGNIKSSNILLDATWTAKVSDFGKVSAGTRHVLTEKSDVCGFGVVLLELLTGKKPILKNEEDGSTRLHVIDFAEPAILAGELVKIKDPRVGPPGVNEAKALELVADTAIHCVKREGKDRPTMADIVLNLERALATCGSDHRSPEKRMAL

SEQ ID NO: 203833 - protein, 69 aa, Glycine max
  Coding DNA Sequence Number=SeqID_87055
MVQEPDAEKSVRKWRKRREQVLESKEASKLQNLADTKLTEEAPATGVQKGEETKSKRRIVKPTYLEDYV

SEQ ID NO: 203834 - protein, 484 aa, Glycine max
  Coding DNA Sequence Number=SeqID_87056
  Gene Ontology: Mol. function=transcription factor activity; Cellular component=nucleus; Biological process=regulation of transcription, DNA-dependent
  Homolog annotation: Hit_ID=UPI000034F24B; Match level="QueryCoverage =94%, HitCoverage=68%, E-value=1e-106, Identity=39%"; Hit description= electron transporter/ transcription factor
  Pfam annotation: Domain name=zf-NF-X1; Domain location=101-121; Score= 20.9; E_value=0.0046; Accession=PF01422.8; Description=NF-X1 type zinc finger
  Pfam annotation: Domain name=zf-NF-X1; Domain location=309-327; Score= 11.2; E_value=0.39; Accession=PF01422.8; Description=NF-X1 type zinc finger
  Pfam annotation: Domain name=zf-NF-X1; Domain location=372-394; Score= 8.6; E_value=0.76; Accession=PF01422.8; Description=NF-X1 type zinc finger
  Pfam module annotation: Pfam domain module=zf-NF-X1::zf-NF-X1::zf-NF -X1; Domain location=101-121::309-327::372-394
  Subcellular localization annotation: CTP_CleavageSite=46; ConfidenceScore=5.40e-01
MFDDVASRSFHVINPVPSFWIVGFTVALNFATLALALLAGHVACTRAGVGRSRRRGSALIVVFSVRIRVRRGLAVGSMFVREGAILVSVLCGATCDKMLPCGYHRCPERCHRGQCVETCRVVVKKSCRCGSLKKDVSAYCFFEFGCVSVYGSEMVVIWRAKGSVRGCVTAVDMLVSAAAVMGIALLALRGPCAPCPIMVTISCACGETRFEVPCGTEMDQKPPRCPKPCPITPLCRHASNIKVSFDTDLCHGARPPPNPEFSLKPKKKKVIQQSEGVPGTPCPPCPELVWRSCVGQHIGAERMEREPACPHHCPRRCHPEDCPPCKVLIKRSCHCGAMVHVFECLYYNSLSAKGQETVRSCGGPCHRKLPNCTHLCPETCHPGQCLNAEKCCKKVTVRCKCKTLKKEWVCQDVQAAYHLAGCHPMDIPKIQFGVGLIPCNSDCQSKVQVVESELQLRKTRVTETEEVEIAGIRNIIQRLGQVNE

SEQ ID NO: 203835 - protein, 470 aa, Glycine max
  Coding DNA Sequence Number=SeqID_87057
  Gene Ontology: Mol. function=protein serine/threonine kinase activity; Cellular component=integral to membrane; Biological process=protein amino acid phosphorylation
  Homolog annotation: Hit_ID=Q9LY50; Match level="QueryCoverage=63%, HitCoverage=39%, E-value=3e-78, Identity=52%"; Hit description =Receptor kinase-like protein
  Pfam annotation: Domain name=Pkinase; Domain location=149-419; Score =49.2; E_value=1.3e-11; Accession=PF00069.15; Description=Protein kinase domain
  Pfam annotation: Domain name=Pkinase_Tyr; Domain location=156-419; Score=-2.2; E_value=2.5e-12; Accession=PF07714.7; Description =Protein tyrosine kinase
  Pfam module annotation: Pfam domain module=Pkinase::Pkinase_Tyr; Domain location=149-419::156-419
MDYEIAESTDKADITVDARSFSWAVDSAIKSETASILGESRIHSFCSVVDNAIRSRTASDLGTSPSPVHSLASAVANAMSSSSAAPFSQLETSPSPVQSLASAVPSAMSRSKAAPFSQLEVVPNATRHVPARLFTWAELKAATNNFSPHNRIRHFGTFGFGYRGKLVDGREVAIVKGTQFGKSEFAIFSRLDHRNLVGLVGYCENRDERLSVYEYMKNGLLRDCLHDKNNVDKDSSVLNSWKMRIKIAWDASLGIQYLHNYANPSIIHRDIKSSNILLDASWTARVFDFELSFICPEPDDEYDEIIMGTMGYMCPEYMTRGVLTAKCDVYGLGVVLLELLTGKRAILLESEEDGPPFYLVDFAVPPILAGDLVEILDSRVGPPDLKEAEALKILAHTAIRCVEEEPRQRPTMNDIVVDLDRAFAICGSSLYDENFSYSIALPSHESNHMTPDPLDTDSCDIPIYEENTNS

SEQ ID NO: 203836 - protein, 291 aa, Glycine max
  Coding DNA Sequence Number=SeqID_87058
  Gene Ontology: Mol. function=nucleoside-triphosphatase activity; Cellular component=integral to membrane; Biological process=transport
  Homolog annotation: Hit_ID=Q9LFH0; Match level="QueryCoverage=89%, HitCoverage=17%, E-value=1e-73, Identity=54%"; Hit description =Probable pleiotropic drug resistance protein 9
  Pfam annotation: Domain name=ABC_tran; Domain location=183-291; Score= -43.3; E_value=0.0012; Accession=PF00005.17; Description=ABC transporter
MELTPRGRTQGHVLTFERDADSFVEEDKELQSKWAAIEKLPTFKRIKTSFVDVSQEEGASSSSTVITLRSGSKRVADVSKLGAVEKRLFIDKLIKHIENDNLQLLQKLRERMDRVNVKLPTVEVKYKNLNVRAECEVVQGKALPTLWNSFSSSLSGFMKTISCTSQGAEISILNNVSGIIKPSRLTLLLGPPGCGKTTLLKALAGKLEQSLKVSGEISYNGYKLGEFVPQKTSAYISQYDLHVPEMTVRETIDFSARCQGVGGRADLVAEISRREIEEGIIPDPDIDTYMK

SEQ ID NO: 203837 - protein, 79 aa, Glycine max
  Coding DNA Sequence Number=SeqID_87059
  Gene Ontology: Mol. function=nucleoside-triphosphatase activity; Cellular component=membrane
  Homolog annotation: Hit_ID=Q9LFH0; Match level="QueryCoverage=63%, HitCoverage=3%, E-value=3e-19, Identity=84%"; Hit description =Probable pleiotropic drug resistance protein 9
MAHISDIKLIRTDTTLDLSQKAEKGEISYNGHMLEEFIPQKSSAYVSQYDLHIPEMTVRETLDFSARCQGVGSRSSRYT

SEQ ID NO: 203838 - protein, 235 aa, Glycine max
  Coding DNA Sequence Number=SeqID_87060
  Gene Ontology: Mol. function=nucleoside-triphosphatase activity; Cellular component=integral to membrane; Biological process=transport
  Homolog annotation: Hit_ID=Q5W274; Match level="QueryCoverage=97%, HitCoverage=60%, E-value=7e-84, Identity=43%"; Hit description =Pleiotropic drug resistance protein 3
  Pfam annotation: Domain name=ABC2_membrane; Domain location=1-174; Score=118.6; E_value=1.8e-32; Accession=PF01061.14; Description=ABC -2 type transporter
MAAEKNSQQDVFNVFGAMYSAALFFGINNCSTVLPYVATERTVLYRERFAGMYSPWAYSFAQVLIEVPYIFIQAVVYVIITYPMLSYDWSAYKIFWSFFSMFCNILYYNYLGMLIVSLTPNVQLAAIVASSSYTMLNLFSGYFVPRLRIPKWWIWMYYLCPMSWALNGMLTSQYGDVNKEISAFEEKKTIAKFLEDYYGFHHDFLGVVGVVLIVIPIVIAILFAYCIGNLNFQKR

SEQ ID NO: 203839 - protein, 827 aa, Glycine max
  Coding DNA Sequence Number=SeqID_87061
  Gene Ontology: Mol. function=DNA binding; Cellular component=nucleus; Biological process=regulation of transcription, DNA-dependent
  Homolog annotation: Hit_ID=Q1SEQ4; Match level="QueryCoverage=60%, HitCoverage=49%, E-value=1e-145, Identity=53%"; Hit description=SBP
  Pfam annotation: Domain name=SBP; Domain location=1-31; Score=2.2; E _value=0.0092; Accession=PF03110.5; Description=SBP domain
FHVLQEFDEGKRSCRRRLAGHNRRRRKTHPDVSVVNEGSLNDQRGSNYLLMSLLRILTNLHSNGSDHTRNQDILSHLLKNLASLAGPNNGGRLAPLLEESKDLVNAGTPGAAQDKPNLNSNAPEASRPSSFIKTDNVIITQDPTMPVAQYETPADGRTQKCIASGDGGVGNSKPPSRPLFSNVCQPRDSLPSQLTTAETKVGRGNLNNIDLNNGYNDIQNTVENHKKPYPPVASVMGSIDRASWLQRDSLKSSPPQTSRNSDSTSIQSPSSSSGEAQISLLIKILFCQGAAPLCICKGKAAYNIPPPYLRIAKSLWTMGYEVLLNDLDRSMSRTDRIVFKLFGKDPSDFPLLIRSQILNWLSHSPTEMESYIRPGCIILTIYLRLEKSAWEELYCNLGSSLRKLLAESNDSFWRTGWVYARVQHSVAFLYNGQVVLDVPLHLKSPQHCRISCIKPLAVPASASAQFIVKGFNLFQSSTRLLCALEGKYLVHASCHGLIGGADAPIQHLSFSCHIPNVTGRGFIEVVEDHGLSSCSFPFIVAEQEVCSEICKLENVIEAAETTDDIQIKKQQMEEMTRALDFLQEMGWLLHRSHVKVKLGPMAPFRDLFQFNRFAWLVDFSMDHGWCAVMNKLLDIIFEGGVDAGEHASIELALLNMGLLHTAVKRNCRPMVELLLRFVPVKTSDGADSEVKQVDEASDRFLFRPDTVGPAGLTPLHVAASMSGLEDVLDALTDDPRMLGIEAWKSSRDSTGLTPNDYACLRGYYSYIQLVQKKTNKKGERQHVVDITGIVVDSYTTQKQSNGHRTCRVSSLQTEKIETTTMPRQCRA

SEQ ID NO: 203840 - protein, 237 aa, Glycine max
  Coding DNA Sequence Number=SeqID_87062
  Gene Ontology: Mol. function=nucleoside-triphosphatase activity; Cellular component=integral to membrane; Biological process=transport
  Homolog annotation: Hit_ID=Q5W274; Match level="QueryCoverage=87%, HitCoverage=14%, E-value=2e-48, Identity=49%"; Hit description =Pleiotropic drug resistance protein 3
MAQLAGADEIESLRNELAEIGRSIRSSFRSHASSFQSVSSINPVQQEVDNNAGEALQWAEIQRLPTFERITSALFDVYDGMETGEKVEGKQVVDVSKLGAQERHMFIEKLIKHIENDNLRLLQKFRNRIDKVGINLPTVELRYQNLCVEAECKIVQGKPIPTLWNTLKEWIFDTTKLPVLKSQNSKISIIKSANGIIKPGRMTLLLGPPASGKTTLLLALAGKLGHSLKVLNLTVFS

SEQ ID NO: 203841 - protein, 806 aa, Glycine max
  Coding DNA Sequence Number=SeqID_87063
  Gene Ontology: Mol. function=nucleoside-triphosphatase activity; Cellular component=integral to membrane; Biological process=transport
  Homolog annotation: Hit_ID=Q5W274; Match level="QueryCoverage=98%, HitCoverage=66%, E-value=0.0, Identity=49%"; Hit description =Pleiotropic drug resistance protein 3
  Pfam annotation: Domain name=ABC2_membrane; Domain location=199-397; Score=81.9; E_value=2e-21; Accession=PF01061.14; Description=ABC-2 type transporter
  Pfam annotation: Domain name=ABC_tran; Domain location=550-740; Score= 87.5; E_value=4.2e-23; Accession=PF00005.17; Description=ABC transporter
  Pfam annotation: Domain name=PDR_assoc; Domain location=402-464; Score=111.3; E_value=2.8e-30; Accession=PF08370.2; Description=Plant PDR ABC transporter associated
  Pfam module annotation: Pfam domain module=ABC2_membrane::ABC _tran::PDR_assoc; Domain location=199-397::550-740::402-464
MNFAPCMKELLMEVSRKEKEGGIVPDPDLDAYMKATSINGLKSSLQTDYILKILGLDICADTLVGDPIRRGISGGQKKRLTTGEMIVGPTKALFMDEISNGLDSSTTFQIISCLQHLVHITDATALISLLQPAPETFDLFDDVILMAEGKIVYHGPCDYILEFFEDSGFKCPQRKGTADFLQEVISKKDQAKYWNSTEKPYSYVSIDQFIEKFKDCPFGLKLKEELSKPFDKSQSHKNALLVIVAFVAMTVFIRTRMTVDVLHGNYFMGSLFYSLIILLVDGFPELSMTIPLSLLESFIWTTLSYYVIGYSPEIGRFFRQFLLLFIIHVTSVSMFRFIASVCQTVVASVTAGTVTILVVLLFGGFIIPKPYMPSWLQWGFWVSPLTYGEIGLTVNEFLAPRWEKMSGNRTLGQQVLESRGLNFDGYFYWISIAALIGFTVLFNVGFTLMLTFLNSPARSRTLISSEKHSELQGQQESYGSVGADKKHVGSMVGSTVQTRKGGLVLPFQPLAVAFHDVQYYVDSPLEMRNRGFTEKRLQLLSDITGSLRPGILTALMGVSGAGKTTLMDVLCGRKTGGIIEGEIRIGGYPKVQETFARVSGYCEQNDIHSPNITVEESVMFSAWLRLPSQIDAKTKAEFVNEVIHTIELDGIKDSLVGMPNISGLSTEQRKRLTIAVELVANPSIIFMDEPTTGLDARAAAVVMRAVKNVVGTGRTVACTIHQPSIDIFEAFDELILMKAGGRLTYAGPLGKHSSRVIEYFESIPGVPKIKDNYNPSTWMLEVTSRSAEAELGIDFAQIYRESTLYE

SEQ ID NO: 203842 - protein, 1065 aa, Glycine max
  Coding DNA Sequence Number=SeqID_87064
  Gene Ontology: Mol. function=nucleoside-triphosphatase activity; Cellular component=integral to membrane; Biological process=transport
  Homolog annotation: Hit_ID=Q5W274; Match level="QueryCoverage=99%, HitCoverage=87%, E-value=0.0, Identity=47%"; Hit description =Pleiotropic drug resistance protein 3
  Pfam annotation: Domain name=ABC2_membrane; Domain location=171-342; Score=65.6; E_value=1.5e-16; Accession=PF01061.14; Description=ABC-2 type transporter
  Pfam annotation: Domain name=ABC2_membrane; Domain location=790-1004; Score=233.0; E_value=6.7e-67; Accession=PF01061.14; Description=ABC-2 type transporter
  Pfam annotation: Domain name=ABC_tran; Domain location=503-693; Score= 82.5; E_value=1.3e-21; Accession=PF00005.17; Description=ABC transporter
  Pfam annotation: Domain name=PDR_assoc; Domain location=347-410; Score=94.3; E_value=3.6e-25; Accession=PF08370.2; Description=Plant PDR ABC transporter associated
  Pfam module annotation: Pfam domain module=ABC2_membrane::ABC2 _membrane::ABC_tran::PDR_assoc; Domain location=171-342::790 -1004::503-693::347-410
MTGEMIVGPIKALFMDEISTGLDSSTTFQIVTCLQQLVHITDATAVLSLLQPAPETYELFDDLILMAEGKIVYHGPRSQALQFFKDCGFWCPERKGVADFLQEVISKKDQRQYWYRNDIPYKYVSVDEFSQIFKSSYWGRMLNDELSRPDDKSESHKNALSFSKYSLGKLDLFKACMKREILLMKRNSFIYVFKTAQLTITAIITMTVFIRTQRTVDLIGANYLLGSLYYTLVRLMTNGVAELIMTITRLPVVDKQKEFYLYPAWAYCLPSAILKIPFSVLDSIVWTSVTYYVIGYSPEITRQLLMSHGVIFTAASLPRWLRWGFWLSPMSYGEIGITLNEFLAPRWQKIKVGNVTEGREVLRSHGLDFDSHFYWISVGALLGFTILFDFGFVLALSYIKQPKMSRALVSKERLSQLRERETSNSVELKSVTVDVGHTPRENQSTGKMVLPFEPLSIAFKDVQYFVDIPPIFNCHSEQEMKKHGSDEKRLQLLCDITGAFRPGILTALMGVSGAGKTTLMDVLSGRKTGGIIEGDIRIGGYPKVQKTFERVSGYCEQNDIHSPYITVEESVTYSAWLRLPTEIDSVTKGKFVEEVLETIELDGIKDCLVGIPGQSGLSTEQRKRLTIAVELVSNPSIIFMDEPTSGLDARAAAVVMRAVKNVVATGRTTVCTIHQPSIDIFETFDELILMKSGGRIIYSGMLGHHSSRLIEYFQNIPGVPKIKDNYNPATWMLEATSASVEAELKIDFAQIYKESHLCRDTLELVRELSEPPPGTKDLHFSTRFPQNSLGQFMACLWKQHLSYWRSPEYNLTRFIFMIVCAIMFGAVFWQKGNKINNQQDLFNVLGSMYIAVIFLGLNYCSTILPYVATERAVLYREKFAGMYSSTAYSFAQVAIEIPYILVQSILYVAITYPMIGFHWSVQKVFWYFYTTFCTFLYFVYLGMMVMSMSSNLDIASVLSTAVYTIFNLFSGFLMPGPKIPKWWVWCYWICPTAWSLNGLLTSQYGDIEKEVLVFGERKSVGSFLRDYYGFRHDRLSLVAVVLIVYPIVYASLFAYFIKKMNYQKR

SEQ ID NO: 203843 - protein, 364 aa, Glycine max
  Coding DNA Sequence Number=SeqID_87065
  Gene Ontology: Mol. function=calpain activity; Cellular component =intracellular; Biological process=proteolysis
  Homolog annotation: Hit_ID=Q1S3Q9; Match level="QueryCoverage=85%, HitCoverage=68%, E-value=2e-36, Identity=32%"; Hit description =Cyclin-like F-box; F-box protein interaction domain
  Pfam annotation: Domain name=F-box; Domain location=7-54; Score=39.9; E_value=8.9e-09; Accession=PF00646.23; Description=F-box domain
  Pfam annotation: Domain name=FBA_1; Domain location=196-342; Score= -37.0; E_value=0.0034; Accession=PF07734.3; Description=F-box associated
  Pfam module annotation: Pfam domain module=F-box::FBA_1; Domain location=7-54::196-342
MRSEKKPWSPLLCEELIEEILSRLPVKPLIQFKCVCKGWNSLMSDPYFIKLHLSKSAAKDDLEHLQLMKNVCLGSIPEIHMESCDVTIWSVHVMGCTVGSSEILEEYRVRFWNKATRVISRESPTLSFSPGIGRRTMFGFGYDPSSDKYKVVAIALTMLSLDVFEKTEMKVYGAGDSSWRNLKGFPVLWTLPKVGGVYLSGTLNWVVIKGKETIHSEIVIISIDLEKETCRSLFLPDDFCFFDTNIGVFRDSLCVWQDSNTHLGLWQMRKFGDDKSWIQLINFSYLHLNIRPNEEKSMILPLCMSNNGDFFMMKFTRNADDEYQTILYNQRDGKSQVSVVSSGSFRTLLWRNLKIFTKSLVIPY

SEQ ID NO: 203844 - protein, 315 aa, Glycine max
  Coding DNA Sequence Number=SeqID_87066
MNCNLAEGEHHKDSCYYYSINNFDRKQEPVIYDYHEKERAPDLESILADFMMYQASSKGYCYSMQQQGIQFERNQSSAGYQWESFRQSEYHNKAEGVLNLDDLLIQFKDTVESIQQAFRRTETQISKLVDDMTNAATIKEEERTEIETHQESICQVTSINHQLTNKEETPEVSSTPEYPYLDTVGYVGGKDKGRLELSIKVEKIFFDLFEAMKHPDMGDAYFEEEEVEQEITLSTATMVLQSPLEKEPGYGRDCLACDEELDDSKDSCVDQVVFEELEKLRPAEKPKAELKTLPAHLKYVFLEEDETNLLSLATL

SEQ ID NO: 203845 - protein, 250 aa, Glycine max
  Coding DNA Sequence Number=SeqID_87067
FSSDSSFTMFNSCQDIDEEGTSILSHIDQHLLYSHTLCNMGPQRRKRRRFIEGSHELLRKNPVQRAPNVSEEVRIMQQRIRSGVILPKKIREDSLLSAAIWSSLLDQSIKKGNCCTRELGVLLPGTNDVSQILKSKRVLHRIKKMLFDCVKDITITLPAQDDRKKGSRQFMGPLQIAKVLPQRTKKWGQQAGDGENLTYLLALDYLNSIMEWNKFEPHVKDISVEITDAILDNIHNEIVFEMIGNLTRNT

SEQ ID NO: 203846 - protein, 434 aa, Glycine max
  Coding DNA Sequence Number=SeqID_87068
  Gene Ontology: Mol. function=protein binding; Cellular component =ribonucleoprotein complex; Biological process=mRNA processing
  Homolog annotation: Hit_ID=UPI00005DC1C7; Match level="QueryCoverage =62%, HitCoverage=28%, E-value=2e-79, Identity=55%"; Hit description =protein binding
  Pfam annotation: Domain name=FF; Domain location=12-61; Score=24.8; E_ value=0.00031; Accession=PF01846.10; Description=FF domain
  Pfam annotation: Domain name=FF; Domain location=219-269; Score=19.9; E_value=0.0092; Accession=PF01846.10; Description=FF domain
  Pfam annotation: Domain name=FF; Domain location=86-142; Score=19.5; E_value=0.012; Accession=PF01846.10; Description=FF domain
  Pfam module annotation: Pfam domain module=FF::FF::FF; Domain location=12-61::219-269::86-142
MEKENAAEEHRRNIAEYRKFLESCDYVKANSHWRKIQDRLEDDDRYLRLEKIDCLLVFQDYIRDLEKEEEEQKRIQKDQIRRGERKNRDAFRKLLEEHVAAGILTAKTQWHEYCLKVRDLPQYQAVASNTSGSTPKDLFEDAAEDLEKQYHEDKTLIKDTIKSGKITVVTTSVFEEFKVAVLEEAACQTISEINLKLIFEELLERAKEKEEKEAKKRQRLADDFTNLLYTFKDITASSKWEDCKSLFEEAQEYRSIGDESYSREIFEEYITYLKEKAKEKERKREEEKAKKEKEREEKEKRKEKEKKEKDREREKDKSKERHRKDETDSDNQDMTDGHGYKEEKKKEKDKERKHRKRHQSSIDDVDSEKEEKEESKKSRRHGSERKKSRKQADSPESDNENRHRRHKREHWDGSRKTGGHEELEDGELGDDVEN

SEQ ID NO: 203847 - protein, 150 aa, Glycine max
  Coding DNA Sequence Number=SeqID_87069
MEHTNYNDVHCVETIVNVPFSWEHKPGLSKVTTHGHHNGTSMVLQPPPCSSSSSGSGSDHKHKVEEESQILRAVQTSLRISSFRMESQKEEDPFVEAYKKCTRSPFIHQQSNRVQKNIRSRPNIWKYVNFFSCKHSDDVCGNKAVHTYKS

SEQ ID NO: 203848 - protein, 279 aa, Glycine max
  Coding DNA Sequence Number=SeqID_87070
  Gene Ontology: Mol. function=mannosyl-3-phosphoglycerate phosphatase activity; Cellular component=cytoplasm; Biological process=metabolic process
  Homolog annotation: Hit_ID=P76329; Match level="QueryCoverage=45%, HitCoverage=49%, E-value=9e-20, Identity=38%"; Hit description =Putative mannosyl-3-phosphoglycerate phosphatase
MATAKEYSDNVQREVNIDVDALLEAIQKKTSGEVQEFMQAEDAHRVKVNGEAFDSYTELAEAFELDIRDFTITEENLNTASEYALAEPLRYLAYVLRIILDSGRAGGKEKCDRDYAIILITRRFTDAFGRKECIDDPAASEWLARLKQQQIPLVICSSKTAAEIIPLQKRLGIAGAPFIAENGARVAFGGEAQIAEEPGADYLALCATLSTLQADFRFTGFHDFSDAEVARFTGLTLTEASQSRLRDASEVIVWRDDETRLDAFRAALAQHQLALTQGG

SEQ ID NO: 203849 - protein, 99 aa, Glycine max
  Coding DNA Sequence Number=SeqID_87071
MAMGGGGVGSTIGSCFWTMVLFWLEMSMMFGFGDLVVHSRVPTPDALLRRGVAIEDVHYAFCGFVIEDPVLNFACCNLLKAIFNEVVPDVHIARVAFLF

SEQ ID NO: 203850 - protein, 664 aa, Glycine max
  Coding DNA Sequence Number=SeqID_87072
  Gene Ontology: Mol. function=RNA-directed DNA polymerase activity; Cellular component=chromatin; Biological process=one-carbon compound metabolic process
  Pfam module annotation: Pfam domain module=RVT_1::Retrotrans_gag; Domain location=431-600::46-125
MSSSDKLDEALLRLSNHQALLGESMNTLTQKIDDLLTRVTPCFRLLLAHTHHPTTCTYTKPQIEARALQTRFAPSQYDDPTGALFKLTQRGSVTQYLSEFEELANRTIGLPPPFLLSCFVSGLTPEIRREVQALQPLTLVQAAVLARLQEEKLLDNRPPPRPRPVPPVPTPALVPPSPPPHSPRPTPLPPLLPTPTRTAPPPIRRLSPDEIASRQERGLCFYCDEKFHRGHKCASRIFLLIANEEDNPTPHIGSPNPPPDPPDHIDITNPGPAQISLNSLAGHLASETLQLMGQLSGHPVVVLVDGGSTHNFIQQELVTQLRLPCQPTPSPLRVMTTETDLYCHISLIETDSITSQNFHQDSQKLLTKFASLFQQPNTLPPECEIDHHIHLLPHSAPINVWPYRYPHFQKCEIETRVDAMLQKGLIQPSTSPLSSPVLLVKKHDGTWRLCMDYRTLNAITIHDRFSIPTIDELMDELGGARCFSKLDLLQGYHQICMHSDDIPKTAFHTHHGHYEFRVMPFGLCNAPSSFQATMNAIFRLYLRQFIIVFFDDILIYSPCFADHFLHLELAFQVLSAHHFVLKLTKCFFAQDQVEYLGHLASYRGVEPLASKVAAIHNWPIPRTTRAVQSFLGLAGFYRRFIRGYASIAASIVWFLHFSDVVRLS

SEQ ID NO: 203851 - protein, 157 aa, Glycine max
  Coding DNA Sequence Number=SeqID_87073
  Gene Ontology: Mol. function=protein binding; Cellular component =nucleus
  Homolog annotation: Hit_ID=Q2QNJ0; Match level="QueryCoverage=87%, HitCoverage=67%, E-value=2e-29, Identity=42%"; Hit description =Expressed protein
  Pfam annotation: Domain name=DUF538; Domain location=2-148; Score =202.8; E_value=8.3e-58; Accession=PF04398.3; Description=Protein of unknown function, DUF538
MASVVKERSGAEIVYGSEECYRHSIELLEELGFPKGVLPLQDLVECGRVRETGFVWMKQKAPYEHFFEGTNTRVSYAVEVTGYVEKFRMKKMSGIKSKQMMLWVPITEMSIEDPKGQKILFKTPMGIGKSFPILAFMTPEEKEKHLLLQYKEIQENS

SEQ ID NO: 203852 - protein, 503 aa, Glycine max
  Coding DNA Sequence Number=SeqID_87074
  Gene Ontology: Mol. function=protein serine/threonine kinase activity; Cellular component=membrane; Biological process=protein amino acid phosphorylation
  Homolog annotation: Hit_ID=Q49N13; Match level="QueryCoverage=99%, HitCoverage=99%, E-value=0.0, Identity=83%"; Hit description =Putative receptor-like protein kinase 3
  Pfam annotation: Domain name=Pkinase; Domain location=181-452; Score =164.8; E_value=2.2e-46; Accession=PF00069.15; Description=Protein kinase domain
  Pfam annotation: Domain name=Pkinase_Tyr; Domain location=181-452; Score=139.5; E_value=9.1e-39; Accession=PF07714.7; Description =Protein tyrosine kinase
  Pfam module annotation: Pfam domain module=Pkinase::Pkinase_Tyr; Domain location=181-452::181-452
MASDLNSGLSQETSVFGLKAWELMGIIVGLFIIIILVVISICLTSRKKSRRVNGMLPLSHMLSVSDEIKEIRVDQVSANNHPQNGAFVSLYDRFSDRDSEKVLIQTNNGENSSQSGSFVHLKKDDGSQSGEESGAKSVSTYRSSSHPITAPSPLCGLPEFSHLGWGHWFTLRDLELATNRFSKDNVIGEGGYGVVYQGQLINGSPVAVKKLLNNLGQAEKEFRVEVEAIGHVRHKNLVRLLGYCIEGTHRLLVYEYVNNGNLEQWLHGAMRQYGFLTWDARIKILLGTAKALAYLHEAIEPKVVHRDIKSSNILIDDDFNAKISDFGLAKLLGAGKSHITTRVMGTFGYVAPEYANSGLLNEKSDVYSFGVLLLEAITGRDPVDYSRPATEVNLVDWLKMMVGNRRAEEVVDPNIETRPSTSSLKRALLTALRCVDPDSEKRPKMSQVVRMLESEEYPIPREDRRRRKSQAGNMELEAQKETSDTEMTENPDSKSNGRRNQRK

SEQ ID NO: 203853 - protein, 367 aa, Glycine max
  Coding DNA Sequence Number=SeqID_87075
  Gene Ontology: Mol. function=sugar porter activity; Cellular component=membrane; Biological process=transport
  Homolog annotation: Hit_ID=Q75I89; Match level="QueryCoverage=97%, HitCoverage=90%, E-value=1e-147, Identity=73%"; Hit description =Expressed protein
  Pfam annotation: Domain name=TPT; Domain location=130-270; Score =178.0; E_value=2.4e-50; Accession=PF03151.7; Description=Triose -phosphate Transporter family
  Subcellular localization annotation: CTP_CleavageSite=33; ConfidenceScore=5.35e-01
WVLSPKYFNFPLPITLTMIHMGFSGAVTFFLVRVFKVVTPVKMTFEIYATCVIPISAFFASSLWFGNTAYLHISVAFIQMLKALMPVATFLMAVMCGTDKARCDMFFNMLLVSVGVVISSYGEIHFNVVGTVYQVTGIFAEALRLVLTQVLLQKKGLSLNPITSLYYIAPCSFVFLSVPWYLLEKPVMEVSQIQFNFWIFFSNALCALALNFSIFLVVGRTGAVTIRVAGVLKDWILIALSTVIFPESTITWLNIIGYAIALCGVVMYNYIKVKDFRASQSPDEIIPDRITKFIDLVSSNSIDIQDWKFEKRSSDFYVPDNVSSNRGSGGGNGSLSDMKIDEEAPLISSSRVSHIGRMQLANHATGK

SEQ ID NO: 203854 - protein, 68 aa, Glycine max
  Coding DNA Sequence Number=SeqID_87076
MEARAESENKHHWFPKRKEKTTKNTRMKKKLDVAKCKESRTSIILQNNQGRIWLGGPRAWAIAQGSRA

SEQ ID NO: 203855 - protein, 288 aa, Glycine max
  Coding DNA Sequence Number=SeqID_87077
  Gene Ontology: Mol. function=triacylglycerol lipase activity; Biological process=lipid metabolic process
  Homolog annotation: Hit_ID=Q8L570; Match level="QueryCoverage=96%, HitCoverage=62%, E-value=2e-32, Identity=46%"; Hit description =Lipase class 3-like protein
MVAAAHWIAKLCTPALLKALNESPDSEVKESCPLLLRPFAIVIFAAACMTWELAESGKHFMVPTLSASSVDDLRSEVAASSWLSDLWDQVEHTKVLKVVHHSATALGSHLKSISVAKDKVAGASAIVRPATSGTQQLLDVNKHITSSVVNDIAEGKLWYELEKELEKQNYILNIRAQVEEAAVEKEITEEENQLIDAAQGSNSITPSHNVDSYRFYPPGKIMHIISAPSSDDSSSNSIEEHVKLYETPRQLYSKLRLSRTMINDHYMPTYRKMIQPLIQQLEKDINVK

SEQ ID NO: 203856 - protein, 129 aa, Glycine max
  Coding DNA Sequence Number=SeqID_87078
  Homolog annotation: Hit_ID=Q8L570; Match level="QueryCoverage=29%, HitCoverage=5%, E-value=9e-09, Identity=68%"; Hit description=Lipase class 3-like protein
MWGMWDFTLHLYSNTENVEGEASSSTDNMLESIATLLEMLRFTYSETIGKWPIADKAFGINYFMRKQKSNNNNEGVATQCTKNKYDKANNKGSGATGKKNHKQRTNMHEGRRRSTNRVKRHRKKEEEEP

SEQ ID NO: 203857 - protein, 97 aa, Glycine max
  Coding DNA Sequence Number=SeqID_87079
MGIVHNIGEQQKLDVLSILTKKLPQQAFLQGVRCITEFSVAVSCAELNVGGTAEFLVAEPYGVVATKGKRRWVLRLTLTLDPTQQSKVDGNQAEVGR

SEQ ID NO: 203858 - protein, 85 aa, Glycine max
  Coding DNA Sequence Number=SeqID_87080
  Homolog annotation: Hit_ID=Q9LVV4; Match level="QueryCoverage=93%, HitCoverage=38%, E-value=8e-18, Identity=58%"; Hit description =Genomic DNA, chromosome 5, P1 clone:MNB8
  Subcellular localization annotation: CTP_CleavageSite=56; ConfidenceScore=5.05e-01
MCKTSLHVVVTMFTGYLLGYAAFRALFNHSPAMNAAGGILGLVGAMFVETFLFIIRSSNADADKTRKSSQKPRSSFSTSRIKKNQ

SEQ ID NO: 203859 - protein, 201 aa, Glycine max
  Coding DNA Sequence Number=SeqID_87081
MAKKKSWFSLLKRLFIWGTHSTQDKKEKRRKWIFGRLKSKRLPSIKAPLPSKGTTLSEAEKEQSKHALTVAIASAAVAEAAVTAAHVAAEVVCLTGQCKENSEESQPVQTAFRGYLARKALRLTQKGVAADIMLDTTMRGYIWSIQDEDFSALSFETMKKSPRRGAKVELLICTRDARDAKTEPNCVRIKQNWKNDSLKLN

SEQ ID NO: 203860 - protein, 582 aa, Glycine max
  Coding DNA Sequence Number=SeqID_87082
  Gene Ontology: Mol. function=enzyme inhibitor activity; Cellular component=cell wall; Biological process=cell wall modification
  Homolog annotation: Hit_ID=Q9SC90; Match level="QueryCoverage=90%, HitCoverage=86%, E-value=0.0, Identity=59%"; Hit description=Pectin methyl-esterase PER precursor
  Pfam annotation: Domain name=PMEI; Domain location=51-203; Score =96.5; E_value=8.2e-26; Accession=PF04043.6; Description=Plant invertasepectin methylesterase inhibitor
  Pfam annotation: Domain name=Pectinesterase; Domain location=258-554; Score=631.8; E_value=5.8e-187; Accession=PF01095.10; Description =Pectinesterase
  Pfam module annotation: Pfam domain module=PMEI::Pectinesterase; Domain location=51-203::258-554
MATGFDTAHEKKKKIAVLSVSSILLVAMVVAAAVGIRDGAEVVEEGGDTIAKSQRNQQVICESAEYKETCHKSLAKASGTSDLKELIITAFNATAEEIANQIKNSTLYHELATDHMTKQATDICKEVLGYAVDDIRRSVHTLEKFDLNKLNDYAYDLKVWIAGTLAHQQTCLDGFENTSSEAGKTMAKVLNASLELSNNALDIVNGVSSLFKGLNLSSFSVNSNRKLLSEETALVDGFPTWVSEGQRRLLQAVDPKPDVVVAQDGSGQVKTIHEALKLVPKKNKKPFVIYIKAGIYNEYIIMNKHLTYVTMIGDGPTKTRITGSKNYVDGVQTYNTATFGVNAANFMAKNIGFENTAGAEKHQAVALRVTADKAVFYNCNMDGFQDTLYTQSQRQFYRDCTVTGTIDFVFGDAVAVFQNCKFIVRMPLENQQCLVTAGGRSKIDSPSALVFQSCVFTGEPNVLALTPKIAYLGRPWRLYAKVVIMDSQIDDIFVPEGYMAWMGSAFKDTSTYYEFNNRGPGANTIGRITWPGFKVLNPIEAVEYYPGKFFQIANSTERDSWILGSGVPYSLGPLIALPFPTA

SEQ ID NO: 203861 - protein, 78 aa, Glycine max
  Coding DNA Sequence Number=SeqID_87083
MKTQEAEHANIGLGSSGQQKNFWNLSSEPQILCQYKFYPTYLTAKVIQMKVEDVKCNEAASRFIAENRTELPQRGLVG

SEQ ID NO: 203862 - protein, 181 aa, Glycine max
  Coding DNA Sequence Number=SeqID_87084
  Homolog annotation: Hit_ID=Q1RUY4; Match level="QueryCoverage=97%, HitCoverage=31%, E-value=2e-11, Identity=31%"; Hit description=IQ calmodulin-binding motif, putative
MSVGEITKLYSVRDQNNDIETSPADREPSRPCSHNSPSTTPSKVPLANGAKTKVLSSSRGGSWGGDGDSKSMFSKNLENTRRHSIGVSQVRDDESNSSSSPSTKVATKVKSSSSSSKVRSASFGVHRNGTPEKATSAPLKKRLSSPASPAGIRRYAVSTRPGNVASNKSVANAIPSLMRRK

SEQ ID NO: 203863 - protein, 50 aa, Glycine max
  Coding DNA Sequence Number=SeqID_87085
  Subcellular localization annotation: CTP_CleavageSite=55; ConfidenceScore=5.13e-01
MATYRKKPFWGRGSSPSKLMLSPKGMSSPRRAGCLGMKLSHGPFTPFLGK

SEQ ID NO: 203864 - protein, 95 aa, Glycine max
  Coding DNA Sequence Number=SeqID_87086
  Gene Ontology: Mol. function=nucleic acid binding; Cellular component= ribonucleoprotein complex; Biological process=multicellular organismal development
  Homolog annotation: Hit_ID=Q9FJ56; Match level="QueryCoverage=70%, HitCoverage=14%, E-value=6e-21, Identity=70%"; Hit description=RNA -binding protein-like
  Pfam annotation: Domain name=RRM_1; Domain location=31-94; Score =50.4; E_value=6.2e-12; Accession=PF00076.12; Description=RNA recognition motif. (a.k.a. RRM, R
MEEMPKNEVQQESQIMNKRKIINEMVWRKKIFVGGLPSGISEEEFKNYFERFGTITDVVVIQDSVTHRPRGFGFITFDSEKLVENVMLNSFHDLN

SEQ ID NO: 203865 - protein, 137 aa, Glycine max
  Coding DNA Sequence Number=SeqID_87087
MAALGVSTFFTSLQWICVDKVLHAVSRDDKTLKDINVEPKISCTTKAHEDTRDVSIVSCVDKAMKDTHVIHDKALEDEILKDIHGEPEISFVNEKTLEDIHVVSTISCVDKVMEDTHVDVLHDKALKDQTLEDIYLC

SEQ ID NO: 203866 - protein, 40 aa, Glycine max
  Coding DNA Sequence Number=SeqID_87088
MEKMEILDFNILLREFVMKPTIGNPDNTIKAMSNNLYSIP

SEQ ID NO: 203867 - protein, 326 aa, Glycine max
  Coding DNA Sequence Number=SeqID_87089
  Homolog annotation: Hit_ID=Q9LZ88; Match level="QueryCoverage=43%, HitCoverage=25%, E-value=5e-12, Identity=41%"; Hit description =Kinesin-like protein
IKKCRIENELGRRMDFVLDAINTDHIYISFHSLGINGIPDITQKAEKNEGGVGGARRVLFQRCTIAPVWSTSLKGASHSGAARFSMPLRNLWLRFVAKWTPPPALCSGRKSFGFASSLLLMRPLKGYVLLTDHLTYLTSSTTFPVTIIQQWGIKVFLNLLDQSWTLRLFFFTVDKNGNGGFAEFLSATEKNGKSIAVSFYEVDDRERAMDLLNLEKPPILVFEDRGRIQFKGLSQVLVKSIAEFQNLYSYACFALKGAPKKGGCEHVRRSHMGLIVHIFSQNGSLVSKVNFVDLAGYEDARKKSSDGSYLAEIKNYTHATGFVEGN

SEQ ID NO: 203868 - protein, 628 aa, Glycine max
  Coding DNA Sequence Number=SeqID_87090
  Gene Ontology: Mol. function=calcium ion binding; Cellular component =membrane; Biological process=transport
  Homolog annotation: Hit_ID=Q1RUY8; Match level="QueryCoverage=100%, HitCoverage=76%, E-value=0.0, Identity=72%"; Hit description =Mitochondrial carrier protein, putative
  Pfam annotation: Domain name=Mito_carr; Domain location=537-621; Score=51.0; E_value=4e-12; Accession=PF00153.17; Description =Mitochondrial carrier protein
  Pfam annotation: Domain name=efhand; Domain location=375-403; Score =28.1; E_value=3e-05; Accession=PF00036.22; Description=EF hand
  Pfam module annotation: Pfam domain module=Mito_carr::efhand; Domain location=537-621::375-403
MVSGSDPVESFFNSVQVVKDSLSPLEVGIRKAAKDLEHCLAGSKNKVNNGVCLIAPVRESGAFQICDVKKKKGLSMKVPLKAFWGMFSQNSGNGNGNGSSNIRAQVGKEDGPSCTNCLQFAVTWSLLVNGFLQSLPLPFKSGKKKCQKVCDEDKLCSCMKPTVSSCEVKQNESKGGQFGRAVREKGVRKKDGKNVSLECLIGFIFDQLSQTLQSLDHHGVQDNNDDLDNGKTSLPQPSFSHFGHVNALAGFLEEHKVYVNSFLGNLRFAKVGGVPSSVPGEESPSTNGEGDISSDNGNGNNENKDETGGNSPQKVANNIFSIPLSNVERLKSTLSTVSLTELIELLPQLGRTSKDHPDKKKLISVQDFFRYTEAEGRRFFEELDRDGDGQVTLEDLEVAMRKRKLPRRYAKEFMSRARSHLFSRSFGWKQFLSLMEQKEPTILRAYTSLCLSKSGTLKKSEILESLKNAGLPANEDNAVAMMRFLKADTEESISYGHFRNFMLLLPSDRLQEDPRSIWFEAATVVAVPPAVEIPAGSVLRSALAGGLSCALSCALLHPVDTIKTRVQASTMSFPEIISKLPEIGRRGLYRGSIPAILGQFSSHGLRTGIFEASKLVLINVAPTLPELQ

SEQ ID NO: 203869 - protein, 107 aa, Glycine max
  Coding DNA Sequence Number=SeqID_87091
MGTGLFVMPRPKEVITKIEICGEMKCSTSMKCLLPNGGEWFLKMKRNKGMELGRSLFWIRPHCFGSGRISSNGNFGQQMVQLGTWVSREDSVGLALTNLSEEVKVRV

SEQ ID NO: 203870 - protein, 93 aa, Glycine max
  Coding DNA Sequence Number=SeqID_87092
MMTKFISKNGSLNQEKERERMNIDRKWATESCEGLVLGVKMHDHVWSSSGYLDSAPSLLNSAPPNFQKSPNYPARLYPVTGGILLPLPEHASP

SEQ ID NO: 203871 - protein, 147 aa, Glycine max
  Coding DNA Sequence Number=SeqID_87093
  Gene Ontology: Mol. function=isomerase activity; Cellular component =mitochondrial inner membrane; Biological process=metabolic process
  Homolog annotation: Hit_ID=Q45W70; Match level="QueryCoverage=65%, HitCoverage=43%, E-value=2e-45, Identity=92%"; Hit description =Isomerase-like protein
  Pfam annotation: Domain name=FAA_hydrolase; Domain location=10-118; Score=56.6; E_value=8.1e-14; Accession=PF01557.9; Description =Fumarylacetoacetate (FAA) hydrolase family
MTPALFCFTLTNWIHFCTSGYALALDMTARDLQAAAKSAGLPWSLAKGQDTFTPISSILPKTAVPNPDDLELWLKVDEEIRQKGSTKDMIFKIPFLISYISSVMTLFEGDVILTGIALILHHIVCRLSSKLSFGPMRIGSANRIEHC

SEQ ID NO: 203872 - protein, 87 aa, Glycine max
  Coding DNA Sequence Number=SeqID_87094
MTEMKESKMKHRSWLFFTGTSFTSLWGIFDCEVLSFSLAEASIPLSGLIYRLLVLTTNNGGQSFIDCSKYEIIWQWKEEFGASFGSY

SEQ ID NO: 203873 - protein, 492 aa, Glycine max
  Coding DNA Sequence Number=SeqID_87095
  Gene Ontology: Mol. function=drug transporter activity; Cellular component=membrane; Biological process=multidrug transport
  Homolog annotation: Hit_ID=Q2QNV0; Match level="QueryCoverage=88%, HitCoverage=99%, E-value=3e-97, Identity=45%"; Hit description=MATE efflux family protein
  Pfam annotation: Domain name=MatE; Domain location=16-176; Score =103.4; E_value=6.5e-28; Accession=PF01554.9; Description=MatE
  Pfam annotation: Domain name=MatE; Domain location=254-416; Score =147.1; E_value=4.6e-41; Accession=PF01554.9; Description=MatE
  Pfam module annotation: Pfam domain module=MatE::MatE; Domain location=16-176::254-416
MQVLEEAKRMTDIGFPIAAMSLVGYLKNMTLVVCMGRLGSLELAGGSLAIGFTNITGYSVLSGLAMGMEPLCTQAFGSRNFSLLSLTLQRTILMLLLFSLPISLLWLNLESLMLCLRQNPDITRVATLYCCFAIPDLIANCFLHPLRIYLRSKGTTWPLLWCTLLSILLHLPTLTFLTFKLNLGVPGIAISSFVANFSNLFFLLLYMFYTRVRKESLHVPLLMPRHMSHNVTTCSSTSTIAKEWGVLMKFSIQSCLAVCLEWWWYELMTISAGYLHNPRVSLATAGIVIQTTSLMYTLPTALSASVSTRVGNELGAGQGERARLSTVVAIGLALVSSIFGLLWTTMGRERWGRVFTSDSEVLQLTMAVLPIIGLCELANCPQTTSCGILRGSARPGVGAVINFCSFYLVGAPVAIVLAFYWKLGMVGLCYGLLAAQIACVVSIFVVVYKTDWERESLKATCLVGKSSCGTFAYEDQTAVKCEGVVFLHNSEK

SEQ ID NO: 203874 - protein, 135 aa, Glycine max
  Coding DNA Sequence Number=SeqID_87096
  Homolog annotation: Hit_ID=Q9FGQ9; Match level="QueryCoverage=30%, HitCoverage=23%, E-value=3e-07, Identity=60%"; Hit description =Arabidopsis thaliana genomic DNA, chromosome 5, TAC clone:K14A3
  Pfam annotation: Domain name=DUF581; Domain location=38-96; Score =99.5; E_value=1e-26; Accession=PF04570.5; Description=Protein of unknown function (DUF581)
  Subcellular localization annotation: CTP_CleavageSite=63; ConfidenceScore=5.09e-01
MVGLSVVLEAQKSCINKKTPQVINKTSMMLSSIHNKPSPPLPQPSSLFQPPTFLDQCFLCGKRLLPGKDIYMYKGDRAFCSVDCRCKQIFTDEEEAIQKEKCSLAAMRPTSSSASTSTASHHHRKGTRNRGGACF

SEQ ID NO: 203875 - protein, 72 aa, Glycine max
  Coding DNA Sequence Number=SeqID_87097
MKFISSVLFIVLILSIGIGNEGPLRVTEANICDVKLYYYCEEDCFTDCPKKYGKKAQGICNEASECICRWQC

SEQ ID NO: 203876 - protein, 37 aa, Glycine max
  Coding DNA Sequence Number=SeqID_87098
MVPIRDNLVVGGLDIAQSIRQIAGAAGFKPSNKGGGC

SEQ ID NO: 203877 - protein, 38 aa, Glycine max
  Coding DNA Sequence Number=SeqID_87099
MWLAYAPVKNNAEDAAKFFERKSIPQCNFLTNGHLSCK

SEQ ID NO: 203878 - protein, 1209 aa, Glycine max
  Coding DNA Sequence Number=SeqID_87100
  Gene Ontology: Mol. function=RNA-directed DNA polymerase activity; Cellular component=chromatin; Biological process=RNA-dependent DNA replication
  Pfam annotation: Domain name=ADH_N; Domain location=1055-1191; Score=- 6.4; E_value=0.0024; Accession=PF08240.2; Description=Alcohol dehydrogenase GroES-like domain
  Pfam annotation: Domain name=Chromo; Domain location=1037-1092; Score= 25.4; E_value=0.0002; Accession=PF00385.14; Description='chromo' (CHRromatin Organisation MOdifier
  Pfam module annotation: Pfam domain module=ADH_N::Chromo::RVT _1::Retrotrans_gag; Domain location=1055-1191::1037-1092::382-553::49- 140
MAENTHSQASLCEMEERLSSRMESRFVELTASMQQTIHEMFQQRQQDSPAASNPPRGKALQWHSAYIKSVGLENLPSWNEYQILLLDRFGDVCEDPMVDLMKLRQTRSIIEYHEEFDSIVSRVDLSDEHQLSCFLGGLKQEVQMIVRMFQPNSVRKAYYLAKMYESSFSNTQAKPFVKNQKSSFVPKPPLLPNPPRSTNPLTINPSTKPQTPKHLTPAYMAERRVKGLCYFCDEPFTPEHDLTHKRLQIHVLEIEDEEKGPGPQQPDANVVTEPDSEPLIFVNALTGVVNFRTMRVTGYCGKKPLHILINSGSTHNFLDLHIAQKMGYQTEAINIVSVNVADGNKVQISSKEPSGLPPCRVGHDHKIPLMQGANPVNKRPYSPYASLVVLVGKKDGAWRLCMDYRDLNKATVKNKFPIPLVEDLLDELYGSTIFSKIDLRVGYNQVQMDAADIHKTAFRTHAGHFEYLVMPFGLTNAPATFQGLTNSVFQHYLRRFLLVFFDDILIYSSSMEDHLSHLYQVLLTMRTHCMYAKKSKCYFAIDKQLRSFLGLASYYRRFVSQYGAIAKPLTDMLKKDNFSWSSTAKEAFQELKQRLVASPVLALPDFSKEFVVEVDASGLGLGVVLMQNHHPIAFISRSLNTQQQSLSTYEKELLAIVFAVQKWRHYLPPKKFIIRNDHRCLKYILEQRLSTTFQQKWLVKLMEFDFNIEYREGRENMAADALSRLDSPEIMALQVYQPNSSMLSRIRQSWQKDPILQQLVSDLKSNPSSQKHYTWVRNELRRKGRLVIGSDSQLRQDILSWIHASACGGHSSRDATLQKMKNVVYWRGVSKAIKLSKAAHFMALSHPYTVADVAQCFLDNVFKLHGFPHTITNDRDPIFVSHFWKEFMSLQGIQAPPVHLPYLSGESKIALVDRSLQKHEEMLKLLKFHMKRVQDRMKQLADRSRSDRSFQIGDLVYVKLHDYRQVSVQARTNAKLAPKYYSLFPVEDKIGVVAYKLKFPLGSMVHNVFHVSQLKKFNGTTTVGDFSPSPLLDTSQKEPAAIIDRMTVNRGNRAITKVLVQWKHHLLEDPTWEFFYDLKQKTSNALAEFLVLLHQKANDGYRIVESVGQGVTEFKEEDHVLIVFIGESMSCRQCTSGKSNTCEILGLERRGLMHSDQKTRFSLKGKLVYNYCAVSSFSEYTVVHSGCVVKVSPLAPLEKICLLSCGVVA

SEQ ID NO: 203879 - protein, 116 aa, Glycine max
  Coding DNA Sequence Number=SeqID_87101
  Gene Ontology: Mol. function=binding; Cellular component =mitochondrial inner membrane; Biological process=transport
  Homolog annotation: Hit_ID=Q8LB35; Match level="QueryCoverage=64%, HitCoverage=25%, E-value=2e-23, Identity=67%"; Hit description =Putative carnitine/acylcarnitine translocase
  Pfam annotation: Domain name=Mito_carr; Domain location=45-116; Score= -1.4; E_value=0.0047; Accession=PF00153.17; Description=Mitochondrial carrier protein
MSQQLGFTIELYLDPTLENQVLKAWNILEIEESDNGIWPEFLASSTGKEFVAGEFGGIADIISGYPLDTFRMMQQSSNNGSAAFTILRNLVAKEGPTALYRGMASPLASVTLQLTN

SEQ ID NO: 203880 - protein, 56 aa, Glycine max
  Coding DNA Sequence Number=SeqID_87102
MANHTTLKTTTERLEEEISHLSDKHFDLASKVKDTSKEERITIVSFYMDGPALSWF

SEQ ID NO: 203881 - protein, 143 aa, Glycine max
  Coding DNA Sequence Number=SeqID_87103
MGTHRDMNESNLSIKYHVDLGRQHQNQIKGKEESPNCPTCIWLNREKLAHLTTFPLGFTGDPHNRQPTASKTFQVTWKSPFCHHLMKCNIDGAAAKGTPDPAIFKDYRITYMGGFSSNLSISFALHDELVRVMIFIEIAFTRG

SEQ ID NO: 203882 - protein, 114 aa, Glycine max
  Coding DNA Sequence Number=SeqID_87104
  Subcellular localization annotation: CTP_CleavageSite=53; ConfidenceScore=5.06e-01
MVLQKLSLNDAYNNRSRITAVEMKLQRCFLGTLSLNTRHLRSREPFLGSSHPRALSHSPLSLRCGCALTELTIFVSQRLSYVFFVPPCPVIETFCFLPSLSIAVIVQLRKLINN

SEQ ID NO: 203883 - protein, 73 aa, Glycine max
  Coding DNA Sequence Number=SeqID_87105
MVVILPNENIVIWFCSLHNRPDNYLKRIINSALKGFDDTPQSKLKDATRWIVVKYFNDARPLEPERMKALCIQ

SEQ ID NO: 203884 - protein, 145 aa, Glycine max
  Coding DNA Sequence Number=SeqID_87106
  Gene Ontology: Mol. function=protein dimerization activity; Cellular component=nucleus; Biological process=regulation of transcription, DNA-dependent
  Homolog annotation: Hit_ID=Q9T062; Match level="QueryCoverage=73%, HitCoverage=36%, E-value=5e-15, Identity=42%"; Hit description=BZIP transcription factor-like protein
  Pfam annotation: Domain name=bZIP_1; Domain location=55-119; Score =31.0; E_value=4.2e-06; Accession=PF00170.11; Description=bZIP transcription factor
  Pfam annotation: Domain name=bZIP_2; Domain location=55-109; Score =17.0; E_value=0.014; Accession=PF07716.5; Description=Basic region leucine zipper
  Pfam module annotation: Pfam domain module=bZIP_1::bZIP_2; Domain location=55-119::55-109
MFFHEEAEAVHSSYFPVLETMFTPSEIEELFSLVNEPASPGLGSGSQGSNREVRSMHERKLRRMQSNRESARRSRWRKKRHLENLTNQLNRLRTENQEYKNRLFLTMHQNLLLSVQNERLRSESVTLMARLSDLYQNLGTMMISQ

SEQ ID NO: 203885 - protein, 117 aa, Glycine max
  Coding DNA Sequence Number=SeqID_87107
  Subcellular localization annotation: CTP_CleavageSite=54; ConfidenceScore=5.25e-01
MVLMLKMMIHSLIIMQMATPPNSLLPPPTDLASHSPSTLKWTRKTTRLRSLATRSVGAEKSLNWKQVPVAQKDLIWEDIQALTINKDDVDDIVCEKYDISKEKWTQFCQSRRDPLWE

SEQ ID NO: 203886 - protein, 121 aa, Glycine max
  Coding DNA Sequence Number=SeqID_87108
MEITNSKDTQKKLPCQAIKVPSNNQIVKNMIKKCGRIGVIEKYTGKPKPRDAQKSFQKSKMLKIIKEATTYLNGCSQEFSKVQGMLIMRKEATTYLNRRCQTPTDARTRSSDEAQLFEQLQ

SEQ ID NO: 203887 - protein, 114 aa, Glycine max
  Coding DNA Sequence Number=SeqID_87109
  Gene Ontology: Mol. function=sugar porter activity
  Homolog annotation: Hit_ID=Q69M22; Match level="QueryCoverage=58%, HitCoverage=19%, E-value=5e-20, Identity=70%"; Hit description =Integral membrane protein-like
MDLACKQALVLSAQHALSTKTCIYAERAERAKQEADEDEEEGEEGEVGGAWLAAKGGVGEGNEERGDRWKDNEGVKVGMAEEIGVGKDGEIKDECGGEEFFGNGEDEGVVVEKP

SEQ ID NO: 203888 - protein, 257 aa, Glycine max
  Coding DNA Sequence Number=SeqID_87110
  Homolog annotation: Hit_ID=Q2A962; Match level="QueryCoverage=16%, HitCoverage=36%, E-value=1e-08, Identity=75%"; Hit description=Zinc finger (C2H2 type) containing protein
MGAGIGLVSVTQIRNLSKSQHHQNQNQQQQQKTLTPPLIFLHPHHQQPVGCGIQGTMKIKMSPGSFCRREFRSAQALGGHMNVHRRDRARLHQASVVPHNNNNSNNSNINPISSFSNTPSFLNISHHHQDPFVANGGLCLLYPFPSPNNNNNDPFSSLAHNNNACGDLPSTVFSVSSSHSQYSSLQYSPIRVPSCSATSFDFSVAQPAAASGRNNAFSSSYSGKVEQEPIISSSTHHGLHHEELDLELRLGNKSTST

SEQ ID NO: 203889 - protein, 70 aa, Glycine max
  Coding DNA Sequence Number=SeqID_87111
  Subcellular localization annotation: CTP_CleavageSite=57; ConfidenceScore=5.55e-01
MQDENETTVLGVGSSSMTKTVRFGFGSSSVQRFLGRSRNGVEGPSSSERMMRSIVTVSAPLWCLLVSVFE

SEQ ID NO: 203890 - protein, 860 aa, Glycine max
  Coding DNA Sequence Number=SeqID_87112
  Gene Ontology: Mol. function=microtubule motor activity; Cellular component=microtubule associated complex; Biological process =microtubule-based movement
  Homolog annotation: Hit_ID=Q9S7P3; Match level="QueryCoverage=96%, HitCoverage=99%, E-value=0.0, Identity=52%"; Hit description=Kinesin- like protein
  Pfam annotation: Domain name=Kinesin; Domain location=31-359; Score =525.4; E_value=6.3e-155; Accession=PF00225.13; Description=Kinesin motor domain
MKKKRKRVVAEPALSIHQRIKKMEKICVAVRLRPLVSQDSSSSSVGTFWKVEDNRISLHKIHGTPLSASSYAFDHIFDERSTNASVYELLAKDIIHAALDGFNGTAFAYGQTSSGKTFTMNGSETDAGVIPRAVGDIFATMEMMSDREFLIRVSYMEIYNEEINDLLVVENQKLQIHESLERGVFVAGLKEEIVNNAEQVLNLIKAGEVNRHFGETNMNVRSSRSHTIFRMVIESKAKDSNSSNDCSINDVVRVSVLNLVDLAGSERIAKTGADGVRLKEGKYINKSLMVLGNVINKLSEGSKQRGHIPYRDSKLTRILQPALGGNAKTSIICTIAPEEIHIEETRGTLQFASRAKRITNCVQVNEPILGKAHVLTVRISQILTEAALLKRQQLEIEELRKKLQGSHAEVLEQEILKLRNDLLKYEMERGKLEMELQEERKSRDQWIREQRMKIENSCTTKSFSDCGTNDNQGSGCFRRGFVEEYSDISSSISQGDIFKSPKVDPNAFVARRSKNSTLPDHSPLPDAFCNVADEDMWVKMNNGYIADLDSLQTTPPTNRKVQSFPTSDATVGCTSEIEKYEREVQDLRKQLELAKERINELEQKHSEEVPSSKQLIVETPKHQQETRLTHELPLRLSESEGNFKDSFEEALSVMQRFASGGTLSTAKILSTMSEIGDHLFATLEGHFAVNTGGERSSTGNSALINEHQKEFRQRIDNIITSLELSETSITGQEWKHKCSCEPKGSDLGGETAKDDLNERYENLERELLLLKVERDSLLQKFSESSEKLSMVSSQKENALKELNTEVLRRKNIEGEVKQIAAAFTNRQKSLISFHSDLKTKIENWRAQTTILVPKSFGFKD

SEQ ID NO: 203891 - protein, 36 aa, Glycine max
  Coding DNA Sequence Number=SeqID_87113
MSLRAQKLPKLPYMATALKYALSIIVLTATSSILLP

SEQ ID NO: 203892 - protein, 146 aa, Glycine max
  Coding DNA Sequence Number=SeqID_87114
  Gene Ontology: Mol. function=RNA-directed DNA polymerase activity; Cellular component=chromatin; Biological process=RNA-dependent DNA replication
MMTTLVLALPNITLPFFLETDAFGISMGAILMQWGHPHAFFSKSFSPRLLHASIYVRELHAITFAVHKWRQYLLDHKFTILTDHCSLKDLMAQLIQTPAQQYHLTKLLRGALWVNPDNPFISALLTKFYYTLIGDHLGIKKNLHRL

SEQ ID NO: 203893 - protein, 131 aa, Glycine max
  Coding DNA Sequence Number=SeqID_87115
  Homolog annotation: Hit_ID=Q1T2D5; Match level="QueryCoverage=49%, HitCoverage=4%, E-value=5e-07, Identity=40%"; Hit description=Chromo
MELNLRMMDSIAKMGWIVDVVGSGKDSEAGDGSLCTSTQIATCWPKWVKCMDIAVSDHHTERGSGFQWEVKELGDSRLHKIVSTVVVDKYSETSMVDIAKDTKGVDGGEARHGIQAYMRGKGGRFKGSEGI

SEQ ID NO: 203894 - protein, 141 aa, Glycine max
  Coding DNA Sequence Number=SeqID_87116
  Gene Ontology: Mol. function=chromatin binding; Cellular component =chromatin; Biological process=chromatin assembly or disassembly
  Homolog annotation: Hit_ID=Q1SAV4; Match level="QueryCoverage=68%, HitCoverage=25%, E-value=1e-16, Identity=43%"; Hit description =Integrase, catalytic region
MAFKVATVFIDIVSRYKFLAPKEWSHNTSQHFGTDVTPYEFGYGKPPPFIPSYMHKFSNNEVVDSLLVTRDAIHSSLKCQLTKAEDAMKYYADEKHRDKTFEVGQQENYKQLGLNPELSLDLKRADNFILPNLILSRFYLI

SEQ ID NO: 203895 - protein, 118 aa, Glycine max
  Coding DNA Sequence Number=SeqID_87117
YILCGTSREYIYLGCTTENKRGYISCGSVQVEGTSTWLFKENKGGYIPSGSLLVKDFTRLLEISRTGGYLGTGHRHGAPTESIVVALIRSVVANRGTLSRDAKSWLVPYQVPRQRIGQ

SEQ ID NO: 203896 - protein, 47 aa, Glycine max
  Coding DNA Sequence Number=SeqID_87118
  Homolog annotation: Hit_ID=Q04903; Match level="QueryCoverage=92%, HitCoverage=9%, E-value=3e-07, Identity=92%"; Hit description =Protein farnesyltransferase subunit beta
MKEKLMFELATLPFLDSYWNQVASVLNILDDELIKNVGDYILSLEAM

SEQ ID NO: 203897 - protein, 75 aa, Glycine max
  Coding DNA Sequence Number=SeqID_87119
MASLFPAEENNDKLLKKIEGREKRVEKRHAQQSHLELQKQQKRKKRAKRIKPEMTNPKAQPHTKNKISRACGSRK

SEQ ID NO: 203898 - protein, 347 aa, Glycine max
  Coding DNA Sequence Number=SeqID_87120
MAAFPEQFKVSRCPLTLSDELFDGIKSACGGAKSGADMELHHTRWCPVLTAWLYSTYSATTLGSMRCHSHSHSHLVEQWFVILDRFRGIFQEHYAKIVIVCRAVERPYGATLLSSSSFLHGDYRSCLGEIEESLVKTKPDTSICNVNGDDDDQRIINLDDDNFDNFTLSQIKASCKTRKRKQSQGLDSSKINMKVEDSSFLEDYRKKHRETNDYDFLETFDSLKSKLSKNMKAKKKKFFEEPSPTDTQEIMLVIKFEPQEILNNQELPPSSKEILDYHEFSASSQEIQDYQEFSPSCEEIQDGQEFPPISEEIKIDQEISFFSGDSISLVEVKSEVPKADCYGENNL

SEQ ID NO: 203899 - protein, 1229 aa, Glycine max
  Coding DNA Sequence Number=SeqID_87121
  Gene Ontology: Mol. function=RNA-directed DNA polymerase activity; Cellular component=chromatin; Biological process=chromatin assembly or disassembly
  Pfam annotation: Domain name=Chromo; Domain location=1129-1183; Score= 38.5; E_value=2.3e-08; Accession=PF00385.14; Description='chromo' (CHRromatin Organisation MOdifier
  Pfam annotation: Domain name=rve; Domain location=825-981; Score =100.8; E_value=4.1e-27; Accession=PF00665.16; Description=Integrase core domain
  Pfam module annotation: Pfam domain module=Chromo::RVT_1::Retrotrans _gag::rve; Domain location=1129-1183::459-627::127-213::825-981
MPPRKNTASGEPAVEEYGDTRVEFVAGEEAADNQTQLLNLMSTFSKGFEEEGEGQASVKRGQPSTETRKSGRNPRLKPLEGDDLAEFRQSMKKIELPSFYGDDPIGWIARAEIYFNVQETREAIRVSLAQLCMEGGTIHSFHSLLNEYENLSWEDFKKEMLEWYGGRGEGIVYDQLASLKQSGSMEDYIHSFECLIAQGLKDEIHARMRSLHIANPFTRGRIMNVARAIDVEISRQCRVWQGRGEIRGVGLIVENDGGEKSKNGPKDKGARHLSYQELLDRKQRGLCFKCGGGLYGIESLFDEEGEGGRTMNDEVARHKSETQGVCRGIKVEFDEREFVIDAFLFELEDMDLIFGMSWLTTLGETLVDWKNQVMKIKTDRGERWLKGVPHEDSLLNFVDVFAEPKGLPPVRAKEHRIILQPGQGPINVRPYKYAYHQKNEIEKQVRELMEVGHVRHSQSAYSSLVILVKKKNNKWWMYEDYRALNKATIPDKFPLPVIEELLDELHGARFFSKLDLRSGYHQVRMKEEDIPKTAFRTHEGHYEYLIMPFGLMNAHSTFQALMNEVFRALLRQGILVFFDDILESIEYLGHIISIQGVTVDPVKASTVVEWHVPKNVKGVHGFLGLTGYYRKFIKDYGKIATAPVLQLPNFDEEFSLECDACGTGIGAILMQNKKPVAYYNKVLSPCNLTKSAYERELTALGKENRGVDALSRSRDEMELNNMIYFPVWLDCQEINAEVHADEKLRKIIEEVKKGQGENINARFVYKQGVLYYKNPLVIPEKSTWIPKFLEEFHATPQGGHSACDTCQRQKYVTAAPSGLLQPLPIPERVWEDISIDFITGLPRSRGFEAILVVVDHLTKYCHFVPLKHPYTAKALAEIFVRGVVRLHGVPNSVVSDRDPLFMSLLWKEFFKMQGTKLKIGTAYHPQMNGQTKVTNRCLEMYLRCFITDQPKTWLIWMPWAEFWFNTTYHGSTRMTPFEAVYGRQPLKLGLVVQGEVRVEVVQQDLIERDEALRQLKSHLLRAHDRMRAQANKHRKERYFVVGDFIFLKLKQNRQHFVMNRVNPKLSAKYYGPFEVVEKIGEVAYRLKLPPSLKIHPVFHVSLLKKKVMGKYKVEEVLPIRLEDDRTKLMTPEAILAARNSTKRGETKKQVLRHWKGQAMDEATWEDEVTIRSQFPKFGLEDKALFQEKGIDTDPNATGPRESLIQEEKGKNRWSRVYVRKRPRNDDVAH

SEQ ID NO: 203900 - protein, 72 aa, Glycine max
  Coding DNA Sequence Number=SeqID_87122
MAQRELGSTDDSRYNTDATVGASVNTTVMSATTRDYDQNDSDKLAPQQGIMIKMTVISLCHSFLGRCCSTSR

SEQ ID NO: 203901 - protein, 55 aa, Glycine max
  Coding DNA Sequence Number=SeqID_87123
MKGLSMNLFCFTSLARATTQPNKAMNFHFVNNEANNTYTILPSPLGHNIVALATS

SEQ ID NO: 203902 - protein, 82 aa, Glycine max
  Coding DNA Sequence Number=SeqID_87124
MKERSERTESKSASPGIRVEGVIEESMSAGSEGAEDRDLRCKMSVACNFLLLWCVSEGKKIGVDDDILPETQRHTSMENFYG

SEQ ID NO: 203903 - protein, 416 aa, Glycine max
  Coding DNA Sequence Number=SeqID_87125
  Gene Ontology: Mol. function=catalytic activity; Cellular component =integral to membrane; Biological process=cellular metabolic process
  Homolog annotation: Hit_ID=Q1M0P1; Match level="QueryCoverage=96%, HitCoverage=95%, E-value=1e-173, Identity=74%"; Hit description=UDP -glucuronic acid decarboxylase 2
  Pfam annotation: Domain name=3Beta_HSD; Domain location=102-328; Score=-86.7; E_value=1.3e-06; Accession=PF01073.9; Description=3 -beta hydroxysteroid dehydrogenaseisomerase family
  Pfam annotation: Domain name=Epimerase; Domain location=101-329; Score=180.1; E_value=5.5e-51; Accession=PF01370.11; Description=NAD dependent epimerasedehydratase family
  Pfam annotation: Domain name=NAD_binding_4; Domain location=103-314; Score=-47.3; E_value=1.4e-05; Accession=PF07993.2; Description=Male sterility protein
  Pfam annotation: Domain name=Polysacc_synt_2; Domain location=101 -375; Score=-156.9; E_value=0.00049; Accession=PF02719.6; Description= Polysaccharide biosynthesis protein
  Pfam annotation: Domain name=RmlD_sub_bind; Domain location=100-398; Score=-99.1; E_value=3.2e-07; Accession=PF04321.7; Description=RmlD substrate binding domain
  Pfam annotation: Domain name=adh_short; Domain location=99-223; Score= -62.3; E_value=0.07; Accession=PF00106.15; Description=short chain dehydrogenase
  Pfam module annotation: Pfam domain module=3Beta_HSD::Epimerase::NAD _binding_4::Polysacc_synt_2::RmlD_sub_bind::adh_short; Domain location=102-328::101-329::103-314::101-375::100-398::99-223
  Subcellular localization annotation: CTP_CleavageSite=52; ConfidenceScore=5.25e-01
MIHRTQTPDLPNRTSDSPPKSTNRIGYMFRERVPFLLVGVAIASVFFQLLPSRSIVSAPHDSFLETELALPTRRVLLEGSTTQEKKGRVPLGVRGKKQKRVLVTGGAGFVGSHLVDRLIERGDSVIVVDNLFTGRKENVLHHMGNPNFELIRHDVVEPILLEVDQIYHLACPASPVHYNVHKTNVVGTLNMLGLAKRVGARFLISSTSEVYGDPLQHPQAETYWGNVNPIGVRSCYDEGKRTAETLAMDYHRGAGIEVRIARIFNTYGPRMCLDDGRVVSNFVAQALRKEPLTVYGDGKQTRSFQYVSDLVEGLMRLMEGEHVGPFNLGNPGEFTMLELAQVVQETIDPNAKIEFRPNTEDDPHKRKPDISKAKELLGWQPTVSLREGLPLMVSDFRQRLFGDSKLTGGKGASEAA

SEQ ID NO: 203904 - protein, 186 aa, Glycine max
  Coding DNA Sequence Number=SeqID_87126
MTTVASLSFVVENLGLKVLQNKGLEVRLSGSAAKGKPPTTLLLVDWRCMVPLISGSSMFYTEFSLINFNVSSLSRSRVQQIIGATNNLHRHSWNVLPPLVDDPKHTSSATKLVSKSPLDKYENQIKGFASGLGVYRHDFNIDVHDLCLGLSSISINDHLEDSYFTPDSGRLPFTLNSIKSSLWQHL

SEQ ID NO: 203905 - protein, 262 aa, Glycine max
  Coding DNA Sequence Number=SeqID_87127
  Gene Ontology: Mol. function=ribonuclease H activity
  Homolog annotation: Hit_ID=Q70G10; Match level="QueryCoverage=22%, HitCoverage=12%, E-value=6e-18, Identity=66%"; Hit description=SUMO protease
MFIIDVYQASYIVDEVKDKTGKDIDVSSWKKEFVEDLPEQQNGYDCGVFMIKYADFYSRNLGLCFNQIVDWTDYTYHPDIQSPSYQIQRGFLQVWGRINSNCDGAVSGGVAACGRVLRNQAGAVVVFAHNLGMCSISQAEIWAITMGVKLAWDKGFTNLYVESDFKYAIEMMDGVCEFSNNCFQLFLEIVKINLTLKLLYIIAALLGESMIDDGSYKDGATDPTLLCFAFALWEVKCTHNLHLLKVSQAYVLERDMSSTPFD

SEQ ID NO: 203906 - protein, 789 aa, Glycine max
  Coding DNA Sequence Number=SeqID_87128
  Gene Ontology: Mol. function=microtubule motor activity; Cellular component=microtubule associated complex; Biological process =microtubule-based movement
  Homolog annotation: Hit_ID=Q6WJ05; Match level="QueryCoverage=80%, HitCoverage=77%, E-value=1e-138, Identity=75%"; Hit description =Central motor kinesin 1
  Pfam annotation: Domain name=Kinesin; Domain location=210-470; Score =222.5; E_value=9.6e-64; Accession=PF00225.13; Description=Kinesin motor domain
MGGQMQQSNAAATALYDHAGAGSLHYAAGPATDAGDAVMARWLQSAGLQHLASPLASTAIDQRLLPNLLMQGYGAQSAEEKQRLFKLMRNLNFNGESGSEPYTPTSQNLGGVAVSDGFYSPDFRGDFGAGLLDLHAMDDTELLSEHVISEPFEPSPFMPGGSRGFEDDFNPINRKQERGEADSDASLFLPTNEKDNTRENNVAKIKVVVRKRPLNKKELAKKEDDIVTVYDNAYLTVHEPKLKVDLTAYVEKHEFCFDAVLDENVTNDEIAKWLCSCAVNRKLCMREDGRQQVCIVGLQEFEVSDVQIVKEFIEKGNAARSTGSTGANEESSRSHAILQLVVKRHNEVKESRRKNNDVNEAKSGKVVGKISFIDLAGSERGADTTDNDRQTRIEGAEINKSLLALKECIRALDNDQIHIPFRGSKLTEVLRDSFVGNSKTVMISCISPNAGSCEHTLNTLRYADRVKSLSKSGNPRKDQATNPVPPAIKEVSSTSSLPASVGADDFNGQCQEVKTMDMGRKVVEKESSLYSSAADVDKQSSFSSSYPFNGREEKSSTSAPIDRERFEVKNSYGGDSTSQKMNSYSIDVTNEKVQRVSPPRRKGTKEEKSERSVNWVKRDANGSDHSTASSKQQSTGNYSITTGSGQSETESSSDVNISAILEEEEALIAAHRKEIEDTMEIVREEMKLLAEVDQPGSLIDNYVTQLSFVLSRKAASLVSVIGIVAAEDGEAAVEQEEENEDEEECDAEGGAAEAVDGVGFAGGEEGGDEGAPIGGEELNGEKEKDGQKE

SEQ ID NO: 203907 - protein, 868 aa, Glycine max
  Coding DNA Sequence Number=SeqID_87129
  Gene Ontology: Mol. function=protein binding
  Homolog annotation: Hit_ID=UPI0000E481D3; Match level="QueryCoverage =19%, HitCoverage=35%, E-value=2e-13, Identity=30%"; Hit description =PREDICTED: similar to Germ cell-less homolog 1 (Drosophila)
  Pfam annotation: Domain name=BTB; Domain location=45-155; Score=41.9; E_value=2.3e-09; Accession=PF00651.21; Description=BTBPOZ domain
  Pfam annotation: Domain name=MATH; Domain location=735-867; Score =7.1; E_value=0.02; Accession=PF00917.16; Description=MATH domain
  Pfam module annotation: Pfam domain module=BTB::MATH; Domain location= 45-155::735-867
MEEPQYREHPKAKIATIPPSQHSDGAAAELRGVDCNLASLCEHVQIEGFNSGSFSDIVVNAMGSTYRLHRLILSRSSYFRNMLHGPWKEAGAPVVTLHVDDKNVNDEAIAMALAYLYGHHPKLNDNNAFRVLAAASFLDLQDLCGICTDFIISELWTSNFLAYQVFAENQDYGIHGERVRTACWGYLCQSGGMELKEVLPKLSSQTLHALLTSNDLWIPNEEKRFELALHTFLAKSANCKVEHHAHGISGTESATSVHADSGSSKGKSVTDSCTSKRLETGMGKMSLKTDLEDPSTPSLLVKLADPVADFNDGVSVSNERVQQASYASSPNLNPRYSCDMEGPSLSNSLPDTDGMRTSCYVEMPLGAGATGMGATEVGIEGPSEEGPCYHLENNSWLDRDQSRHCFSSNSCNELTSSDWGRYGTPLFSWNGQVVGRRQLKSHPRGNYRGHGDEYDAFFNIFEGGSLLYCNMSFDALLNARKQLEELGFPCKAVNDGLWLQMLLSQRVQEIAADTCKVCSLMSMACTCQKQFAFSHGASTTGSYAQEHNQNIMPGNAGNIYVAESSAGERNGLFRPVRVHVRGAIDGLAGIGRGTTFVPASASPPTRFVFSRVPFGVGNRNYPQSAANDDSETRADPNGDLAGDGLTALVGLSLGGSNGTNVHTELTQRGYEMGLQSSMSGTTAGGASTGGIPMQMLETPEHTIGIEWDNVNSSSISLDLKTPLSHFPPFRFGVRFEDVHRLGDGQVKHSPEVFYAGSLWKVSVQAFNDEDPQGRRTLGLFLHRRKAEVTDIHRKVHMYVDSREKVTARYQLTVPSKREMTVFGSFKQTGTLLPKAPKGWGWRTALLFDELADLLQNGALRVIAVVQLV

SEQ ID NO: 203908 - protein, 375 aa, Glycine max
  Coding DNA Sequence Number=SeqID_87130
  Gene Ontology: Mol. function=calpain activity; Cellular component =intracellular; Biological process=proteolysis
  Homolog annotation: Hit_ID=Q1RSQ2; Match level="QueryCoverage=94%, HitCoverage=95%, E-value=4e-80, Identity=48%"; Hit description =Cyclin-like F-box; F-box protein interaction domain
  Pfam annotation: Domain name=F-box; Domain location=13-60; Score =37.7; E_value=4e-08; Accession=PF00646.23; Description=F-box domain
  Pfam annotation: Domain name=FBA_1; Domain location=216-347; Score= -36.7; E_value=0.0032; Accession=PF07734.3; Description=F-box associated
  Pfam annotation: Domain name=FBA_3; Domain location=216-345; Score= -28.3; E_value=0.064; Accession=PF08268.2; Description=F-box associated
  Pfam module annotation: Pfam domain module=F-box::FBA_1::FBA_3; Domain location=13-60::216-347::216-345
MKRDNRRGLRRRNKTVFLPQELIIQILLRLPVKSLLRFKCVSKSWLSLITDPHFAKSHFELAAARTHRLVFFDTSSLITRSIDFNASLHDDSASVALNINFLITDTCCNVQILGSCRGFVLLDCCGSLWVWNPSTCAHKQISYSPVDMGVSFYTFLYGFGYDPLTDDYLVVQVSYNPNSDDIVNRVEFFSLRADAWKVIEGVHLSYMNCCDDIRLGLFLNGVIHWLAFRHDVSMEVIVAFDTVERSFSEIPLPVDFECNFNFCDLAVLGESLSLHVSEAEIWVMQEYKVQSSWTKTIDVSIEDIPNQYFSLICSTKSGDIIGTDGRAGLTKCNNEGQLLEYRSYSNSSRGQHQVAVYSDSLLSLPCDSEQAEEDA

SEQ ID NO: 203909 - protein, 390 aa, Glycine max
  Coding DNA Sequence Number=SeqID_87131
  Gene Ontology: Mol. function=cysteine-type peptidase activity; Biological process=proteolysis
  Homolog annotation: Hit_ID=Q70G10; Match level="QueryCoverage=78%, HitCoverage=56%, E-value=8e-43, Identity=38%"; Hit description=SUMO protease
  Subcellular localization annotation: CTP_CleavageSite=35; ConfidenceScore=5.74e-01
MAVVTSNGKRRQHWPSANYHFPSPNSKRPRLPTMSQNHAQSVLSSSSIISRISTYPETKPPLHREVHAPCRPRKFDSPAFNRSAHYYRKEEISHDVGNLLSKNYQRAKNSALASIRFGEKGKEVIEVDADSSKDMVSEEDSSVEEVRFVEEDGREVRSVVTEHKWQEGDLVVTEVKDLDAKDMCGGPQQQSTSSVVSELTNGDLNVVNAEKMLDILSLTPDHDLSSVQAYKKLLDALGQRTDTLNRLEAEIKVNEKRMSTFELLRPKKELVEEVPLEPFIPLTKEEEVEVAHAFSTNRKKILVSHEKSGIEISGEKFQCLRPGAWLNDEVINVYLELLKERERREPQKFLNCHFFSTFFYKRCLHTHAPVHCALLGFISFMESNSNGNAF

SEQ ID NO: 203910 - protein, 241 aa, Glycine max
  Coding DNA Sequence Number=SeqID_87132
  Homolog annotation: Hit_ID=Q1PEW8; Match level="QueryCoverage=57%, HitCoverage=80%, E-value=9e-10, Identity=28%"; Hit description=F-box family protein
  Pfam annotation: Domain name=F-box; Domain location=20-70; Score =17.8; E_value=0.04; Accession=PF00646.23; Description=F-box domain
MADLRVKKGSNKKHGSVSVTTIKSLPKELQVEIFAKVATRSIFDHCMIKLCCKEFLHAAEDDYVYRHASMENFALVPLPWFTGNKESSFLKRCRESGNSEILYREGMLQYFTSSRVELGLKNLKEAALEGHDDAKYVYCMLLMCGEDEGQRKQGFDLFCSLKESTSVIRCRKRVKSFVRSMWLKNKPNGKSSFCGSGTCDSERQKQLSKRWSSFEDKDGGISCQRCGADHELGFFCNMFGV

SEQ ID NO: 203911 - protein, 379 aa, Glycine max
  Coding DNA Sequence Number=SeqID_87133
  Gene Ontology: Mol. function=protein phosphatase type 2C activity
  Homolog annotation: Hit_ID=Q9LUS8; Match level="QueryCoverage=95%, HitCoverage=72%, E-value=3e-77, Identity=46%"; Hit description =Similarity to protein phosphatase-2c
  Pfam annotation: Domain name=PP2C; Domain location=179-378; Score= -48.7; E_value=0.0041; Accession=PF00481.12; Description=Protein phosphatase 2C
MLNSEGDLKISFGYKCNSDRGIPCEVASGCKILPGVRRTSSFSCFSGAALSANATLANTNICNVCLTDEDMRVHITYLSCSPSTTSDILEYDSCTLKSMSDPSRSEGFLNAKEVQVAGGAAGEDRVQAVCSEENGWLFCAIYDGFNGRDAADFLAGTLYDTIISYFNKLIWELEPGSVKAYDDGCLGGSLQYKLDDSLIYHEDQSLSRFKGINDSNHGCFAKCSPSTKSEVSCDSFSYGVLDILERSISQAENDFLYMVEQEMEERPDLVSIGSCVLLVLLHGNDLYTLNLGDSRAVLATCTTVDRMDKRERLEAIQLTDNHTVDNEVERARLLADHPDDPKIVIGGKVKGKLKVTRAFGVGYLKKVSILSYTSANRFL

SEQ ID NO: 203912 - protein, 304 aa, Glycine max
  Coding DNA Sequence Number=SeqID_87134
  Gene Ontology: Mol. function=alanine-tRNA ligase activity; Biological process=alanyl-tRNA aminoacylation
  Homolog annotation: Hit_ID=A0CKM4; Match level="QueryCoverage=55%, HitCoverage=60%, E-value=2e-14, Identity=29%"; Hit description =Chromosome undetermined scaffold_2, whole genome shotgun sequence
MELGLMDKNPTKLEHFDDMWRLESTATLLSHLKGDDGRHVLTLDRTIFYPQGGGQPADTGFVLIHGFDNNKFLVSDVRSKDGIVFHYGFFENLGGEFEPTLEKGKEVSLFVDQPRRKLNSRLHSAGHLLDICLPRIGLGNLEPSKAYHFPDGPWVEYKGTISQNEMQSKQKDLELEANALISMGGKVSVDILPYDEAAKLCGGCLPDYVPKRQEYSSSYSLFHWSLMLKFYVGQEIHAYGVLSTLYFVEVLISHKYEIVFMKMEETLISVIVKYEGDKIISSLNISVLVSVSLPACPTCMYLLA

SEQ ID NO: 203913 - protein, 97 aa, Glycine max
  Coding DNA Sequence Number=SeqID_87135
  Gene Ontology: Mol. function=structural constituent of ribosome; Cellular component=ribonucleoprotein complex; Biological process =translation
  Homolog annotation: Hit_ID=Q41852; Match level="QueryCoverage=97%, HitCoverage=100%, E-value=3e-30, Identity=70%"; Hit description=40S ribosomal protein S21
  Pfam annotation: Domain name=Ribosomal_S21e; Domain location=1-96; Score=146.8; E_value=5.7e-41; Accession=PF01249.9; Description =Ribosomal protein S21e
MQNEEGKLTGLYVPRKWYYVVTFFRIVHVRCNSATNRLITAKDHASVQINIGHLDENGIYNGHFSTSALSGFVRAQGDANSALDRLWQKKKAEVKQH

SEQ ID NO: 203914 - protein, 206 aa, Glycine max
  Coding DNA Sequence Number=SeqID_87136
MAEEISTSDLCNVKQCCEEFLDAAEDDHVYQQASLEKFALASLAWFTSDSESLFLKRCKETGNTEIVYREAMVEYFTSSRVESGLENLKKVAMEGHDEEKSACFFMCSEDEGEKKQGFDIFCSFKASTSIIMKCRNRVKAFVQSMWVNNKAVIRNRKTSFCPSVTCNSERLNKLSRWTSSSEDEEAGSNAISCECCRVDYELWTVL

SEQ ID NO: 203915 - protein, 116 aa, Glycine max
  Coding DNA Sequence Number=SeqID_87137
  Gene Ontology: Cellular component=cellulose and pectin-containing cell wall
  Homolog annotation: Hit_ID=Q8L9P8; Match level="QueryCoverage=68%, HitCoverage=67%, E-value=2e-15, Identity=56%"; Hit description=RALF
  Pfam annotation: Domain name=RALF; Domain location=53-93; Score=26.5; E_value=3.5e-05; Accession=PF05498.2; Description=Rapid ALkalinization Factor (RALF)
MGSSTFCAFFLLCAILAVHVAQSSSSTLDLDAFFLPLKSGCRGSVAECSLLAGDDAEFLMESESNRRILAGRSYISYGALRRNTVPCSRRDEREVWGLLMAVTTDLVLYMPVFGLK

SEQ ID NO: 203916 - protein, 136 aa, Glycine max
  Coding DNA Sequence Number=SeqID_87138
  Pfam annotation: Domain name=zf-GRF; Domain location=20-59; Score =6.2; E_value=0.0054; Accession=PF06839.3; Description=GRF zinc finger
  Subcellular localization annotation: CTP_CleavageSite=30; ConfidenceScore=5.39e-01
MSQRSNASSSRTRVSSQVVLFCGCGRRAVRCVAGTNINRGRTFFTCSINKDFYLGLFKMKLDIVAFGVDDSLGTFSIEQRRQFGREEDKTMWKAQVNSKLDCMGIEMKMFRTIVYEMFLIQLLSMVVFVCNCHFSP

SEQ ID NO: 203917 - protein, 107 aa, Glycine max
  Coding DNA Sequence Number=SeqID_87139
MSLGIQIKQIGGGVIGYWVGLVGLVGWVVKGGVGGYWVVDLVVLRLVGGGGYGKCWLGGGGKGRDGHICPFMFLMGCKKQLPRICGSVHQKQLRSGLNFGHLFSAKQ

SEQ ID NO: 203918 - protein, 151 aa, Glycine max
  Coding DNA Sequence Number=SeqID_87140
  Subcellular localization annotation: CTP_CleavageSite=58; ConfidenceScore=5.08e-01
MVHHCPTCVQASTMTLLIIAFNRHPSKSSVMRMPTEGKIELMAYTLCSVLGFSRGSLCCIYYSNTEICPTLPYFDLLDQAVNNILIWTLLIFHVMCINMMYAAKRWKIKIRYRVNVMPKGHSMRTVVWLFQQSRGNNEMKLNRNYKCDKRG

SEQ ID NO: 203919 - protein, 358 aa, Glycine max
  Coding DNA Sequence Number=SeqID_87141
  Gene Ontology: Mol. function=protein phosphatase type 2C activity; Cellular component=protein serine/threonine phosphatase complex; Biological process=protein amino acid dephosphorylation
  Homolog annotation: Hit_ID=Q9LUS8; Match level="QueryCoverage=76%, HitCoverage=54%, E-value=1e-100, Identity=68%"; Hit description =Similarity to protein phosphatase-2c
  Pfam annotation: Domain name=PP2C; Domain location=39-317; Score =57.1; E_value=5.8e-14; Accession=PF00481.12; Description=Protein phosphatase 2C
MRKEKIPHQAPFAIQAAQLLGRAIGAGLFAITPAGERGMCCKAIKLGNARVFPVTTLTSLEDPENQSLSRFKGINNSNHGCFAKCNPSTKSEVSCDSFSHGVLDILQRAISQAENDFLYMVEQEMEERPDLVSIGSCVLLVLLHGNDLYTLNLGDSRAVLATCGTADRMDKSERLKAIQLTDNHTVDNKVERARLLADHPDDPKIVIAGKVKGKLKVTRAFGVGYLKKKSLNDALMGILRVHDLKSPPYISTNPSLNVHRISNSDQFVIVGSDGLFDFFSNDEAVKLVESYILSNPFGDPAKFLIEQLVARAADSAGLSMEELMNIPAGRRRKYHDDVTVIVIMLGMNQRTSKASTCI

SEQ ID NO: 203920 - protein, 90 aa, Glycine max
  Coding DNA Sequence Number=SeqID_87142
MEEFLQKVAWPGVRPSPLGGGEASAAQEPQPNQEDDSSEATPTPPEPFIFEDDPVTTEGTQQASPTGILALDLNKEVMDQDPPPTQDQDH

SEQ ID NO: 203921 - protein, 135 aa, Glycine max
  Coding DNA Sequence Number=SeqID_87143
  Gene Ontology: Mol. function=nucleic acid binding; Cellular component= nucleus; Biological process=DNA integration
MKDEMKSMQYNDVWDLVKFLEGVKPIGRKWIFKTKKDSKGKTKRYKARLVAKGFTQKEVIDYKETFSLVSSKDSFRTIMTLVAHFDLEMHQMNVMTVFLNGDIEETIYMVQPKNFLPSDSKFVVCKLNKSIYDLK

SEQ ID NO: 203922 - protein, 88 aa, Glycine max
  Coding DNA Sequence Number=SeqID_87144
MLFDTLFQVYTDFMGPQNPTYIEPPTMVVKDVRSALLTACMKGAFKILGRCTLYLLQGPRHINDLEKRHPQGNATSLDYLMGGISIPN

SEQ ID NO: 203923 - protein, 112 aa, Glycine max
  Coding DNA Sequence Number=SeqID_87145
  Gene Ontology: Cellular component=integral to membrane; Biological process=vesicle-mediated transport
  Homolog annotation: Hit_ID=O23429; Match level="QueryCoverage=99%, HitCoverage=46%, E-value=8e-34, Identity=66%"; Hit description =Vesicle-associated membrane protein 724
  Pfam annotation: Domain name=Synaptobrevin; Domain location=10-106; Score=95.8; E_value=1.3e-25; Accession=PF00957.11; Description =Synaptobrevin
MKYIIDHAEEIEKLIKVKAQVSEVKSIMLENIDKAIDRGENLTILADKTETLHSQAEGSPNFQAQEFKKQGTHVRRKMWYQNMKIKLVVLGILLLLVLVIWLSVCHGFNCAN

SEQ ID NO: 203924 - protein, 37 aa, Glycine max
  Coding DNA Sequence Number=SeqID_87146
MAEPESEPTTEMLVHWGSIITSMERDNMFVTRRDVER

SEQ ID NO: 203925 - protein, 1465 aa, Glycine max
  Coding DNA Sequence Number=SeqID_87147
  Gene Ontology: Mol. function=RNA-directed DNA polymerase activity; Cellular component=chromatin; Biological process=chromatin assembly or disassembly
  Pfam annotation: Domain name=Chromo; Domain location=1369-1417; Score= 24.6; E_value=0.00035; Accession=PF00385.14; Description='chromo' (CHRromatin Organisation MOdifier
  Pfam annotation: Domain name=RVP; Domain location=336-440; Score= -13.8; E_value=0.088; Accession=PF00077.10; Description=Retroviral aspartyl protease
  Pfam annotation: Domain name=RVP_2; Domain location=339-454; Score= -32.2; E_value=0.00033; Accession=PF08284.2; Description=Retroviral aspartyl protease
  Pfam annotation: Domain name=RnaseH; Domain location=838-959; Score= -32.0; E_value=0.055; Accession=PF00075.14; Description=RNase H
  Pfam annotation: Domain name=rve; Domain location=1066-1222; Score =103.1; E_value=8.4e-28; Accession=PF00665.16; Description=Integrase core domain
  Pfam module annotation: Pfam domain module=Chromo::RVP::RVP_2::RVT _1::Retrotrans_gag::RnaseH::rve; Domain location=1369-1417::336 -440::339-454::580-749::103-193::838-959::1066-1222
MADHGTRKTTTDRLEDAIARLTNSQANLNERYTNISDKVDSILDHLRLRDEHQNQTSVSNTNGHRNTVKLDIPRFDGRDPMGWIFKMNQLFQYQHTPEEERITVASLYLDGAALSWYQWMFTNGLITSWQGFLQALESRFAPTFYDDPKGALFKLVQRGSVNEYLTEFERLANRVVGLPPPFLLSCFISGLVPELRREVLALQPISLLQATALAKLQEDKLRDRRPPPQRSSHPSPSPSSSIPNTKPKPPYVQRTPEEMAFRRERGLCYNCDDKWSSNHRCKGRILLFVADDITQDSGEPGSTEPSLVSEENSANPIGVLDPSPPHVSLHAMSGLPSSKTFRVYGSIRNTRITVLIDSGSTHNFLQPRVAHFLHLPIEDTQPLRVLVGNGSTLDCNKRCPNTPLHIQGHSFSITFHLLEISGADAVLGIEWLKQFGQVTTDYTFFMMRFNHLGQEVSLRADVATGPEPASATQVKRMLHTGSTSALFHLRIIPTNPIDETTTHLPHSLESITKLILRYDQLFQPPKSLPPSREVNHRITLLPSTAPVNVRPYRYPHFQKAEIERQIAELLSAGLVRPSTSPYSSPILLVKKKDGTWRLCVDYRSLNAITVRDRFPIPTIDELLDELGHASWFTKLDLRQGFHQILMNDADVEKTTFRTHHGHYEYLVMPFGLCNAPSTFQAAMNRLLAPFLRRFAAVFFDDILVYSSSLSSHVQHLDLILQALLRNEFYLKRTKCLFAQRELEYLGHVVSGSGVTPEPSKIQAIAQWPTPTTPKELRAFLGLTGFYRKFVRHYAAIASPLTSLLCKDAFEWSLESQEAFDTLKSAMINTPVLALPNFHEPFVVETDASGTAMGAVLSQQGHPLAFFSKNFNPRLLNASTYVRELHAITSAVRKWRQYLLDSSFTILTDHKSLRELMTQVIQTPEQHYYLSKLLGFDYTIQYKTGATNVVADALSRRPPEPGELLILSVPQFDFLRDIHQALVSDPEFQSLLTRVQENPSAYPQYRIHNGFLLFNNRIWLNKTNPYITTLLSEFHATPLGGHFGVAKTLHRLEASFFWQGQKQDVQKHIRECKDISMDFVTHLPPSSGFTVIMVVVDRYSKGVHLGALPTGFSAFKVAMLFVEIVCKHHGFPKSIVSDRDPVFLSAFWRELFRLSGTHLRLSTAYHPQSDGQTEVVNRVLEQYLRCFVNSQPSSWFRYLALAEWCYNTSLHSSSGLTPFEVIYGKPPPTIPQYIPGFTNNEAVASLVQSRQDIHTKLQKQLKKAQASMKKYADAHRDDVTFNEGQWVYVKLRPTRQRSATGPHHPKLSKRYFGPFKILAKVGEVAYRLALPAEARIHPVFHCSLLRRHHGPSPSSTEPWNLEIVGQRPKQRPLCILDRRLDTSTYPPTKLVLVQWVGQPPEDTSWESWLELQEAYHLEDKVVFEDDGIVSNQVHEEEDNTHEDASVVPTRPARAITKPRYLQDYVS

SEQ ID NO: 203926 - protein, 188 aa, Glycine max
  Coding DNA Sequence Number=SeqID_87148
  Gene Ontology: Mol. function=transferase activity, transferring glycosyl groups; Cellular component=membrane
  Homolog annotation: Hit_ID=Q10RW1; Match level="QueryCoverage=90%, HitCoverage=31%, E-value=4e-24, Identity=40%"; Hit description =Xyloglucan galactosyltransferase KATAMARI 1, putative, expressed
  Pfam annotation: Domain name=Exostosin; Domain location=7-152; Score=- 18.7; E_value=3.9e-08; Accession=PF03016.6; Description=Exostosin family
MGWVDGVIPFRWSSHASRKIRSIIRSECENATSSSDSSYDTLCEIVDCSNGVCEHDPVRFMRPMLSASFCLQPPGDTTTRRSTFDAVLAGCIPVFFEELSAKAQYGWHLPEAEFEELSVFIPKEEVVFRGMRILDVLQQIPRGRVRRMRERVLELMPSVFYRKHNSSPGLKTKKDAVDLAIDGTLDKI

SEQ ID NO: 203927 - protein, 52 aa, Glycine max
  Coding DNA Sequence Number=SeqID_87149
MSEDKGVGPAWRFAPKQPWVPATELDDVAVNNVGSEEHAVPKGRASLFVHAA

SEQ ID NO: 203928 - protein, 749 aa, Glycine max
  Coding DNA Sequence Number=SeqID_87150
  Gene Ontology: Mol. function=protein serine/threonine kinase activity; Cellular component=integral to membrane; Biological process=protein amino acid phosphorylation
  Homolog annotation: Hit_ID=O65510; Match level="QueryCoverage=100%, HitCoverage=68%, E-value=0.0, Identity=46%"; Hit description =Putative receptor protein kinase
  Pfam annotation: Domain name=LRR_1; Domain location=1-23; Score=11.4; E_value=2.1; Accession=PF00560.23; Description=Leucine Rich Repeat
  Pfam annotation: Domain name=LRR_1; Domain location=119-141; Score =10.8; E_value=2.7; Accession=PF00560.23; Description=Leucine Rich Repeat
  Pfam annotation: Domain name=LRR_1; Domain location=143-165; Score =7.4; E_value=12; Accession=PF00560.23; Description=Leucine Rich Repeat
  Pfam annotation: Domain name=LRR_1; Domain location=167-190; Score =12.7; E_value=1.2; Accession=PF00560.23; Description=Leucine Rich Repeat
  Pfam annotation: Domain name=LRR_1; Domain location=196-219; Score =6.2; E_value=20; Accession=PF00560.23; Description=Leucine Rich Repeat
  Pfam annotation: Domain name=LRR_1; Domain location=221-243; Score =8.6; E_value=7.1; Accession=PF00560.23; Description=Leucine Rich Repeat
  Pfam annotation: Domain name=LRR_1; Domain location=245-267; Score =15.0; E_value=0.27; Accession=PF00560.23; Description=Leucine Rich Repeat
  Pfam annotation: Domain name=LRR_1; Domain location=25-47; Score=8.9; E_value=6.1; Accession=PF00560.23; Description=Leucine Rich Repeat
  Pfam annotation: Domain name=LRR_1; Domain location=269-291; Score =15.4; E_value=0.21; Accession=PF00560.23; Description=Leucine Rich Repeat
  Pfam annotation: Domain name=LRR_1; Domain location=293-315; Score =5.9; E_value=23; Accession=PF00560.23; Description=Leucine Rich Repeat
  Pfam annotation: Domain name=LRR_1; Domain location=317-339; Score =15.9; E_value=0.15; Accession=PF00560.23; Description=Leucine Rich Repeat
  Pfam annotation: Domain name=LRR_1; Domain location=341-363; Score =10.2; E_value=3.6; Accession=PF00560.23; Description=Leucine Rich Repeat
  Pfam annotation: Domain name=LRR_1; Domain location=365-387; Score =16.2; E_value=0.12; Accession=PF00560.23; Description=Leucine Rich Repeat
  Pfam annotation: Domain name=LRR_1; Domain location=389-411; Score =16.9; E_value=0.075; Accession=PF00560.23; Description=Leucine Rich Repeat
  Pfam annotation: Domain name=LRR_1; Domain location=413-435; Score =14.2; E_value=0.47; Accession=PF00560.23; Description=Leucine Rich Repeat
  Pfam annotation: Domain name=LRR_1; Domain location=437-459; Score =9.8; E_value=4.2; Accession=PF00560.23; Description=Leucine Rich Repeat
  Pfam annotation: Domain name=LRR_1; Domain location=461-483; Score =14.0; E_value=0.55; Accession=PF00560.23; Description=Leucine Rich Repeat
  Pfam annotation: Domain name=LRR_1; Domain location=485-507; Score =17.4; E_value=0.05; Accession=PF00560.23; Description=Leucine Rich Repeat
  Pfam annotation: Domain name=LRR_1; Domain location=49-68; Score=4.5; E_value=40; Accession=PF00560.23; Description=Leucine Rich Repeat
  Pfam annotation: Domain name=LRR_1; Domain location=509-531; Score =11.7; E_value=1.9; Accession=PF00560.23; Description=Leucine Rich Repeat
  Pfam annotation: Domain name=LRR_1; Domain location=533-555; Score =16.0; E_value=0.13; Accession=PF00560.23; Description=Leucine Rich Repeat
  Pfam annotation: Domain name=LRR_1; Domain location=557-579; Score =15.6; E_value=0.18; Accession=PF00560.23; Description=Leucine Rich Repeat
  Pfam annotation: Domain name=LRR_1; Domain location=581-600; Score =15.0; E_value=0.28; Accession=PF00560.23; Description=Leucine Rich Repeat
  Pfam annotation: Domain name=LRR_1; Domain location=605-624; Score =9.5; E_value=4.7; Accession=PF00560.23; Description=Leucine Rich Repeat
  Pfam annotation: Domain name=LRR_1; Domain location=71-93; Score =18.5; E_value=0.024; Accession=PF00560.23; Description=Leucine Rich Repeat
  Pfam annotation: Domain name=LRR_1; Domain location=95-117; Score =16.6; E_value=0.089; Accession=PF00560.23; Description=Leucine Rich Repeat
  Pfam annotation: Domain name=LRR_2; Domain location=413-436; Score =4.3; E_value=4.2; Accession=PF07723.3; Description=Leucine Rich Repeat
  Pfam annotation: Domain name=LRR_2; Domain location=533-556; Score =3.8; E_value=4.8; Accession=PF07723.3; Description=Leucine Rich Repeat
  Pfam annotation: Domain name=LRR_2; Domain location=71-90; Score =10.6; E_value=0.56; Accession=PF07723.3; Description=Leucine Rich Repeat
  Pfam module annotation: Pfam domain module=LRR_1::LRR_1::LRR_1::LRR _1::LRR_1::LRR_1::LRR_1::LRR_1::LRR_1::LRR_1::LRR_1::LRR_1::LRR _1::LRR_1::LRR_1::LRR_1::LRR_1::LRR_1::LRR_1::LRR_1::LRR_1::LRR _1::LRR_1::LRR_1::LRR_1::...
  Pfam module annotation: Pfam domain module=LRR_1::LRR_2::LRR_2::LRR _2; Domain location=1-23::119-141::143-165::167-190::196-219::221 -243::245-267::25-47::269-291::293-315::317-339::341-363::365 -387::389-411::413-435::...
  Pfam module annotation: Domain location=437-459::461-483::485-507::49- 68::509-531::533-555::557-579::581-600::605-624::71-93::95-117::413 -436::533-556::71-90
MLRKISLRSNSFNGTIPSSLSKCTLLRSLFLQDNSFYGNLPAEIANLTGLMILNVAQNHISGSVPGELPLSLKTLDLSSNAFSGEIPSSIANLSQLQLINLSYNQFSGEIPASLGELQQLQYLWLDRNLLGGTLPSALANCSALLHLSVEGNALTGVVPSAISALPRLQVMSLSQNNLTGSIPGSVFCNRSVHAPSLRIVNLGFNGFTDFVGPETSTCFSVLQVLDIQHNRIRGTFPLWLTNVTTLTVLDVSRNALSGEVPPEVGNLIKLEELKMANNSFTGTIPVELKKCGSLSVVDFEGNDFGGEVPSFFGDMIGLNVLSLGGNHFSGSVPVSFGNLSFLETLSLRGNRLNGSMPEMIMGLNNLTTLDLSGNKFTGQVYANIGNLNRLMVLNLSGNGFSGKIPSSLGNLFRLTTLDLSKMNLSGELPLELSGLPSLQIVALQENKLSGDVPEGFSSLMSLQYVNLSSNSFSGHIPENYGFLRSLLVLSLSDNHITGTIPSEIGNCSGIEILELGSNSLAGHIPADISRLTLLKVLDLSGNNLTGDVPEEISKCSSLTTLFVDHNHLSGAIPGSLSDLSNLTMLDLSANNLSGVIPSNLSMISGLVYLNVSGNNLDGEIPPTLGSRFSNPSVFANNQGLCGKPLDKKCEDINGKNRKRLIVLVVVIACGAFALVLFCCFYVFSLLRWRKRLKQGVSGEKKKSPARASSGTSGARSSSTESGGPKLVMFNTKITLAETIEATRQFDEEN

SEQ ID NO: 203929 - protein, 88 aa, Glycine max
  Coding DNA Sequence Number=SeqID_87151
EAVAARVLIGTFVRWVLHDVLRVVSDELEHCARPKVSSFLFLLLLGFTPQLGFIDSTQNRVEMNRGRTSKRVLRPKLKNRGLVNISPL

SEQ ID NO: 203930 - protein, 65 aa, Glycine max
  Coding DNA Sequence Number=SeqID_87152
LKNEADAAPVTRSLGASDSRAQSQGAVGDDGSQPVESSDGIVEVELEGRQGLDLSDGYGAAIRAR

SEQ ID NO: 203931 - protein, 940 aa, Glycine max
  Coding DNA Sequence Number=SeqID_87153
  Gene Ontology: Mol. function=microtubule motor activity; Cellular component=microtubule associated complex; Biological process =microtubule-based movement
  Homolog annotation: Hit_ID=Q1S0D4; Match level="QueryCoverage=99%, HitCoverage=97%, E-value=0.0, Identity=67%"; Hit description=Kinesin motor domain, putative
  Pfam annotation: Domain name=Kinesin; Domain location=25-344; Score =464.2; E_value=1.6e-136; Accession=PF00225.13; Description=Kinesin motor domain
MGFVGGEEAIQEPTGHDERILVSVRLRPLNEKELARNDVSDWECINDTAIIYRSNLSASDRSLYPTAYSFDSVFRTNSSTRQVYEKAAKEVALSVVGGINSSIFAYGQTSSGKTYTMSGITEYTVSDIFNYIEKHKEREFMLKFSAIEIYNESVRDLLSPDCTPLRLLDDPERGTVVERLTEETLRDWNHFTELISFCEAQRQIGETALNEASSRSHQILRLTIESSAREFLGNDKSSSLSASVNFVDLAGSERASQTHSAGTRLKEGCHINRSLLTLGTVIRKLSKGRNGHIPFRDSKLTRILQSSLGGNARTAIICTMSPARSHVEQTRNTLLFASCAKEVSTNAQVNVVMSDKALVKQLQKELARLEDELRNSGPAHLTSETAALLREKDRQIDMLKKEVRELTLQRDLAHSRISGMLQVHGEDVATKELESMDPQYPNLHMRNSWNFENQREEPNVLSLDGEESVRSFDASQYSDGHSFSSDDNLFQLPDLEKNLLVRSSPPGLPVKRTDAAPNDLDQKSIEDQHEEDNCKEVRCIELEDVITNTHKHSNSADLRSHTYTDSNASSPSANTAILGLVVVDNRDKEKVVDLSSSLSKEDKRLNNMHQDFVLPSPKEISVCMTGNSTSSSRTLKLSRSRSCIASIMRNLSSDWFEDEDVIQNTPPIGNEKAFPGRPEGFPKNIYALNYNANAERLSCNGHGNSVQNSSVHDVQNVKSSTNKEREGNGPLAPKGKETENLNRLSLLADHEVPGTGLDPILSAKNVKDIGLDPMQADGETHSHSHWPSKFQRLQREIIEFWDACNVSLVHRTYFFLLFKGEPSDSIYMEVELRRLSYLTQTFSQGNQTVEDGRTLTPELSMRYLRKERQMLSKQMHKRLSKYDRQNLYLKWGLRLSSKHRSLQLAHQLWSDTKDMDHVRDSASIVAKLVGLVEPEQAFKE

SEQ ID NO: 203932 - protein, 56 aa, Glycine max
  Coding DNA Sequence Number=SeqID_87154
MNVWSHHLPRRTHPYRGKAYGNCAPFPLFCHHLTELDEGQQEFSGTLSDIEDWHCN

SEQ ID NO: 203933 - protein, 664 aa, Glycine max
  Coding DNA Sequence Number=SeqID_87155
  Gene Ontology: Mol. function=DNA binding; Cellular component=nucleus
  Homolog annotation: Hit_ID=Q10LJ1; Match level="QueryCoverage=84%, HitCoverage=59%, E-value=6e-44, Identity=35%"; Hit description =Expressed protein
MQQETEIEMCKKHRDKGHCLVPGAASDTWNQIEEASFILGLYIFGKNLVQASVGLKALVEGVGVGKGKEDLTGLAIDSMKSTQVLPARQEIPVGKACSLLTPSEIISFLTGDFRLSKARTSDLFWEAVWPRLLARGWHSEQPDSHNYAATSKYSLVFLVPGVKKFSRKLVKGNHYFDSVSDVLCKVASDPELIELETIADNDCTSKEGNGWTKDTKLDRENSPDQPRHCYLKVKTPNHSTDVMKFTVVDTSLASEKMTKVRELRSLPFEILKACTFENDSDDENTSEEQTNESESVNTTCLDREKNDITKASKSNTGKCVSSLLNCLEHNPSKEELPRSSMGSSSLSAASKGPKTEFLSNTLKRDGMKCPSLQRMVSDNKNDLVPVTKRRRRLTACSRAKKNSNTANFFVVPRVNQEEASFCPDPDNSKSSANVTANVFVASRVKQEEAIPHKSKCSESVLSWEIPTQEKNSSADFPTQKNKTLADPPSNPSSIINGEAVRDTSSSGNKDQCDKPQPRTMIDLNLPVPLEVEADETFVNEVAEMQQNNTGKESDDLSVVTNAKLSEQPDIHTRRQSTRNRPPTTKVLEAFAFGYLDRKEKCRNRDYLQDSSTRPSRRVSRKLAGSRNGGTDLEKEEKTDVVCNGNGNHSIDSNVIYPGSTCNER

SEQ ID NO: 203934 - protein, 121 aa, Glycine max
  Coding DNA Sequence Number=SeqID_87156
  Gene Ontology: Mol. function=sequence-specific DNA binding; Cellular component=intracellular; Biological process=regulation of transcription, DNA-dependent
  Homolog annotation: Hit_ID=Q942Y5; Match level="QueryCoverage=76%, HitCoverage=52%, E-value=4e-37, Identity=78%"; Hit description =Putative HAP3-like transcriptional-activator
  Pfam annotation: Domain name=CBFD_NFYB_HMF; Domain location=22-87; Score=125.9; E_value=1.2e-34; Accession=PF00808.13; Description =Histone-like transcription factor (CBFNF-Y) and archaeal histone
  Pfam annotation: Domain name=Histone; Domain location=19-90; Score =11.0; E_value=0.011; Accession=PF00125.14; Description=Core histone H2AH2BH3H4
  Pfam module annotation: Pfam domain module=CBFD_NFYB_HMF::Histone; Domain location=22-87::19-90
MVDNVGGSSSNAENSGIREQDRLLPIANVGRIMKQILPPNAKISKESKETMQECVSEFISFVTSEASEKCRKERRKTVNGDDICWALGSLGFDDYAEPLRRYLQRYRELEVDRGNSPPKRE

SEQ ID NO: 203935 - protein, 122 aa, Glycine max
  Coding DNA Sequence Number=SeqID_87157
  Gene Ontology: Mol. function=signal transducer activity; Cellular component=intracellular; Biological process=signal transduction
  Homolog annotation: Hit_ID=Q6AU06; Match level="QueryCoverage=86%, HitCoverage=27%, E-value=2e-41, Identity=69%"; Hit description =Putative WD G-beta repeat protein
  Pfam annotation: Domain name=WD40; Domain location=33-74; Score=31.1; E_value=3.8e-06; Accession=PF00400.22; Description=WD domain, G-beta repeat
  Pfam annotation: Domain name=WD40; Domain location=78-118; Score =21.9; E_value=0.0023; Accession=PF00400.22; Description=WD domain, G- beta repeat
  Pfam module annotation: Pfam domain module=WD40::WD40; Domain location=33-74::78-118
MMGGKQTGVMVHCGWNESGKKRKRKRLWNYSTGKFLKTYTGHVNSKYCISSTFSITNGKYIVGGSEDNCIYLWDLQSRKIVQKLEGHSDAVVSVSCHPTENMIASGALGNDNTVKIWTQQKD

SEQ ID NO: 203936 - protein, 140 aa, Glycine max
  Coding DNA Sequence Number=SeqID_87158
  Gene Ontology: Mol. function=oxidoreductase activity; Biological process=aromatic compound metabolic process
  Homolog annotation: Hit_ID=Q9FVQ0; Match level="QueryCoverage=77%, HitCoverage=34%, E-value=1e-15, Identity=46%"; Hit description =Flavin-containing monooxygenase, putative
MAFELSVSKGAYLCFISNKQKGRAHFGDVFFINREAIFISQIKYVSHLGITPLYRRTVELAEYDQGCHNWRVMALNGDSGQLEEYRGRFQGLSGFPLGFVLGRISKISMFLLLDRGILAWKSHWTLSTMVPKLPFSFIAQ

SEQ ID NO: 203937 - protein, 91 aa, Glycine max
  Coding DNA Sequence Number=SeqID_87159
  Subcellular localization annotation: CTP_CleavageSite=71; ConfidenceScore=5.83e-01
MVVTQPPTLLHVFQLFPSASLSALPLSFLPLTESSLSRSSHSLAARSGSSLLQRTHLLSLSATSSSCCEVSSMASTPPLHNQMRCLWQIRG

SEQ ID NO: 203938 - protein, 332 aa, Glycine max
  Coding DNA Sequence Number=SeqID_87160
TYILHNGNCGTGSHLEEKMNKSNKENALSWQKSGKVTSLRVKEKDRISGSEVIRDKMKVSASDNDFYKNDVSYESRVDPNHHASGTETRNDVKNSSLKSNHKIVDPSKKNSSRHWSNEAGKQTVQKQNEIGNPVLKVDATRSTNRKIISQQNLIQNFVEENIANQVCTGSRDGKAKVIASSEDKVKRETLYVGSRTAPESQKGDMSNGHPVHASGNDVPKFARNPIDVCCKVGVNCSSESFIPDGQLSESGPVTTNSSQTASSILEEATKLKDSADHYKNSGFEFESNETYFKAALKFLHGASLLESSHSESSKHGETSQMQIYATTAKLFE

SEQ ID NO: 203939 - protein, 161 aa, Glycine max
  Coding DNA Sequence Number=SeqID_87161
  Gene Ontology: Mol. function=zinc ion binding
  Homolog annotation: Hit_ID=Q10LI9; Match level="QueryCoverage=72%, HitCoverage=13%, E-value=1e-17, Identity=39%"; Hit description=CW -type Zinc Finger family protein, expressed
MVSEPILDPLTGHLPYYPRTKPKVLGVKGCIGKNPGESPSSSASDIDNLNNLAVVDKVTMTRGSNTHVANNQVISAQNRPNIVRLLDFTQDINLAMEASRKCKSTYRAANLNMEGARNRNDCITSIRKVVDFSFQDVDELVHLVLTAMKAITRAGLGGVRD

SEQ ID NO: 203940 - protein, 603 aa, Glycine max
  Coding DNA Sequence Number=SeqID_87162
  Gene Ontology: Mol. function=binding; Cellular component =intracellular; Biological process=metabolic process
  Homolog annotation: Hit_ID=Q2QXB0; Match level="QueryCoverage=94%, HitCoverage=96%, E-value=1e-151, Identity=48%"; Hit description =Pentatricopeptide, putative, expressed
  Pfam annotation: Domain name=PPR; Domain location=126-160; Score=2.5; E_value=3.8; Accession=PF01535.11; Description=PPR repeat
  Pfam annotation: Domain name=PPR; Domain location=161-195; Score =23.1; E_value=0.001; Accession=PF01535.11; Description=PPR repeat
  Pfam annotation: Domain name=PPR; Domain location=294-328; Score =27.5; E_value=4.8e-05; Accession=PF01535.11; Description=PPR repeat
  Pfam annotation: Domain name=PPR; Domain location=329-363; Score =13.2; E_value=0.2; Accession=PF01535.11; Description=PPR repeat
  Pfam annotation: Domain name=PPR; Domain location=433-467; Score =12.3; E_value=0.26; Accession=PF01535.11; Description=PPR repeat
  Pfam annotation: Domain name=PPR; Domain location=91-125; Score=32.3; E_value=1.7e-06; Accession=PF01535.11; Description=PPR repeat
  Pfam module annotation: Pfam domain module=PPR::PPR::PPR::PPR::PPR::PP R; Domain location=126-160::161-195::294-328::329-363::433-467::91-125
  Subcellular localization annotation: CTP_CleavageSite=51; ConfidenceScore=5.44e-01
MNLVTSLSSSLSRQHKLSLFHFHTNTKAHFVAKLQTCKDLTSATSTHSNVVKSGLSNDTFATNHLINCYLRLFTIDHAQKLFDEMPHRNVVSWTSLMAGYVSQGQPNMALCLFHQMQGTLVLPNEFTFATLINACSILANLEIGRRIHALVEVSGLGSNLVACSSLIDMYGKCNHVDEARLIFDSMCTRNVVSWTSMITTYSQNAQGHHALQLFKEFNHSRLDKPNHFMLCSAVSACASLGSLGSGKITHGVVIRLGHEASDVIASALVDMYAKCGCVNYSAKIFRRIQNPSVIPYTSMIVGAAKYGLGILSLQLFQEMVVRRIKPNDITFVGVLHACSHSGLVDKGLELLDSMDGKYGVTPDAKHYTCIADMLGRVGRIEEAYQLAKSVQVEGDGYAMLWGTLLSASRLYGRVDIALEASNRLIESNQQVAGAYVTLSNAYALAGDWENAHNLRSEMKHTGVYKEPGSSWIEIKESTYLFHAGDISKYTQGREILSLLRELEERMKGRGYVGGTKGLVFVDVEEEAKEEIVSMHSEKLALAFGLINTPKGVTIRIMKNLRMCRDCHGAFKLISDIVERELVVRDVNRFHHFKNGLCTCGDFW

SEQ ID NO: 203941 - protein, 581 aa, Glycine max
  Coding DNA Sequence Number=SeqID_87163
  Gene Ontology: Mol. function=translation elongation factor activity; Cellular component=intracellular; Biological process=translational initiation
  Homolog annotation: Hit_ID=Q9LIF4; Match level="QueryCoverage=20%, HitCoverage=40%, E-value=4e-39, Identity=56%"; Hit description =Arabidopsis thaliana genomic DNA, chromosome 3, P1 clone:MHC9
  Pfam annotation: Domain name=2OG-FeII_Oxy; Domain location=19-91; Score=68.6; E_value=2.1e-17; Accession=PF03171.10; Description=2OG -Fe(II) oxygenase superfamily
  Pfam annotation: Domain name=mTERF; Domain location=187-458; Score =66.5; E_value=8.3e-17; Accession=PF02536.5; Description=mTERF
  Pfam module annotation: Pfam domain module=2OG-FeII_Oxy::mTERF; Domain location=19-91::187-458
MALSLGLKGDVFEKMFGETLQGIRMNYYPPCSRPDLVLGLSPHSDASAITVLQQARGSPVVLTNGRYKSVEHRAVVHQEKDRMSIVTFYAPSFELELSPMPEFVDENNPCRFRSYNHGHLRKQGFTFTTLKWNPIVQLQFLKFEFCTTSRSFVVPYLINNCGFSQENALKASLRLRFRGPQKPDSVLSFFRSHGFSNSQICHILQKAPRLLLCNTQKTLLPKFQYLLSKGVSSLDIVRMVTPAPRFLERSLENHIIPTCEFVRGFLQSDKRMIHLLIRSPKLLNESSVTPNIKLLLDNGVTHSSIALLLQRRNQLLWSANLLKTVEELKQMGFDPSTSTFSMALLAKRTVGKTKWAEKIDTFKKWGWSQEQVLLAFRRQPQCMLSSRDKINAVMSFWVEQVGFNSAEIVKAPGIFLFSLQKRIAPRALVVQFLISKSLLQKEASLTTPFILPEKLFLKKPSILCSELRNVVEELKPLGFDPFKLSFAMVLQAKSAVSNSLWDAKVDTFKRWDWSEDEVFIAFRNQPNHLLSNGLIKKSSSLVTLFSKSDKVFLQKYVRCFWDRELTSMWLLWFNLWMLILV

SEQ ID NO: 203942 - protein, 827 aa, Glycine max
  Coding DNA Sequence Number=SeqID_87164
  Gene Ontology: Mol. function=zinc ion binding
  Homolog annotation: Hit_ID=Q10LI9; Match level="QueryCoverage=53%, HitCoverage=50%, E-value=6e-31, Identity=28%"; Hit description=CW -type Zinc Finger family protein, expressed
  Pfam annotation: Domain name=zf-CW; Domain location=399-447; Score =61.7; E_value=2.4e-15; Accession=PF07496.5; Description=CW-type Zinc Finger
VMISFTIPGGVLISPLHDSLLYLIRKEKAHGNIKPMYSLNGHQEHYSMSTDESDSFVGDGHLLKKRKVTVVDQSDKQHMNGNHSENDMTLHTKKKLRSRTLNRKDFLSNDLRCTPLSSSICDAGETDEVTVKAFEVSKEVDKDGVKCRMVSTEAVKEDTLESISGQDFDKIEKQNTGSSFMQKVLEHKTEIFQNNNSTDPKINSKCNAFAISKRIKCDTMKCKVDQDTQKCETNQEGKVKSESKNESKGERSPGKVMTDAEKDSIGTSNNAMVNDRKSTGIGVTSSKSKMHKIKSMKDNKVTDCDRDSLKGKKSQRKVDRINPTDRPTLNKATVNSILDHVYKSAYIVKERPSGNKVVNQLSAGPCVKDAPGAFSIAENKPTSEIVPSSAAATPQVIEEDWVCCDSCQKWRLLPMGLKPEQLPEKWLCSMLYWLPGMNRCNISEEETTKTLYASYQMPIFVGQNNMQNCATGPETEVRSVDALQLGLNHKKSSSDVMLDRGKKKHGINEKARSVINNDIGPADSNRMKKSISKHSSRLNNLIEEKNTPKVKEKQMNGGDRNHFRLKHKMEDNQHGSGTAKKSKTEDVYYADKQLNPSMEFKKVGLNSRNGLPTKASGKNMGKYDDYCWSDDLEDKLVVPVKKGDWAQFSSDDGSLDATNSSKIGSIKKRKMTDWLDSEKHNKTLSLEGDMKCGKEGNVNRREKKYIVLNMDAKSVTERDDKLVRESGVKRVFSSDSRDEMAIGTEVKSVNKVQQPRKHKKNVASYQALDCFDQLGKDLGSGELSLTATSSSSKVSGSHKARTNLEDVRGSPVESVTSSPLWTSNMDK

SEQ ID NO: 203943 - protein, 222 aa, Glycine max
  Coding DNA Sequence Number=SeqID_87165
  Gene Ontology: Mol. function=zinc ion binding
TNNLLPVLFKDERIQHALGHFRKEFEEGISADRLGAKFGDYGSFLPTCERSPPLRSCPKTPQKHSSSPKSPSNLHMVAAFQNSKAPPNIPPSMRLGTASYKAPPFRNIRVPSADNSVKNTDISSNEVIEKFTLKDCANKSENLTDQRTLKLRIKVKSDILAKKKAVIYSGLGLDDSPSSSMENSHEESEDMPHVSQETPEESPTSIVQLMQPVVIVVAMHLW

SEQ ID NO: 203944 - protein, 238 aa, Glycine max
  Coding DNA Sequence Number=SeqID_87166
  Gene Ontology: Mol. function=metal ion binding; Biological process =ubiquitin cycle
  Homolog annotation: Hit_ID=Q10NE1; Match level="QueryCoverage=94%, HitCoverage=96%, E-value=4e-61, Identity=50%"; Hit description=Zinc finger family protein, putative, expressed
  Pfam annotation: Domain name=zf-C3HC4; Domain location=177-217; Score= 38.0; E_value=3.2e-08; Accession=PF00097.15; Description=Zinc finger, C3HC4 type (RING finger)
MSFVFRGTRADIENGFPGFIPERRALLWLVLGVFLMATMLRMYATCQQLQVQAQAHAAAASGILGHTELRLHMPPSIALASRGRLQGLRLQLALLDREFDDLDYETLRALDSDNVSTAPSMTEEEINALPVHKYKVSGPQSGSSSMQQTSSSTPAEKKQDNSTAVGSMKASDDELTCSVCLEQVDVGDVLRSLPCLHQFHANCIDPWLRQQGTCPVCKFRAGSGWSDNGHNDIIADMV

SEQ ID NO: 203945 - protein, 81 aa, Glycine max
  Coding DNA Sequence Number=SeqID_87167
  Subcellular localization annotation: CTP_CleavageSite=37; ConfidenceScore=5.42e-01
MDPTSFSRRESGSLPHPPWTSSLLRVGKRTQVHGLARGVRRVCGLPVSPLNPWFENPTNYNTLRISLNPNLSLLACDILSI

SEQ ID NO: 203946 - protein, 231 aa, Glycine max
  Coding DNA Sequence Number=SeqID_87168
  Gene Ontology: Mol. function=kinase activity
  Homolog annotation: Hit_ID=Q1SCC6; Match level="QueryCoverage=50%, HitCoverage=25%, E-value=8e-49, Identity=85%"; Hit description=CBS
MAVWHGGFLKKCHQIAVALWVSTGGAMAAAIVLESKWDEQHAPARAPRELPKSTTAPCTSTSSLMVSPEVDDGTTLQCEFSRSHPKSTMAPREHHAREQWMATAMATDGSGNTLLGNHGSNLTEEELETHTISAWKGGKWTGFTQCFIRAGPYDNLKEIAVKILQNGISTVPIIHSEDGSFPQLLHLASLSGILKCILGIVLVHYLYFNFQFVQSLWGRGCPKLGNQIAGL

SEQ ID NO: 203947 - protein, 888 aa, Glycine max
  Coding DNA Sequence Number=SeqID_87169
  Gene Ontology: Mol. function=electron carrier activity; Cellular component=nucleus; Biological process=electron transport
  Homolog annotation: Hit_ID=Q1SCC8; Match level="QueryCoverage=62%, HitCoverage=94%, E-value=0.0, Identity=67%"; Hit description=DIRP; Cytochrome c region
  Pfam annotation: Domain name=DIRP; Domain location=465-562; Score =169.8; E_value=6.7e-48; Accession=PF06584.3; Description=DIRP
GGSDSGKESNDDAEISKKSQKRLRGKHLSDSKALEGHFSDHSQSHSVASGDGCLSLLKKRHSGIRLHAVRKRTPRVPISYSIGKDNGDRFFSSARQGSKQMVDTNDVAHKVALALTEASQRGGSSKISGSPDKKFVPSPGLKSGKKHPKSEIAGAKFCSSDLDDGSSELSLGSTEGENLNKHLNDIKEASSGTDDGFQDEKYKATVRERYLVIALIPLPHKDEGSAFDALKTLADLSLMLPVTNPDTESSAQFNKGNHDVVDESKMETHKVFPRIESTASNKLGKVFSDDGAAVPEAEGAHQLNAGFKKRKQKSFNLKNDETHTGSHLCGSLKTKATDEVKKSIVKGKRSSVSTAHSRQLKGVKSLGNLSSSTNDKRERDDSSFSLMKVSSTYQGSPLNRGKPRRKMEKPKPMVQQDLVVSRNIFSSQHKKSIASLQDGSSSQKGKLVNCLSSYQMRRWCTFEWFYSAIDYPWFSKREFVEYLYHVGLGHVPRLTRIEWGVIRRPRRFSEQFLIEEKHKLNQYRESVRSHYAEILAGTKEGLPTDLAQPLIVGQHVIAIHPKTREIHDGSVLTVDHCRYRVQFDQPELGVEFVMDIDCMPLYPFENMPTSLIQYNISSAPINEDFIELKPNGKLKQRKVAGHTILSPTENTDAIENLHISSTMHGRSTLSKQVSSSSSKSQLKVVCSEIGIGNAQLASSSRPSLLDHVHSKEADILAISELNCALDKKERVLSELKHMNDGVSESQKYGDNSVKDSEPFKRNYASVSSALFCLRQRNTYQASSSVLSLKPLANFDDPSGQASSSNCSACHNQESISQSHIAEIVESSRRKARTMVVEATQDQLTANILNPLASCHVQDAELNSSSDQNEMKIPSELISHCLATLFMIQ

SEQ ID NO: 203948 - protein, 49 aa, Glycine max
  Coding DNA Sequence Number=SeqID_87170
  Gene Ontology: Mol. function=DNA binding; Cellular component=nucleus
  Homolog annotation: Hit_ID=Q1SCD0; Match level="QueryCoverage=94%, HitCoverage=23%, E-value=6e-16, Identity=87%"; Hit description =Homeodomain-related
VVLAIRNRSVEMVEALYTMNRAYLSLPEGTASVVGLIAMMTDHYSVLRC

SEQ ID NO: 203949 - protein, 341 aa, Glycine max
  Coding DNA Sequence Number=SeqID_87171
  Gene Ontology: Mol. function=transcription factor activity; Cellular component=nucleus; Biological process=regulation of transcription, DNA-dependent
  Homolog annotation: Hit_ID=Q6J9Q2; Match level="QueryCoverage=52%, HitCoverage=68%, E-value=4e-37, Identity=43%"; Hit description =Putative AP2/EREBP transcription factor
  Pfam annotation: Domain name=AP2; Domain location=41-105; Score =114.2; E_value=3.8e-31; Accession=PF00847.10; Description=AP2 domain
  Subcellular localization annotation: CTP_CleavageSite=28; ConfidenceScore=5.17e-01
TSSDTPFKGYDPSQTQMCLSLLQRNTSPCGERRGRRKQAEPGRFLGVRRRPWGRYAAEIRDPTTKERHWLGTFDTAQEAALAYDRAALSMKGSQARTNFVYSDNINFHTLQLSPMNVQVQPLLPASQFLTTTTTQTNQNSHFQVIHSTPNCGNPSPLNNDMCVETTYGSAQDDNFFFSSDSNSGYLECIVPDDCFRPASSSSNSSNSRKSNVSDQKANTSSMESTNHHHHQYSHVDMTSFSQEGIEMAPRASYNFSDFCYQSEVSQGSWDDQQSWDWNSSELSAIFKNPMRVENGCMDALCPINDSPSSSYGLMNEAASSSTTCSPSLPPFGDVDLGYPLF

SEQ ID NO: 203950 - protein, 101 aa, Glycine max
  Coding DNA Sequence Number=SeqID_87172
MPVYTTTLHLTTTFSTAQDMAQALHADEYLRRVMSIDGCSPDGYNSTCPPTASTRLIFRELKRCFLKRRIIDVREESRVREQDLENFQVEERMNIINEIRV

SEQ ID NO: 203951 - protein, 49 aa, Glycine max
  Coding DNA Sequence Number=SeqID_87173
MGKDVGCAIQLYKTEFPINGEKEFVPKPIESLDQSCLSFVLNFIYNFTD

SEQ ID NO: 203952 - protein, 264 aa, Glycine max
  Coding DNA Sequence Number=SeqID_87174
  Gene Ontology: Cellular component=mitochondrion; Biological process =response to cold
  Homolog annotation: Hit_ID=Q9FF87; Match level="QueryCoverage=43%, HitCoverage=25%, E-value=4e-10, Identity=33%"; Hit description =Arabidopsis thaliana genomic DNA, chromosome 5, P1 clone:MRO11
MLLKRHKNVFLGPTPLLENPNRLTPVGFIHCAFRDQCSTEIGGGENRGTHVQQPGNGGTREAVIEEEFGGKREAGVVGEKDGGVAAETSDDEFVGDEEGSEELVGGDDVAVEGAGEEGGGSGGDADDVGGGGAFGAEELEFGEDEVVGVAEEDGVLALDDLADLERREAVGGEEGENGVGPVGAVEAELAGDAEGSLWGEAEAGDEVGDCEGVRNGAAEFDKRMMLMLRSWCRGLQMEKGSVTVLVPIQHACVARGRMGVAPQN

SEQ ID NO: 203953 - protein, 80 aa, Glycine max
  Coding DNA Sequence Number=SeqID_87175
  Homolog annotation: Hit_ID=Q1SYU4; Match level="QueryCoverage=46%, HitCoverage=9%, E-value=2e-07, Identity=52%"; Hit description=Zinc finger, RING-type; Thioredoxin-related; RINGv
MAVASGVEVDGAGRVFDFFDEAAVAVGTDDGVVGPDTDEAAAAVAPNVSYFSFSLRVSDFFFPGRERTCVAWNKDNSETA

SEQ ID NO: 203954 - protein, 552 aa, Glycine max
  Coding DNA Sequence Number=SeqID_87176
  Gene Ontology: Mol. function=structural constituent of ribosome; Cellular component=intracellular; Biological process=translation
  Homolog annotation: Hit_ID=Q0WWX4; Match level="QueryCoverage=100%, HitCoverage=96%, E-value=1e-128, Identity=43%"; Hit description =RanGAP1 interacting protein
  Pfam annotation: Domain name=Kelch_1; Domain location=115-161; Score =17.6; E_value=0.04; Accession=PF01344.15; Description=Kelch motif
  Pfam annotation: Domain name=Kelch_1; Domain location=167-210; Score =14.2; E_value=0.097; Accession=PF01344.15; Description=Kelch motif
  Pfam annotation: Domain name=Kelch_2; Domain location=115-161; Score =16.4; E_value=0.11; Accession=PF07646.5; Description=Kelch motif
  Pfam annotation: Domain name=Kelch_2; Domain location=166-210; Score =9.0; E_value=2.5; Accession=PF07646.5; Description=Kelch motif
  Pfam module annotation: Pfam domain module=Kelch_1::Kelch_1::Kelch _2::Kelch_2; Domain location=115-161::167-210::115-161::166-210
MFGISRRRMKLGRLKVQLSEANPGTRTPIRHPKRNGNSNGEGEGDAGGSSGHSDEVDCQPSTEITSGSSENWMVLSIAGDKPTPRSNHAAAVIGNKMIVVGGESGTGLLDDVQVARSGHSVVRASSVLILFGGEDAKRRKLNDLHMFDLKSLTWLPLHYTGTAPSPRFNHVAALYDDKILYIFGGSSKSRTLNDLYSLDFETVRELCRSKCVNGHGETVIFDIVKNEWSVAITSPPSSITTNKGFSMVLVQHKEKDFLVAFGGSKKEPSNQVEVLIMEKNESTLGSQSAHIDSVARQNLASAIEHGSGRRSLSESLVIDPNFPPTNTSLRKQFDHDEEYNTDLKMDKNSDERSFPRAVDHRTNKDYHGKQMNTSEVKTNMEEQQTLLSGILNQQNLVFENDMPESDNLLFSENINININSGSLTTSNVYYYYESKLASLIRKNGILEGQLAASIASKEAAEKSLTSVLKSRQEMDRKLTESEKEMELMREKLAGLELAQEETNNLSNIVHSDNVRLEHDVAFLKAVLDDTQKELHSTRGVIAGERARAFQLQ

SEQ ID NO: 203955 - protein, 452 aa, Glycine max
  Coding DNA Sequence Number=SeqID_87177
  Gene Ontology: Mol. function=transferase activity; Cellular component= nucleus; Biological process=mRNA editing
  Homolog annotation: Hit_ID=Q84SD0; Match level="QueryCoverage=94%, HitCoverage=97%, E-value=5e-92, Identity=35%"; Hit description =Putative pentatricopeptide (PPR) repeat-containing protein
  Pfam annotation: Domain name=PPR; Domain location=119-153; Score =35.3; E_value=2.1e-07; Accession=PF01535.11; Description=PPR repeat
  Pfam annotation: Domain name=PPR; Domain location=18-52; Score=25.4; E_value=0.0002; Accession=PF01535.11; Description=PPR repeat
  Pfam annotation: Domain name=PPR; Domain location=181-215; Score =28.6; E_value=2.2e-05; Accession=PF01535.11; Description=PPR repeat
  Pfam annotation: Domain name=PPR; Domain location=222-256; Score=1.2; E_value=5.4; Accession=PF01535.11; Description=PPR repeat
  Pfam annotation: Domain name=PPR; Domain location=274-308; Score=8.3; E_value=0.78; Accession=PF01535.11; Description=PPR repeat
  Pfam annotation: Domain name=PPR; Domain location=309-343; Score =33.6; E_value=6.7e-07; Accession=PF01535.11; Description=PPR repeat
  Pfam annotation: Domain name=PPR; Domain location=344-377; Score=9.4; E_value=0.58; Accession=PF01535.11; Description=PPR repeat
  Pfam module annotation: Pfam domain module=PPR::PPR::PPR::PPR::PPR::PP R::PPR; Domain location=119-153::18-52::181-215::222-256::274 -308::309-343::344-377
MANYAFLMLHHLHIPDFFSWGCVIRFFSQKGLFTEAVFLYVQMHRMSLCPSSHAVSSALKSRARIQDMLVGVSIHGQVRVLGFNTCVYVQTALLDLYSKIGDMGTARKLFNEMAKKSVVSWNSLLSGYVKAGNMDQACTLFRRMPERNLASWNAMIAGFIDCGSLVSAREFFYAMPRRNCVSWITMIAGYSKGGDVDSARMLFDQMDRKDLLSYNAMIAYKMTLASVISACSQLGDLEHWCWIESHINDFGIVLDDHLATALIDLYAKCGSIDKAYELLFPSMRKRDSASDAIKLFEQMLAECIGPNLVTYTGLLTAYNHAGLVEKGYQCFNSMKDYGLVPSIDHYGIMVDLLGRAGYLDEAYKLIINMPMHQNAGVWRALLLACRLHNNVELGEIAVQHCIKLGSDTTGNCSLLSGIYATVEKWDDAKKLRMGMEGKEITGCSWTSNLATP

SEQ ID NO: 203956 - protein, 76 aa, Glycine max
  Coding DNA Sequence Number=SeqID_87178
PGAYQHVMAKSYLHPDFPSVVSLGQDRLELPSGVGTEHGQQKLIKERMQVGMGSRPTDHCPFSALSKQKTSLQGSP

SEQ ID NO: 203957 - protein, 119 aa, Glycine max
  Coding DNA Sequence Number=SeqID_87179
  Gene Ontology: Mol. function=sequence-specific DNA binding; Cellular component=nucleus; Biological process=regulation of transcription, DNA-dependent
  Homolog annotation: Hit_ID=Q9LVW2; Match level="QueryCoverage=85%, HitCoverage=30%, E-value=3e-17, Identity=44%"; Hit description =Similarity to heat shock transcription factor
  Pfam annotation: Domain name=HSF_DNA-bind; Domain location=11-117; Score=-89.6; E_value=0.023; Accession=PF00447.8; Description=HSF -type DNA-binding
EKAEKKWLDRSASTMELVKENYDSEEEQVNKHKQMKTSSKQLKKLQEGFRKVDLDRWEFANEGFQGGKKHLLKNIRRRRKCNKLHQGAFNMMKPDVDSEVEKLKKDHNILKVEILKLRQ

SEQ ID NO: 203958 - protein, 136 aa, Glycine max
  Coding DNA Sequence Number=SeqID_87180
  Subcellular localization annotation: CTP_CleavageSite=26; ConfidenceScore=5.23e-01
MAESSKKRKCSTSTTTAIGQRLHDTSSDSPAPPNPSPCSLTLFSSNDQHQSQGISFEGILVDDWKHIYSSHDARKMVCNENANMTGRLLAGSFTFECRIMHYILCRVLFPRTTNLAQASEEDLIMLWDLQTSHQID

SEQ ID NO: 203959 - protein, 37 aa, Glycine max
  Coding DNA Sequence Number=SeqID_87181
MWEKGKAVVVGGSATQSVASKRSSFTVAPGVFSGCIC

SEQ ID NO: 203960 - protein, 142 aa, Glycine max
  Coding DNA Sequence Number=SeqID_87182
  Gene Ontology: Mol. function=nucleoside-triphosphatase activity; Cellular component=chloroplast; Biological process=transport
  Homolog annotation: Hit_ID=Q8LEF6; Match level="QueryCoverage=69%, HitCoverage=31%, E-value=2e-26, Identity=64%"; Hit description=Non -intrinsic ABC protein 14, chloroplast precursor
MVEISGIDVTYQPPGTQLRLLNSVSFSLPEKRYLNDCLISVNCNSFGLIFGQSGSGKTTLLQLLAGISKPTSGSIYIQEYESDGNPSQPPEPLVPERVGIVFQFPERQPQEAAIKLAFQHPFTPKAMGVEHGNAGGPTMDIG

SEQ ID NO: 203961 - protein, 308 aa, Glycine max
  Coding DNA Sequence Number=SeqID_87183
  Gene Ontology: Mol. function=nucleic acid binding; Cellular component= beta-galactosidase complex; Biological process=DNA integration
  Homolog annotation: Hit_ID=Q1SEJ7; Match level="QueryCoverage=99%, HitCoverage=30%, E-value=7e-86, Identity=46%"; Hit description =Integrase, catalytic region; Zinc finger, CCHC-type; Peptidase aspartic, catalytic
MTIVHIVLALAASQSCPLHQLDVKNAFLHGDLKEEAPRVWFEKFRSTLLGFSFTQSLYDHSLFLQRTSKGIVILLVYVDDIVVTGFDQTAIYATHQLLHSTFHMKDLGQLTYFLAGLTNASTVDTPMEVNIKYSRDEGYLLEDPTLYHSISTFQQSITSSDIFLAPPIIFLLVLHSNFEPSDADWVGCPDTRKSTTGWCMFLGDALISWKSKKQDFVSKSSTESKYRAMPVACFEIIWLRGILTEPGFTQAQPTPLHADNTSSIKIASNPVYHEHTKHIEVDCHSIREAYNRKVITLPYVSTSIQLGL

SEQ ID NO: 203962 - protein, 314 aa, Glycine max
  Coding DNA Sequence Number=SeqID_87184
  Homolog annotation: Hit_ID=Q9FMU1; Match level="QueryCoverage=71%, HitCoverage=61%, E-value=1e-24, Identity=36%"; Hit description =Arabidopsis thaliana genomic DNA, chromosome 5, P1 clone:MUA22
SKPSFSSTNQPSFSKPHHQENQTSYSGLVDSREDKSQEETPAIISELFEGFLTIGTLGAETVTNEPGTPTFAMPSENITSRSEEVTGNELKLISYELEKFLETEKEESLYDSSGRNSYVSIITLSEKEIDGPKAEDYRNKAVCPLQGYLLGSSFELPETKEVRKERASLAELLYKTKSTSQDCIDTGIQGETQVKRTPKSAAMHIMRKILKRVHSSSKSCNTSRNDADSASTNKKLQKATNSVSSASAFPSSISQKLDDLNFSLWRQKIEPVIKSYKLQRFVTNPQIPLQLLTEVGRDAGIENPAYEAWEQQDQ

SEQ ID NO: 203963 - protein, 189 aa, Glycine max
  Coding DNA Sequence Number=SeqID_87185
  Gene Ontology: Mol. function=nucleic acid binding; Cellular component= endoplasmic reticulum membrane; Biological process=DNA integration
  Homolog annotation: Hit_ID=Q1T010; Match level="QueryCoverage=97%, HitCoverage=16%, E-value=5e-42, Identity=44%"; Hit description =Peptidase S8 and S53, subtilisin, kexin, sedolisin; Integrase, catalytic region; Zinc ...
  Homolog annotation: Hit description=finger, CCHC-type; Peptidase aspartic, catalytic
MKLIGYHPTGGYKLYDPRNKQVIVSRDVVIDETRGCDWKLEAGSGSTRMIVDTSNPIESEMNTSAPTELRRSTRGELVHYPLMAKAKIIEFEKPVQEPKWINAMKDEIGSIERNQTWELVSLPHDKKPIALKWVYKVKVNPNGEGIKHKARLVAKGFLQKVGIDYGEIYALVARMEIVRLVVAIANLRG

SEQ ID NO: 203964 - protein, 319 aa, Glycine max
  Coding DNA Sequence Number=SeqID_87186
MEELKRVQSAKEHDAFEEAMLQSLIEASLARANDDISDVLDEDILRLMEKAYVVLESMSIEAIIVSLEQRKIIQLTKEPIKLTDLLTILDKRLLRTTKQQEIEWILPSRPPFQTQPSVSIHPNLNTRLYHGFRGYKVLEWKTCNKVWKEKGVVGSHILHSKMQEVELDKLSLLNLWKEDFHGIGPFNYPYNYIREEHLDEEPILYQVNCYKGKELLIEEDEDAPPTRYMKACPKRIFKHELEALMNKTKLTSLDWSTIKRFYILKAHCSSLEPDKKPIADALQLILMLAMAVEVYDPPPSREYVRLIEAELLKTREELP

SEQ ID NO: 203965 - protein, 82 aa, Glycine max
  Coding DNA Sequence Number=SeqID_87187
  Subcellular localization annotation: CTP_CleavageSite=50; ConfidenceScore=5.12e-01
MVVGEITTSFPLKVLKFSRKVVHPTQLKSPLIGKPSSSRLWKFTHHLGMKESTKKAFLASSSMLIHGITSTSLLFGAIVHKD

SEQ ID NO: 203966 - protein, 74 aa, Glycine max
  Coding DNA Sequence Number=SeqID_87188
MTSASSAVPDSLPTKKVKLQTLRRQYELLSMNDVAVEIEESKDLDLMSVEELQNYLEAHEQRINERRNTEKAQE

SEQ ID NO: 203967 - protein, 161 aa, Glycine max
  Coding DNA Sequence Number=SeqID_87189
MDIMLYGGPRPVTDNKKEIISFHKTTNLTYMCRLNHSYLFSMVMPKLWSQDYVSDRDRFYTNKVMVGEKMRAFKDKLNPKVKKNHIHFGMLFTQILRNVGVNVSTMELSVGASHLEGVTFVKLGIVDNFPKYAQKHIKKKVKKEPKEEPHSTVGQTMGTQD

SEQ ID NO: 203968 - protein, 117 aa, Glycine max
  Coding DNA Sequence Number=SeqID_87190
MINTVLSPLFYIDVIETKWEHDDMLHVDHFSGFLHSHPYAFLSSFTMPMLKVVISPEMLSLSTNIAMSFSDSNSLSKAWVPLGVDLVDLVSKDEGENLKKDTSYEEDPSMDDEDPTT

SEQ ID NO: 203969 - protein, 238 aa, Glycine max
  Coding DNA Sequence Number=SeqID_87191
  Gene Ontology: Mol. function=nucleic acid binding; Cellular component= nucleus; Biological process=DNA integration
  Homolog annotation: Hit_ID=Q1T010; Match level="QueryCoverage=100%, HitCoverage=17%, E-value=8e-56, Identity=43%"; Hit description =Peptidase S8 and S53, subtilisin, kexin, sedolisin; Integrase, catalytic region; Zinc ...
  Homolog annotation: Hit description=finger, CCHC-type; Peptidase aspartic, catalytic
MVTISIEAESTSSWYLDTECSTHMSVRRDWLISFDESTKNKIRFVDDSTLKEEEIGKVLIKRKDGKKSFISDVLYVSGMKSNFLSLGKLLEKGFVMNMENNFLKVFDSKRRLVLKAHLSQNRTFKVGNDVMKHKCLANVVCKSEQLWHHRFGHLNFRDLNLLNKHNMVYGFPHMEVPSEVCEECLECKQTKSSFNKQIPTRASDKLGVIYSDVCGPIQFESLGGNRSFVSFIDDLTRK

SEQ ID NO: 203970 - protein, 92 aa, Glycine max
  Coding DNA Sequence Number=SeqID_87192
MAQRKNIYKIPSGAWREKDEYNVRMTMMQCGLTDQWLSYPPGIHIRRTTTIKFMPDRIAPRLPPLDPTKKKGEVPPHNKPMPHQGPKDNVAL

SEQ ID NO: 203971 - protein, 105 aa, Glycine max
  Coding DNA Sequence Number=SeqID_87193
MVYKRRRKLCPINCRLEFRIQFSLNVVGILNKKGNGKTETGNVFGSGVEVYSRWALMLKAIKVNGRWRCFILNFIIYIDSGFSSLLLPKMDCLNSSQASLKLLNN

SEQ ID NO: 203972 - protein, 151 aa, Glycine max
  Coding DNA Sequence Number=SeqID_87194
MEMQKEVDVVEPALTEVTSQPPQIVEDTLATISISNTPREITPLTTFAPTGLSEERIRVPSTGQPRRDHEKKNTLESSLKSFNDFVLFNMNLMVEQRLPPFIQTPPSPPTTIVQPHPEVPTLAITVDLVLVPPHLPPKSPPPIPQPLSTKG

SEQ ID NO: 203973 - protein, 70 aa, Glycine max
  Coding DNA Sequence Number=SeqID_87195
MMMLRLGPKNYVSGKDRFNIYKVMVGEKAFKHRFNPELKKNLIPFGMLFTQIIRNVGVNVFGIAPSAGAF

SEQ ID NO: 203974 - protein, 220 aa, Glycine max
  Coding DNA Sequence Number=SeqID_87196
  Gene Ontology: Mol. function=nucleic acid binding; Cellular component= integral to membrane; Biological process=DNA integration
  Homolog annotation: Hit_ID=Q1SJY4; Match level="QueryCoverage=98%, HitCoverage=49%, E-value=3e-24, Identity=32%"; Hit description=Zinc finger, CCHC-type
  Pfam annotation: Domain name=zf-CCHC; Domain location=203-220; Score =14.9; E_value=0.0034; Accession=PF00098.13; Description=Zinc knuckle
MELNTKAHYTLRCALSNNEYNKICRLKTTKEIWDSLNINYEGTKDVQLRKIVTLTRHYESFPMKEGEHVDDMFRRLQVLLNDLEALRHTFTKARINLKILDSFPKVWEPKTTIQEARNMKNLAWDELPKKTSSRRKEKMSFSKDLKVQMASSNNSYGDSIDDEMTLMSRKFKQMMKKKGKFQHSSKRKDTRFKKKYKEESNEIIYFECRKPRHMKAECPS

SEQ ID NO: 203975 - protein, 50 aa, Glycine max
  Coding DNA Sequence Number=SeqID_87197
  Homolog annotation: Hit_ID=A0DY41; Match level="QueryCoverage=70%, HitCoverage=9%, E-value=7e-07, Identity=61%"; Hit description =Chromosome undetermined scaffold_7, whole genome shotgun sequence
YPSYCRSNIWPRNALPELEVAFKALGKLIFDIGLMLAYHCDQYGKTAIDI

SEQ ID NO: 203976 - protein, 86 aa, Glycine max
  Coding DNA Sequence Number=SeqID_87198
MRILVMGQGSKQLKVVSQHGCRFRVKLPYYFHEARVTLMIWEQHEKLVMATARWVLKHPVYGIDDVPKGKLYKVLEFQQTLSTITK

SEQ ID NO: 203977 - protein, 120 aa, Glycine max
  Coding DNA Sequence Number=SeqID_87199
MTSRDQVWSFCTHDTRRYLMVIRTPLPFRHSRVRWHAETKFGHSAPMIRGDTLRQTQLCPMARRDQVWSFCTHDTRRYLTVICTPLLGRHSCVRWHAETKFGHSAPMIRGDTLRLSAPLC

SEQ ID NO: 203978 - protein, 174 aa, Glycine max
  Coding DNA Sequence Number=SeqID_87200
  Gene Ontology: Mol. function=sequence-specific DNA binding
  Homolog annotation: Hit_ID=Q1XPD5; Match level="QueryCoverage=99%, HitCoverage=67%, E-value=9e-53, Identity=55%"; Hit description=Helix- turn-helix motif
  Pfam annotation: Domain name=HTH_3; Domain location=8-62; Score=52.0; E_value=2e-12; Accession=PF01381.12; Description=Helix-turn-helix
MSILAENIRYLRDQLKLSQQSVADNLSITRGRYAKYEDGASQPPIELLIKMSRYYRVSIDLMVTIDLKKYPLNDIINLPDNRIVLPVVVDQSGNNSIEIIPQKASMGYLSGYTDPGYIESLQNISLPFLTNGKYRAFPVEGDSMPPFKDGSYIVGKYIEKTEDLKPDKTYIFVT

SEQ ID NO: 203979 - protein, 87 aa, Glycine max
  Coding DNA Sequence Number=SeqID_87201
  Gene Ontology: Mol. function=DNA-directed DNA polymerase activity; Cellular component=intracellular; Biological process=DNA repair
  Homolog annotation: Hit_ID=Q1XRU3; Match level="QueryCoverage=100%, HitCoverage=22%, E-value=3e-34, Identity=78%"; Hit description=DNA -directed DNA polymerase
MDLDTFFVSCERLNNSELNGIPLIIGGGDRGVVASCSYEARKFGVRSAMPIRMALKLCPDAKVIRGDHEMYSNLSHLVTEVIQRGVP

SEQ ID NO: 203980 - protein, 102 aa, Glycine max
  Coding DNA Sequence Number=SeqID_87202
  Homolog annotation: Hit_ID=Q1RZK3; Match level="QueryCoverage=72%, HitCoverage=5%, E-value=2e-25, Identity=69%"; Hit description=WD40 -like
MFFGVFHRIWNHEKATLLNSFDNHDFPNKEISKLCLVNELDDSLLLAASSDGNIRIWKDYTLKGKQKLATPFSSIHGHKAGVVALCLFLGMWDISLNPNVLK

SEQ ID NO: 203981 - protein, 239 aa, Glycine max
  Coding DNA Sequence Number=SeqID_87203
MVAFFFFLKEFVTIGETLSSPDNLLLGENKALCKLGDGLGLGLGIGDLLWLFFKGENEAALEVEPPLVNQRVGVLPSEGEVEAVDVDELVELEIVGKKDVGGLEVRAGEGGDNVDVLVGEWVLQELDQLMQHLKVEFNLQHPQQQLTPRSLYKLIKFDGATCKEELPKREAETTNPDSKTCFFHTIMYCCIGEGGFAGGGGTAGGRTTDSASRATRALTFLGPGKMMEGSAGFQQFFWI

SEQ ID NO: 203982 - protein, 58 aa, Glycine max
  Coding DNA Sequence Number=SeqID_87204
MGGYERKVEGLSLWGRRDRVREGLGCCTKRKWKFRERGRKGQLINMRGEKPLKIQKVI

SEQ ID NO: 203983 - protein, 54 aa, Glycine max
  Coding DNA Sequence Number=SeqID_87205
MAVTNPSDDDGEEETTVTSLREREHSARTNMLAAEKELILRSYFTQCQSYIRYF

SEQ ID NO: 203984 - protein, 99 aa, Glycine max
  Coding DNA Sequence Number=SeqID_87206
MKVWNQYFIAPAVIKDACYIIFLHNKESQMATLSLLGVDSVLTTLFVAASSSKWKGISFNGGQTGTRRYLIPISTTRLKTPMLTLTQYNDGHKYPPTLT

SEQ ID NO: 203985 - protein, 139 aa, Glycine max
  Coding DNA Sequence Number=SeqID_87207
  Gene Ontology: Mol. function=nucleic acid binding
  Homolog annotation: Hit_ID=Q1SKA8; Match level="QueryCoverage=78%, HitCoverage=43%, E-value=3e-09, Identity=32%"; Hit description=Zinc finger, CCHC-type
  Pfam annotation: Domain name=zf-CCHC; Domain location=95-112; Score =21.4; E_value=0.00029; Accession=PF00098.13; Description=Zinc knuckle
MSLATLFGKLQEHEMELIRLHQHEENNKKNKGIELRASSSFIQEESDKEDLNEIEEDDDFRFFVKRFNKFLRNKGNQRRSNINPKKKGEDSSLAPKCYECDQPGHLRFDCLVFKRRMEKSDKRNFKEKKRKERIHHLGR

SEQ ID NO: 203986 - protein, 36 aa, Glycine max
  Coding DNA Sequence Number=SeqID_87208
MPKTCSLPASAPDRASSIKRCVNQLLKGKNRVRNDA

SEQ ID NO: 203987 - protein, 169 aa, Glycine max
  Coding DNA Sequence Number=SeqID_87209
MSNTRGSPLRIIQANSMLQFFTSIARPEGNLFQGLPNEDPASFGKCCFHPLAKPICLLSERLLSARKNPEEDKLYRLAKRTASVHPPSEKGALSQKSLTCAKRSIQAHEHKQGHLFKPEIRFCEESLDWDLELCMSRVSRERKLQVPESFERFCCVKICKDQSLKQEPV

SEQ ID NO: 203988 - protein, 211 aa, Glycine max
  Coding DNA Sequence Number=SeqID_87210
  Homolog annotation: Hit_ID=O65154; Match level="QueryCoverage=25%, HitCoverage=48%, E-value=6e-08, Identity=52%"; Hit description=RNA polymerase II transcriptional coactivator KIWI
  Pfam annotation: Domain name=PC4; Domain location=115-208; Score =13.7; E_value=4.4e-05; Accession=PF02229.6; Description =Transcriptional Coactivator p15 (PC4)
MSGKAKRRDDDGASDTDSNSEGHVSPKKSLKKDYDDDPDSITICEVVRCPASVPGRASSIKTDISLLSSAPVFYVEVLTTKPRYLPSIVRKLIFTSLKKRRREIEKVKSGGDVSSTSKNLTISQKLLQSSSRCLFWSAQSPLSQHTQNSLPILCFQISNNKRVSVRKWKGNIMVDIHEFYIKDGKQLAGRKGIVRVLGQTFSMLLYCLILM

SEQ ID NO: 203989 - protein, 77 aa, Glycine max
  Coding DNA Sequence Number=SeqID_87211
MEKISKVQEREQQSEGYVQSVEWSTPLPRSVKCDVDAAFFENVMEMDIGICVGCVVASSSSKGCTAALHGHARRWWQ

SEQ ID NO: 203990 - protein, 113 aa, Glycine max
  Coding DNA Sequence Number=SeqID_87212
MRLHCYQASRRPNMTTDRPPLLMALIDPGIGTNISTCGQSPSGVTISRNLTFDGRARRKEKGSTRGCPCSYVSSGKWALGAKAARPGELKLSAEAMSSPRRAGARPGELVSSP

SEQ ID NO: 203991 - protein, 178 aa, Glycine max
  Coding DNA Sequence Number=SeqID_87213
  Gene Ontology: Mol. function=oxidoreductase activity, acting on NADH or NADPH; Cellular component=chloroplast; Biological process =electron transport
  Homolog annotation: Hit_ID=Q06FP8; Match level="QueryCoverage=70%, HitCoverage=32%, E-value=3e-61, Identity=86%"; Hit description=NADH -plastoquinone oxidoreductase subunit 7
  Pfam annotation: Domain name=Complex1_49kDa; Domain location=1-157; Score=39.8; E_value=2e-15; Accession=PF00346.9; Description =Respiratory-chain NADH dehydrogenase,
MLRASGIQWDLRKVDNYECYEEFDWEVQWQKEGDSLARYLVRIGEMMESIKIIQQALEGIPGGPYENLEIRCFYREKEPEWNEFEYRFISKKPSPTFELPKQELYVRIEAPKGELGIFLIGDQNGFSLEMENSSARDIWNYMGICPYFDSYIGNYDKCTSNCMVRKGNIRRDTTTYWT

SEQ ID NO: 203992 - protein, 121 aa, Glycine max
  Coding DNA Sequence Number=SeqID_87214
MEREARERVIESLHGEAMKWMDRFVLTLNGSQKLPRLLAGAKAMVDVYSAPEEVHGLFDYFVVKVNKITKKNEHALRHPYQTRAKTKIMCEIEEVQEKMKADMEAMKDQMTSMMEAMLSMR

SEQ ID NO: 203993 - protein, 282 aa, Glycine max
  Coding DNA Sequence Number=SeqID_87215
  Homolog annotation: Hit_ID=Q47522; Match level="QueryCoverage=20%, HitCoverage=77%, E-value=5e-19, Identity=74%"; Hit description=LacZ protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPEFDASETIRVFCLVETIKVICLSLKTSMSFDQDYYNLLFLPEIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 203994 - protein, 156 aa, Glycine max
  Coding DNA Sequence Number=SeqID_87216
  Homolog annotation: Hit_ID=Q1SMF0; Match level="QueryCoverage=71%, HitCoverage=20%, E-value=5e-13, Identity=35%"; Hit description =Tetratricopeptide-like helical
MDEDQWMYNSIMSQKVDMNEQNEDEAGVNEEHVDCSNAFNTSQVFATRDDILHWARCVAYEIGFVTMIMRSDTNTGTRGRTSFILIGRERSGQYRSRKNDFVRRDTDTRKCGCPFKLRGKSIVGGQGWMMKLMCGSDNHEMAKSLVGHLCRSKASW

SEQ ID NO: 203995 - protein, 232 aa, Glycine max
  Coding DNA Sequence Number=SeqID_87217
  Pfam annotation: Domain name=Transposase_23; Domain location=37-107; Score=-3.9; E_value=0.0031; Accession=PF03017.5; Description =TNP1ENSPM transposase
MQSQGLAVPPEPLVGPSGPRVSTKGSCVDPSGNDPETGDSDRCGLYIEVDHACLVAMGRVYEGSTIVHNTPLLPSQVKVSLEEVTDADASVPVPTDEISLEGQTLHTFLAWPTHLLKSLSQQVAASPAKPPPKPDPEIDDPLYLMTLTIPELFLRPYQISPLYIKHEDLSENRTRWSNVSAYQCYSCGFCISLKHVCEWGILISMDSSSHSPFRGSTTADTGRWSSSCPRNT

SEQ ID NO: 203996 - protein, 113 aa, Glycine max
  Coding DNA Sequence Number=SeqID_87218
MCTVRGLSIERCIVSLELDRAGLGYLRGPTAFRYLFSHLLAHCRNLPFDGRATRGSQVRLPRKENARSRHQRLFEENVGKTGKERNVKALDHERSLGVVDKSGAFAPMYPQLR

SEQ ID NO: 203997 - protein, 304 aa, Glycine max
  Coding DNA Sequence Number=SeqID_87219
  Homolog annotation: Hit_ID=Q70KF5; Match level="QueryCoverage=22%, HitCoverage=11%, E-value=3e-29, Identity=92%"; Hit description =Arginine decarboxylase
MVKVGTSYVPINVSFRQKLAQGFPVLQWLLFLSAVPPVQLLTGWCVTAKAPPDISAGKCSGRVPFAIQAAQLLGRAIGAGLFAITPAGERGMCCKAIKLGNARVFPVTTLNSMHSGHFGGTSGEKGKFGLTTAQILRVVKKLAHAGMLDCLQLLHFHIGSQIPSTALLADGVGEAAQISSLSIPSTSRGGPVPAFVPFSEVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 203998 - protein, 61 aa, Glycine max
  Coding DNA Sequence Number=SeqID_87220
MGGELSKRGCLRKLLEKATCSSWRADLAWASWAVFQVKKNCFHQKIVSKLRYFHNASETFP

SEQ ID NO: 203999 - protein, 68 aa, Glycine max
  Coding DNA Sequence Number=SeqID_87221
MKTQFMGLRKMVENGELHKAITTHGSKLEVGGHMNDNAIHGASKKGSRIENCTKQSLRMAPNSKVEYT

SEQ ID NO: 204000 - protein, 129 aa, Glycine max
  Coding DNA Sequence Number=SeqID_87222
FCLANLPGDAFSLWGNFFEAKKQMMADAKFAGLLGLGKPLVEILPPGQLRGFCPLLAWLGSAVLGFVGDLEGRDESKRQRAESQWIVAARPLCHLQYPVAYLSRLQRILPAARWELRFKASRRANPPHE

SEQ ID NO: 204001 - protein, 118 aa, Glycine max
  Coding DNA Sequence Number=SeqID_87223
RNAAQKHKPKRVESVNADAEAFVEALEHTKTRDTGHQSVSLENKTGDSTVLKIGDSAKVVIKQDMKGRKHKYGFNNNKREKTEKKRVVDDETGDKHKLYEVLRIPCKTKNRCLTQRKM

SEQ ID NO: 204002 - protein, 76 aa, Glycine max
  Coding DNA Sequence Number=SeqID_87224
MAGMINKPHDVRFPELLDPSGLDAEALEAEILDLAESVRGTILQMTNEYFVSQAMADYPQAPRSNLAVQIANQPDI

SEQ ID NO: 204003 - protein, 214 aa, Glycine max
  Coding DNA Sequence Number=SeqID_87225
  Gene Ontology: Mol. function=signal transducer activity; Cellular component=membrane; Biological process=signal transduction
  Homolog annotation: Hit_ID=Q39IN5; Match level="QueryCoverage=88%, HitCoverage=37%, E-value=3e-28, Identity=37%"; Hit description =Methyl-accepting chemotaxis sensory transducer
MALLFTLAAGFFGLWSAHRSLGVFHGDVQRHMAAERLAAEVEGHFKTQVQEWKNVLLRGSDNALREQHWKGFLADERAVQDKTAALLALVDDASLREIAQGFVAQHRKMAEGYRVGLDKFEATGFDPSVGDMAVRGVDREPAEMLSQLKAGIAAQSKAVADDAYSSGKHATELSLVLMLVAAVAGVAIGWLITRAVVAPLRSAVQLAEKGPRAI

SEQ ID NO: 204004 - protein, 88 aa, Glycine max
  Coding DNA Sequence Number=SeqID_87226
MQEGLWIRQHLNKYRVVTNVSSKCSFRSEMLNIPCSLNDLSFNKNIFCKKDKNNLTKHFVHKELRRSDFLIAIKEYVGARETPSSTAK

SEQ ID NO: 204005 - protein, 68 aa, Glycine max
  Coding DNA Sequence Number=SeqID_87227
MNYFTEEAVFRSCNVNYGRQLLPWSLAEDVFREIPRKKHSSVVVMSTSEDCLFRGVSRKMSFARLHGT

SEQ ID NO: 204006 - protein, 175 aa, Glycine max
  Coding DNA Sequence Number=SeqID_87228
  Gene Ontology: Mol. function=nucleic acid binding; Cellular component= nucleus; Biological process=chromatin modification
  Homolog annotation: Hit_ID=Q7G8Y3; Match level="QueryCoverage=93%, HitCoverage=15%, E-value=5e-76, Identity=82%"; Hit description =Probable chromatin remodelling complex ATPase chain
  Pfam annotation: Domain name=SLIDE; Domain location=7-120; Score =236.8; E_value=4.5e-68; Accession=PF09111.1; Description=SLIDE
MGSVEYYDRIIKNIERGEARISRKDEIMKAIGKKLDRYKNPWLELKIQYGQNKGKLYNEECDRFMICMIHKLGYGNWDELKAAFRMSPLFRFDWFVKSRTTQEITRRCDTLIRLVEKENQEYDERERQARKEKKLAAKSMTPSKRSMPRQTESPSLKKRKQLTMDDYLSSVYILQ

SEQ ID NO: 204007 - protein, 251 aa, Glycine max
  Coding DNA Sequence Number=SeqID_87229
  Homolog annotation: Hit_ID=Q41296; Match level="QueryCoverage=80%, HitCoverage=86%, E-value=6e-07, Identity=24%"; Hit description =Glutamic acid-rich protein
MGCGKSKHDVASGNTVLQRKKSTVNSKDNETQNVEKNNDANVDNVRFEVEEKNKENVKEIEVEGKGDYESNDVAGNITKVQQEDKALETSAQAEAEENKAPEIVVAEGPNEESERGKDESLLGKNEQEKVKDVAVAEEKQPTEEKKDLENEKVDLSVKEETLPLMKEEESKDTNEEALVKEEENKNTNEEALVKEESKDTNEEALVKEEESKDTKEETLEKEEETKETTEQGKTLVKEGETKDANVSTSTS

SEQ ID NO: 204008 - protein, 407 aa, Glycine max
  Coding DNA Sequence Number=SeqID_87230
  Homolog annotation: Hit_ID=Q9LVG0; Match level="QueryCoverage=75%, HitCoverage=78%, E-value=1e-107, Identity=60%"; Hit description =Adenylyl cyclase
  Subcellular localization annotation: CTP_CleavageSite=50; ConfidenceScore=5.26e-01
MQVFSNARQASRLLLSPHLRSSEAPHSTALSLFSGLTQRDSRPVNTDPIQCFLSKAFYSSGVGTVEATPSEDVKELYDKMLDSVKVKRSMPPNAWLWSMIANCKHQPDIRLLFDILQNLRRFRLSNLRIHDNFNCNLCREVAKACVHAGALDFGMKALWKHNVYGLTPNIASAHHLLTNAKNHNDTKLLVEVMKLLKKNDLPLQPGTADIVFSICYNTDDWELINKYAKRFVMAGVKLRQTSLETWMEFAAKRGDIHSLWKIEKLRSNSMKQHTLITGFSCVKGLLLERKPSDAVAVIQVLNQTLSDTKKSGIKGELQKLVSEWPLEVIKHQKEEDRKALAASLKSDILVMVSELLSMGLEANWLRFWLHSSGISVDYVGTKIIWHMSSTLNCKKLLSQVRDTIMAF

SEQ ID NO: 204009 - protein, 331 aa, Glycine max
  Coding DNA Sequence Number=SeqID_87231
  Gene Ontology: Mol. function=metal ion binding; Cellular component =cytoplasm; Biological process=ubiquitin cycle
  Homolog annotation: Hit_ID=Q2QP88; Match level="QueryCoverage=84%, HitCoverage=82%, E-value=3e-91, Identity=62%"; Hit description=CHY zinc finger family protein, expressed
  Pfam annotation: Domain name=zf-C3HC4; Domain location=188-230; Score= 40.4; E_value=6e-09; Accession=PF00097.15; Description=Zinc finger, C3HC4 type (RING finger)
  Pfam annotation: Domain name=zf-CHY; Domain location=62-135; Score =21.4; E_value=6.4e-06; Accession=PF05495.3; Description=CHY zinc finger
  Pfam module annotation: Pfam domain module=zf-C3HC4::zf-CHY; Domain location=188-230::62-135
MIGLNPIGRSYGNILFSPAQVTAPYLIPSGAIITGEDAGFVLPAATRSTHAVTVITTLRLLKNPFDRHELVRQDVKQVVCSVCDTEQPRGGLDKLLILFLGFSHSLLFLLKVAQVCTNCGVKMGEYFCNICKFFDDDVEKEQFHCDDCGICRVGGRDNFFHCKKCGSCYAIGLRDNHLCVENSMRHHCPICYEYLFDSLKDTIVMKCGHTMHHECYVEMIKNDKYCCPICSKSVIDMSKTWKRIDEEIEATVMPEDYRNRKNPLAHINYTCIYQYNEASSYQKTPLQKFTSTFLAKNVVTADHIILVQLRLQFFPNDQILGFKKGKLSAEN

SEQ ID NO: 204010 - protein, 789 aa, Glycine max
  Coding DNA Sequence Number=SeqID_87232
  Gene Ontology: Mol. function=nucleic acid binding; Cellular component= nucleus; Biological process=chromatin modification
  Homolog annotation: Hit_ID=Q7G8Y3; Match level="QueryCoverage=87%, HitCoverage=67%, E-value=0.0, Identity=79%"; Hit description =Probable chromatin remodelling complex ATPase chain
  Pfam annotation: Domain name=HAND; Domain location=692-774; Score= -11.0; E_value=4.1e-05; Accession=PF09110.1; Description=HAND
  Pfam annotation: Domain name=Helicase_C; Domain location=467-546; Score=101.5; E_value=2.5e-27; Accession=PF00271.21; Description =Helicase conserved C-terminal domain
  Pfam annotation: Domain name=SNF2_N; Domain location=186-412; Score =275.6; E_value=1e-79; Accession=PF00176.13; Description=SNF2 family N-terminal domain
  Pfam module annotation: Pfam domain module=HAND::Helicase_C::SNF2_N; Domain location=692-774::467-546::186-412
MGRPSKTQVSNDFSSEEEEEDASAAASHQIVDDEEELEAVARSASSDDDDNSPDEAAEDDDEDKQDESNVDPEVSKREKARLREMQQLKKQKVQEILDAQNATIDADMNNRGKGRLNYLLQQTELFAHFAKGDQSSQKKAKGRGRHASKVTEEEEDEEYLKGEEDGLANTRLVTQPSCIQGKMRDYQLAGLNWLIRLYENGINGILADEMGLGKTLQTISLLGYLHEFRGITGPHMVVAPKSTLGNWMNEIRRFCPVLRAIKFLGNPDERKHIREELLVAGKFDVCVTSFEMNNLHELWALLNFLLPEIFSSAETFDEWFQISGENDEHEVVQQLHKVLRPFLLRRLKSDVEKGLPPKKETILKVGMSQMQKQYYKALLQKDLEVVNAGGERKRLLNIAMQLRKCCNHPYLFQGAEPGPPFTTGDHLITNAGKMVLLDKLLPKLKERDSRVLIFSQMTRLLDILEDYLMFRGYQYCRIDGNTGGDDRDASIEAFNKPGSEKFVFLLSTRAGGLGINLATADVVILYDSDWNPQVDLQAQDRAHRIGQKKEVQVFRFCTEYTIEEKVIERAYKKLALDALVIQQGRLAEQKTVNKDELLQMVRFGAEMVFSSKDSTITDEDIDRIIAKGEEATAELDAKMKKFTEDAIKFKMDDTAELYDFDDEKDENKFDFKKIVSENWVEPPRRERKRNYSESEYFKQTMRQGGPTKPKEPRIPRMPQLHDFQFFNTHRLSELYEKEVRYLMQAHQKNQVKDSIDVDEPEDRRVKKGICLEEYWGVKVAKNAYSNWLV

SEQ ID NO: 204011 - protein, 58 aa, Glycine max
  Coding DNA Sequence Number=SeqID_87233
  Subcellular localization annotation: CTP_CleavageSite=47; ConfidenceScore=5.24e-01
MTTTTMMSTPTTTEAITRRVLSTQSDTLNTRRFGGVQQRAPQSSHLLASYIVTFSNDC

SEQ ID NO: 204012 - protein, 47 aa, Glycine max
  Coding DNA Sequence Number=SeqID_87234
  Gene Ontology: Cellular component=intracellular; Biological process =signal transduction
  Homolog annotation: Hit_ID=Q9FMR1; Match level="QueryCoverage=87%, HitCoverage=9%, E-value=4e-11, Identity=73%"; Hit description=Rac GTPase activating protein
  Pfam annotation: Domain name=PBD; Domain location=2-45; Score=38.7; E_ value=2e-08; Accession=PF00786.18; Description=P21-Rho-binding domain
MEIGLPSNFRHVSHVAFDRFNGFLGLPMEFKAEAPKRALSASYYSSH

SEQ ID NO: 204013 - protein, 80 aa, Glycine max
  Coding DNA Sequence Number=SeqID_87235
MVVGLVVVDLVVVEVLLSKHVVTVQNGWVEANYLVMESCRWTHSLYETIQSDSMRCRHHDIMPVQLSHQLFVAKQAPPVP

SEQ ID NO: 204014 - protein, 143 aa, Glycine max
  Coding DNA Sequence Number=SeqID_87236
  Gene Ontology: Mol. function=nucleic acid binding; Cellular component= signal recognition particle, endoplasmic reticulum targeting; Biological process=SRP-dependent cotranslational protein targeting to membrane
MEKMREEEGMRGIGREEIIKDMEVDLHNKLQRLIQGNKSVDEYYKGIEISLIRAQIEEYQEATMARFLHGLNKEDKETFKKKGGSSFKSHEKDAALSKNNLNPTLTSSKTSLLNVLSAWESIILPPNVLTKGLWLCRGMRMGN

SEQ ID NO: 204015 - protein, 105 aa, Glycine max
  Coding DNA Sequence Number=SeqID_87237
ILSKGRSTKEKAFRFKESNSNTMRALLPSTTDIYPSQPKDFYDSISNFSFILFKRNYLLGKVEVILSSSKPLNFLGFGLACHIRVEANLPTIVIGKNVSIDSITY

SEQ ID NO: 204016 - protein, 110 aa, Glycine max
  Coding DNA Sequence Number=SeqID_87238
MAKIHHQAWPTKTYHPMKHTPHTYSQNNSKAPKFLKGRGNIGSKGLSKELIQGRLIWLEAYKNKMPKSSPNMHVKQEVSTRVKPRLLCKQSMGQNTPNKIDDDGSNSHQG

SEQ ID NO: 204017 - protein, 165 aa, Glycine max
  Coding DNA Sequence Number=SeqID_87239
  Gene Ontology: Mol. function=RNA binding; Cellular component=nucleus; Biological process=mRNA processing
  Homolog annotation: Hit_ID=Q69VQ7; Match level="QueryCoverage=92%, HitCoverage=47%, E-value=8e-61, Identity=69%"; Hit description =Putative THO complex 3
  Pfam annotation: Domain name=WD40; Domain location=23-61; Score=42.9; E_value=1.1e-09; Accession=PF00400.22; Description=WD domain, G-beta repeat
  Pfam annotation: Domain name=WD40; Domain location=65-103; Score=8.0; E_value=4.3; Accession=PF00400.22; Description=WD domain, G-beta repeat
  Pfam module annotation: Pfam domain module=WD40::WD40; Domain location=23-61::65-103
MTGEMFFLTTGNGTVEVLSYPSLRPLDTLMAHTAGCYCIAIDPVGRYFAVGSADSLVSLWDISEMLCVRTFTKLEWPVRTIGFNYTGDFIASASEDLFIDISNVHTGRTVHQIPCRAAMNSVEWNPKYNLLAYAGDDKNKHQADEEAPFLLVFENANKEPDEVDL

SEQ ID NO: 204018 - protein, 262 aa, Glycine max
  Coding DNA Sequence Number=SeqID_87240
MGETKDTHIVEIPVDQEHHNNHHKNVLCSMTSNMIEAIEDHPLTEISESPGHLLLLKLWQREEELFAKRIAHKETRMDTIKAELFQLSSFFFIFHAFFLTLLFTSWAKAQQQAQPHHSVCHKWWLPSMVSLCTSLVFVVLVQVKVHRYWKVWGHLQRERNDGRAVTRCIQELRMKGASFDLSKEPNSSSSVKRMKSSSVEIKWRPLTWCSKNLLTFSLVCFTALLGAWTLMALAEGLVVVNFIPDPTIPTVLGEFVELKILG

SEQ ID NO: 204019 - protein, 76 aa, Glycine max
  Coding DNA Sequence Number=SeqID_87241
MASGNRLPRVSMFRSCVTRVWALIAMAAQLIHDHVEMECLEGVWETFEVNERCRFRGSLSRTSAARICAKLLKGCA

SEQ ID NO: 204020 - protein, 88 aa, Glycine max
  Coding DNA Sequence Number=SeqID_87242
MEEASQFGSIEAVIDLPSPIRWHVKWKMAHTKNTGQMTSESAKEIVEKIDSLEEQASQGFFVPHGRQDVLTAAIGRPEHHGRVRAIGA

SEQ ID NO: 204021 - protein, 63 aa, Glycine max
  Coding DNA Sequence Number=SeqID_87243
MADTTSPEQAAYPSMPKDQTTPAQSPNASLVSTHKDLYNSEHDEGHELYRHQLFDFDHLAYLE

SEQ ID NO: 204022 - protein, 271 aa, Glycine max
  Coding DNA Sequence Number=SeqID_87244
  Gene Ontology: Mol. function=chitin binding; Cellular component =extracellular region; Biological process=chitin metabolic process
  Homolog annotation: Hit_ID=UPI00006A17C9; Match level="QueryCoverage =99%, HitCoverage=100%, E-value=8e-31, Identity=29%"; Hit description= UPI00006A17C9 related cluster
GLHNLALRGLHVLAFRGVHILPLRGLHALTFKRVHVLTFRGLYVVAIRGLHVLAFRRLHVLPFRGLHAHNFRGLHVLAFRGLHVLPFRGQHDLPFRGMQALALTGLHVLTFRGLHNLAFRGLDALAFRGVHILPLRGLYALAFVGLDTLTFKGVHVLNIRGLYIVAIRGLQVLAFRGLHVLHFRGLHAHTFKGYLHRTTRPWLRKASLPHLQRTTHARLQRTTSLCLRRATRPHLQRTTHPRFLSDTRPRLQRTTRLTFQGAARPCLQGAT

SEQ ID NO: 204023 - protein, 96 aa, Glycine max
  Coding DNA Sequence Number=SeqID_87245
MFLSKLSPSSLTPPSFDLLHGHLIKIIIQLWVGNASGTGVVASRKGEMGGDSESNSNQVSMGSMKLRVCKEEGAWDLARWGGSRGVQIKGILERKS

SEQ ID NO: 204024 - protein, 71 aa, Glycine max
  Coding DNA Sequence Number=SeqID_87246
  Gene Ontology: Mol. function=GTPase activator activity; Cellular component=nucleus; Biological process=intracellular transport
  Homolog annotation: Hit_ID=Q9LMK7; Match level="QueryCoverage=68%, HitCoverage=21%, E-value=5e-20, Identity=91%"; Hit description=Ran -binding protein 1 homolog a
MIGADLERLGLPHEKPNLARSLMLQELHGARASLLPLVPILVEPVKLRFAAIREEQASTAPISGKTVKSRS

SEQ ID NO: 204025 - protein, 549 aa, Glycine max
  Coding DNA Sequence Number=SeqID_87247
  Gene Ontology: Mol. function=sodium:hydrogen antiporter activity; Cellular component=integral to membrane; Biological process=sodium ion transport
  Homolog annotation: Hit_ID=Q4VT46; Match level="QueryCoverage=96%, HitCoverage=97%, E-value=0.0, Identity=69%"; Hit description=Nhx1 antiporter
  Pfam annotation: Domain name=MFS_1; Domain location=163-455; Score= -51.8; E_value=0.074; Accession=PF07690.6; Description=Major Facilitator Superfamily
  Pfam annotation: Domain name=Na_H_Exchanger; Domain location=32-460; Score=135.4; E_value=1.6e-37; Accession=PF00999.11; Description =Sodiumhydrogen exchanger family
  Pfam module annotation: Pfam domain module=MFS_1::Na_H_Exchanger; Domain location=163-455::32-460
MAVGVGALYLYDKLTTLMMTSDHASVVSMNLFVALLCACIIIGHLLEENRWINESITALLIASHFLYLYYLPFHQQHEFEAASIFSLSGSLYWGLYIVYHGRKKLSYISFQFQVKKKQFFRNFMTIMLFGAVGTLISFCIISLGAIHFFQKLDIDSLKIGDFLAIGAIFSATDSVCTLQVLNQDETPLLYSLVFGEGVVNDATSIVLFKAIQNFDLSHIDLTTALQLLGNFLYLFIASTVLGIFVGLLSAFIIKKLYFGKLIRHSTDREVALMVLMAYLSYMLSELFSLSAILTVFFCGIVMSHYTWHNVTESSRVTTKHVFATLSFIAEIFIFLYVGMDALDIEKWRIVSQSPRKSIGVSSLLLALILVGRAAFVFPLSFLSNLLKNSQSEKIELKQQVTIWWAGLMRGAVSIALAYNQFTRLGHTKLRENAIMITSTITVVLFSTLAFGLMTKPLVRLLLPSSKHVMSLPSPPSTPKSFTVPLLGSQNGPPPSTLRMLLSCIPTRGVHHYWRKFDDSVMRPVFGGRGFVPYVPGSPLEQSVHQWRCT

SEQ ID NO: 204026 - protein, 166 aa, Glycine max
  Coding DNA Sequence Number=SeqID_87248
  Gene Ontology: Cellular component=nucleus; Biological process =intracellular transport
  Homolog annotation: Hit_ID=Q8RWG8; Match level="QueryCoverage=99%, HitCoverage=50%, E-value=5e-16, Identity=35%"; Hit description=Ran -binding protein 1 homolog b
MSVQEHAGNEKSCVWHARDFADGELKDELFCIRFPSIERFEVCIHSFGSWEILARGPCLSNCIVNLSLLARFHRKRITDIEVDFEEDCKSFMETFQEVAESQKAEDEKESADAAGLIEKLSVEEKADAEKKDEEKSEDKTVEKESASGKESKAVEDKKAEEPASSA

SEQ ID NO: 204027 - protein, 479 aa, Glycine max
  Coding DNA Sequence Number=SeqID_87249
  Gene Ontology: Mol. function=RNA binding; Cellular component =ribosome; Biological process=translation
  Homolog annotation: Hit_ID=Q5ZC75; Match level="QueryCoverage=48%, HitCoverage=52%, E-value=8e-69, Identity=60%"; Hit description=30S ribosomal protein S1-like
  Pfam annotation: Domain name=S1; Domain location=300-372; Score=21.8; E_value=0.0017; Accession=PF00575.13; Description=S1 RNA binding domain
  Subcellular localization annotation: CTP_CleavageSite=53; ConfidenceScore=5.43e-01
MPFTLHPSKFLCSPNCTIIPVKDTTLFTNTINKPHKNPTKFRSFAKVVLSTPRASIVSKKDSILGYTHFTLRSRSDGDGFSTDVSQDDGTSQELEQLELLNKPSPVLVTEGSSSEVEVEEEKPSQEEALAPFLKFFKGKDSGEDVEEDGEGLEVAEEKSDVGGENEEGDKKVSVEYYESKPGDFVVGVVVSGNENKLDVNVGADLLGTMLTKEVLPLYGKEMENLLCDVEKDAEDFMVRGKMGIVKNEEAISGVPVPGRPVVEIGTILFAEVLGRTLSGRPLLSTRRLFRRIAWHRVRQIKQLNEPIEVRITEWNTGGLLTRIEGLRAFLPKAELVKRANSFTELKENVGRCMYVQITQIDETKNNLILSEKEAWQKLYLREGTLLDGTVKKILPYGAQIKLGKTNRSPNDVIEKILLSIVGQSAEAVGCKNESVGECSALKGRTRASSVGQSGSENVGFSNANVCENPMPRIPKGSSA

SEQ ID NO: 204028 - protein, 175 aa, Glycine max
  Coding DNA Sequence Number=SeqID_87250
  Homolog annotation: Hit_ID=Q588B7; Match level="QueryCoverage=17%, HitCoverage=5%, E-value=1e-09, Identity=93%"; Hit description =Vacuolar Na+/H+ antiporter
MLLMKRQVIEIKKVTRDEKGSDGFIDPSVLLQQMTDDDASTEKSNKKSSSSCSLTSPLSLSWFLQVQRVYVAACHHYTIEVAHIASPSTSVSASLSRHRVTPTSDHPCTTPSRSPTWSYLLPLPKLVFPIIVVVLSCHTNVELSLHDVVEVALTLTSTKHHQSPSPSTSPFSNKV

SEQ ID NO: 204029 - protein, 359 aa, Glycine max
  Coding DNA Sequence Number=SeqID_87251
  Gene Ontology: Mol. function=protein binding; Cellular component =cytoplasm; Biological process=abscisic acid mediated signaling
  Homolog annotation: Hit_ID=O82257; Match level="QueryCoverage=99%, HitCoverage=88%, E-value=1e-130, Identity=64%"; Hit description =Putative tubby protein
  Pfam annotation: Domain name=F-box; Domain location=4-59; Score=18.5; E_value=0.024; Accession=PF00646.23; Description=F-box domain
  Pfam annotation: Domain name=Tub; Domain location=70-359; Score =539.4; E_value=3.8e-159; Accession=PF01167.8; Description=Tub family
  Pfam module annotation: Pfam domain module=F-box::Tub; Domain location=4-59::70-359
MEQSWRANMPRELLREVLLRIESSEATWPSRRSVVACGGVCRTWRLIVKEIVKPPQLSSNITFPISLKQPGPREHLLQCFIRRNSATQTYYLFLSLSSALIADDGKFLLAARKFRRPTCIDYIISLDADDMSRESNAYVGKLRSNFLGTKFTIYDIPLPHVGAKMTKSCFTKLVNPKQVSPRVPTGNYPVAHISYELNVLGSRGPRRMHCVMDTIPASAIEPGGVAVAPSQTDFSVSNIDTSFPFFQTNSTSLENSISGDQRNKKDDVLVLRNKAARWHEQLECWCLNFHGRVTIASVKNFQLAVSPENGHAGPQEDEVILQFGKVGKDLFTMDYRYPISAFQAFAICLSSFATTVACE

SEQ ID NO: 204030 - protein, 1336 aa, Glycine max
  Coding DNA Sequence Number=SeqID_87252
  Gene Ontology: Mol. function=nucleic acid binding
  Homolog annotation: Hit_ID=Q5BN47; Match level="QueryCoverage=96%, HitCoverage=30%, E-value=0.0, Identity=62%"; Hit description=SPLAYED splice variant
  Pfam annotation: Domain name=DEAD; Domain location=1009-1167; Score= -36.9; E_value=0.0073; Accession=PF00270.19; Description=DEADDEAH box helicase
  Pfam annotation: Domain name=QLQ; Domain location=425-460; Score=6.9; E_value=0.051; Accession=PF08880.1; Description=QLQ
  Pfam annotation: Domain name=ResIII; Domain location=1005-1161; Score= 4.7; E_value=1.9e-05; Accession=PF04851.6; Description=Type III restriction enzyme, res subunit
  Pfam annotation: Domain name=SNF2_N; Domain location=1011-1293; Score= 348.0; E_value=1.6e-101; Accession=PF00176.13; Description=SNF2 family N-terminal domain
  Pfam module annotation: Pfam domain module=DEAD::QLQ::ResIII::SNF2_N; Domain location=1009-1167::425-460::1005-1161::1011-1293
MRLFCTMMGLGINEYLMLGFEGFKEEVIQQQNPFPTSSDEMASSHNVELEAAKFLHKLIQDSKDEPAKLATKLYVILQHMKSSSKEHSMPYQVISRAMETVINQHGLDIEALKSSRLPLTGGPQIGSSSQSMNVTKDSRVSLAENEVSKMDPFASGRPPVAPSGGAPDYYQGSVAQRSGQSFDQGSPSSLDSRSANSQSQDRRDTANWDKQVSQKDGKKAMTKRKRGDTSSPVELHVDSPSQLDPRNTGVNARKGKMTKAESSDGLPVKSGELTNFNMAPNSGQLENISALSGSMRTMLRANQEGHHLLAKQTDLTKVGNLMVRAPNSKYAEDTEVSSAHIASGKQQGAYAKVHGGMAVPAGASSMVEAFSNSMQYGGAVERDGGSSTTLADGHKIAQVGRQNSGSEITMLRQGVPARDTGKPAMPFKEQQLKQLRAQCLVFLAFRNGLAPKKLHLEIALGTAFSREDGSRKDLIDHKGKSQSFNEPGNSSGVMMPFGGPSNVRQTDKNPLGSSSAGKIVEADSLSKGTESPRTLEDKGNLHVTKRGEVERRIQERVAAQASSATSCQQQDSSSTRGAVVGNNHLDDVDTGNMQVGRSNQSSVVGPNNWAGFAGANEASKGPPQVSTIQHELPIERRENIPCQFQNVVNNCGSRNHNSVNQMSFSLKEQWKPVPGTDSDPHGATMMKDGNVMIKHVSTDGFKTVPLDNASKHGISFATEQDGNERLVSADLPPSPKCTMTERWIMDQQKKRLLVEQNWVLKQQKTKQRMATSFYKLKENVSSSEDISAKTKSVIELKKLQLLELQRRLRSDFLNDFFKPIATEMEHLKSIKKHRHGRRVKQLERFELKMKEERQKRIRERQKEFFSEIEVHKEKLDDVFKIKRERWKGFNRYVKEFHKRKERIHREKIDRIQREKINLLKINDVEGYLRMVQDAKSDRVKQLLKETEKYLQKLGSKLQEAKTAAGRFGQDVDETGNHYMESNEKYYKMAHSIKESIAEQPSSLLGGKLREYQMNGLRWLVSLYNNHLNGILADEMGLGKTVQAKNDRGPFLVVVPSSVLPGWDSEINFWAPGVHKIVYAGPPEERRRLFKERIVHQKFNVLLTTYEYLMNKHDRPKLSKIHWHYIIIDEGHRIKNASCKLNADLKHYQSSHRLLLTGTPLQNNLEELWALLNFLLPNIFNSSEDFSQWFNKPFESAGDSSPDEALLSEEENLLIINRLHQVLRPFVLRRLKHKVENELPEKIERLIRCEASSYQKLLMKRVEENLGSIGNSKARSVHNSVMELRNICNHPYLSQLHAEEVDNFIPKHYLPPIIRLCGKLEMLDRLLPKLKATDHRV

SEQ ID NO: 204031 - protein, 252 aa, Glycine max
  Coding DNA Sequence Number=SeqID_87253
  Gene Ontology: Mol. function=structural molecule activity; Cellular component=protein storage vacuole
  Homolog annotation: Hit_ID=Q5JMK3; Match level="QueryCoverage=49%, HitCoverage=32%, E-value=3e-14, Identity=38%"; Hit description =Putative VAP27
MATELLQIEPAELRFVFTMQAQRMAPPDMLCKDKFLIQSTVVPFGTTEDDITSDMFSKDSGKYIEEKKLRVVLISPPSSPVLLPVNGDMKHDPSNEIYVQKDRVPSGVENIPPPCKLSSSHHPNVSDEVKGLEPAQDMKEDREDEDIVPRQAENVGDMKPAKDDMQLNLTNESEELKSKLSVMDSKLRVAEVTITKLNEERHRNTQEKDLLKKELEVLKRQINTKGSQAGFPFLFVCMVALISVAVGYYIHP

SEQ ID NO: 204032 - protein, 1827 aa, Glycine max
  Coding DNA Sequence Number=SeqID_87254
  Homolog annotation: Hit_ID=Q5BN47; Match level="QueryCoverage=7%, HitCoverage=3%, E-value=6e-37, Identity=60%"; Hit description =SPLAYED splice variant
ETELDIFEAVDKKRKEDELATWKKLVLGQAADGSDSDIPPLPARLVTDEDLKQFYEAMKISDVPKAEVESSGVKRKGGYIGGLDTQHYGRGKRAREVRSYEEQWTEEEFEKMCQVENPDSPNKVKEVAEKSCPTNTSSSVVSTSNSQPVAVPPVVPTLPAVESLPVVVQQVKEITPPAKRGRGRPKRITSDKSPAVVISPVTSGTVEVDTQLQKGIGSGHLASSTPDSVAHSAEVVGVNAPVQQSDPGVSPNSQPVIPMPSIPPNSQVAAVPVSVPIQARGQGRKSHGGEGIRRRGKKQVMTSSPIPAGSVVPDLKVNEKLEDTLVSPSSGQAISQSETVPSSAAVPHPPSASLSSGKDPVGVGIVLNSQAPPPLPSNTTLIQTAPTYPSVQMQSKGQNQKSQTGVSRRRGKKQATILASVPDLLHQDLHQTANLPISSDSMSGEKATELKSLQANNVQESKCVVQDQASQSVGDQDLKSLGGSDDSSKQTVIMSSCEDSMIKSPGQDLDEVKNPDAHDSSVKVVKSSEITSSKIDEVCNNSGNETLLVTTVPVTEAIKDQHLGGKTHNQTVETSKTFPSVVDTSINSLTGNETTENISKSLDPVTPKIVPSTLSTVYSSTPGSESTHPGSIESMPTKRQGRKTQNRAEPPRRRGKKSTAVLPVVPDAVTGQDPKLSHHAQNSSGDSLLGKATANVTQTQALEILLPCGVVSHDSNRKERATNSTHNKQQKVASTRIDGAPISTDKISVHDVARVMKEVFSGTCIPKPKAHDSAGSEDRNAPVVPVLTKAAVDVTSNNQSLKDKVYSDIAATGAACLTSNVAVNVNEKQPEMASNMQNLEGKSCLDMPITGEHNLTSDVKEKAEQMLHCVESSTTGCKIALDTTLNAVQKTDDSSERLPTSCALNDLNIDSSSHQMCSSSGAEPLAVIDHKIKSQSDSLEKCSRSSPLDIGSMGCPPTPLEPDTFSNNPVTSQADTCTQSHSSTNKPPVSTELISNEKLESLEPSLKSSSLACVDGSGFLVQTENLGDQPQVIPSSPATDLPPMTMIVSSISEHAEVKSETESTLKASAELSSDEGIVGYKVPSSQLLETENRNPFGHNSQKVLEPSVKQCSESASEMKVPVSPKAVQVQKHPDALEPADLHGTPLIESCPKSLCEEKKDDGNSICEPLQSCVVEPINIDPVSQENIVLPIPIENLKTDSSEACHMEMDTSDRLVLPQPSGLEAVGNDLVGISGVGSLVEGNKSEAAVLPPSTLKEEQNRGLAVTCTVRSSEPLEESMEKGVANDSRVQEEAKVDKVETDIQMDSSISQTLQAKHEIFQENMNFPSHLMTKEENIEVSSSRPLSISSSPSHELKDSELELGDKYISQVGDSQTGSEDNMLKRLDLVSSPSVTKEEVLSSTSDIDGSGGLSTSLNVHQLVTVPDAVKSSSSQVSENNSERVTSKCMDVPSCFQMVEGDNVDMLSDKGPLCNSLAPSEPRDPLIENSSDGIEDSIPNPLPQQKSECSESEKVDEVKTSDVVRVDPGLMSKNTDLPSSLVMEQDKADASYDSPLAAAEPKYCLTGENCEDANEEPNPSEAEIGNEMDASDVAGINTQLSSSNNIVPSSFLMTKDDKIVVSSDNGPQCSVQVLKGSEDCQTEGSCKDATEVRLSVEDVTASGGKREVETLSDEGPQGILEAQDGSRGLADFEEGADSKSCAAEMGNVSEVPKPSVSAEKVERILEAQDGSRGLSDVEEGTDSKSCAAEMGNLSEVPKLSVSAEKVEGILESRDGSRGLSDIEEGTDTKGCAAEMGNLSEVPKPSVSAEKVEGILESRDGSRGLADIEDGTD

SEQ ID NO: 204033 - protein, 80 aa, Glycine max
  Coding DNA Sequence Number=SeqID_87255
  Homolog annotation: Hit_ID=Q69VQ7; Match level="QueryCoverage=66%, HitCoverage=15%, E-value=1e-14, Identity=70%"; Hit description =Putative THO complex 3
GKCSQQAELSGENINITYKPDGTHVAVGNRDDELTILDVRKFKPIHRRKFNYEVLSSLYFILAVWSVSVSLLKPVLEDKK

SEQ ID NO: 204034 - protein, 969 aa, Glycine max
  Coding DNA Sequence Number=SeqID_87256
  Gene Ontology: Mol. function=heat shock protein binding; Cellular component=integral to membrane; Biological process=protein folding
  Homolog annotation: Hit_ID=Q5Z5F4; Match level="QueryCoverage=97%, HitCoverage=98%, E-value=1e-172, Identity=37%"; Hit description =Putative DNAJ heat shock N-terminal domain-containing protein
  Pfam annotation: Domain name=DnaJ; Domain location=67-128; Score =94.6; E_value=3e-25; Accession=PF00226.21; Description=DnaJ domain
MDCNKEEALRAKDIAEKKMENRDFVGARKIALKAQQLYPDLENIAQMLVVCDVHCSSEQKLFGNEMDWYEILQVEQTAGDAIIKKQYRKFALQLHPDKNNFAGAESAFKLIGEAQRVLLDREKRSLFDMKRRVPTNKPAMSRFNSTVKNNVRPNSSCSNSQQQQQSRQPAQQQQNGDRPTFWTVCPFCSVRYQYYKEILNKSLRCQNCKRPFVAYEVNVQGTSSPATNSTQQASDQQKDGLNHGAFKMGAGSQGNSQAEKSNMGPYDKKRPSNVSGKPNGKRKRKQVAESSEGSDTMSSNDSEEDIVAGKDGNSSVENHSSPREGHPRRSTRQKHQVSYKENVKNNDNGFLKPRGDGESHGKTTKMNDQKGLAAEHKEGKQKQHLYSERNEETKTDRGKDAVGGSTQMDGNSEHSPDSTSKAENHPNVYVYPDAEFNDFFKGKNKECFAAGQIWGIYDTAEGMPRFYALIRKVLSPGFKLQIIWFESHPDCKDEINWVNEELPVACGKYKLGDTDITEDHLMFSHLVLCEKISRNTFKVYPRKGETWALFKNWDIKWYMDVKSHQLYEYEFVEILTDYVEGKGVYVAYMAKLKGFVSLFLRNINEENKSFQIPPQELFRFSHRVPSFKLTGQEGVGVPAGSYELDPGALPVNLEEIAVPENSDVKVGRSSSGGENTRPSNRSEPLMTSEGDASIPKVNLERSNLATENKDSVDDSDNCCAPPESSPEAINVPDTQFFDFDGGRALEKFQIGQIWAFYSDEDGLPKYYGQIKKIETSPDLELHVYWLTCCWLPENTIKWEDKDILISCGRFKVNETHDFLSVYSTTSCVSHQVHADAVGKNKNYAIFPRKGDVWALYRKWTNKMKCFEMENCEYDIVEVVEETDLFINVLVLEFVSGYTSVFRGKSNEGSSVNLRIPRKELLRFSHQIPAFKLTEEHGNLKGFWELDPDGASAGSNILVLCWLPLGSVNC

SEQ ID NO: 204035 - protein, 632 aa, Glycine max
  Coding DNA Sequence Number=SeqID_87257
  Gene Ontology: Mol. function=binding; Cellular component =intracellular; Biological process=metabolic process
  Homolog annotation: Hit_ID=Q6ZIP5; Match level="QueryCoverage=96%, HitCoverage=76%, E-value=1e-104, Identity=33%"; Hit description =Pentatricopeptide (PPR) repeat-containing protein-like protein
  Pfam annotation: Domain name=PPR; Domain location=112-145; Score=6.3; E_value=1.3; Accession=PF01535.11; Description=PPR repeat
  Pfam annotation: Domain name=PPR; Domain location=174-208; Score =34.4; E_value=3.9e-07; Accession=PF01535.11; Description=PPR repeat
  Pfam annotation: Domain name=PPR; Domain location=224-258; Score=4.7; E_value=2.1; Accession=PF01535.11; Description=PPR repeat
  Pfam annotation: Domain name=PPR; Domain location=306-340; Score =35.3; E_value=2e-07; Accession=PF01535.11; Description=PPR repeat
  Pfam annotation: Domain name=PPR; Domain location=40-74; Score=30.4; E_value=6.3e-06; Accession=PF01535.11; Description=PPR repeat
  Pfam annotation: Domain name=PPR; Domain location=407-441; Score =43.4; E_value=7.5e-10; Accession=PF01535.11; Description=PPR repeat
  Pfam annotation: Domain name=PPR; Domain location=442-475; Score=3.9; E_value=2.6; Accession=PF01535.11; Description=PPR repeat
  Pfam annotation: Domain name=PPR; Domain location=546-580; Score =12.1; E_value=0.27; Accession=PF01535.11; Description=PPR repeat
  Pfam module annotation: Pfam domain module=PPR::PPR::PPR::PPR::PPR::PP R::PPR::PPR; Domain location=112-145::174-208::224-258::306-340::40 -74::407-441::442-475::546-580
MNGMRSYLFRTTPKIVALARSGQISDARKLFDEIPHKDSVAWNAMLTAYSHVGLYQQSLSLFGCMRISHSKPDNFSFSAVLNACACAGASYVRFGATLHALVVVSGYLSSLPVANSLIDMYGKCLLPDDARKVFDETSDSNEVTWCSLMFAYANSCRLGVALELFRSMPERVVIAWNIMIVGHARRGEVEACLHLFKEMCGSLCQPDQWTFSALINACAVSMEMLYGCMVHGFVIKSGWSSAMEVKNSMLSFYAKLECQDDAMKVFNSFGCFNQVSWNAIIDAHMKLGDTQKAFLAFQKAPERNIVSWTSMIAGYTRNGNGELALSMFLDLTRNSVQLDDLVAGAVLHACASLAILVHGRMVHGCIIRHGLDKYLYVGNSLVNMYAKCGDIKGSRLAFHDILDKDLISWNSMLFAFGLHGRANEAICLYREMVASGVKPDEVTFTGLLMTCSHLGLISEGFAFFQSMCLEFGLSHGMDHVACMVDMLGRGGYVAEARSLAEKYSKTSITRTNSCEVLLGACYAHGDLGTGSSVGEYLKNLEPEKEVGYVLLSNLYCASGKWREAEMVRKAMLDQGVKKVPGSSWIEIRNEVTSFVSGNNAYPYMADISKILYFLELEMRHTSPINFDIEGPL

SEQ ID NO: 204036 - protein, 110 aa, Glycine max
  Coding DNA Sequence Number=SeqID_87258
MTLPCGEQVMPFHEQGVELEGFHEERTEGDDLAAGRRERRACPSGERQVTPIFVVRVRQKNNKENNKVVTLWGTMFSIWTVKMAWFWRLRTWSNGVLLLKMVVIGEESPL

SEQ ID NO: 204037 - protein, 82 aa, Glycine max
  Coding DNA Sequence Number=SeqID_87259
  Homolog annotation: Hit_ID=Q69VQ7; Match level="QueryCoverage=55%, HitCoverage=13%, E-value=3e-16, Identity=78%"; Hit description =Putative THO complex 3
  Pfam annotation: Domain name=WD40; Domain location=9-47; Score=33.0; E_value=1.1e-06; Accession=PF00400.22; Description=WD domain, G-beta repeat
MEEQIPFKNLHNREYSGHKKKVHSVAWNCIGTKLASGSVDQTARIWHIEPHGHRMQRAFIFPLSIGQSFGLLYLNMASGLME

SEQ ID NO: 204038 - protein, 78 aa, Glycine max
  Coding DNA Sequence Number=SeqID_87260
  Homolog annotation: Hit_ID=Q9AUH6; Match level="QueryCoverage=76%, HitCoverage=9%, E-value=1e-10, Identity=69%"; Hit description=F-box containing protein TIR1
MGEAGGGAPGGHGVVVADEGVGVGERASTSYQDLNTSGAALRSGWEVRKWSTLSRMFSRTWSGRHSRSPGDVSNESQS

SEQ ID NO: 204039 - protein, 1372 aa, Glycine max
  Coding DNA Sequence Number=SeqID_87261
  Gene Ontology: Mol. function=DNA binding; Cellular component=beta -galactosidase complex; Biological process=DNA integration
  Homolog annotation: Hit_ID=Q1SLU3; Match level="QueryCoverage=94%, HitCoverage=98%, E-value=0.0, Identity=38%"; Hit description =Integrase, catalytic region
  Pfam annotation: Domain name=rve; Domain location=563-686; Score =78.2; E_value=2.6e-20; Accession=PF00665.16; Description=Integrase core domain
  Pfam module annotation: Pfam domain module=RVT_2::rve; Domain location=850-1060::563-686
MVISYSDFATNPSNPYYMHPNENPSLVLVQPVLDNKNYQIWCRLMKVALISKNKLRCNNLVLSWLQRSIFEEIAKSLLWCDRASLVWKSLANRFSQGDIFRVADIQEEVARLQQGTLEISSYFTKLMTLWEEIENFRPIRDCTCAIPCSCGAATDLRKFKKQDKVIKFLKGLGDQYSHVRSQIMLISPLPTLDNAFNLILQQERQFNLPSTTDSSIENQSSVNHFSQTPSRPSNNSGRGCGRGYSSGGCGNRLCTHCNRTNHTVETCFIKHGYPLGFQHRKSNSSGNASVVNSVQDAGSAHISSSSSASTSTNGSSASLSTIQEQYTQILQLLQQSNLQSTSPSSVNSVFATNFVSYTSPSPSSGKNLSNNTSHWWIVDTGATDHITYIFDSFSSTYHIAPKTMTMPNGDTVTTTIAGSVLLYDSLVLHNVYYFPSFHVNIISVTTLFDSTLYDVKLYPNYCKIVQLLYPKMTGFIARRIGKLYVLDTTSPLVFSPTPGSVNTSISYDPTTIWHFRLGHLSSHIHKCISSYFPFVTFNDNHKPCNTCHLAKQRNLPFAYSTTKSVAIFDLIHADIWGPLSTPSISGHKYFLTLVDDYSSDNGPEFLMTSFYLSKGIIHHRSCVETPQQNGIVERKHQHILNVAHALSFHSHLPHNLWHLSIQQAIHIINRLPTPLLNNLTPYQMLHSTPPSLHHLRVFGCLAYSSTLHNHRTKFAPRARKSIFLGYREGTKGYLLYDPITHEFYVSRNVIFHETVFPFASPPPANNPVSVNPDITTLDTSDILLDLPLSLPSPNEPTSPPAPTRKSHRLTKPPTYLSEYHCNLLSSMLLASNPEPKTYKQACKFDCWNLAMKFELDALASTNTWSVVDLPKVAKLTTIRTFLSVAGIKDWHLEQLDVNNAFLHGDLYEEVYMDLPPGFLPPGSSSNKVYKLHKSLYGLKQASRQWFSKLSTALISLGYSPSFADHSLFTKLHNSHFTALLVYVDDIVLTCNDLQEIQYVKQFLDSTFKIKDLGKLKYFLGLEIARSTQGIFLNQRKYALELLEDSGLLATKPSTTPFDCSLKLHDSDSPPYEDETTYRRLVGRLLYLTTTRPDIAFIVQQLSQFISQPLQVHHSAAIRVLKYLKSALAKGLFYSSSSTLKLSGFADSDWASCPATRRSVTGYCVFLGTSMLSWKSKKQSTVSMSSSEAEYRALASLTCELQWLQYLFKDLHISLDQPISVYCDNKSAIYLAHNPIFHERTKHIEIDCHVIREKIQTGLIHLLPVSSAAQLADVLTKPLPAPSFNSLISKLGQLDIHSPACGGLLHDPFSPSHHPSQYIVPNDKDSKLGLQEARGVQEEGKAQKKGDEGLRTSWIVCHAACRKCTVEARVRSF

SEQ ID NO: 204040 - protein, 527 aa, Glycine max
  Coding DNA Sequence Number=SeqID_87262
  Gene Ontology: Mol. function=transferase activity
  Homolog annotation: Hit_ID=Q1RWV8; Match level="QueryCoverage=92%, HitCoverage=70%, E-value=1e-178, Identity=63%"; Hit description=IMP dehydrogenase/GMP reductase
  Pfam annotation: Domain name=Ank; Domain location=113-142; Score=6.0; E_value=4.3; Accession=PF00023.20; Description=Ankyrin repeat
  Pfam annotation: Domain name=Ank; Domain location=40-78; Score=2.0; E_ value=16; Accession=PF00023.20; Description=Ankyrin repeat
  Pfam annotation: Domain name=Ank; Domain location=79-111; Score=17.3; E_value=0.055; Accession=PF00023.20; Description=Ankyrin repeat
  Pfam module annotation: Pfam domain module=Ank::Ank::Ank; Domain location=113-142::40-78::79-111
MVEVVEIESLFNYAMKGQWKEVLEVCKNNPRALETKVTKAEDSVLHIAVYVGQTIFLTTLLENINEDVSLAILNIPNSKGNTPLHLAAELGKVDICNTIAKRDPKLILCRNFKDETPLYLAAIHGTKDAFYCLHGHLQNKDDYSPCIKSNGDTILHSTISNEYFGLALQIIRMYPNLADAVNQDGLSPLHILAMKPNCFKSSTRMEFLDRMIYNCLLVNELKEETEDLSSNGEDTHFNYAMNYRTCFSFLNLLKNAVKAITIGTKDSNAGTDDEENLPKSSPINFVQERAKKENKLYRFPPNWEVLIRFLTIMMKALLILFGVGASWIGKIQRRKEKHIWAKLVMDELIERASLYKYDYTGKSSFVLQHDNDMENKDSHVNKKTIEKKRSVSPILIAAKMGVNEMVEKVLDTFPVAIHDVDSDNKNVVLLAIENRQPRVYKLLAKRNLVKESAFCHIDNQGNSALHLAAMYREHRPWRVPGDAMQMQWEYKWYKQNHFRHVYNNVSDKITSNEDKCEEKIGNLYKLA

SEQ ID NO: 204041 - protein, 155 aa, Glycine max
  Coding DNA Sequence Number=SeqID_87263
  Homolog annotation: Hit_ID=Q1SMB6; Match level="QueryCoverage=54%, HitCoverage=22%, E-value=2e-09, Identity=52%"; Hit description =Cyclin-like F-box; F-box protein interaction domain
MLETTVKSPKPLSSTDDESFLPNELILEIFLRVLIDVIPKIVNLVILVMRILLTMVFATITCMTSTKLLLVVTDLFETVAKVYTFGEEEYSGKRLQNFPCRPTVRLGKFVSGTLNWIAEGAVSDDRCVILSPDLKQGIWAVWMMKEYVFKILGLN

SEQ ID NO: 204042 - protein, 70 aa, Glycine max
  Coding DNA Sequence Number=SeqID_87264
MGFLDPPDIQKYILPPHLILVSMGLLSVDQLQIPSTLMSGVSTIAHYQRWHIQHPGFKGLLLNSNNAYQH

SEQ ID NO: 204043 - protein, 875 aa, Glycine max
  Coding DNA Sequence Number=SeqID_87265
  Gene Ontology: Mol. function=protein serine/threonine kinase activity; Cellular component=integral to membrane; Biological process=protein amino acid phosphorylation
  Homolog annotation: Hit_ID=Q69X93; Match level="QueryCoverage=99%, HitCoverage=92%, E-value=0.0, Identity=50%"; Hit description =Putative receptor-like protein kinase 2
  Pfam annotation: Domain name=LRR_1; Domain location=119-141; Score =13.1; E_value=0.99; Accession=PF00560.23; Description=Leucine Rich Repeat
  Pfam annotation: Domain name=LRR_1; Domain location=143-165; Score =14.4; E_value=0.43; Accession=PF00560.23; Description=Leucine Rich Repeat
  Pfam annotation: Domain name=LRR_1; Domain location=167-189; Score =12.0; E_value=1.6; Accession=PF00560.23; Description=Leucine Rich Repeat
  Pfam annotation: Domain name=LRR_1; Domain location=191-213; Score =7.6; E_value=11; Accession=PF00560.23; Description=Leucine Rich Repeat
  Pfam annotation: Domain name=LRR_1; Domain location=215-237; Score =13.3; E_value=0.89; Accession=PF00560.23; Description=Leucine Rich Repeat
  Pfam annotation: Domain name=LRR_1; Domain location=23-45; Score=3.9; E_value=53; Accession=PF00560.23; Description=Leucine Rich Repeat
  Pfam annotation: Domain name=LRR_1; Domain location=239-261; Score =8.6; E_value=7.1; Accession=PF00560.23; Description=Leucine Rich Repeat
  Pfam annotation: Domain name=LRR_1; Domain location=263-285; Score =11.2; E_value=2.3; Accession=PF00560.23; Description=Leucine Rich Repeat
  Pfam annotation: Domain name=LRR_1; Domain location=287-309; Score =9.5; E_value=4.7; Accession=PF00560.23; Description=Leucine Rich Repeat
  Pfam annotation: Domain name=LRR_1; Domain location=311-333; Score =9.7; E_value=4.3; Accession=PF00560.23; Description=Leucine Rich Repeat
  Pfam annotation: Domain name=LRR_1; Domain location=335-357; Score =19.5; E_value=0.012; Accession=PF00560.23; Description=Leucine Rich Repeat
  Pfam annotation: Domain name=LRR_1; Domain location=359-381; Score =13.8; E_value=0.61; Accession=PF00560.23; Description=Leucine Rich Repeat
  Pfam annotation: Domain name=LRR_1; Domain location=383-405; Score =16.5; E_value=0.098; Accession=PF00560.23; Description=Leucine Rich Repeat
  Pfam annotation: Domain name=LRR_1; Domain location=408-430; Score =8.9; E_value=6.1; Accession=PF00560.23; Description=Leucine Rich Repeat
  Pfam annotation: Domain name=LRR_1; Domain location=432-453; Score =12.1; E_value=1.6; Accession=PF00560.23; Description=Leucine Rich Repeat
  Pfam annotation: Domain name=LRR_1; Domain location=455-478; Score =15.0; E_value=0.28; Accession=PF00560.23; Description=Leucine Rich Repeat
  Pfam annotation: Domain name=LRR_1; Domain location=47-69; Score =12.1; E_value=1.6; Accession=PF00560.23; Description=Leucine Rich Repeat
  Pfam annotation: Domain name=LRR_1; Domain location=71-93; Score =12.4; E_value=1.4; Accession=PF00560.23; Description=Leucine Rich Repeat
  Pfam annotation: Domain name=LRR_1; Domain location=95-117; Score =15.2; E_value=0.25; Accession=PF00560.23; Description=Leucine Rich Repeat
  Pfam annotation: Domain name=Pkinase; Domain location=583-850; Score =113.8; E_value=4.9e-31; Accession=PF00069.15; Description=Protein kinase domain
  Pfam annotation: Domain name=Pkinase_Tyr; Domain location=583-850; Score=92.0; E_value=1.7e-24; Accession=PF07714.7; Description =Protein tyrosine kinase
  Pfam module annotation: Pfam domain module=LRR_1::LRR_1::LRR_1::LRR _1::LRR_1::LRR_1::LRR_1::LRR_1::LRR_1::LRR_1::LRR_1::LRR_1::LRR _1::LRR_1::LRR_1::LRR_1::LRR_1::LRR_1::LRR_1::Pkinase::Pkinase_Tyr; Domain location=...
  Pfam module annotation: Domain location=119-141::143-165::167 -189::191-213::215-237::23-45::239-261::263-285::287-309::311 -333::335-357::359-381::383-405::408-430::432-453::455-478::47-69::71- 93::95-117::583-850::583-850
QLRIGGNPYLTGQIPSQLGLLTNLTTFGAAATGLSGVIPSTFGNLINLQTLALYDTEISGSIPPELGSCSELRNLYLHMNKLTGSIPPQLSKLQKLTSLLLWGNSLTGPIPAELSNCSSLVIFDVSSNDLSGEIPGDFGKLVVLEQLHLSDNSLTGKIPWQLGNCTSLSTVQLDKNQLSGTIPWELGKLKVLQSFFLWGNLVSGTIPSSFGNCTELYALDLSRNKLTGSIPEQIFSLKKLSKLLLLGNSLTGRLPSSVSNCQSLVRLRVGENQLSGQIPKEIGQLQNLVFLDLYMNHFSGSIPVEIANITVLELLDIHNNYLTGEISSVIGELENLEQLDLSRNSLIGEIPWSFGNFSYLNKLILNNNLLTGSIPKSIRNLQKLTLLDLSYNSLSGGIPPEIGHVTSLTISLDLSSNEFTGEIPDSVSALTQLQSLDLSHNMLYGGIKVLGSLTSLTSLNISYNNFSGPIPVTPFFRTLSCISYLQNPQLCQSMDGTSCSSSLIQKNGLKSAKTIAWVTVILASVTIILISSWILVTRNHGYKVEKTLGASTSTSGAEDFSYPWTFIPFQKVNFSIDDILDCLKDENVIGKGCSGVVYKAEMPNGELIAVKKLWKASKADEAVDSFAAEIQILGYIRHRNIVRLIGYCSNGSVNLLLYNYIPNGNLRQLLQGNRSLDWETRYKIAVGSAQGLAYLHHDCVPAILHRDVKCNNILLDSKFEAYLADFGLAKLMHSPTYHHAMSRVAGSYEYGYSMNITEKSDVYSYGVVLLEILSGRSAVESHVGDGQHIVEWVKRKMGSFEPAVSILDTKLQGLPDQMVQEMLQTLGIAMFCVNSSPTERPTMKEVVALLMEVKSQPEEMGKTSQPLIKQSSNQS

SEQ ID NO: 204044 - protein, 669 aa, Glycine max
  Coding DNA Sequence Number=SeqID_87266
  Gene Ontology: Mol. function=nucleic acid binding; Cellular component= nucleus; Biological process=mRNA polyadenylation
  Homolog annotation: Hit_ID=Q1STD4; Match level="QueryCoverage=99%, HitCoverage=97%, E-value=0.0, Identity=56%"; Hit description=RNA -binding region RNP-1
  Pfam annotation: Domain name=PABP; Domain location=578-650; Score =114.0; E_value=4.4e-31; Accession=PF00658.8; Description=Poly -adenylate binding protein, unique domain
  Pfam annotation: Domain name=RRM_1; Domain location=142-212; Score =94.3; E_value=3.6e-25; Accession=PF00076.12; Description=RNA recognition motif. (a.k.a. RRM, R
  Pfam annotation: Domain name=RRM_1; Domain location=233-304; Score =102.9; E_value=9.7e-28; Accession=PF00076.12; Description=RNA recognition motif. (a.k.a. RRM, R
  Pfam annotation: Domain name=RRM_1; Domain location=337-407; Score =96.4; E_value=8.8e-26; Accession=PF00076.12; Description=RNA recognition motif. (a.k.a. RRM, R
  Pfam annotation: Domain name=RRM_1; Domain location=37-125; Score =47.3; E_value=5.3e-11; Accession=PF00076.12; Description=RNA recognition motif. (a.k.a. RRM, R
  Pfam module annotation: Pfam domain module=PABP::RRM_1::RRM_1::RRM _1::RRM_1; Domain location=578-650::142-212::233-304::337-407::37-125
MAAAISSPMAQSVAAAATPVIAPGVALGGGPFANASLYVGDLEGNVNEEQLYDLFSQVAQIASIRVCRDQTKRSSLGYAYVNFANAQDGFDLPELKSLCCHCAEKTSNAMELLNFTPLNGKPIRIMFSQRDPSIRKSGHGNVFIKNLDTSIDNKALHDTFAAFGTVLSCKVALDSSGQSKGYGFVQFDNEEAAQNAIKRLNGMLINDKQVYVGLFIRRQEREQTNGSPKFTNVYVKNLSETYTDEDLKKLFGPYGTITSATVMKDVNGKSRCFGFVNFQNPDSAAAAVERLNGTTINNDRVLYVGRAQRKAEREAELKAKIEQERISRYEKLQGANLYLKNLDDSFSDEKLKDLFSEFGTITSCKVMIDSNGRSKGSGFVSFSTPEEASKALNEMNGKLIGRKPLYVAVAQRKEERKAHLQAQFAQIRAPGGMAPLPAGIPLYHPGAPRLAPQQLYYGQGTPGFMPPQPAGFSFQQQILPGMRPGVAPNFIMPYHLQRQGQLGQRTGVRRNGNFQQVQQNQMLHRNSNQGFRYMPNGRNGMDPSLVPHGLMGPMMPMPFDGSGVTAAPNDNQRPGALSTTLASALASATPENQRMMLGEHLYPLVERLAPNQYTAKVTGMLLEMDQSEVINLIESPEDLKTKVSEAMQVLHEVASGSEVDQLGSMSLNE

SEQ ID NO: 204045 - protein, 116 aa, Glycine max
  Coding DNA Sequence Number=SeqID_87267
  Gene Ontology: Mol. function=metal ion binding; Biological process =metal ion transport
  Homolog annotation: Hit_ID=UPI00001634B5; Match level="QueryCoverage =95%, HitCoverage=80%, E-value=1e-08, Identity=36%"; Hit description =copper ion binding / metal ion binding
MYCNSCERTVAKVISKCKDNSCVTTTLLLGVEKFITDMNEHRVVVTGRIDPMKVFKKLKKKTGKKVEIVSNMDEEPNDESDKLVMMHQFAPENDSCIKTETIMMFSDENPNACVVM

SEQ ID NO: 204046 - protein, 245 aa, Glycine max
  Coding DNA Sequence Number=SeqID_87268
  Gene Ontology: Mol. function=nucleic acid binding
  Homolog annotation: Hit_ID=Q10L02; Match level="QueryCoverage=31%, HitCoverage=32%, E-value=9e-29, Identity=76%"; Hit description=RNA recognition motif family protein, expressed
  Pfam annotation: Domain name=RRM_1; Domain location=48-115; Score =58.0; E_value=3e-14; Accession=PF00076.12; Description=RNA recognition motif. (a.k.a. RRM, R
REWEGIVAGAEAIAPGGEAEAHRHRADGSAMSTIATVTAGLTETAAHLFLPACLPEDLRIPFERYGPVKDVYLPKNYYTGEPRGFGFVKYRYGEDAAEAKQHLNHTIIGGREIRIVFAEENRKTSQEMRVNTRGSGRHGGGRRRNRTRSPRPRSYSRSPSPARDDSRILTDMMTYRDGRGRDDYYSPERSRSYSRSLSPSGGKDYKKSPRLRENGRSPNDKKDQTPRRSESPRDNDCSPSRSHSR

SEQ ID NO: 204047 - protein, 88 aa, Glycine max
  Coding DNA Sequence Number=SeqID_87269
MTELAPKCKPQIDSHHYTQKVWLEDKTYGTLIGIRKETQNRTIKNFRDEILVNLMPQEGRGKPDADSREKPSQGKERLGVVREEPRRD

SEQ ID NO: 204048 - protein, 304 aa, Glycine max
  Coding DNA Sequence Number=SeqID_87270
  Gene Ontology: Mol. function=transcription factor activity; Cellular component=nucleus; Biological process=regulation of transcription, DNA-dependent
  Homolog annotation: Hit_ID=Q9LXV5; Match level="QueryCoverage=68%, HitCoverage=75%, E-value=2e-52, Identity=53%"; Hit description =Nuclear transcription factor Y subunit A-1
  Pfam annotation: Domain name=CBFB_NFYA; Domain location=249-304; Score=50.8; E_value=4.6e-12; Accession=PF02045.6; Description=CCAAT -binding transcription factor (CBF-BNF-YA) subunit B
  Subcellular localization annotation: CTP_CleavageSite=70; ConfidenceScore=5.23e-01
MKGTRGQRCCKHWNDVGPTQRPRVPWIRAAQVRVTWATFSFVGFLSRAPITSPSTPKPAVSGHPHPLPPPGSEDMQSKSETANRLRSDPHSFQPGSVYSEPWWRGIGYNPVAQTMAGANASNSSSLECPNGDSESNEEGQSLSNSGMNEEDDDATKDSQPAAPNGTGNYGQEQQGMQHTASSAPSMREECLTQTPQLELVGHSIACATNPYQDPYYGGMMAAYGHQQLGYAPFIGMPHARMPLPLEMAQEPVYVNAKQYQGILRRRQARAKAELERKLIKSRKKKYWDMNKCNMSGKVIYQGYN

SEQ ID NO: 204049 - protein, 219 aa, Glycine max
  Coding DNA Sequence Number=SeqID_87271
  Gene Ontology: Mol. function=sugar porter activity; Cellular component=integral to membrane; Biological process=carbohydrate transport
  Homolog annotation: Hit_ID=Q8LBI9; Match level="QueryCoverage=96%, HitCoverage=49%, E-value=7e-59, Identity=55%"; Hit description=Sugar transporter ERD6-like 16
KWAIEEHKDVDSGEANRIQGLQEPFIQHEKDAAACKDVESNTTVENGSIGMVLLLFVVGYSAPTQAAIREDLNLSLAEFSMFGSLVTIGATLGAITSGRITDFIGRKGDPYSLDLGRFFTGYGIGVISFVVPVYIAEIAPKNLRGGLATTNQLMIVIGSSISFLLGSFLSWRQLALAGLVPCISLLIGLHFIPESPRWLAKVGLKKEFQVALRKLGKRC

SEQ ID NO: 204050 - protein, 189 aa, Glycine max
  Coding DNA Sequence Number=SeqID_87272
  Homolog annotation: Hit_ID=Q2HRX8; Match level="QueryCoverage=72%, HitCoverage=20%, E-value=1e-07, Identity=29%"; Hit description=IMP dehydrogenase/GMP reductase
CWIYEYFSSVHQCVTDDAYEETSPRASRWLTTKAHMKGIIGASYRARCDALTVIDVCWLPYTEMGPMVVTVQPERVLCQFRYIQSIPPPPVSASLSYDDMDDRWMHFSDHVAAVGDICVMPRQDDYEGYEAIAESLERVLNLRMVTAGTELQISCKIASGSPGGVLAQMEVLGLDKDGAQSIDDVFYVL

SEQ ID NO: 204051 - protein, 67 aa, Glycine max
  Coding DNA Sequence Number=SeqID_87273
MALRQHLKRKKLQILQKIHFQHRLFRTFYIGSKTDVESSDVEWMDVNIGFVKLMLTYDNIGALNTRC

SEQ ID NO: 204052 - protein, 71 aa, Glycine max
  Coding DNA Sequence Number=SeqID_87274
MPNIVNLMCFNFNFSEACALSESHALSEALSPLNELGEYGGEYENHLCAQRIISLLSETFVSSCAKRTQLA

SEQ ID NO: 204053 - protein, 149 aa, Glycine max
  Coding DNA Sequence Number=SeqID_87275
TLHGSGTPGQVIEIEYGVQGEGLRHAGSVLVDADGKWSFTSPYLHQPGVWEYQARASTGEMKSNWSSKFVLDVSPDAAFDQQAQDEAQPDGLTLHQLLSEGGTGLFIEDDSTQLLVNGKPGDSVQLQDILPEGEAVDGWTQQTGTLTIA

SEQ ID NO: 204054 - protein, 209 aa, Glycine max
  Coding DNA Sequence Number=SeqID_87276
  Gene Ontology: Mol. function=nucleic acid binding; Biological process= DNA integration
  Homolog annotation: Hit_ID=Q0KIN0; Match level="QueryCoverage=89%, HitCoverage=12%, E-value=9e-26, Identity=31%"; Hit description =Integrase core domain containing protein
MATSGPVFSFSGIPTIATAKLNWKNYLSWSASVELWFLGQGYHDHLEKNVNVVPNDKKLEWEKVDYQLCAVLWQSVESDVLEILRSFKTCHLFWKKAQEIFANDIQSLFDATVKVTALKQSNHDMIAHMGKARATVEELRRFLVADSLEEVNRKLDKFYMVLAGDQVPLMDSLITRLLRVPHALKDENLTDAVETSAMVAPRGRGGGRN

SEQ ID NO: 204055 - protein, 187 aa, Glycine max
  Coding DNA Sequence Number=SeqID_87277
RDSKVSMTDLVSTEDDVAEDDVSLCVLSSFSSYRQQKVYTDNHSGISARQRDSKVSMTDLVSAEDDIYLRMSTGLSAAIDEGRRRRPKVYTDNHSGISARQRDSKVSMTDLVSAEDDGAEDDVSLCVLSGFSSYRQQKVYTDNHSGISARQRDSKVSMTDLVSAEDDINHSMSTGLSAAIDEGRRRR

SEQ ID NO: 204056 - protein, 179 aa, Glycine max
  Coding DNA Sequence Number=SeqID_87278
  Gene Ontology: Mol. function=2-polyprenyl-6-methoxy-1,4-benzoquinone methyltransferase activity; Cellular component=mitochondrion; Biological process=ubiquinone biosynthetic process
  Homolog annotation: Hit_ID=UPI0000E450A1; Match level="QueryCoverage =62%, HitCoverage=43%, E-value=7e-49, Identity=77%"; Hit description =3-demethylubiquinone-9 3-methyltransferase
MEMLEHVPDPRSVVLACAQLMKPGGEVFFSTINRNPKAWLLAVFGAEYVLRMVPRGTHDVKKFIRPAELLNWVDETALRERNMTGLHYNPLTNQFRLGRGVDVNYMVHTHRQAAVVAARCITREIAPLWNLRPAIYLTERHNALLTASPPLTSDRPRFITRWPYPDQFPFRRCDALFVR

SEQ ID NO: 204057 - protein, 63 aa, Glycine max
  Coding DNA Sequence Number=SeqID_87279
MLLLGIRCWVLVSSIAVVVLIIIGGCAEGSRPHRILVDTDVDTDDFFALLYLLKFNASQFQLE

SEQ ID NO: 204058 - protein, 255 aa, Glycine max
  Coding DNA Sequence Number=SeqID_87280
  Homolog annotation: Hit_ID=Q8LBI9; Match level="QueryCoverage=44%, HitCoverage=34%, E-value=9e-38, Identity=67%"; Hit description=Sugar transporter ERD6-like 16
  Pfam annotation: Domain name=AT_hook; Domain location=66-78; Score =14.9; E_value=0.061; Accession=PF02178.9; Description=AT hook motif
MRMFRWMCGKIRQDKIRNEAIRERVGLAPIVEKMVENRLRWFGHVERRPVDSVVRRVDQMERRQTIRGRGRPKKTIREVIKKDLKLNDLDRRLSSGKIGSIAYACMQVPFTVLGAMLMDKSGRRPLIMDQSLLLDCVPILAVASVLIYVGAFSIGMGPVPWVIMSEIFLIHVKGTAGSLVVLVNWLGAWQSYSQKPKEKHWKKFRHASIHRRKKRETKLGWINSAIASKCCSQISVRAKNFQQEDHVQLLLVKFF

SEQ ID NO: 204059 - protein, 773 aa, Glycine max
  Coding DNA Sequence Number=SeqID_87281
  Homolog annotation: Hit_ID=Q8LAN3; Match level="QueryCoverage=34%, HitCoverage=89%, E-value=1e-122, Identity=77%"; Hit description =Prolyl 4-hydroxylase alpha subunit-like protein
  Pfam annotation: Domain name=2OG-FeII_Oxy; Domain location=452-577; Score=69.3; E_value=1.2e-17; Accession=PF03171.10; Description=2OG -Fe(II) oxygenase superfamily
  Pfam annotation: Domain name=ShK; Domain location=590-631; Score =19.4; E_value=0.0073; Accession=PF01549.14; Description=ShK domain -like
  Pfam module annotation: Pfam domain module=2OG-FeII_Oxy::ShK; Domain location=452-577::590-631
MAGESGGSATNLNFDLPEEVVQVLPSDPFQQLDVARKITSIALSTRVNTLESDLSSLRAQIADKDNLIADLQSQLDSLDASLSQIAATLFQTEQDKESLLQENASLSDTVKKLNRDVSKLEVFRKTLMQSLQEDDDNSVSSVLGGTPDTVAKIQSQASLTSTSQIGGTFNLYAIYLYNIALLLILGALYNEASLPPAISSSTGNSFADDQESDAIRPRVSQNLLLASQGSTPRITPPGSPPILSASVSPTRTSKPVSPRRHSISFSTTRGMHDDRSSVFSSMSLTHGSISSSDAGTGSQTGRTRVDGKEFFRQVRNRLSYEQFGAFLANVKELNSHKQTKEVLPPVFSVLSSLTSYAGSASSVINPSKVKQISWKPRAFVYEGFLTDLECDHLISLAKSELKRSAVADNLSGESQLSDVRTSSGMFISKNKDPIVAGIEDKISSWTFLPKENGEDIQVLRYEHGQKYDPHYDYFTDKVNIARGGHRIATVLMYLTDVAKGGETVFPSAEEPPRRRGAETSSDLSECAKKGIAVKPRRGDALLFFSLHTNATPDTSSLHAGCPVIEGEKWSATKWIHVDSFDKTVGAGGDCSDNHVSCERWASLGECTKNPEYMIGSSDIPGYCRKSCKAWDSSDHHVSCERRASLRECTKNPEYMIGSSDFPGYYRKFCKASEGTERLVFFEPSAPEIRSIDFNASLYDDSASVALKLNFLPPKPYDVRIRGFHGQLAYPPIIAPSKNVMFLTFLYGFWYDPSTDDYLVVKVFCHACSAVSAN

SEQ ID NO: 204060 - protein, 754 aa, Glycine max
  Coding DNA Sequence Number=SeqID_87282
  Homolog annotation: Hit_ID=Q5FSC7; Match level="QueryCoverage=34%, HitCoverage=78%, E-value=9e-12, Identity=29%"; Hit description =Inosine-uridine preferring nucleoside hydrolase
  Pfam annotation: Domain name=IU_nuc_hydro; Domain location=371-732; Score=-41.0; E_value=2.3e-08; Accession=PF01156.9; Description =Inosine-uridine preferring nucleoside hydrolase
GISISANAWTSAGHAVNHIYDLLYMMGRDDVAVGVGGEGGILQNGTILPNVGGYLPIVEQGMTTVGGCRYRGAIPVGLGGRLDIDANYGIRKAFLPQQPTAQQVLIEKISAGPITLLVIGAHTNIAIFLMNNPHLKKNVEHIYIMGGGVRSSNPTGCCPKNASSTCVPMQCGDRGNMFTDYNTNPYAEFNIFGDPFAAYQSYFMWDSFTAGVAVSIMSKPNNHKGENEFAEMEYMNITVITSNKPYGVSDGSNPFFDGRRVPKFNLEKGGVHSGHVQQGLRDPLCFVNNGKGKCQDGYTAEVSGPDSVRVLVATKAKPNKDVGSSLDREYFISFLNVLKHPQNAGRFNFITQFPYYKEVTYKPDFQNKTLGKPVVFDMDMSAGDFLALFYLLKVPVQVIDLKALIVSPTGWTNSATIDVIYDLLHMMGRDDIPVGLGDVFAMNQSDPIFPPVGECKYVKAIPHGSGGLLDSDTLYGLARDLPRSPRRYTAENSEVWGAPRDTDHPELRQPLAMEVWDSVLQRTKPRSKITVLTNGPLTNLAKVVSVKNISSRIQEVYVVGGHLSSNVNDKGNIFSVPSNQYAEFNMFLDPLAAKTVFESEVNITLIPLNTQRQVSSFSTIIGELRRTPRTPEAVFSERLLSRLYRLKQTHNRYQHMDTFLGEIVGAAVLTDSNSGLNPNFEVKAVNVLADGNESSDGKIVVDEKGGKLVRILSSVDAKVYYSLYANKLGDEDQSAKIGSFEKQRRKWNHPHSKK

SEQ ID NO: 204061 - protein, 74 aa, Glycine max
  Coding DNA Sequence Number=SeqID_87283
  Homolog annotation: Hit_ID=Q653U4; Match level="QueryCoverage=68%, HitCoverage=7%, E-value=3e-08, Identity=60%"; Hit description=Zinc finger (C3HC4-type RING finger) protein-like
  Pfam annotation: Domain name=YTH; Domain location=2-57; Score=-18.9; E_value=0.018; Accession=PF04146.6; Description=YT521-B-like family
MSISCYTGCMLIVETKIRKVVMIYNKTKKNHFLQISRDCQELEPSIGEQLASLLYLEPDSELMVYSPLSHHLAL

SEQ ID NO: 204062 - protein, 821 aa, Glycine max
  Coding DNA Sequence Number=SeqID_87284
  Gene Ontology: Mol. function=RNA-directed DNA polymerase activity; Cellular component=chromatin; Biological process=chromatin assembly or disassembly
  Pfam annotation: Domain name=RVP_2; Domain location=209-322; Score= -44.0; E_value=0.0027; Accession=PF08284.2; Description=Retroviral aspartyl protease
  Pfam annotation: Domain name=zf-H2C2; Domain location=713-754; Score =25.1; E_value=0.00016; Accession=PF09337.1; Description=His(2) -Cys(2) zinc finger
  Pfam module annotation: Pfam domain module=RVP_2::RVT_1::zf-H2C2; Domain location=209-322::346-546::713-754
MADSGKALGTSDRLENALVRLTNQQLCLGESMHSMTLKIDELLHHVSPLLSPPPVPLPLHHPHPLFKLTQRGNVGQYLSKFEDLANWIVGLPVPFLLSCFVSGLTPEIHRESRAPQPISLSPPHATPLPPLLPSPPRPPPPPTLKCLTPEEIASCRERGLCFNCDEKCHRGHRYASWVFLLIAEDEDPTISHIGPNDSIPDPPDGPDSCPAQISLNSLAGHLASKTLRLVGTITGYSVILLVDSGSTHNFIQQQLVTQLGLPCWKTTPLRVMVGNGQQLECNCFCEAVTIDIQTTPFTVDLYVLPIAGANGRLVELQGDNDANLGFFLATRDSHPELQALLTKFGSLFQNPQILLPTRDTDHHIHLLPLSTPVNYESILLAGTTSEEDYRALNALTVKDRFPIPTIDELLDELGGARCFSKLDLLQGYHQIRMHVSDIPKTAFKTHHGHYEFKVMPFGLCNAPSSFQATTKMIFRPYLLHFIIVFFDDILIYSDSFEDYLCHLETTFQVGGTSSFESSNYPSVANSSVYQSPEKLPGSCRVLSPVHLRLCYHCGSLGEVTLHRGDECVGSRNGHSPISIGTSHCLLQQTLQLEASSCIHVCPGIVRDYDGGNSNPETTHVFGASNGAADALSRLPEQDPSMFMILSVPCLTFMEELRRQLDSHPEYQHQHQNVRDCPAKHPEFSITHDLVLNRGRIWLPWGLPIISTLLTEYHAMPTGGHIGVAKTLAHITENFYWPGLRDDVNQFVANCVECQVTKYETKKIVGLLCLLPVPYRPWEDLSLDFIVGLSSYHGYTVILVVAVYTESLLSLPYDSKKAEKDN

SEQ ID NO: 204063 - protein, 47 aa, Glycine max
  Coding DNA Sequence Number=SeqID_87285
MPFPTLETQGVKEGKERWRHDVDEEGVRVDMVEDEVVVVTGSLTELI

SEQ ID NO: 204064 - protein, 342 aa, Glycine max
  Coding DNA Sequence Number=SeqID_87286
  Gene Ontology: Mol. function=nucleic acid binding; Cellular component= nucleus; Biological process=mRNA processing
  Homolog annotation: Hit_ID=Q653U4; Match level="QueryCoverage=95%, HitCoverage=38%, E-value=2e-33, Identity=31%"; Hit description=Zinc finger (C3HC4-type RING finger) protein-like
  Pfam annotation: Domain name=zf-CCCH; Domain location=202-222; Score =7.5; E_value=0.13; Accession=PF00642.15; Description=Zinc finger C -x8-C-x5-C-x3-H type (and similar)
  Pfam annotation: Domain name=zf-CCCH; Domain location=70-95; Score =15.2; E_value=0.013; Accession=PF00642.15; Description=Zinc finger C- x8-C-x5-C-x3-H type (and similar)
  Pfam annotation: Domain name=zf-CCCH; Domain location=98-123; Score =8.6; E_value=0.096; Accession=PF00642.15; Description=Zinc finger C -x8-C-x5-C-x3-H type (and similar)
  Pfam module annotation: Pfam domain module=zf-CCCH::zf-CCCH::zf-CCCH; Domain location=202-222::70-95::98-123
MEDSEGVLSFDFEGGLDAAPSSAAAAVPSGPLVQHDSSAAASAVSNGGHAAPAPSTADPAGGNVPGRRSFRQTVCRHWLRSLCMKGDACGFLHQYDKARMPVCRFFRLYGECREQDCVYKHTNEDIKECNMFDGVLKSSDCAKRLNFEQTFLILVSTFIMHCILAAGLFVWDDDLSLFSERITNYFLASLLCSSNEVLHGRIYWYKLGFCPNGPDCRYRHAKSPGPPPPVEEVLQKIQHLFSYNYNSSNKFFQQRGASYNQQAEKPQLPQGTNSTNQGVTGKPLPAESGNAQPQQQVQQSQQQVNQSQMQNVANGQPNQANRTATPLPQGISRCVQGPVFFN

SEQ ID NO: 204065 - protein, 94 aa, Glycine max
  Coding DNA Sequence Number=SeqID_87287
  Homolog annotation: Hit_ID=Q10CF2; Match level="QueryCoverage=91%, HitCoverage=42%, E-value=2e-30, Identity=72%"; Hit description =Expressed protein
  Pfam annotation: Domain name=GLTP; Domain location=1-92; Score=-18.7; E_value=1.3e-06; Accession=PF08718.1; Description=Glycolipid transfer protein (GLTP)
MSLVTVCLFGRGNSLRDPASKAYEQVFAPHHGWAIRKAVSAGMYALPTKEQLLKKLNEDEASAKDHMQSYVTASAPLIQYIDKLFVSRDLGIDW

SEQ ID NO: 204066 - protein, 66 aa, Glycine max
  Coding DNA Sequence Number=SeqID_87288
MTPPGRNGVVDFFANRHRLFVKGGLPWRCHKAQWQVDMAKFRLFTIDNTGSRLARQERSSLCQTQS

SEQ ID NO: 204067 - protein, 177 aa, Glycine max
  Coding DNA Sequence Number=SeqID_87289
MIITLDDVSRLLHLPMTYRIIDYVSSTFNRDTVTVLLMTHLSILTEIKAKAATNASVKYDIYQELDSRSCHLPLVPQQPDCLPRVRMGVVALAYLHDHFSYVSLYDSKQCGDYMALLMAWVKWQQHIIPPDDVVPPGDPWACTSNYLPWFYKYSHPYVIPPVEERAPRSLLCLSRIP

SEQ ID NO: 204068 - protein, 81 aa, Glycine max
  Coding DNA Sequence Number=SeqID_87290
MYFRRPIPILRCGVSNDDSKNTNDDYINNDDKDNDSDGIDSVGGGDDRDNIGGSYSNNISDIDHGDDSDNSDNNKIGINNQ

SEQ ID NO: 204069 - protein, 103 aa, Glycine max
  Coding DNA Sequence Number=SeqID_87291
  Gene Ontology: Mol. function=adenosylmethionine decarboxylase activity; Biological process=spermidine biosynthetic process
  Homolog annotation: Hit_ID=Q75KG4; Match level="QueryCoverage=93%, HitCoverage=27%, E-value=2e-17, Identity=46%"; Hit description =Putative S-adenosylmethionine decarboxylase
MDGYWYSTIHVTPEDGFSYASFECVGSVNGNIGHVLRKVVQIFRPGTMSISTTCNGFSNDIMWTQMAGAVEPLGLKCRSCAMDKFPNAGTVVFQTFTPRRKNV

SEQ ID NO: 204070 - protein, 1416 aa, Glycine max
  Coding DNA Sequence Number=SeqID_87292
  Gene Ontology: Mol. function=zinc ion binding
  Homolog annotation: Hit_ID=Q6K3D4; Match level="QueryCoverage=21%, HitCoverage=28%, E-value=1e-113, Identity=65%"; Hit description =Putative PKG-Ib
  Pfam annotation: Domain name=PP2C; Domain location=54-339; Score =128.4; E_value=2e-35; Accession=PF00481.12; Description=Protein phosphatase 2C
  Pfam annotation: Domain name=zf-C3HC4; Domain location=1362-1401; Score=11.3; E_value=0.011; Accession=PF00097.15; Description=Zinc finger, C3HC4 type (RING finger)
  Pfam module annotation: Pfam domain module=PP2C::zf-C3HC4; Domain location=54-339::1362-1401
MGCVHGKSCCGDSSSSDDGSRDYRELGFIHGHRKNVLAQRSLKHVPVPSHNFILEYTFLSQRGYYPDSPDKENQDSFCITTQLQGNPNVHFFGVYDGHGQFGSQCSNFVKHRLVEKLSNDPALLEDPVQAYNSAFLATNQELRSTSEIDDSMSGTTAITVLVIGDTLYVANVGDSRAVLAVRDGNHIVAEDLSSDQTPFRRDEYERVKLCGARVLSVDQVEGLKDPDIQHWGDEESRGGDPPRLWVPNGMYPGTAFTRSIGDSLAETIGVIAIPEVKTVQLTPNHLFFVVASDGIFEFLTSQTVVDMAASYMDPRDACSAIAEKSYKLWLELENRTDDITIIIVQIKGLSNSGTSGVGSDEINGGGTVMNSRTGTHEISATPGSNVYRSVRNSLSDLHSCQHVASVTSAAIERGFTEASSSLFAVSPKWYISTFQLPEHCALLLYIYWSLHFRLPTCQLKKPNPSEENTCAHLPVTQLHLHSTDLIFGRGINNELEIKGRWYTRSCDCDYHLQWIVEETHRMVDAKMISLVASCSSQMSPSVSCQEKGSRNKRKFRVDPPLGEPNKFIPAPQLKCFSYEFSAERFEITPGHGQAAACDLCGVSQDYSDGLKLGLGLYNPGTSEVGPSQSKDEPETDEINDADWSDLTEAQLEELVLTNLDTILKSAIKKIVACGYTEDVATKAILRPGICYGCKDTLSNIVDNSLAFLRNGQEIDTSREHYFEDLVQLEKYNLAELVCVLREVRPFFSVGDAMWCLLICDMNVSHACAMDCNPLSSLGNDNSTGGPSNQAESLSKAETKCPEPSLISPSKSIPTCSHNSQSKKPFVTRIPGVNNLNPQIIGGASEKEGASCGSECINKAFSAAGTSQSGLMKEKRGTVRKVHSGSTKRDYILQHKSFHKEKSYRTYGLKGSSRRGKVNGLSGLVLDKKLKSVSESSTINLKSASLQISKAVGIDTTQDSISVNFSCNAGTSTSTAFSLVNSSDSVCRSTNTSFAINAANTIPVFSCPASLSATNTDLSLSLSSKIKPSTESVCSNNEAPNSSYMGILYNNNNNNKSPRQWIPHDGKDEMILKLLPRVRELQNQLQEWTEWANQKVMQAARRLSKEKAELQTLRQEKEEVERLKKEKQSLEENTLKKLSEMENALCKVSGQVERANATVRKLEVEKAALRKEVEAAKIRATETAASCQEVSRREKKTQMKFQSWEKQKSLFQEELTIEKRKLAQLLQELEQARMQQEQVEGRWQQEAKAKEEFILQASSIKKEREQIEESGKSKEDAIKLKAERNRQMYRDDIHKLEKEISQLRLKTDSSKIAALRMGIDGCYASKCLDMKNGTAQKEPRASFISELVIDHSATGGVKREQECVMCLSEEMSVLFMPCAHQVVCKTCNELHEKQGMQDCPSCRSPIQQRIAVRFPRI

SEQ ID NO: 204071 - protein, 220 aa, Glycine max
  Coding DNA Sequence Number=SeqID_87293
  Homolog annotation: Hit_ID=Q9FNL3; Match level="QueryCoverage=74%, HitCoverage=78%, E-value=9e-24, Identity=35%"; Hit description =Arabidopsis thaliana genomic DNA, chromosome 5, P1 clone:MCL19
  Pfam annotation: Domain name=DUF679; Domain location=28-192; Score =288.6; E_value=1.2e-83; Accession=PF05078.3; Description=Protein of unknown function (DUF679)
  Subcellular localization annotation: CTP_CleavageSite=64; ConfidenceScore=5.89e-01
MNANSSSMSTNTQTQPLLGTGVSVTNTNTSPFSAVGSFIKLLPTGTLFVFQFLNPVLTNSGECNASNKWLSGILLVACGFSCAFSSFTDSYTGSDNQRHYGIVTTKGLWPSPASESVDLSTYRLKFGDFVHAVLSLLVFAVLGLLDTNTVHCLYPGFESTQRLLLQVLPTVIGVLAGGHFVISPSNRHGIGYPLTSDSNTTSPELNHTTAPPQHPNHTSV

SEQ ID NO: 204072 - protein, 144 aa, Glycine max
  Coding DNA Sequence Number=SeqID_87294
  Homolog annotation: Hit_ID=Q10CF2; Match level="QueryCoverage=86%, HitCoverage=59%, E-value=5e-36, Identity=62%"; Hit description =Expressed protein
  Pfam annotation: Domain name=GLTP; Domain location=21-144; Score =14.7; E_value=4.4e-09; Accession=PF08718.1; Description=Glycolipid transfer protein (GLTP)
MTEGNGDKTLRKIADAFNDLANVFTDSQSAEAEVKVAPFSHACSLVSPLFGCLGVAFKFAEMDYVAKVHDLAEASKSIQNLQSLIELDVQANTVRKGGSHTRNLLRVKRGLDMVRVLFEQILVTEYVHHLLIYILLCAKYILFI

SEQ ID NO: 204073 - protein, 445 aa, Glycine max
  Coding DNA Sequence Number=SeqID_87295
  Gene Ontology: Mol. function=protein binding; Cellular component =cytoplasm; Biological process=ubiquitin cycle
  Homolog annotation: Hit_ID=Q8LGK0; Match level="QueryCoverage=59%, HitCoverage=76%, E-value=5e-89, Identity=40%"; Hit description=F-box protein family, AtFBL4
  Pfam annotation: Domain name=LRR_1; Domain location=209-233; Score =0.3; E_value=2.5e+02; Accession=PF00560.23; Description=Leucine Rich Repeat
  Pfam annotation: Domain name=LRR_1; Domain location=235-258; Score =7.4; E_value=12; Accession=PF00560.23; Description=Leucine Rich Repeat
  Pfam annotation: Domain name=LRR_1; Domain location=55-77; Score=0.6; E_value=2.2e+02; Accession=PF00560.23; Description=Leucine Rich Repeat
  Pfam annotation: Domain name=LRR_1; Domain location=80-111; Score =6.1; E_value=21; Accession=PF00560.23; Description=Leucine Rich Repeat
  Pfam annotation: Domain name=LRR_1; Domain location=9-30; Score=7.8; E_value=9.9; Accession=PF00560.23; Description=Leucine Rich Repeat
  Pfam module annotation: Pfam domain module=LRR_1::LRR_1::LRR_1::LRR _1::LRR_1; Domain location=209-233::235-258::55-77::80-111::9-30
MLPNYEEGDLDFLRLSDAGLSALGQDFPKLHKLGLIRCSSVSSDGLTPLARKCTSLRALDLQVCYVGDQGLAAVGQCCKQLEDLNLRFCHRLTDTGLVELALGVGKSLKSLGVAACTKITDISMEAVGSHCRSLENLSLESETIHNKGLLAVSQGCPALKVLKLHCFDVTDDALKAVGTNCLLLELLALYSFQRFTDKGLRAIGNGCKKLKNLTLIDCYFISDKGLEAIATGCKELTHLEVNGCHNIRNLGLEYIGRSCQEGFALGFVIRKSNSTLGSDSWVDDPITRHIISLYISKEEEPRHLNAYARLCKRPDCGAALGMNDGLSSLLLDLPSVTGAFMVAHAIGDIITGDTVELEVIVTAAPSVGGLFDSLTGEHLSSCKSTYEVFNSEEEEDEEEDEEEDEEEDEAPLSSSLEIKFKTALPSFSVHSISNGSRALLFSFLK

SEQ ID NO: 204074 - protein, 57 aa, Glycine max
  Coding DNA Sequence Number=SeqID_87296
MTFVSLSLTITAHGWMVLWDFRKQWKLFDLEPGPGSLPSGKTQLAPISHQKKEKEMK

SEQ ID NO: 204075 - protein, 183 aa, Glycine max
  Coding DNA Sequence Number=SeqID_87297
MTTFEASPPTKSRICNCKQGLVVCHGVLPLVLAEHTCTDSTIRKSGYQPKDSAAGTGGIHMYRVRVAEHTCTNSVIGKSDYQPKDSSVGTGGIHMRSIQPISHAACTQVLIPPLGKAITNLKIPAGGTGGIHMPSIQPMTHVACIQVLIPPLGKVITNLKILLLALAGYTCHPSSQGAMQHAS

SEQ ID NO: 204076 - protein, 96 aa, Glycine max
  Coding DNA Sequence Number=SeqID_87298
MISAFIQGRNITDNAQIPNEILHHMKCKTRGKHCEIALKMNISKAYDKQPNYRVQFVMRRQANALVHPLARVTTSHACSKVFQYMHSIMYLPTQYE

SEQ ID NO: 204077 - protein, 54 aa, Glycine max
  Coding DNA Sequence Number=SeqID_87299
RSDDEKAERGQKSVDKQLYETACGIGSRFHIAIGALVTHCGVELYGGGCERWGA

SEQ ID NO: 204078 - protein, 471 aa, Glycine max
  Coding DNA Sequence Number=SeqID_87300
  Gene Ontology: Mol. function=transferase activity, transferring glycosyl groups; Cellular component=integral to membrane; Biological process=metabolic process
  Homolog annotation: Hit_ID=Q7XZD0; Match level="QueryCoverage=98%, HitCoverage=97%, E-value=0.0, Identity=67%"; Hit description =Isoflavonoid glucosyltransferase
  Pfam annotation: Domain name=UDPGT; Domain location=9-466; Score= -32.6; E_value=5.5e-09; Accession=PF00201.9; Description=UDP -glucoronosyl and UDP-glucosyl transferase
MDVKERPLKLYFIPYLAAGHMIPLCDIAQFFASRGHHVTIITTPSNAEILHQSKNFRVHTFDFPSEEVGLPDGVENLSAVTDLEKSYRIYIAATTLLREPIESFVERDPPDCIVADFLYCWVEDLAKKLRIPWLVFNGFSLFSICAMESVKKHRIGDGPFVIPDFPDHVTIKSTPPKDMREFLEPLLTAALKSNGFIINNFAELDGEEYLRHYEKTTGHKAWHLGPASLVRRTEMEKAERGQKSVVSTHECLSWLDSKRVNSVVYVSFGSLCYFPDKQLYEIACGMEASGYEFIWVVPEKKGKEEESEEEKEKWLPKGFEERKKGMIIKGWAPQVVILEHPAVGAFLTHCGWNSTVEAVSAGVPMITWPVHSDQFYNEKLITQVRGIGVEVGAEEWNLSAYFQTQKLLPRDRIEMAVRTLMDVSDQALQIRRQAQNFSRIARQAVQVAGSSYNNLTALIHYVKRFRDSAEG

SEQ ID NO: 204079 - protein, 35 aa, Glycine max
  Coding DNA Sequence Number=SeqID_87301
MDASVIAEYDPKSDLLDQEFMLKGKWYQRKDVESH

SEQ ID NO: 204080 - protein, 476 aa, Glycine max
  Coding DNA Sequence Number=SeqID_87302
  Gene Ontology: Mol. function=transferase activity, transferring glycosyl groups; Cellular component=integral to membrane; Biological process=metabolic process
  Homolog annotation: Hit_ID=Q7XZD0; Match level="QueryCoverage=97%, HitCoverage=97%, E-value=0.0, Identity=69%"; Hit description =Isoflavonoid glucosyltransferase
  Pfam annotation: Domain name=UDPGT; Domain location=8-464; Score= -39.1; E_value=1.2e-08; Accession=PF00201.9; Description=UDP -glucoronosyl and UDP-glucosyl transferase
MEPLKLYFIHYPTAGHMIPLCDIATLFASRGHHATIITTPVNAQIIRKSIPSLRLHTVPFPSQELGLPDGIESLSSLIDDIRHFPKVYHAISMLQPPIEQFVEQHPPDCIVADFLFPWVHDLANKLNIPSVAFNGFSLFAICAIRAVNLESSDSFHIPSIPHPISLNATPPKELTQYLKLMLESQLKSHAIIINNFAELDGQDYIRHYEKTTGHKTWHLGPASLISCRTAQEKAERGMKSAVSMQDCVSWLDSKRVNSVLYICFGSLCHFPDEQLYEIACGMEASGHEFIWVVPEKKGKEHESEEEKEKWLPRGFEERNAEKGMIIRGWAPQVIILGHPAVGAFITHCGWNSTVEAVSEGVPMLTWPVHGEQFYNEKLITEVRGIGVEVGAAEWTTTGFGERYQMLTRDSIQKAVRRLMDGADQALEIRRRAKHFQEKAKQAVRVGGSSHNNLTALIHDLIRLRDAKLPSPDTPKG

SEQ ID NO: 204081 - protein, 411 aa, Glycine max
  Coding DNA Sequence Number=SeqID_87303
  Gene Ontology: Mol. function=oxidoreductase activity; Cellular component=periplasmic space; Biological process=electron transport
  Homolog annotation: Hit_ID=O65749; Match level="QueryCoverage=59%, HitCoverage=56%, E-value=3e-94, Identity=52%"; Hit description =Copper amine oxidase precursor
  Pfam annotation: Domain name=AWPM-19; Domain location=14-155; Score =273.9; E_value=3.2e-79; Accession=PF05512.2; Description=AWPM-19 -like family
  Pfam annotation: Domain name=Cu_amine_oxid; Domain location=143-403; Score=117.2; E_value=4.8e-32; Accession=PF01179.10; Description =Copper amine oxidase, enzyme domain
  Pfam module annotation: Pfam domain module=AWPM-19::Cu_amine_oxid; Domain location=14-155::143-403
MASGSKSVASILLVLNLVLYFIVLVIASWAVNHGIQRSGETASVLSIPARIFPIYFPMGNMTTGFFVIFSLVAGVVGFTTSLTGLQNILQWNAPNLHAAAMSSLTTWALTLLAMGFACKEIELGWTDSNLRTLETITIIVSATQLLCTGVIHVGVSEVVAQRMGGRHKSRRVLYKGYISKLFVPYQDPTDDFYYKTFFDSGEFGFGLSTVSLNAICVFEQYGSIMWRHTETGIPNESFAETRMEVNLVLRTVVTVGNYDNWEFKTSASIKPSGVDIKHKSEIKSDRHGTLVSANSIGRNCKDNTCRLSPGELSVVKPNKKTSVGSQIRGAFTNFNVWVTPYNRTEENRDINNKDIVLWHVVGIHHVPAQENFPIMPLLSTAFELRPTNFFERNPVLKTLSPKDVQWPGCPK

SEQ ID NO: 204082 - protein, 232 aa, Glycine max
  Coding DNA Sequence Number=SeqID_87304
  Gene Ontology: Mol. function=RNA-directed DNA polymerase activity; Cellular component=signal recognition particle, endoplasmic reticulum targeting; Biological process=RNA-dependent DNA replication
  Pfam annotation: Domain name=zf-CCHC; Domain location=159-176; Score =26.2; E_value=4.8e-05; Accession=PF00098.13; Description=Zinc knuckle
  Pfam module annotation: Pfam domain module=Retrotrans_gag::zf-CCHC; Domain location=15-102::159-176
GAIGHILNITPEEEKRIESLKREGMIHGDPLVEYWNDFKSAFRKRHIPSYYERELMDKLQRLRQGSMSVEEYRQQMELLLLRVGLRDEERTSIARFLSGLNMEERDKIELLPYKDLDELVQLCIKRILGAAPSKPKEDKGKIIEKSTPKTSSQERTSNIKCFKCLGRGHIASKCPTKKTVIMRGQDIYSSQEDTISSPSSSGSEDEVKGEESSDEVYPHQEGDLLMVRRLLG

SEQ ID NO: 204083 - protein, 113 aa, Glycine max
  Coding DNA Sequence Number=SeqID_87305
MGEVEEVQEKMKADMEAMKEKMATMMEAMMIMKKIMEASAVAVAATSTDAKVNPMPPSGLNQMNHPTSAMVGKNLGSTGGPHDVQIQNEQAFPPYGLPLNYTPPNVAYTPNKN

SEQ ID NO: 204084 - protein, 81 aa, Glycine max
  Coding DNA Sequence Number=SeqID_87306
LRVESQHFATVHDDNPRVASMPYFGVIEEIWENKLNKYFMFKILVMKDDDDSTLDTCLTPFSMQMSSNANGEEEIDDVLAN

SEQ ID NO: 204085 - protein, 172 aa, Glycine max
  Coding DNA Sequence Number=SeqID_87307
  Gene Ontology: Mol. function=protein serine/threonine kinase activity; Biological process=protein amino acid phosphorylation
  Homolog annotation: Hit_ID=Q8W4J2; Match level="QueryCoverage=51%, HitCoverage=15%, E-value=2e-09, Identity=41%"; Hit description =Mitogen-activated protein kinase 16
MSCCYSVLVLYTFVLPYTCVRSSLDLKFINRCFHCVDFKFASFRCGSVASGVAARPGKVVGSILHYNNCGAAVTADAEQRRMGRNPSVSAQYAAPSSSYPRRNPSCKSERAEEVIEGANGLQTKPQHITQKVAAAALGGPGAYQVSWPTRNADQSSELNKDMRGHSIDNIEG

SEQ ID NO: 204086 - protein, 824 aa, Glycine max
  Coding DNA Sequence Number=SeqID_87308
  Gene Ontology: Mol. function=binding; Cellular component=proton -transporting two-sector ATPase complex; Biological process=ATP synthesis coupled proton transport
  Homolog annotation: Hit_ID=Q10L20; Match level="QueryCoverage=88%, HitCoverage=89%, E-value=1e-179, Identity=45%"; Hit description =Expressed protein
  Pfam annotation: Domain name=Arm; Domain location=329-372; Score=3.3; E_value=4.7; Accession=PF00514.13; Description=Armadillobeta-catenin -like repeat
  Pfam annotation: Domain name=Arm; Domain location=589-627; Score =17.9; E_value=0.038; Accession=PF00514.13; Description=Armadillobeta- catenin-like repeat
  Pfam annotation: Domain name=HEAT_PBS; Domain location=359-396; Score= 2.6; E_value=43; Accession=PF03130.6; Description=PBS lyase HEAT-like repeat
  Pfam annotation: Domain name=HEAT_PBS; Domain location=574-611; Score= 7.2; E_value=10; Accession=PF03130.6; Description=PBS lyase HEAT-like repeat
  Pfam annotation: Domain name=HEAT_PBS; Domain location=614-653; Score= 8.6; E_value=6.4; Accession=PF03130.6; Description=PBS lyase HEAT -like repeat
  Pfam module annotation: Pfam domain module=Arm::Arm::HEAT_PBS::HEAT _PBS::HEAT_PBS; Domain location=329-372::589-627::359-396::574 -611::614-653
MEGEGSIHVQVDELQRVRLSETISIGTTMFEPRGLSSIDKLDSNNSTANSVSSTTSAPEKKLTLFALQLAVLEKAATGLGTLGFIWATVVLLGGFAITLEKTDFWFITIILVVEGTRIFSRSHELEWQHQATWSITENHQHQYVSTDTTPTRTPTRMWISSDVPLLPYAKWFFLSRHVSRLLYWLQLLSATACVVLSLIKLVKHDYGEVAKGDTDKRNRKSALSIFYALALAEALLFLMEKAYWEWQVSYCKLLEEVDKECELGSSGMVSTRRFFYDAYSRCVNGSIFDGLKMDMVGFSMDLLASNSPDEQLIGARILRQFSISERFSDDTLQKIGIDISMVERLVEMLNWTDPKEEEIRLSAAEILSKLAGKKQNSLRIAGIPGAMESISSLLQTNRSVIPAADEIGENKLLFDHQNYGFWTFNHLGLLILKKLARDLDNCGKIGNTRGLLPKIIDFTRAEEWLLKSENVTPSQVLTLKRSLQLVKMLASTDGTTGKHLRREISEIVFTISYIRDILRYGEKHPLLQKLSIEILTSLALEEDATERIGGTGGVLKELFNIFFKHNIPENQKHVKIVAGEALAMLALESKSNCHRILKLKVLERLVEALKDPLLRVNAARILRNLCTYSGSEWFIQLKGVTAAAPVILQAIISEENKIQEVIVGLAGNVFRYMTSHESSIVFEEAGITEAELANKLVQILKKHQYPPTKVPRIRRFVIELAIWMMKDKAENIDTYKGLGMDEVLEGVLETTSELESFNVFSGTVGLNRHTLTTQSLVEMALKLMEDSYPRWPRETNVATCKCADTLNRKFSKKTDMFAAAEKMA

SEQ ID NO: 204087 - protein, 66 aa, Glycine max
  Coding DNA Sequence Number=SeqID_87309
MALPQLQHAQNLLCSAPSSWLPKDKDRQSSKVRLIKLLGAQSFLSEHEDEHKKLLGKFLGYYSNMY

SEQ ID NO: 204088 - protein, 105 aa, Glycine max
  Coding DNA Sequence Number=SeqID_87310
MRLPQEPLNKKPRGLARKNMAETNSVELCGAATEELAACSRSKRSLSQRLCETETNMLAIVSKYKEELNLATAHEHKVADEYARVYAEKETRGRVIDSLHQEATM

SEQ ID NO: 204089 - protein, 341 aa, Glycine max
  Coding DNA Sequence Number=SeqID_87311
  Gene Ontology: Mol. function=protein dimerization activity
  Homolog annotation: Hit_ID=Q1S735; Match level="QueryCoverage=82%, HitCoverage=100%, E-value=3e-25, Identity=40%"; Hit description =Probable transposase [imported]-Arabidopsis thaliana-related
MPSTEVPSSQKASTPNTSHNVKQKNDPAWGHCKQIDEGYTKVTMMCIYIVKNRLREVVLIGSRLTWLDKKAKLRLCKKVLVNVQHQMKQLLEQNDKNKKRKMQEQFEESNTFNEDLVRIVEDLRRTPKSSVSAKSQKGKNTPRVDDYFMPITTPRAQPSLKSVLQSKEVVEKCDKAIAKWMIDASMSFNVVNSTFYQPMIDAISSMGLGDYFHKHIGPEGCIESYNGIRDWAGSTYAKDFKAEKFVEQILDSGFWKQFNVEEFDKHKNTQPSILEPINRYTHEDPEVQDKLNEGMRIYKNTKGDFARRATVREQNTIMPVLRVVKEIEVYLNIFILIKGIG

SEQ ID NO: 204090 - protein, 46 aa, Glycine max
  Coding DNA Sequence Number=SeqID_87312
  Gene Ontology: Mol. function=beta-galactosidase activity; Cellular component=beta-galactosidase complex; Biological process =carbohydrate metabolic process
  Homolog annotation: Hit_ID=Q4QYX3; Match level="QueryCoverage=93%, HitCoverage=5%, E-value=6e-15, Identity=75%"; Hit description=Beta -galactosidase
MWTENWTGWFKNWGGPIPHRIARDVAFAVTRFFQYVGVFQNYYMVT

SEQ ID NO: 204091 - protein, 139 aa, Glycine max
  Coding DNA Sequence Number=SeqID_87313
  Gene Ontology: Mol. function=hydrolase activity, acting on glycosyl bonds; Cellular component=beta-galactosidase complex; Biological process=carbohydrate metabolic process
  Homolog annotation: Hit_ID=P49676; Match level="QueryCoverage=96%, HitCoverage=16%, E-value=1e-23, Identity=38%"; Hit description=Beta -galactosidase precursor
MYPLGYQYSQNRQYSFTYEAKIKLKKGTNEISLLSGTIGLPNYGAHFSNVSVGVYGPVQLVALKNNTEVVKDITNNTLNYKVGLHGEIVKLYNPENNKGWNTNGLPTYRVFVWYKALFKSPKGIDLVVVNLKGLKKGQA

SEQ ID NO: 204092 - protein, 400 aa, Glycine max
  Coding DNA Sequence Number=SeqID_87314
  Gene Ontology: Mol. function=cation transporter activity; Cellular component=membrane; Biological process=cation transport
  Homolog annotation: Hit_ID=Q84ND3; Match level="QueryCoverage=98%, HitCoverage=96%, E-value=0.0, Identity=78%"; Hit description=Cation diffusion facilitator 11
  Pfam annotation: Domain name=Cation_efflux; Domain location=113-392; Score=253.8; E_value=3.6e-73; Accession=PF01545.11; Description =Cation efflux family
MGTELRTDSTDYRTELLSPTIAVENVSMARQPSWRINMEEHRLPERRMESHFGFGFFINTLKRQRKLAEYYKRQERLLKGYQEVDSYTDLGMIPGNLTEDEMKELERSERVAIYASNIGNMVLFVAKVYASIESRSLAVIASTLDSLLDLLSGFILWFTAHAMSKPNQHKYPIGKNRMQPVGIVVFASVMATLGLQILFESGREIITKTQPDRDPVKEKWMIGIMVTATLVKVMLMTYCRRFKNEIVRAYAQDHFFDVITNSIGLATAVLAIKFYWWLDPVGAILIALYTISNWAKTVMENVWSLIGKTAPAEYLAKLTYLCWNHHKEIKHIDTVRAYTFGSNYFVEVDIVVSEEMSLSQAHDIGETLQDKLEKLPEIERAFVHMDLNTTHKLEHKTKVG

SEQ ID NO: 204093 - protein, 208 aa, Glycine max
  Coding DNA Sequence Number=SeqID_87315
  Gene Ontology: Mol. function=hydrolase activity; Cellular component =cytoplasm
  Homolog annotation: Hit_ID=Q9LUG8; Match level="QueryCoverage=88%, HitCoverage=77%, E-value=2e-60, Identity=57%"; Hit description =Similarity to endo-1
  Pfam annotation: Domain name=DLH; Domain location=14-207; Score=-7.9; E_value=9.9e-07; Accession=PF01738.9; Description=Dienelactone hydrolase family
MGCFILLNCCLCLLSFSLFMILNAKNIADKVAATGYYVVVPDFFNGEPYDPENVKRPKDVWLKDHNPEKGIEVAKPVIEALKSKGVSAIGAAGFCWGAKTVTNLGKSKHIQVSVLLHPSYIIVDDIRGVEIPIAILGAENDRVAFPPKLAEQFRQALKAKPQIDSYVKIFPNVSHGWTVRYDPKDPKAVEAADKAHQIMIGWFHKHLK

SEQ ID NO: 204094 - protein, 102 aa, Glycine max
  Coding DNA Sequence Number=SeqID_87316
MQRESQSESVDVQIGDRLEEMICDLGKESFQQAHASMYDTLQSDSKKRLYLRRKKSLTLLSMVLSLVMSRPDIGGVTKASLHFFRWCRICFQRKTRCQKITI

SEQ ID NO: 204095 - protein, 70 aa, Glycine max
  Coding DNA Sequence Number=SeqID_87317
  Subcellular localization annotation: CTP_CleavageSite=32; ConfidenceScore=5.69e-01
GGETSSSTESNGGSQNVRSSIPILPNSSSSLVSMTYSPSFNSSQLVAQRKLFAESQIGRTSFQRLLEPNS

SEQ ID NO: 204096 - protein, 74 aa, Glycine max
  Coding DNA Sequence Number=SeqID_87318
  Subcellular localization annotation: CTP_CleavageSite=59; ConfidenceScore=5.17e-01
MERSLSKYKLKYYYYKLFCIITTTKAAYYVSNSTTVSKKRRRSSTGGISVIKGFRTTTFAATRRRHPAVVAIRI

SEQ ID NO: 204097 - protein, 209 aa, Glycine max
  Coding DNA Sequence Number=SeqID_87319
MTDLVSAEDNVNHHVSMGLSAAIDEGFSSYRQQKVYTDNHSGISARQRDSKVSMTDLVSAEDYGAEDDVSLCVLSSFSSYRQQKVYTDNHSGISASQRDSKVSMTDLVSAEDDGAEDDVSLCVLSSFSSYRQQKVYTDNHSGISARQRDSKVNMTDLVSAEDDGAEDDVSLCVLSGFSSYRQQNVYTDNHSGISARQRDSKVSMTDLVS

SEQ ID NO: 204098 - protein, 525 aa, Glycine max
  Coding DNA Sequence Number=SeqID_87320
  Gene Ontology: Mol. function=metal ion binding
  Homolog annotation: Hit_ID=Q60D31; Match level="QueryCoverage=48%, HitCoverage=87%, E-value=1e-76, Identity=58%"; Hit description =Putative mandelonitrile lyase, related
  Pfam annotation: Domain name=zf-C3HC4; Domain location=295-353; Score= 2.1; E_value=0.097; Accession=PF00097.15; Description=Zinc finger, C3HC4 type (RING finger)
GFNGGALVASEIKTPLEMRVEELGLLCYSGKIAKTGSLCCVASRPHESNAGSRDWSMGPNEPYWRTNSSYSPPPTRWDFRFQSEGLPYDVNDGVQLYGSSTSSIDKESRGWVRGNHLYDLHYSASDDTGIFLSSPSDLSQGPQWTPPAIQEISIDNYETSTRKDSHPSVDRVSFTPNKEGTSVNPNSGGSTSSQSESSESESTAKSRLSSQRNFSNLRSFMSKPIHPMSFNDLTTTRDAFDPAVTDFTEFDTSTPLRDGHRWSSASSSQEFADITESFELETPGRSHFLSDGFRCGLCERFLTQRSPWSSRRIVRSGDMPTIGVLPCCHAFHAECLEQTTPKTQKSDPPCPVCVKLEEENSPDQRGHLRLRTGFPRLKSSRDDGPSRPWGCVQVGDCVEGALHAPPRNTMLLLNRNRIKKNLSLKGNIGKEFPGKMRKNGTFSSHLFSGSSADGEAVGSSKATAGPSVWRFFFYLHYGRLSGSHLPSSGTGTGTDIASPSSGINAKAGQFGTEAAQILDFFTLII

SEQ ID NO: 204099 - protein, 70 aa, Glycine max
  Coding DNA Sequence Number=SeqID_87321
  Gene Ontology: Mol. function=methyltransferase activity; Biological process=metabolic process
  Homolog annotation: Hit_ID=Q6Z2U2; Match level="QueryCoverage=90%, HitCoverage=21%, E-value=6e-15, Identity=57%"; Hit description =UbiE/COQ5 methyltransferase-like
MDTSNRNGTFLKFMQRVLDPLQQTLADGCHLSRETGNDISRAGFSSVELNTAFLSSATFINPHAYGIAYK

SEQ ID NO: 204100 - protein, 262 aa, Glycine max
  Coding DNA Sequence Number=SeqID_87322
  Gene Ontology: Mol. function=methyltransferase activity; Biological process=metabolic process
  Homolog annotation: Hit_ID=Q6Z2U2; Match level="QueryCoverage=86%, HitCoverage=69%, E-value=1e-40, Identity=41%"; Hit description =UbiE/COQ5 methyltransferase-like
  Pfam annotation: Domain name=Methyltransf_11; Domain location=127 -235; Score=44.6; E_value=3.5e-10; Accession=PF08241.2; Description =Methyltransferase domain
  Subcellular localization annotation: CTP_CleavageSite=18; ConfidenceScore=5.10e-01
MKPHTSLARFRSESTRTRQSNSAPSFSPMTRWNPPPNHASVEEDTSLKLQHWELPYFQYNPPEPPTHHALLKKFHPPRPDWYEEFYASVMNSATKDYEAEFGVFPCKVAMYKSQIFGNLKGKGLRILEIGIGTGPNLSYYASGSGVEVVGIDPNPKMEKYARSSAASAGLPTSNFEFIQAMLSMIVVIGAYQVGEAIPLSDASVDAVVGTLVLCSVKDVDMTLKEAEKRGKKLWMFLNEKGDQNHNKHCITFEDTYLSSSTL

SEQ ID NO: 204101 - protein, 193 aa, Glycine max
  Coding DNA Sequence Number=SeqID_87323
FQRREGFMITSFYDTNYVGDKVERKNTIGSYNFIDGNLPSYPPRIHIRPTIIIEFMLDCITSRLPPLDLRKKKGKFPPCNKPMPHPSPKDNIALHPIPYNWRVKKLQESSLKESRFKNNQDQDSRLKIQDSREEIEKQQSRLHKGSIFQNSKYSTVEAKLHGESKMMTKEMTKSSKINQRTTQVNQEQLKSSR

SEQ ID NO: 204102 - protein, 186 aa, Glycine max
  Coding DNA Sequence Number=SeqID_87324
  Gene Ontology: Biological process=response to brassinosteroid stimulus
  Homolog annotation: Hit_ID=Q67X40; Match level="QueryCoverage=97%, HitCoverage=98%, E-value=3e-47, Identity=51%"; Hit description =Integral membrane family protein-like
  Pfam annotation: Domain name=DUF588; Domain location=22-171; Score =190.2; E_value=5e-54; Accession=PF04535.3; Description=Domain of unknown function (DUF588)
MKGGSIEVGEVSKDASPRKGVARGLSIMDFILRIIAAVATLGSALAMGTTNETLPFATQFIKFRAEFDDLPSLVFFVMANAVVCGYLVLSLMISVFHILRSTAVKSRILLVALDTVMLSLVTASASAATSIVYIAHNGNTGANWFAICQQYNNFCERISGSLIGSYIAVALFIILIMLSLVAISRN

SEQ ID NO: 204103 - protein, 65 aa, Glycine max
  Coding DNA Sequence Number=SeqID_87325
MSNEELKLQDPRIHDVGYNIFSEEDRSPPAQAVAAQKRKLLYNHGGCTSSAPSPGSKSYFVSFGT

SEQ ID NO: 204104 - protein, 72 aa, Glycine max
  Coding DNA Sequence Number=SeqID_87326
MKKILGLQAPHGASSQMLKSEATKLQFRNALLCALSEKDYTMWNITYERKRRCKRNRIILQGRLAKARYKPL

SEQ ID NO: 204105 - protein, 102 aa, Glycine max
  Coding DNA Sequence Number=SeqID_87327
  Gene Ontology: Mol. function=DNA binding; Cellular component=nucleus; Biological process=regulation of transcription
  Homolog annotation: Hit_ID=A0FK20; Match level="QueryCoverage=84%, HitCoverage=20%, E-value=2e-26, Identity=63%"; Hit description=Myb transcription factor
  Pfam annotation: Domain name=Myb_DNA-binding; Domain location=44-90; Score=55.0; E_value=2.6e-13; Accession=PF00249.21; Description=Myb -like DNA-binding domain
MTAEDRSAEENVRNGVAAKDLGGKEKDIAEVTSAAEGLVAGSVKGPWSPEEDALLSRLVAQFGARNWGMIARGVPGRSSKSCRLRWCNQLDPCLKRKPFTGN

SEQ ID NO: 204106 - protein, 138 aa, Glycine max
  Coding DNA Sequence Number=SeqID_87328
  Pfam annotation: Domain name=Yos1; Domain location=64-138; Score =135.0; E_value=2e-37; Accession=PF08571.1; Description=Yos1-like
  Subcellular localization annotation: CTP_CleavageSite=50; ConfidenceScore=5.04e-01
MWSEKRCALASLWLCLIIGYHLLSSLIPPSTSSPPPPPPPPSTDSFFAPSSGTLRKCPQQKMGLWTLLEGFLLLANALAILNEDRFLTPRGWGLSDFSAGQTKSFKGQLIGLIYATQYLRFPLILLNSVFIIVKLVSG

SEQ ID NO: 204107 - protein, 509 aa, Glycine max
  Coding DNA Sequence Number=SeqID_87329
  Gene Ontology: Mol. function=zinc ion binding; Cellular component =integral to membrane; Biological process=peroxisome organization and biogenesis
  Homolog annotation: Hit_ID=Q8LAE3; Match level="QueryCoverage=85%, HitCoverage=97%, E-value=1e-178, Identity=70%"; Hit description =Proline transporter 1
  Pfam annotation: Domain name=Aa_trans; Domain location=95-495; Score =322.1; E_value=9.8e-94; Accession=PF01490.8; Description =Transmembrane amino acid transporter protein
MECLLLLAASKSKEQKPFLYLINCLHKPRGKKRKTNSNTSRSAHSGQKVTLAVKNVSAAAEEEEEAEAEEEHMTLISDVENLADAEIPDTAHQISTDSWFQVGFVLTTGINSAYVLGYSGTIMVPLGWAGGVVGLILATAISLYANALIARLHEYGGTRHIRYRDLAGFIYGRKAYSLTWALQYVNLFMINAGYIILAGSALKAAYVLFREDDGMKLPYCIAIAGFVCAMFAICIPHLSALGIWLGFSTVFSLVPPHTWYSCSSWKHLQHGIKSPPGDYSIPGTSTSKIFTTIGASANLVFAYNTGMLPEIQATIRQPVVKNMMKALYFQFTVGVLPLYLVTFAGYWAYGSSTATYLMSDVNGPVWAKAMANIAAFLQSVIALHIFASPMYEYLDTKYGIKGSALAFKNLSFRVLVRGGYLTVNTFVSALLPFLGDFMSLTGAISTFPLTFILANHMYLVTNENKLTSTQKLWHWINICFFALMSAAAAIAALRLIDLDSKTYHVFADL

SEQ ID NO: 204108 - protein, 409 aa, Glycine max
  Coding DNA Sequence Number=SeqID_87330
  Gene Ontology: Mol. function=nucleotide binding
  Homolog annotation: Hit_ID=Q1S5H0; Match level="QueryCoverage=97%, HitCoverage=75%, E-value=0.0, Identity=78%"; Hit description=Plant protein family, putative
  Pfam annotation: Domain name=DUF246; Domain location=15-360; Score =563.2; E_value=2.6e-166; Accession=PF03138.5; Description=Plant protein family
MSDKRKENFTNGYLMVHANGGLNQMKTGISDMVAIAKIMKATLVLPTLDHNSFWTDSRYGLSSTDFKQIFNWKNFIEVLKDDIQIMESLPPEFAAIKPVLKAPAGYYEGEMLQLLKKNKVIKFTHTDSRLVNNGLATPIQRVRCRAMYEGLRFTVPIEELGMKLVNRLRDNNTPYIALHLRYEKDMLAFTGCSHNLTQDEAVELKKMRYKVKHWKVKEIDGKSRRLRGSCPMTPREVAVFLEALGYPHDTKIYVAAGMIYGKDAMKPLQSKYRHLLTHSTLATKEELLPFMGHQNQLAALDYFIAVESDVFIYSYDGHMAKAARGHRAFEGFRKTITPDKQKFVRLIDQLDNGLISWDEFSSKVKSIHANKNGGPHNRKVNRHPKLEESFYANPYPGCICERRETTTTM

SEQ ID NO: 204109 - protein, 181 aa, Glycine max
  Coding DNA Sequence Number=SeqID_87331
  Gene Ontology: Mol. function=sugar porter activity; Cellular component=membrane
  Homolog annotation: Hit_ID=Q9C770; Match level="QueryCoverage=75%, HitCoverage=40%, E-value=1e-68, Identity=90%"; Hit description =Integral membrane protein, putative; 85705-84183
MSATRKKIANKQDWEEYPAGNDDAGDDGDEGEIGEPGLALEGHDVSENGGEEGSGGADGLVKRDGEVAERDVAEDDGEAEDEAEGGDLEELEAGADGLHGDHLEPGDGDVAEEGASGHVTHGEEDRVLEAIVAKEVLVQEQHPNVRRVPRRHKPDPQQTPRRLHFPSPPQSGSENNNIAHH

SEQ ID NO: 204110 - protein, 160 aa, Glycine max
  Coding DNA Sequence Number=SeqID_87332
  Gene Ontology: Mol. function=structural constituent of ribosome; Cellular component=ribonucleoprotein complex; Biological process =translation
  Homolog annotation: Hit_ID=Q9LMK0; Match level="QueryCoverage=69%, HitCoverage=100%, E-value=1e-54, Identity=88%"; Hit description=60S ribosomal protein L35a-1
  Pfam annotation: Domain name=Ribosomal_L35Ae; Domain location=60-154; Score=169.1; E_value=1.1e-47; Accession=PF01247.8; Description =Ribosomal protein L35Ae
MEWALQKNPSRPAPFDSVYKNPETDITTPSAELSRREKEEQEASPLPNMVKGRQGERVRLYVRGSILGYKRSKSNQYPNTSLIQIENVNTKEEVAWYCGKRMAYIYKAKVKKDGSHYRCIWGKVTRPHGNSGIVRAKFKSNLPPRSMGARVRVFMYPSNI

SEQ ID NO: 204111 - protein, 290 aa, Glycine max
  Coding DNA Sequence Number=SeqID_87333
  Gene Ontology: Mol. function=hydrolase activity, hydrolyzing O -glycosyl compounds; Cellular component=membrane; Biological process =carbohydrate metabolic process
  Homolog annotation: Hit_ID=Q1S5H4; Match level="QueryCoverage=90%, HitCoverage=58%, E-value=1e-119, Identity=78%"; Hit description =Glycosyl hydrolases family 17, putative
  Pfam annotation: Domain name=Glyco_hydro_17; Domain location=1-263; Score=136.5; E_value=7.2e-38; Accession=PF00332.9; Description =Glycosyl hydrolases family 17
  Subcellular localization annotation: CTP_CleavageSite=33; ConfidenceScore=5.13e-01
MVTSIAQNRSVAQSWLYTHVVPFYPRVKITTISVGNAFPDVYPNSVNDLLPAISNVHVSLRDLGIRNIKVSTSFSFVTALTSPFPPSNAQFQEPNGATLFGPLLQFLHDTNSSFLINLYPYNLYRLNPEIPLGIALFQEHPFNFRDDFTTGVRYRNLFDVMVDAVVSALAVAGYETVPIIVTETGWPSSSAAANEFDANLGYAEIYLKGLVKHLKSGMGTPLLKDGVTEVFVYEMFDKEEGTTGRSWGVLYPNGTAKYHRVDFSCSSVASGSLHIAVMIIIFFLSLLVIV

SEQ ID NO: 204112 - protein, 185 aa, Glycine max
  Coding DNA Sequence Number=SeqID_87334
  Gene Ontology: Mol. function=adenylosuccinate lyase activity; Cellular component=cytoplasm; Biological process=purine ribonucleotide biosynthetic process
  Homolog annotation: Hit_ID=Q8VZX0; Match level="QueryCoverage=99%, HitCoverage=39%, E-value=2e-86, Identity=78%"; Hit description =Adenylosuccinate-AMP lyase
  Pfam annotation: Domain name=ASL_C; Domain location=60-163; Score =214.0; E_value=3.5e-61; Accession=PF08328.2; Description =Adenylosuccinate lyase C-terminal
MAKLFHLLIQFNNILIDFDRDVWGYISLGYFKQTTKAGEIGSSTMPHKVNPIDFENSEGNLGVANGGIGHSLLAYKSTLQGIGKLQVNEACLSEDLNHCWEVLAEPIQTVMRRYGVPEPYEKLKELTRGRAVTKESIRDFIKGLDIPEEAKSNMLKLTPDTYVGAAVELARTVENVVNTVIGIKI

SEQ ID NO: 204113 - protein, 311 aa, Glycine max
  Coding DNA Sequence Number=SeqID_87335
  Gene Ontology: Mol. function=adenylosuccinate lyase activity; Cellular component=cytoplasm; Biological process=purine ribonucleotide biosynthetic process
  Homolog annotation: Hit_ID=Q8VZX0; Match level="QueryCoverage=100%, HitCoverage=59%, E-value=1e-149, Identity=84%"; Hit description =Adenylosuccinate-AMP lyase
  Pfam annotation: Domain name=Lyase_1; Domain location=84-310; Score= -35.7; E_value=3.9e-07; Accession=PF00206.10; Description=Lyase
  Subcellular localization annotation: CTP_CleavageSite=46; ConfidenceScore=5.84e-01
MEFTALSNATQLGSFNPLRTNLQSSTQHFLPFSYASFPSSSRRGCSCKAVLSTHTPTSTHNNMFGPRSIDFELSALTALSPLDGRYWSKVKELAPFLSEYGLIYFRVLVELSVIPEIVEVPSFSDGAKSFLEGLIDNFSVEDALEVKNIERVTNHDVKAVEYFLKHKCQSNAEVAKVVEFFHFACTSEDINNLAHALMLRETMNSIMFPVMDKIIKALCDMAKDNAHVPMLSRTHGQPASPTTLGKEMAIFAARLSRERKDLSQVEIVGKFAGAVGNYNAHIVAYPDVNWPHIAEQFVHSLGLSFNPYVAQ

SEQ ID NO: 204114 - protein, 65 aa, Glycine max
  Coding DNA Sequence Number=SeqID_87336
MTLWIVGFGDPIEGGKLVTVCDSKDTAHGNDEGEGENHVRSKGFQLGKVKEQNDEKKFDARRRGS

SEQ ID NO: 204115 - protein, 56 aa, Glycine max
  Coding DNA Sequence Number=SeqID_87337
MMGVKYLGAVKRRLHSTKQWSPGEIRGVPTEGGAFWWKQPSSPGRAGWQPPPSFLL

SEQ ID NO: 204116 - protein, 240 aa, Glycine max
  Coding DNA Sequence Number=SeqID_87338
  Gene Ontology: Mol. function=pantoate-beta-alanine ligase activity; Cellular component=cytosol; Biological process=pantothenate biosynthetic process
  Homolog annotation: Hit_ID=Q8ZBK7; Match level="QueryCoverage=67%, HitCoverage=57%, E-value=4e-63, Identity=73%"; Hit description =Pantoate--beta-alanine ligase
  Pfam annotation: Domain name=Asp_decarbox; Domain location=164-240; Score=91.7; E_value=2.3e-24; Accession=PF02261.7; Description =Aspartate decarboxylase
  Pfam annotation: Domain name=Pantoate_ligase; Domain location=1-161; Score=113.4; E_value=6.7e-31; Accession=PF02569.6; Description =Pantoate-beta-alanine ligase
  Pfam module annotation: Pfam domain module=Asp_decarbox::Pantoate _ligase; Domain location=164-240::1-161
GASRPGHFRGVATIVSKLFNLVQPDIACFGEKDFQQLAIIRKMVADMGFDIDIVGVPTVRAKDGLALSSRNGYLTSDERKLAPVLSQVMNSMAQRLSNGERHVDEIIEHAEQTLRDQGLRPDGLAICDADTLQPLTVDSQRAVILMAAWLGNARLIDNQQVDLTADLHYEGSCAIDQDFLDASGILQYEAIDIYNVTNGQRFSTYAIAAERGSKIISVEDEVARSWQPKVAYFDGDNEMK

SEQ ID NO: 204117 - protein, 258 aa, Glycine max
  Coding DNA Sequence Number=SeqID_87339
  Homolog annotation: Hit_ID=Q3KBE5; Match level="QueryCoverage=94%, HitCoverage=5%, E-value=1e-18, Identity=33%"; Hit description =Filamentous haemagglutinin-like precursor
RWGSDGSIVLADSHYSTIGTVTTTTEWKGDRVITVDGSLDLWGDESWVGKPVADLARELGMTESDVCDSGPYCGPAPRLVDKEGSLAWWGDESWVGRPATELGAEMGMSEEEICAAMGYCYGGGTLTEVTTYGKRLGAPAWSVLRTGKGDLALLAAQDVRMKSGFGVYTAGAPTALGDGRDTQFTPGRAPVPRNTALLGPVQASGRYDAAIATYQAWYPDQGGNLHVQAGRDITGDTWSARAEAGTPQRDQAGHSSAA

SEQ ID NO: 204118 - protein, 258 aa, Glycine max
  Coding DNA Sequence Number=SeqID_87340
  Homolog annotation: Hit_ID=Q8TGM5; Match level="QueryCoverage=15%, HitCoverage=61%, E-value=2e-07, Identity=70%"; Hit description =Uncharacterized protein ART3
LGRNLPPDWGCIPKQPDSPTAPRGATGSGHDGALTLSGAPFQGTWARSATEDASPDYNSDAEGDRFSWWAFPGSLAVTKGILRVAPPDLRSRWERACTQRVVDGSRTDRLARDWSRAWLIHHFITAKSAMNPDFNQPRGGRALGLMASGATCVQRLDGSRDSAIHTKYRISLRSSSMQEPRYPLPRVIDEEAGRTGRRGHPLPPDGIDNDPSAGSPTETLLRLLLPLNDKVQWTSHNVAGSEPLTSPQSEHFTGPFNR

SEQ ID NO: 204119 - protein, 83 aa, Glycine max
  Coding DNA Sequence Number=SeqID_87341
MAAALSLARDPYKVALLPPVQLCFRVYTDVKIALSREFNIGYLNTDVKLAMAKGLFDHVVEGLVMYFMRAEEELGHIVEVSTT

SEQ ID NO: 204120 - protein, 296 aa, Glycine max
  Coding DNA Sequence Number=SeqID_87342
  Homolog annotation: Hit_ID=Q47522; Match level="QueryCoverage=14%, HitCoverage=53%, E-value=9e-19, Identity=100%"; Hit description=LacZ protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPEFDRVERANRTLQDRLIKEMRLKGICSIEQANVWLPYQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 204121 - protein, 192 aa, Glycine max
  Coding DNA Sequence Number=SeqID_87343
  Subcellular localization annotation: CTP_CleavageSite=32; ConfidenceScore=5.35e-01
MPKTQVKNQESSKFQESKSRSINASFKNQRVVQSMQVSRIKESFNQSKFQESKSCSIKIQDSRYILCGTSRGYIYLGCNTENKRGYISCGSVQVEGTSTWLFKENKGGYIPCGSLLVKDFTRFVVAFREEFYKLYLPNLGDIKERNYCLLSFGILRPSTKLDRTTYFSILAMTILDEIEGKVINIDSIESGL

SEQ ID NO: 204122 - protein, 101 aa, Glycine max
  Coding DNA Sequence Number=SeqID_87344
MEPMQIAGGNGAFPVNATAGHGVAINDGVLLEVGLASQTGELMLGHCLPSLRVQQEVAERDRLLQMKAPVPLAIWAAVGSSQWHWRFEVDVAIPNGDFSPL

SEQ ID NO: 204123 - protein, 338 aa, Glycine max
  Coding DNA Sequence Number=SeqID_87345
  Pfam annotation: Domain name=Transposase_23; Domain location=223-291; Score=-4.6; E_value=0.0036; Accession=PF03017.5; Description =TNP1ENSPM transposase
KQVPTAQKDLIWEDIQAKFDIPEASDRTKKKILQTVGEQWRQFKSDLTSKWVLAADKDSVDDTVCEKYDISKEKWAPVLLDPQRPLLGGCAEKGTGHLEAKHRPPRVVSWGTEVVIHPLSPIKRHMKWKMTRTKKTGQMTSEATKEIVEKILSHFQLRIDLLTTAIGRPEHLGHMCVAGAAANSTNQGPAGGVDHRKSDLADDVILQLDPVSVSVTDSIIGTCTVSTKRSCVDPSMTDPDTGRVYEGSITIHNIPLLHDQVKVGVEEVKDADAHIHVPTDEVNLVGQALNTFLAWPTHLVKHLSEQGTVGPTKPVDRLDHEVMWDATVFGVFNQDFPL

SEQ ID NO: 204124 - protein, 175 aa, Glycine max
  Coding DNA Sequence Number=SeqID_87346
MKVSVAEAKPFGGVDSGVEGEEERVVELLVPDLGNERKDVVAGELRMDPMDGNPTTTGGGRLGLAVIGEVDGNNGKRSQQGCGVCFMSAGWGGGIGIGGGVGMGVCVGSAFAKEEDGRCWLVNRVSIFRRRRSSLAAMEAWVTTRSAMAASRRSKHSEESSSFAIGVLNESTKLL

SEQ ID NO: 204125 - protein, 276 aa, Glycine max
  Coding DNA Sequence Number=SeqID_87347
  Homolog annotation: Hit_ID=Q53LP7; Match level="QueryCoverage=61%, HitCoverage=61%, E-value=8e-08, Identity=27%"; Hit description =Expressed protein
MLDPRRDQPTISFPLSNEIGHITHGYDTWGATNTDFMASKKRPKNYKICHSYNNDMEVQLGTGSKVDDDESGICSPPLWTTSPPKSPHQCKNHYRCLSPASKTQAIARGQRELMEMVKSMPESSYELSLKDLVEHPRVEVAQEKGAEERKNLGDKNVDSRKKVDMNIKKGQVKRSGNIDSGGFYLKMVFPISLGSKKKTKNESLVNSGSNKVSPRTSVSDHGSKSLDKEWWKKKSLSGSGGESDSGVSSINSGSMKSSGSNNSSSSSRSNSRMENN

SEQ ID NO: 204126 - protein, 111 aa, Glycine max
  Coding DNA Sequence Number=SeqID_87348
MVFHLRLVMSFKTKKGDIGSKGLSKELIQGRLIWLETYKNKMPKSSPNMHVKQEVSTRVKPRLLCKQSMGQNTPNKIDDDGSKSHQGEKQGFQFTKCQELLFQKTLPITGT

SEQ ID NO: 204127 - protein, 77 aa, Glycine max
  Coding DNA Sequence Number=SeqID_87349
MRECGFYVMYWISRIILGGFKDNWETILMMSRRIKNLLEKGGESLIQDFFKIKPCLTMKGFKSFKAHVIDYQWLESV

SEQ ID NO: 204128 - protein, 99 aa, Glycine max
  Coding DNA Sequence Number=SeqID_87350
VFATRDDVLNWAQAVAYEIGFVAVIMRKTDFVRRDTGSHNHEMAKSLVGHSYAGSDTEMQQLMKLLEQDQYIHWHRLKDEEVVRNIFWCHPDAVKLSNA

SEQ ID NO: 204129 - protein, 359 aa, Glycine max
  Coding DNA Sequence Number=SeqID_87351
MFSLLQTAEAEKASLEQQRKIDELEAQLNEAEDIVTDLRAELKLVYLELETARNNQVQPLNGQNEKQVVTFQESAKPEISISSPHKELECVTSCDVANKSLTMNVLDNKCCNSKQQTEQLCIYNLEDSCGHNSDFASIITRSKEPELRRNGFTQRVRALEGNLLDEKLLKQDVHNQHYGKKLGIIAKDSNGQVAKYSALTEKMEIKKHVKHHKIPKRKIYSYYWSRFLSSCKIHLNDNCKSSKGVCFLPSIKLGAISKWKSKRRRHRHLGMKSFAFRSCKPSFFLKQCSSVCNNEKCCEDESGAKMKSLPPLTDVEPVHRTIGVTESIQAVNKFELVEKAIEKDSELLNLEENAAQNLT

SEQ ID NO: 204130 - protein, 167 aa, Glycine max
  Coding DNA Sequence Number=SeqID_87352
  Gene Ontology: Mol. function=protein binding; Cellular component =integral to membrane; Biological process=defense response to fungus
  Homolog annotation: Hit_ID=Q1SWI7; Match level="QueryCoverage=97%, HitCoverage=70%, E-value=4e-42, Identity=36%"; Hit description =Leucine-rich repeat
  Pfam annotation: Domain name=LRR_1; Domain location=119-138; Score =5.0; E_value=33; Accession=PF00560.23; Description=Leucine Rich Repeat
  Pfam annotation: Domain name=LRR_1; Domain location=149-167; Score =9.1; E_value=5.5; Accession=PF00560.23; Description=Leucine Rich Repeat
  Pfam annotation: Domain name=LRR_1; Domain location=22-44; Score =10.7; E_value=2.8; Accession=PF00560.23; Description=Leucine Rich Repeat
  Pfam annotation: Domain name=LRR_1; Domain location=46-69; Score =11.8; E_value=1.8; Accession=PF00560.23; Description=Leucine Rich Repeat
  Pfam annotation: Domain name=LRR_1; Domain location=71-94; Score=6.0; E_value=22; Accession=PF00560.23; Description=Leucine Rich Repeat
  Pfam module annotation: Pfam domain module=LRR_1::LRR_1::LRR_1::LRR _1::LRR_1; Domain location=119-138::149-167::22-44::46-69::71-94
  Subcellular localization annotation: CTP_CleavageSite=16; ConfidenceScore=5.09e-01
MLDFSNNLIGGALPISFGKLSSLRYLNLSINKFSGNPFESIGSLSKLSSLRIDGNNFQGVVKEDDLANLTSLKEFHASGNNFTLKVGSNWLPSFQLTYLDVGSWQLGPSFPSWIQSQKKLKYLGMSNTGIIDSIPTQMWEAQSQDKPMQLEILNLASNNLSGEIPDC

SEQ ID NO: 204131 - protein, 144 aa, Glycine max
  Coding DNA Sequence Number=SeqID_87353
MGSLAAILRAVREEEAKAPEESKEVQAIKVELEKTQAVKEKFKAWKEEHDRNKFRGALWGSNSELKLRRDERDQSRVEGLILKDELKACIRSKRSLSQQLSETEGNMLAIIDKYREELNLATAHEHRLVDEYAKVSVEKEARGR

SEQ ID NO: 204132 - protein, 125 aa, Glycine max
  Coding DNA Sequence Number=SeqID_87354
PKPLGVFYPIPLGGRIASWTLNLLTFSSTKGIKAAKQDLKKASEEKEKKKFKERFRISRLKITSRLKYMMRLQHVDYFELLMIEKMEELVRIHKEEYKVLMGCLETISKRLDATGSPHLDYIPSP

SEQ ID NO: 204133 - protein, 120 aa, Glycine max
  Coding DNA Sequence Number=SeqID_87355
MVSTTLLMESSFLDLNFNKLPIKHKQTTQRSSAKVTNYDIMIFLGYPTFGCLARHPKINVRPYLSICYHIPRIGKTSIFLFRARGSRCFGTVMWVVAMVVPRLWLCGDGVGMREGGHGDL

SEQ ID NO: 204134 - protein, 125 aa, Glycine max
  Coding DNA Sequence Number=SeqID_87356
  Homolog annotation: Hit_ID=Q6CQF3; Match level="QueryCoverage=44%, HitCoverage=59%, E-value=2e-08, Identity=72%"; Hit description =Kluyveromyces lactis strain NRRL Y-1140 chromosome D of strain NRRL Y- 1140 of Kluyveromyces lactis
MVTMLSGAKPEETLVEGRSDTDVQSIAGARGRVLSGRCGCSVEPRHGIESSKWAIFGKQNWRCGMNRKLGYGAQLRANLDPTKGVGRLRQQDGGHGSRNPLRRRGGRCKTQGASPGGAVVGADLG

SEQ ID NO: 204135 - protein, 53 aa, Glycine max
  Coding DNA Sequence Number=SeqID_87357
MGEFICAIARSPPSTTYDGGTWRYVAEVRRPWGRQVGCYCPKPSLANPDPTQA

SEQ ID NO: 204136 - protein, 48 aa, Glycine max
  Coding DNA Sequence Number=SeqID_87358
MVVDDDVIFSVFKKYCKYSPDSENWTSWSEGLNWKSGSMARQSCFQIN

SEQ ID NO: 204137 - protein, 107 aa, Glycine max
  Coding DNA Sequence Number=SeqID_87359
MNIQQRISAKHLKNQSLNLSTKLLGETIVRINVSSITNGERQKRKAKGSEILFLSSFKEIKVHWREVPMEKGTSLPMEKGFKILLFPIIDSLGNPLRILHVVSEHVL

SEQ ID NO: 204138 - protein, 68 aa, Glycine max
  Coding DNA Sequence Number=SeqID_87360
MWLNHPYVCTVMGFSIERCTVSLELDRAGLGYRMSGHRVSCSIELSSTRNICERSLIRIRLNSRDISV

SEQ ID NO: 204139 - protein, 113 aa, Glycine max
  Coding DNA Sequence Number=SeqID_87361
MDEIQGLQNMFKYLLEAESQVGTDKNDENVAGYSVGAGHNIQGLQNMFKYLLEAESQMGTDKNDENVVGYSVGVGHSVPVAAGVGDNRFLHPNPKCNLHLKLVILKYKKFHFG

SEQ ID NO: 204140 - protein, 155 aa, Glycine max
  Coding DNA Sequence Number=SeqID_87362
  Gene Ontology: Cellular component=integral to membrane
  Pfam annotation: Domain name=Rhomboid; Domain location=12-150; Score =21.7; E_value=1.8e-05; Accession=PF01694.12; Description=Rhomboid family
MGSRLYTCTTIGLLGTSLSQLHFVMLIGKLVEEEEGNFALWLSYILTGVGANLVSWLVLPRNTVSVGASGAVFGLFSISVLVKMSWDWRKILEVLILGQFVIEKVMEAAQASTSLSGRGGYALQSVNHIAHLSGALVGVLLVWLLSKVPSDPSDQ

SEQ ID NO: 204141 - protein, 121 aa, Glycine max
  Coding DNA Sequence Number=SeqID_87363
FAGLRSNLADVGGTEERLNQWNEIKLKKEEEDKVELVCPATSLTKATSLYKLRRSLTKAASLYKSSLKKTPACVSIFKTFDHLELEEYGVLSESVQSWKDFCGLHMPLVCPDGAVIAYAWK

SEQ ID NO: 204142 - protein, 142 aa, Glycine max
  Coding DNA Sequence Number=SeqID_87364
  Homolog annotation: Hit_ID=Q1SKD7; Match level="QueryCoverage=78%, HitCoverage=30%, E-value=2e-10, Identity=31%"; Hit description =Ankyrin
MAPKKLSTKRSRRDIAAEGTSATLEFDSHRFRSAEHQQRFEAIKGWSFHSERRVHLRDDEYTDFQEEIPRRHWTSLVTPMAKSDPDIVLEFYANAWPTEEGVWDMRSWVRGQWKVRSASLVREGTGPMGLTRRPLPNYYVYR

SEQ ID NO: 204143 - protein, 49 aa, Glycine max
  Coding DNA Sequence Number=SeqID_87365
MDKPIHLVASLCKDNILRVLIELQVNSCKSHSNLQEALRESKKAPIIVA

SEQ ID NO: 204144 - protein, 228 aa, Glycine max
  Coding DNA Sequence Number=SeqID_87366
  Gene Ontology: Mol. function=protein serine/threonine kinase activity; Biological process=protein amino acid phosphorylation
  Homolog annotation: Hit_ID=Q1STT3; Match level="QueryCoverage=51%, HitCoverage=14%, E-value=8e-12, Identity=36%"; Hit description =Protein kinase; S-locus glycoprotein; Curculin-like (Mannose -binding) lectin; Apple-like
  Pfam annotation: Domain name=PSI_PsaH; Domain location=6-141; Score= -15.7; E_value=0.0011; Accession=PF03244.4; Description=Photosystem I reaction centre subunit VI
  Subcellular localization annotation: CTP_CleavageSite=49; ConfidenceScore=5.63e-01
MASLASLVVVQPSTVKGLAGSSLAGTKLSFKPSRQSFRPKNFRYDHSYVVEQRVEWLESVCLGNWLAVFYKTFLFCLQVELLKATVNQCQLPRSFSSILVTFLLLDLIDIRQFAAGGQDVYVQIDASELEHANEGHKKGGVLVVVTVSLVVVAVAGILIILGSCFRKKSCCNVKDFSIKSNQNNGVQVDDMDLLVFDLSTIAKATSNFTVKNKIGEGGFGLVYRVICL

SEQ ID NO: 204145 - protein, 238 aa, Glycine max
  Coding DNA Sequence Number=SeqID_87367
  Gene Ontology: Mol. function=transition metal ion binding; Biological process=aromatic compound metabolic process
  Pfam annotation: Domain name=Transposase_21; Domain location=6-129; Score=-37.6; E_value=2.1e-11; Accession=PF02992.5; Description =Transposase family tnp2
MYLYIHNLQLASLVVHEEKIHDVINPLIENLTKLWDEGVVVFDGYRNETFKLCAMLFCTINDFPTYGNLSGYNVKGHRSCPICEEDISYVQLKHGRKIVYTRHRPFNGSQEHDSATTIDNVPLENDQVKVVAGLAKPVPWDASVFGVYADNFPLYIKHENLSEIAHDGQCLSISIIQLWILALKGFNDSQCSKSKDAARWIIAKYFTYQRPLEPERMKAIRIQWATYYLKVKNQTLGV

SEQ ID NO: 204146 - protein, 80 aa, Glycine max
  Coding DNA Sequence Number=SeqID_87368
MQQDGGMMERRSKNEGEMERTDLRWKDATENVDRERRGKQHSLDGDKKKGQHERISIAVGAGIDNESGSRESEKEMTENA

SEQ ID NO: 204147 - protein, 46 aa, Glycine max
  Coding DNA Sequence Number=SeqID_87369
MEVWILMDECEEGEMGTAAELVEAHNEGVLVVELSGAMRHHTMRAN

SEQ ID NO: 204148 - protein, 143 aa, Glycine max
  Coding DNA Sequence Number=SeqID_87370
MGIFKWGKATDPNQSICLVRLRKHVFTIWTLTHYETSEWRRVLKIRVKAMVKDHPIIRVKGYAVLNGDLLVFATEKKVYGCGLNDMRIQEICDHEFDFNVLRFTSYKDTLRTFGTGAGTLPLSLHTCGTRAGTLPLPSHKQCW

SEQ ID NO: 204149 - protein, 366 aa, Glycine max
  Coding DNA Sequence Number=SeqID_87371
  Gene Ontology: Mol. function=nucleotidyltransferase activity
  Homolog annotation: Hit_ID=O64642; Match level="QueryCoverage=91%, HitCoverage=50%, E-value=3e-48, Identity=36%"; Hit description =Expressed protein
  Pfam annotation: Domain name=NTP_transf_2; Domain location=280-364; Score=12.9; E_value=0.0067; Accession=PF01909.13; Description =Nucleotidyltransferase domain
MVFVHHHHQQQQQQQHELKLQFGSLPTVAYAAAEVSSNGDSLLNLKFNRGGNVVHPTSNSSGNVVLQGNHDAVERERRGLGGYMAGGSLPPETSRVAPGFGNRIRGKGLEGRNENLYGRREGGRMVSGERSNVGLVDQLDRPGPPARSHLHSGSGNETSGIGEVGGRDSKHKGGGRLRMEGFPESGGRVADVDVLGEQLADSLLVEDESDDRTNLRQRRREKDVRFLDSRGQQIMSQRGRMYRRQMMCRRDIDDFNVPFLAIYGSLIPPEEEKLKQKQLVAILEKLVSKEWPTSNLYLYGSCANSFGVSKSDIDVCLAIEEADMEKSKIIMKLADILQSDNLQNVQKVPIYRLAQKLLASLIIASV

SEQ ID NO: 204150 - protein, 57 aa, Glycine max
  Coding DNA Sequence Number=SeqID_87372
MTLFGDPGEPEASLGEPEASLGELGSRKTKEKTLLPPFFASIQHHKSTSKDQKINER

SEQ ID NO: 204151 - protein, 87 aa, Glycine max
  Coding DNA Sequence Number=SeqID_87373
TLVSVVEEGSPSSDLGVEEVTTTTMAPIMTTTTISTHVCDDYSHVAANMVVALLIDVMRKILAADRYLRTQQSRDNTPWDFFTFGSK

SEQ ID NO: 204152 - protein, 77 aa, Glycine max
  Coding DNA Sequence Number=SeqID_87374
  Gene Ontology: Mol. function=nucleotidyltransferase activity
  Homolog annotation: Hit_ID=O64642; Match level="QueryCoverage=87%, HitCoverage=8%, E-value=4e-29, Identity=83%"; Hit description =Expressed protein
MDAERESCKREKDWTRRIGNDRHLICIEDPFEISHDLGRVVDKHSIKVLREEFERAAEVMQNDPNPCIKLFEPYVPS

SEQ ID NO: 204153 - protein, 201 aa, Glycine max
  Coding DNA Sequence Number=SeqID_87375
MANPTILQWVLVFALSYKLMLHLFMRVLSKVKASEPGRNIILVHRKLKDRLRILPSLTPLSPSHLPSSRPRTSLIVEALIASLMHLNLDDVWLGSRSGTVATCGAVRVHEEPFPARASLGARRAGRFLRAQQRVERHHVLVGKTLISHTLMRFLVEKWVLKLTSLTHGGFSILWKHATECLPALDMTQATSTQDSKGSSWI

SEQ ID NO: 204154 - protein, 99 aa, Glycine max
  Coding DNA Sequence Number=SeqID_87376
  Gene Ontology: Mol. function=oxidoreductase activity, acting on the CH-OH group of donors, NAD or NADP as acceptor; Cellular component =mitochondrion; Biological process=metabolic process
  Homolog annotation: Hit_ID=Q67Y01; Match level="QueryCoverage=93%, HitCoverage=27%, E-value=1e-29, Identity=64%"; Hit description =Putative glycerate dehydrogenase
  Pfam annotation: Domain name=2-Hacid_dh_C; Domain location=1-64; Score=-54.2; E_value=2.9e-05; Accession=PF02826.9; Description=D -isomer specific 2-hydroxyacid dehyd
MLVLGKQGFIVNVGRGGLIDEKELVKCLMEGEIGGAGLDVFENEPRVPEELLEMNNVVLSPHAAALTVESMMNLCELMGGNLEAFFSNKPRITPVMLAE

SEQ ID NO: 204155 - protein, 143 aa, Glycine max
  Coding DNA Sequence Number=SeqID_87377
  Gene Ontology: Mol. function=oxidoreductase activity, acting on the CH-OH group of donors, NAD or NADP as acceptor; Cellular component =mitochondrion; Biological process=metabolic process
  Homolog annotation: Hit_ID=Q67Y01; Match level="QueryCoverage=97%, HitCoverage=42%, E-value=4e-35, Identity=53%"; Hit description =Putative glycerate dehydrogenase
  Pfam annotation: Domain name=2-Hacid_dh_C; Domain location=1-109; Score=12.5; E_value=3.6e-10; Accession=PF02826.9; Description=D -isomer specific 2-hydroxyacid dehyd
MYHSRNEKPFILYPFYSNVVELAGNSDVLVFCCPLNEQTRHIINREVMLGKDGVIVNVGRGSLIDEKELVWCLMEEEIRDAGLDLFENEPNVPNELFPLDNVVLSPHAASLTSDGFTEVCELAAEALEVFFSSKLPSTQVLDD

SEQ ID NO: 204156 - protein, 158 aa, Glycine max
  Coding DNA Sequence Number=SeqID_87378
  Homolog annotation: Hit_ID=Q2HSY6; Match level="QueryCoverage=74%, HitCoverage=20%, E-value=6e-09, Identity=34%"; Hit description =Cyclin-like F-box
  Pfam annotation: Domain name=FBD; Domain location=67-112; Score=24.8; E_value=0.00031; Accession=PF08387.1; Description=FBD
MGGKVMTNRLPTLTFPCLRHLEVIKVSTQRQDLWWVARILKACPMLQRLELHLKTYLCIDDDVRERGWPPKFEHNHLKEVVITGIKGYLCEIEIAIYLLRNAISLEKMTIDPRAKVYTENGKWGQAEAFGNWSRVGKPKVHRHLKQEANSSAVELLIK

SEQ ID NO: 204157 - protein, 76 aa, Glycine max
  Coding DNA Sequence Number=SeqID_87379
MTIPVQKFTLRRIGASRDTRILVCAKPHQTIDMHIDNGIRQGRIEQLNNGEVDMEIKFVPSTEPGQDVCQDPNCSE

SEQ ID NO: 204158 - protein, 186 aa, Glycine max
  Coding DNA Sequence Number=SeqID_87380
  Subcellular localization annotation: CTP_CleavageSite=73; ConfidenceScore=5.22e-01
MSQADNSTTISSDDAFPKVLGKDHCGRVRCLGLGGLYSIAFKFNTKFSGVGCSSSSFESSESSQLKEEVVSLKAKLAASEENVKTLQNVMVAYIHIKEGRIPPELGAMFGNTTNPRDEESGQDVPTTTWRIFTSYGRQRRRGERRRHSLGNKPWKKELHHQDEPWIRSLEGCFNGGKEREKGGARN

SEQ ID NO: 204159 - protein, 312 aa, Glycine max
  Coding DNA Sequence Number=SeqID_87381
  Homolog annotation: Hit_ID=Q2QY97; Match level="QueryCoverage=86%, HitCoverage=67%, E-value=1e-12, Identity=25%"; Hit description=F-box domain containing protein, expressed
  Pfam annotation: Domain name=F-box; Domain location=20-67; Score =35.0; E_value=2.6e-07; Accession=PF00646.23; Description=F-box domain
MKNQNRKKQGESAAKCKKEDYISKLPNSIICYILSYLKVKDAVTTSVLSSKWRNISCNPSNLILDEDNMLIKREHSLTYVLLHQSVVQRLEFKRDRTLAFVSNVNMYLSHVEEVQKIDKLKVCFTFRHNEYGSTDLDRWIRFAVEKNVEEIDLCLLEENHHHQINASPNDGYYVFPCEVVGNYEGESGSKSFLKSLRLAHCVLAPHMLHNLGFSTLTTMELFKVDLKSELHIQILLSSCSNLEFFGLSECYNMKNLKIEHPYCQKLKYLKVKLCQELKKLVLYSTSLEALEFKGSKIEFVFDAPRLKTFYSP

SEQ ID NO: 204160 - protein, 71 aa, Glycine max
  Coding DNA Sequence Number=SeqID_87382
MGSEIYPEVHENPRAFFSSSSPILLQPLAHGSSDWSLPREDCINNPHLSPFDAMIQTNGETHSLNMRSLQT

SEQ ID NO: 204161 - protein, 105 aa, Glycine max
  Coding DNA Sequence Number=SeqID_87383
MLDDIGPGKLTDGGPKEKSPGRLGFFVRAVPRLCFGRHWHVLIYSARKRLAHLGKKKCDSPALIENNANRRRPGKMTDRGLEKKPHRMAPIAHFLMDIIQILFRD

SEQ ID NO: 204162 - protein, 188 aa, Glycine max
  Coding DNA Sequence Number=SeqID_87384
MGKVDEGQERIKADIEALKEQMATMMEAMMSMKKIMVVNVAAVAATSAVAEVNPTPPFGLNQINHPTSNMNKHAFLPYGLPPNYTPPDVVHTHDENVNNSTPILVESQQPKSDHAHVSQPMREAHEIPHHNLANFEPRLGYAIEGQAVGGVPLPDNLEDPQFRPQPQPLHFATGRVPPAMAKKGNWIK

SEQ ID NO: 204163 - protein, 91 aa, Glycine max
  Coding DNA Sequence Number=SeqID_87385
MVTSKENERVTIENNVGLWWLTVAVGDGESAWDVRNDFERKKEEEMVFFLSYTEAKAKNAQVRNGLGHRNVAQTPNIFSKIPTVRSWENVL

SEQ ID NO: 204164 - protein, 51 aa, Glycine max
  Coding DNA Sequence Number=SeqID_87386
MPRGNLKVRCEKLTHPCLSKRVWVDKDLASQRSLLRKLLKETTRKFLEEAS

SEQ ID NO: 204165 - protein, 35 aa, Glycine max
  Coding DNA Sequence Number=SeqID_87387
IPEVTKANSGRSASGNFFRKTVFRKWASGRPSSGS

SEQ ID NO: 204166 - protein, 77 aa, Glycine max
  Coding DNA Sequence Number=SeqID_87388
MYSTVVHLLPRTKVRDHHRYQLHGTKISMGQPYIPIVRFPDPNYGIKVVNQNKLPSPIVSSCSNPASAPDHASSIKW

SEQ ID NO: 204167 - protein, 128 aa, Glycine max
  Coding DNA Sequence Number=SeqID_87389
MAFRWVFGYQGEQATRFYRGFSGNDRIGPDPDLARHCPGAGQEHACRCGLHHSGGTGDQQVRRARRTLPHHYFCCKLSLSSQGPNDVFQAQNPPLTGDAAKLGLSLEKENGSGGGIRTPDTRIMIPLL

SEQ ID NO: 204168 - protein, 286 aa, Glycine max
  Coding DNA Sequence Number=SeqID_87390
  Homolog annotation: Hit_ID=Q2HS23; Match level="QueryCoverage=91%, HitCoverage=59%, E-value=2e-79, Identity=64%"; Hit description=T -snare
MEARHATLGRRTLEEIRQKRAAERLSKTSSGPDLTQVPSTSEIAGMSKSESANKLSETDLSALLSQLKGLQKKNTELEEENTKISLKLQTMEIDNETMHKQLNDVEQNTVPSLRKALRDVAMEKDAAVVAREDLSAQLRTLKKRLKEAEDEQYRAEEDAAALRAELNSIQQQAMTNTVSTISSFGNPPDHFQIQRLQKELDDLKLELQRESLLRHQEQEQLAKEQACIASLISEKQELEEKLMSISREPAEASDKAAHKAFSLVRKTSSIWIFHYLVNFQFSVSVS

SEQ ID NO: 204169 - protein, 170 aa, Glycine max
  Coding DNA Sequence Number=SeqID_87391
  Homolog annotation: Hit_ID=Q9FIG0; Match level="QueryCoverage=39%, HitCoverage=70%, E-value=2e-23, Identity=75%"; Hit description =Similarity to elongin C
  Pfam annotation: Domain name=Skp1_POZ; Domain location=103-168; Score= 32.6; E_value=1.4e-06; Accession=PF03931.5; Description=Skp1 family, tetramerisation domain
MVIEKGCLYCTVRRPRVAWRASIVTDAMGAECSSANSPLRRDAERLGHCSVVEDEDFVDESSFDMLDDMIVLLSMVYPFQQREGEEGFACVRENQNQKMKKEDTVKLISSEGFEFVVDKEAAIVSQTIHNMLTSPGSFAERQHGEVTFPEISTTILEKICQYFYWHLQFA

SEQ ID NO: 204170 - protein, 352 aa, Glycine max
  Coding DNA Sequence Number=SeqID_87392
  Gene Ontology: Mol. function=transferase activity; Biological process= biosynthetic process
  Homolog annotation: Hit_ID=Q9FGU6; Match level="QueryCoverage=96%, HitCoverage=75%, E-value=3e-91, Identity=48%"; Hit description =Glycosyl transferase-like
MTELEHLPAKINNAENCQCHNSSYQEILQKQNQPINLLSYPFSWNHLMLSSEPPSKFLKIVLFVKKWPQKSHARGLERHALTLHPALAKRGHDLHKFTTSTNSSFSNYSINNLRFHFSKPTPAGYLDQALVWEQFQAQNSTSTHDLYMLLIWLSLGTELRTRPFILTSFKNSLEPPKKPQTKALTERAVKVVEEVKFFSYYAHHVATSDHAGDILKRVYMIPKERVHIILNGVAQHVFRPDVSKGKDFKKRHGIPDSKSLVIGLAGRLVKDKGHPLMFEALKQIIEENSTFQDCSMVVVAGDGPWGARYRDLGENILVLGPLEQAELASFYNAIDIFVNPTLRAQGLDHTLL

SEQ ID NO: 204171 - protein, 472 aa, Glycine max
  Coding DNA Sequence Number=SeqID_87393
  Homolog annotation: Hit_ID=Q10NJ8; Match level="QueryCoverage=10%, HitCoverage=5%, E-value=5e-07, Identity=52%"; Hit description =Expressed protein
MNRKINDRLKLEKASLSYADFRHEITKNDKDNSLKPYGNKQKQATYQWASEEDELVKYMSNLPGYLEKGEKIPDKALNVGVLDWATLQQWQYSHKHVPLSSRSSTSTINTSSSVSTEGLSGNSSKGFVCSPSRQRIFRPSLQSHFMASPMQDYSVSVKSSGGNFGNCQNLRGGCSNIDTHSNDARVGDHLSQNHPTSIPKGCVRRQLNPHINKESDILPNGGIYEAASHTKIEMSPQDGGPEKKVENFREPNIDADEQVMLGKSKPIVLILPRDIPQNNHCEVPDMQTSLGQKLGSPTGTRLSEKPKEPPCRYPNSNISKTCPLPDEIRGIRYQPERSGSSSTDPEGIKIPASTLSAPVPVRTGIISPCRSRKAEEKKHNIGASSSANGSLKGLDQKVTTEKPRSSSPFRRFSFSIGFTGKGSGCKEVAHVPHQSSIAALKSSSENVRGYASSKISGNDNLVMLSKAGLVAL

SEQ ID NO: 204172 - protein, 613 aa, Glycine max
  Coding DNA Sequence Number=SeqID_87394
  Homolog annotation: Hit_ID=Q10NJ8; Match level="QueryCoverage=62%, HitCoverage=43%, E-value=8e-38, Identity=29%"; Hit description =Expressed protein
MLGKSKPIVLILPRDIPQNNHCEVPDMQTSLGSKLGSPTGTRLSEKPKEPPCRYPNSNISKACPLPDEIRGSRCQPKRSGSSSIDPEDVEIPASTFSAPVPVRTGISPCRSRKAEEKKHNIGASSSANGSLKVLDQKVTTEKPRSSSPFRRFSFSIGFAGKGSGCKEVAHVPHQSSLAALKSSSENVRGYAGSKFSGNDKPGNAAKSRSSSPLRRLLDPLLKPKTSNSHRTVESYQKDSVVIKKNCRSGNGEFSMEKELDRDQRVGCTTINTVDLSKNKKYVPSTFQALLRIAVKNGQPLFTFAVDNNSNILVATVKNLAVSKEDKCNRIYTFFTFREGKKKNGSWMNQASKTKGPDYIHHAVAQMKVSDSHHYDSTSQNCVNSSTTKEFVLFSVKLKQGDAQVTDYEPNDELAAIVVKSAKAVNFINYAHQSSCQNDSQDLHVTVVLPTGVHSLPSNGGPSSLIERWRTGGSCDCGGWDMACKLKILADESQACRKSRISKACFPHPFELFLQVNDQDQENQPAFSFSPFKPGVYSVAFDSSFSLLQAFSICIALVDGLISYELSGSRNHIEGKNSRETLLVQTDELKAFGKLEDIPASYVAYPPLSPVGRV

SEQ ID NO: 204173 - protein, 440 aa, Glycine max
  Coding DNA Sequence Number=SeqID_87395
  Gene Ontology: Mol. function=drug transporter activity; Cellular component=membrane; Biological process=multidrug transport
  Homolog annotation: Hit_ID=Q8S6Q1; Match level="QueryCoverage=98%, HitCoverage=85%, E-value=1e-119, Identity=53%"; Hit description =Putative membrane protein
  Pfam annotation: Domain name=MatE; Domain location=244-382; Score =17.1; E_value=0.00023; Accession=PF01554.9; Description=MatE
PVELAAVGVSIALFNQVSRIAIFPLVSVTTSFVAEEDTLSGENPHIEEGRCLETGPPKDAETKELLPHKGGNNHNSDFVGECFNIAKEEHKRRHIPSASSAIFIGGILGLIQAIFLISAAKPLLNFMGVTSDSPMLHPAKQYLKLRTLGAPAVLLSLAMQGVFRGFKDTKTPLYATGDVTNIALDPLFMFVFRLGVSGAAIAHVISQYLISAILLWRLMEQVDLVPPSIKHLQLDRFLKNGFLLLMRVIAVTFCVTLAASLAARQGPTSMAAFQAILAGAFANKDFDRATATASRVLQMGLVLGLALAFILGIGLHFGAKIFTQDANVLHLIQIGIPFVAVTQPLNSIAFVFDGVNFGASDFAYSAFSMVVVAILSIICLLILSSAGGFIGIWVALTIYMGLRAFAGFLRTLGVPKELMTAHGRHRSYSFILGLGFSGVC

SEQ ID NO: 204174 - protein, 87 aa, Glycine max
  Coding DNA Sequence Number=SeqID_87396
  Gene Ontology: Mol. function=drug transporter activity; Cellular component=membrane; Biological process=multidrug transport
  Homolog annotation: Hit_ID=Q1T5H1; Match level="QueryCoverage=59%, HitCoverage=9%, E-value=5e-13, Identity=67%"; Hit description=Multi antimicrobial extrusion protein MatE
MAEKESMYSLGDWRRIPICTFFKDARLVFKADSLGREILSIALPAAMALTADPIASLVDTAFIGQIGMFCYSFINIELTSHISHRKP

SEQ ID NO: 204175 - protein, 107 aa, Glycine max
  Coding DNA Sequence Number=SeqID_87397
  Gene Ontology: Mol. function=DNA binding; Cellular component=nucleus; Biological process=regulation of transcription
  Homolog annotation: Hit_ID=Q2LME4; Match level="QueryCoverage=91%, HitCoverage=29%, E-value=5e-39, Identity=76%"; Hit description=MYB20
  Pfam annotation: Domain name=Myb_DNA-binding; Domain location=23-70; Score=37.7; E_value=3.9e-08; Accession=PF00249.21; Description=Myb -like DNA-binding domain
MRKPEASNNNTKNNNNNSKKLRKGLWSPEEDDKLMNYMLNHGQGCWSDVARNAGLQRCGKSCRLRWINYLRPDLKRGAFSPQEEELIIHFHSLLGNRYAIPVRVIEF

SEQ ID NO: 204176 - protein, 357 aa, Glycine max
  Coding DNA Sequence Number=SeqID_87398
  Gene Ontology: Mol. function=carboxy-cis,cis-muconate cyclase activity; Cellular component=cytoplasm; Biological process =carbohydrate metabolic process
  Homolog annotation: Hit_ID=UPI00005F9628; Match level="QueryCoverage =93%, HitCoverage=80%, E-value=1e-128, Identity=67%"; Hit description= COG2706: 3-carboxymuconate cyclase
MRNWQAPTRRTALFLALLAVTGPALHAEDAMNSTSSHFAYIGTYNPNGEGVYRVQVDPASGALSQVTLVSKVPNPAQLTLGADGKTLYVASEVADFNGGKHGGITAYRVNPADGGLTQLNQVDSQGAGPVYLSSTPDGRHLLVANYVSGSVAAFPIEADGSLGAASSVQQQQGPAGAAKPAAAVNGSFAISDHNGPHAHMIASDPSGKFVFSTDLGLDRIYQWRFDAASGRLTPNDPPWIAASSAGAGPRHFVFHPDGETVLLVNEEASTLTSYRFDRQKGTLKQLHAVSALPADYQGTSFASGLALSKNGDTLYVANRLHNSIAQFSVGAGGELKPVAETWTRGDYPRSLALSPDG

SEQ ID NO: 204177 - protein, 116 aa, Glycine max
  Coding DNA Sequence Number=SeqID_87399
  Gene Ontology: Mol. function=protein kinase activity; Biological process=protein amino acid phosphorylation
  Homolog annotation: Hit_ID=Q2QZ78; Match level="QueryCoverage=94%, HitCoverage=19%, E-value=2e-35, Identity=65%"; Hit description=AT hook motif-containing protein, putative
MASSGIASLLLPGGRTAHSKFKIPVLVFEDSTCNIHQGTQLAELLNQTSLIIWDEAPMAHKFCFEALDHSLRDIIKHNSKDNTIFGGKVMVFGGDFRQILPVIPRGSRNNSKLLSY

SEQ ID NO: 204178 - protein, 360 aa, Glycine max
  Coding DNA Sequence Number=SeqID_87400
  Gene Ontology: Mol. function=chitin binding; Cellular component =extracellular region; Biological process=chitin metabolic process
  Homolog annotation: Hit_ID=UPI00006A17C9; Match level="QueryCoverage =98%, HitCoverage=100%, E-value=3e-53, Identity=30%"; Hit description= UPI00006A17C9 related cluster
GLHVLTFRGLHVLAIRGLHSLNFRGLHVLTFRGLHALAFIGLHAITFRGLHALAFRGLHVLSFRGLHVLAFRGLHVLAFRGQHAFIFRGLDVLTFRGLHVFAIRGLHILAFRGLHVPTFRGLHVLTFGGLHILTFRGSHVLTVRGLLALAFRGLHVLTFRGLHVLTFRGLHALDIRGLRVLEFVGLNAFTFRGFHALAFVGLHVLTFRGLHVLTFRGGLHALAIRGLHVLAFIGLHALTFRGLHVLAIRGLHVLAFVGLHAVTTKGLHVLAIRGLDAFTISGLRVLAFRGLHVLTFSGLHVLTFRGIHVLAFIGLHVLTFRGLHVLVFIGLHILAFIGLHVLTFLGLHTLAFRGLHVLIF

SEQ ID NO: 204179 - protein, 224 aa, Glycine max
  Coding DNA Sequence Number=SeqID_87401
  Gene Ontology: Mol. function=transcription factor activity; Cellular component=intracellular; Biological process=regulation of transcription, DNA-dependent
  Homolog annotation: Hit_ID=Q62AY3; Match level="QueryCoverage=54%, HitCoverage=58%, E-value=2e-42, Identity=69%"; Hit description =Transcriptional regulator, MarR family
  Pfam annotation: Domain name=MarR; Domain location=40-116; Score =50.0; E_value=8.1e-12; Accession=PF01047.13; Description=MarR family
  Pfam annotation: Domain name=Pencillinase_R; Domain location=40-149; Score=-22.8; E_value=0.019; Accession=PF03965.7; Description =Penicillinase repressor
  Pfam module annotation: Pfam domain module=MarR::Pencillinase_R; Domain location=40-116::40-149
MAQTAARGTDAGAAGLGLLLLWLADDVEQRANAALAPFGISESKLDVLMIFGLAERGLIDSRAVTPSYIADYFGVTRSTVTGLLDWLEKRELLTRALNHEDRRSISLALTDAGRELLTQALPAFWTMCASLVDCLDENDRKALQGILAKSSAGSRSTARGFILPPAARRSWPRIAADTRPDPAPGIGAPPLRRRRCGTSALPVPGTTASVPAPSVPAKARWRTP

SEQ ID NO: 204180 - protein, 750 aa, Glycine max
  Coding DNA Sequence Number=SeqID_87402
  Gene Ontology: Mol. function=nucleoside-triphosphatase activity
  Homolog annotation: Hit_ID=Q710E8; Match level="QueryCoverage=98%, HitCoverage=85%, E-value=0.0, Identity=61%"; Hit description=Origin recognition complex 1a protein
  Pfam annotation: Domain name=AAA; Domain location=500-709; Score =53.9; E_value=5.5e-13; Accession=PF00004.19; Description=ATPase family associated with various cellular activities (AAA)
  Pfam annotation: Domain name=BAH; Domain location=232-373; Score =76.2; E_value=1e-19; Accession=PF01426.8; Description=BAH domain
  Pfam annotation: Domain name=PHD; Domain location=200-247; Score =38.1; E_value=3e-08; Accession=PF00628.19; Description=PHD-finger
  Pfam annotation: Domain name=zf-C3HC4; Domain location=201-244; Score= 5.0; E_value=0.048; Accession=PF00097.15; Description=Zinc finger, C3HC4 type (RING finger)
  Pfam module annotation: Pfam domain module=AAA::BAH::PHD::zf-C3HC4; Domain location=500-709::232-373::200-247::201-244
  Subcellular localization annotation: CTP_CleavageSite=40; ConfidenceScore=5.68e-01
MAATPSKFLQTPSKPKLRSQSNPKSSPVVTPDTPQTLYPRRSTRAKSLLFDAPKPPHTPLEISLTTPKRRIRRSIDCVDQDSGEDKATTSKISDKNKAPVVDASKKKKNGKNSIEVSFAPVTPASSEKASTRKREGEGGVVTRAKRRKSENREKSAKLPQRRVYYTKVVYDGGEFELGDDVYVKRREDASSDDEDPEMEECRMCFSSNDEVMIECDDCLGGFHLKCLRPPLKDVPEGDWICGFCEARKMGMEVQLPKPPKGKKLVRTMREKLLSSDLWSGRIKSIWREVDDNYWCRVRWYTIPEETSVGRQPHNLRRELYRTNDFADIEMESVLRHCHVMTPKEYAKASDEGDDVFLCEYEYDIHWHSFKRLADIDNETENGEEHDSDEDWNVDKESDSDTDEDVEYEKENIKNTQSKPSTSHHLAANLQKGQFFGLQKIGTKTIPQHVRSHKQTDLERAKATLLLASLPKSLPCRNKEMEEITAFINGALSDNQCLGRCLYIHGVPGTGKTMSVLSVMRSLKSEVDAGNIKPYTFVEINGLKLASPENIYKVIYEALNGHRVSWKKALHLLNERFVEGKKTRDEADRPCILLIDELDLLVTRNQSVLYNILDWPTKPHSKLIVIGIANTMDLPEKLLPRISSRMGIQRLCFGPYNYQQLQEIISSRLKGIDVFEKQAVEFASRKVAAISGDARRALEICRRAAEIADYRMKKLISNPDCVTAGKGLVGMVDVEAAIQEMFQAPHIQMMP

SEQ ID NO: 204181 - protein, 198 aa, Glycine max
  Coding DNA Sequence Number=SeqID_87403
  Gene Ontology: Mol. function=iron-sulfur cluster binding; Cellular component=peroxisome; Biological process=electron transport
  Homolog annotation: Hit_ID=Q1SCP9; Match level="QueryCoverage=89%, HitCoverage=15%, E-value=2e-73, Identity=76%"; Hit description =Aldehyde oxidase and xanthine dehydrogenase, molybdopterin binding domain, putative
  Pfam annotation: Domain name=Fer2; Domain location=9-79; Score=39.1; E_value=1.5e-08; Accession=PF00111.17; Description=2Fe-2S iron -sulfur cluster binding domain
  Pfam annotation: Domain name=Fer2_2; Domain location=87-163; Score =161.1; E_value=2.8e-45; Accession=PF01799.10; Description=[2Fe-2S] binding domain
  Pfam module annotation: Pfam domain module=Fer2::Fer2_2; Domain location=9-79::87-163
MKVANEAILYVNGVRRVLPDGFAHFTLLEYLRDIGLTGTKLGCGEGGCGACTVMVSQFDRRLKKCSHYAINACLAPLYSVEGMHVITVEGLGSCKRGLHPVQESLARAHGSQCGFCTPGFVMSMYALLRSSQTPPSEEQIEECLAGNLCRCTGYRPIFDAFRVFAKTSNDLYTGVSSLSLEEGKSVVIRDMSLLPMMK

SEQ ID NO: 204182 - protein, 253 aa, Glycine max
  Coding DNA Sequence Number=SeqID_87404
  Gene Ontology: Mol. function=iron-sulfur cluster binding; Cellular component=peroxisome; Biological process=electron transport
  Homolog annotation: Hit_ID=Q1SCP9; Match level="QueryCoverage=96%, HitCoverage=21%, E-value=1e-122, Identity=85%"; Hit description =Aldehyde oxidase and xanthine dehydrogenase, molybdopterin binding domain, putative
  Pfam annotation: Domain name=Ald_Xan_dh_C2; Domain location=1-253; Score=-68.3; E_value=3.3e-11; Accession=PF02738.8; Description =Aldehyde oxidase and xanthine dehydrogenase, molybdopterin binding domain
  Subcellular localization annotation: CTP_CleavageSite=42; ConfidenceScore=5.08e-01
APQKHQKYVSHVLGLPMSKVVCKTKRVGGGFGGKETRSAFIAAAASVPSYLLNRPVKITLDRDVDMMITGQRHSFLGKYKVGFTNEGRVLALDLEIYNNAGNSLDLSLAILERAMFHSDNVYEIPNMRVMGRACFTNFPSHTAFRGFGGPQGLLIAENWIQRIAVELKMSPEKIRAREGSVLHYGQIVQYSTLAPLWNELKLSCDFAKAREEVDQFNSHNRWRKRGIAMIPNKFGISFTTKLMNQKKVISTDV

SEQ ID NO: 204183 - protein, 214 aa, Glycine max
  Coding DNA Sequence Number=SeqID_87405
  Gene Ontology: Mol. function=2 iron, 2 sulfur cluster binding; Cellular component=peroxisome; Biological process=electron transport
  Homolog annotation: Hit_ID=Q6AUV1; Match level="QueryCoverage=99%, HitCoverage=12%, E-value=2e-66, Identity=72%"; Hit description =Xanthine dehydrogenase, putative
  Subcellular localization annotation: CTP_CleavageSite=46; ConfidenceScore=5.08e-01
MGQGLHTKVAQIAASAFNIPLSSVFISDTSTDKLYTIPTYQVPNASATAASASSDMYGAAVLDACEQIMARMEPIASQHNFNSFAELVGACYAERIDLSAHGFYITPDIGFDWTTGKGKPFRYFTYGAAFAEVEIDTLTGDFHTRVANVFLDLGYSLNPAIDVGQNIQGSLSRMEKHYTEDTNSSKRKSENLIEKKLNRGSFNARFGLGSFRRT

SEQ ID NO: 204184 - protein, 88 aa, Glycine max
  Coding DNA Sequence Number=SeqID_87406
MENWRTTLFNNFLGLHSGRWRMHEQHLAITFMGLRKKWRMENWRTALRNNFAGLQTRSGEWRIGEQHYAITSRGSRLEGGGHMNSARQ

SEQ ID NO: 204185 - protein, 267 aa, Glycine max
  Coding DNA Sequence Number=SeqID_87407
  Gene Ontology: Mol. function=adenosylmethionine-8-amino-7 -oxononanoate transaminase activity; Cellular component=cytosol; Biological process=biotin biosynthetic process
  Homolog annotation: Hit_ID=Q8PI30; Match level="QueryCoverage=98%, HitCoverage=55%, E-value=1e-109, Identity=71%"; Hit description =Adenosylmethionine-8-amino-7-oxononanoate aminotransferase
  Pfam annotation: Domain name=Aminotran_3; Domain location=51-267; Score=-3.0; E_value=1.9e-11; Accession=PF00202.11; Description =Aminotransferase class-III
MCRQQHVHEPEMLADPTPSPLAHHWRQRDLQVLWHPCTQMREHPDTLPLVPIARGEGAWLIDHDGNRHLDAVSSWWTNLFGHAEPRIGGAIAAQAGQLEQVMLAGFGHEPAITLAERLLALAPRQPGRAPLAKVFYADNGSAGVEVALKMAFQYFQNRGEPRRTRFIALENGYHGETLGALALGDIPLYRRVYAPLLAEGLFAPSPDAYLAEPGQSAADRARQAADGLATLFDQHPGEICAVILEPRLQCAGGMRMHDPVYLQRVRE

SEQ ID NO: 204186 - protein, 134 aa, Glycine max
  Coding DNA Sequence Number=SeqID_87408
  Gene Ontology: Mol. function=hydrolase activity
  Homolog annotation: Hit_ID=Q8P6T2; Match level="QueryCoverage=98%, HitCoverage=86%, E-value=9e-54, Identity=82%"; Hit description=ADP compounds hydrolase
  Subcellular localization annotation: CTP_CleavageSite=76; ConfidenceScore=5.69e-01
MTVPAVACRSSIGSPMRRTVPSSASTWTWSSPTANAAASSAWHAPLRTGPGQGPDRCRRDSRAGCGPRTEGRGRLRCAPGRRAARNDPCPDLYEPPVVAGGGARPVPGKAGRRRAGRTGSCPVEAGRAGPADAA

SEQ ID NO: 204187 - protein, 265 aa, Glycine max
  Coding DNA Sequence Number=SeqID_87409
  Homolog annotation: Hit_ID=Q2HRX8; Match level="QueryCoverage=59%, HitCoverage=24%, E-value=6e-23, Identity=36%"; Hit description=IMP dehydrogenase/GMP reductase
MAGHWTVAARAYLLHLLGCTLFANKSATNVHVVYLEALHDLSQTGRYSWGVAALCWIYEHFPSVTESTADQDYDEDSLRACRWIATKKTVKSIHTPAYRECLDRLRILDVCCIPYGEHRPVQDFHMISCYSGLLRWGPVVVYYRPEKVMRQFGYTQTIPTPPADSWVSYDDIHDRWIHYSDHMVLVGEVCDVPSQCANDYIDWFFRISHFFMAPGQASDPLLDGHAPQPRVVPQAPETDIPHVPEPGAPSTSARPVVEEPRHAVI

SEQ ID NO: 204188 - protein, 179 aa, Glycine max
  Coding DNA Sequence Number=SeqID_87410
MAGAQLGNNPANAQTGQRQRAADDKLLIHNPPADRLAEEKAPSGQLQGAHGQVAGFPGVDQEKRHRQHPFAVAFHLRRIAPAVAAVGQLHLLLAIFGVGHFAGHAGETGVAADVEAVGLPANRRMRRPRLRVVEVKDIVVIEDAVAHRRPQRYLEEVLVGKALAAVILRDKVAHLLLHI

SEQ ID NO: 204189 - protein, 81 aa, Glycine max
  Coding DNA Sequence Number=SeqID_87411
MAIKGNYLSASLFNLSLSREISSSLLLTSKKGLRDRWSLVVKQFEYKGWVVLVWFRTCKGFLQVSGTLKQVAWGLDVGIRV

SEQ ID NO: 204190 - protein, 493 aa, Glycine max
  Coding DNA Sequence Number=SeqID_87412
  Gene Ontology: Mol. function=RNA binding
  Homolog annotation: Hit_ID=Q2HS37; Match level="QueryCoverage=99%, HitCoverage=47%, E-value=1e-163, Identity=62%"; Hit description =Nucleic acid binding NABP
MLSELGTRPMLGGNEGSFGDELEKEIGMLLREQRRQEVDDRERELNLYRSGSAPPTVEGSLSAVGGLFGGGGGGAGTAAGAVFSEFSGAKSGNGFSSEEELRSDPAYLSYYYSNVNLNPRLPPPLLSKEDWRFTQRLKGGASVLGGIGDRRKVNRADDNGGRSLFATPPGFNMRKQESEVESENPRGSAEWGGDGLIGLPGLVIVQDDLGLNASVTGFPSRPASRNAFDENGDIISSVESELAHLRRDSLATDTLRSVSNVPVSSAAQNTGPQASYSYAAALGSSLSRSTTPDPQLVARAPSPCPTPIGGGRVVAAEKRGINSPDAFNGVSSGVNEPADIVAALSGMNLSADDVLDGDSHFPSQVESDVDNHQRYLFGMQGGQDPGKQHAYLKKSESGHLHKSAYSDSGKNGGSMSDINNPSLDRHAELQKCAVPPNNSYFKGSPTSAFSGGGGVPAQYSPLDGTNSAFTYYGLSGYAGNPALASLVASQLGT

SEQ ID NO: 204191 - protein, 324 aa, Glycine max
  Coding DNA Sequence Number=SeqID_87413
  Gene Ontology: Mol. function=RNA binding; Cellular component=voltage -gated potassium channel complex; Biological process=potassium ion transport
  Homolog annotation: Hit_ID=Q2HS37; Match level="QueryCoverage=99%, HitCoverage=28%, E-value=1e-160, Identity=89%"; Hit description =Nucleic acid binding NABP
  Pfam annotation: Domain name=PUF; Domain location=113-148; Score =44.7; E_value=3e-10; Accession=PF00806.9; Description=Pumilio-family RNA binding repeat
  Pfam annotation: Domain name=PUF; Domain location=150-184; Score =36.9; E_value=6.8e-08; Accession=PF00806.9; Description=Pumilio -family RNA binding repeat
  Pfam annotation: Domain name=PUF; Domain location=186-220; Score =34.9; E_value=2.8e-07; Accession=PF00806.9; Description=Pumilio -family RNA binding repeat
  Pfam annotation: Domain name=PUF; Domain location=248-282; Score =29.2; E_value=1.5e-05; Accession=PF00806.9; Description=Pumilio -family RNA binding repeat
  Pfam annotation: Domain name=PUF; Domain location=41-75; Score=37.1; E_value=6e-08; Accession=PF00806.9; Description=Pumilio-family RNA binding repeat
  Pfam annotation: Domain name=PUF; Domain location=5-39; Score=29.2; E_ value=1.5e-05; Accession=PF00806.9; Description=Pumilio-family RNA binding repeat
  Pfam annotation: Domain name=PUF; Domain location=77-111; Score=34.3; E_value=4.2e-07; Accession=PF00806.9; Description=Pumilio-family RNA binding repeat
  Pfam module annotation: Pfam domain module=PUF::PUF::PUF::PUF::PUF::PU F::PUF; Domain location=113-148::150-184::186-220::248-282::41-75::5 -39::77-111
MVYQEIMPQALALMTDVFGNYVVQKFFEHGLASQRRELANKLFEHVLTLSLQMYGCRVIQKAIEVVDLDQKIKMVQELDGNIMRCVRDQNGNHVIQKCIECVPEDAINFIVSTFFDQVVTLSTHPYGCRVIQRVLEHCKDPNTQQKVMDEILGAVSMLAQDQYGNYVVQHVLEHGKPHERSAIIKELAGKIVQMSQQKFASNVVEKCLTFGGPSERQLLVNEMLGSTDENEPLQLAQSRLEMPIFVQIGHDDHMAMMKDQFANYVVQKVLETCDDQQRELILSRIKVHLNALKKYTYGKHIVARVEKLVAAGERRIAAQSPHPA

SEQ ID NO: 204192 - protein, 674 aa, Glycine max
  Coding DNA Sequence Number=SeqID_87414
  Gene Ontology: Mol. function=protein translocase activity; Cellular component=chloroplast outer membrane; Biological process =intracellular protein transport
  Homolog annotation: Hit_ID=Q9STE8; Match level="QueryCoverage=77%, HitCoverage=64%, E-value=0.0, Identity=84%"; Hit description=Protein TOC75-3, chloroplast precursor
  Pfam annotation: Domain name=Bac_surface_Ag; Domain location=462-672; Score=-52.1; E_value=0.046; Accession=PF01103.13; Description=Surface antigen
  Pfam annotation: Domain name=GRP; Domain location=49-106; Score= -27.0; E_value=0.044; Accession=PF07172.2; Description=Glycine rich protein family
  Pfam annotation: Domain name=Surf_Ag_VNR; Domain location=146-222; Score=23.7; E_value=0.00067; Accession=PF07244.5; Description =Surface antigen variable number repea
  Pfam annotation: Domain name=Surf_Ag_VNR; Domain location=340-424; Score=4.3; E_value=0.55; Accession=PF07244.5; Description=Surface antigen variable number repea
  Pfam module annotation: Pfam domain module=Bac_surface_Ag::GRP::Surf _Ag_VNR::Surf_Ag_VNR; Domain location=462-672::49-106::146-222::340 -424
  Subcellular localization annotation: CTP_CleavageSite=51; ConfidenceScore=5.73e-01
MASFAAPNNLGSAVLPSRPPPVKCTLFPSCNNNNNHSLSNPSPSHPPPLFKAIAISSAASILMHCTPLSPFLPNPLAKLGGGGGNTGGGGGGGDGWFGGGGGGNGGFWSRMFAAVADESQSQEWDSHGLPANIVVQLNKMSGFKKYKVSDISFFDRNRKMKVGTEDSFFEMVSLRPGGVYTKGQLQKELETLATSGMFEKVDLEGKTNPDGSIGVTISFSESTWQSADGFRCINVGLMQQTKPVEMDADMTDKERLEYYLSQEREYKRRIERARPCLLPRYVHNEILDMLKRHGMVSARLLQRIRDRVQKWYHDEGYACAQVVNFGNLNTKEVVCEVVEGDITQLDIQFQDKLGNVVEGNTQVPVIQRELPRQLRPGYTFNIEAGKQALRNVNSLALFSNIEVNPRPDETNEGGIVVEIKLKELEQKSAEVSTEWSIVPGRGGHPTLASLQPGGTVSFEHRNLQGLNRSINGSITTSNFLNPQDDLAFKLEYVHPYLDGVYYSRNRTLRVSCFNSRKLSPVFTGGPGVDEVPPIWVDRTGVKANITENFTRQSKFTYGLVMEEITTRDESSHICANGQRVLPSGGISADGPPTTLSGTGIDHMAFLQANITRDNTRFVNGTVVGDRNMFQHFVLLTIQILTWVGKDKARSLKKRQKGASSRGRAYNFYADAMSP

SEQ ID NO: 204193 - protein, 204 aa, Glycine max
  Coding DNA Sequence Number=SeqID_87415
  Gene Ontology: Mol. function=heat shock protein binding; Cellular component=integral to membrane; Biological process=protein folding
  Homolog annotation: Hit_ID=Q2HS35; Match level="QueryCoverage=99%, HitCoverage=75%, E-value=7e-83, Identity=77%"; Hit description=Heat shock protein DnaJ, N-terminal
  Pfam annotation: Domain name=DnaJ; Domain location=10-71; Score =119.2; E_value=1.2e-32; Accession=PF00226.21; Description=DnaJ domain
MVVRARRSESPYDVLGVSPSASVDEIKKAYRKLALKYHPDVNKEDKAQEKFMRIKHAYNTLLNSSSRKKYDSGSRGYDFSQGSRSRNVQTEEEFYGLEDFFKDLQEEFKNWEANAASQGKPKSLWEELAEIGEEFVEFLEKELNITDQNDDYKTSQGENTSNFSGTETPSNSSQGEASKGNRSVDDNIEEIEATLAQLKKELGL

SEQ ID NO: 204194 - protein, 149 aa, Glycine max
  Coding DNA Sequence Number=SeqID_87416
  Subcellular localization annotation: CTP_CleavageSite=50; ConfidenceScore=5.50e-01
MATTFASSSPQIAASSFTLPPFQSKKFILFHNPVLQKNNILRPILLPPPPAAAAAQDAVDAAEQLYKTTDQGVATVVSALFFIAFVGLSAITIGVIYLAVTDFLQKREKEKFEKEEAAKGKNKKRKKVGRARAGPRGFGQKYVEDEVDE

SEQ ID NO: 204195 - protein, 394 aa, Glycine max
  Coding DNA Sequence Number=SeqID_87417
  Homolog annotation: Hit_ID=Q2HS33; Match level="QueryCoverage=99%, HitCoverage=100%, E-value=7e-42, Identity=36%"; Hit description=IMP dehydrogenase/GMP reductase
  Subcellular localization annotation: CTP_CleavageSite=28; ConfidenceScore=5.36e-01
MPLPERSYGHVNTSRSPTAVASVEQFLRATSGGESCRKSPTYSPTSSSPSSPYFERLKNHNSEEDNGLCQKKSVLTKVKERAMKFRYSLSKRRMEDENVTPSWGVSLEDDEEEEEDPEYLGAPMYESELAPEGYKENARQHPRANPVISEKHVLHHTVKLGVEQDSKKSRGPVNARFTTTTQPVTTTSNMTSENIAEKLAPVYAGGSNAANAISSKILASGSTTAPATNMSSQTSLVPSSSMQNSSASLCEKNTCQKSASLRDHFMNQSEKGDGARNVSTMQKSSSLSASMSGNKNITSLKSASVKDYSMNKSEPREDAKTDVSQPQMISKATSPTRTSSNAGVMDKVRGAVNSLFGNEEPSQQYGVKTSTTRTSSQTQQVDQEENRGRILQAN

SEQ ID NO: 204196 - protein, 111 aa, Glycine max
  Coding DNA Sequence Number=SeqID_87418
  Gene Ontology: Mol. function=transcription initiation factor activity; Cellular component=nucleus; Biological process =transcription initiation from RNA polymerase II promoter
  Homolog annotation: Hit_ID=Q2HS28; Match level="QueryCoverage=69%, HitCoverage=23%, E-value=1e-30, Identity=80%"; Hit description =Transcription factor IIA, helical
QPSSPWMNQRPPLDVNVAYVEGRDEADKGTSNQPLTQDFFTRTSGKRKRNDLTSQYNVGGYIPQQDGAGDAAHGVFEIEDNNFPFLSFFGIVVDTSWDMWDGENNSCHPIA

SEQ ID NO: 204197 - protein, 83 aa, Glycine max
  Coding DNA Sequence Number=SeqID_87419
MSEDKESHNISVIKRLGRNVLIIVIVVIVNLKMVFFMSMGNCYASWALLFGAPYCYSYHSRGLQTPPCPQGDEGKDRSTVCLT

SEQ ID NO: 204198 - protein, 131 aa, Glycine max
  Coding DNA Sequence Number=SeqID_87420
MALNANYPLKCVNTGDIYSTLPVAKNKIKEHDDKNETNVAGPSGVKIGEGKEDDVGEHYGSDDENVAVAGPSGVNAAYDDETEVNFDEDENNGLTAAEVVLRAQIEAERQKSGENKNDPTPKRQTRLTHSV

SEQ ID NO: 204199 - protein, 184 aa, Glycine max
  Coding DNA Sequence Number=SeqID_87421
  Homolog annotation: Hit_ID=Q2HS23; Match level="QueryCoverage=91%, HitCoverage=40%, E-value=8e-74, Identity=81%"; Hit description=T -snare
MWKIRRGVMKLDWKEDKQKLDRQLYDMAIAIERLESSRQKLLMEIDSQSTEIERLFEENSSLSNSYQEAIGAAARWENQVMDCLKQNEELRGILDNLRMEQARGLPDSSKNGAHEIASLASMKGQLVTEQSRAEALSAEVMQLSAQLEQVKQAYDGLARFYRPVLRNIESNLIKMKQDNSLAVR

SEQ ID NO: 204200 - protein, 188 aa, Glycine max
  Coding DNA Sequence Number=SeqID_87422
  Homolog annotation: Hit_ID=Q1STP5; Match level="QueryCoverage=69%, HitCoverage=24%, E-value=9e-07, Identity=28%"; Hit description=IMP dehydrogenase/GMP reductase
  Pfam annotation: Domain name=DUF1723; Domain location=103-149; Score =12.2; E_value=0.018; Accession=PF08330.1; Description=Protein of unknown function (DUF1723)
LTTFAPIAQDVEHVDHAADKVHEQPREPVADDVVVNAQGFPGKSHDTQLLTECVHHVAVTVWNGEKLSSHGKKIEKFGGFDQEIEGIVAVTKLSLLIACSLDTSDKGLIFAFVEKWHKKTNSFYLPVGEMGQSIVIHRPKRIVQQFDYVKTIPLTSVVPFLSVKKIDDKWMHFSEYLAMVGQICVAPG

SEQ ID NO: 204201 - protein, 108 aa, Glycine max
  Coding DNA Sequence Number=SeqID_87423
MASCNLQYSHQKNHLPLDQDLREGYILDRPKGVNYNTADIPIGWGKIEGGNEQHKNTLQKNSEHPPRTKYAKIIPLDLTSIQQKSSHGWFSEHRIQWKIQPETKQQRL

SEQ ID NO: 204202 - protein, 471 aa, Glycine max
  Coding DNA Sequence Number=SeqID_87424
  Homolog annotation: Hit_ID=UPI000023339E; Match level="QueryCoverage =21%, HitCoverage=85%, E-value=5e-23, Identity=49%"; Hit description =expressed protein
  Pfam annotation: Domain name=FHA; Domain location=33-100; Score=55.8; E_value=1.5e-13; Accession=PF00498.16; Description=FHA domain
MEEQEEEAPTLRLEILQGPGEGKTLEFKPGTAVRIGRVIKGNNLPIKDSGISSKHLTISTESNKWTLRDLDSSNGTVLDGSQIPPHTPFTLHHDSVIKIGELTSIHVIFVPREQQQQQRAVQPRRNPTRRGRTEPVPAPTEPVQTRGRGKPRGLKGKVQIQVQSVEENDASVVDAESERVDPPARVTRKTNRGRSVAKEDSSVVVENFDAPEGKTQIQIQTQSVEVKNASVVEADGERVVPPARVTRKVNRERSVVRVCNDDDDIPVEKAEEPKSTRNLSLVEISDSSVGNSDATVAEEPKKTRVTRNPKNTRAVKGNVENKTKRGVAGKRELEKESEDLNGLKEVCDGTEEENLNGDVGKLPDLKGRKRGATEKRELEKEDEDLNGVKEACIGREDANLNGDDRNWPDLKGRERELEKEGEDGNDVYLPKQIIDETEEMIDLMTQKAERLREYIVEKQQQNGKAKMPMEE

SEQ ID NO: 204203 - protein, 75 aa, Glycine max
  Coding DNA Sequence Number=SeqID_87425
MFEGLVHQLLLGYLGRYFKDIQKEQLKIRLEDITDNTCIFERPEWMFTCVNILLVCELVYCWWQCTLPVLQWLRM

SEQ ID NO: 204204 - protein, 57 aa, Glycine max
  Coding DNA Sequence Number=SeqID_87426
MTSNSWGSGLDGRGRTNNARQSIRGAPDSMIRFVGGGCTNNARQSIRGAPDSMVEDA

SEQ ID NO: 204205 - protein, 93 aa, Glycine max
  Coding DNA Sequence Number=SeqID_87427
GCNRLPGLKNEVRKLREPLRDGSLVIDYQIVMAAQLIHDRVEMECLEGAWETLEGNTRCRFRGTIRFTATSLVHPDEPARTHQRTVEWTAFSD

SEQ ID NO: 204206 - protein, 103 aa, Glycine max
  Coding DNA Sequence Number=SeqID_87428
MPGRTLILYMTVLDESMGCMLRHHDASGKRSGPPSKEIHAELHHLTEFDIVYVTQKVIEGSTLVDYLAQATLDLWVHLPRKEGARSRHQRLLEEDVGKTGKDV

SEQ ID NO: 204207 - protein, 302 aa, Glycine max
  Coding DNA Sequence Number=SeqID_87429
  Gene Ontology: Mol. function=ion channel activity; Cellular component= integral to membrane; Biological process=ion transport
  Homolog annotation: Hit_ID=Q8H6U3; Match level="QueryCoverage=49%, HitCoverage=39%, E-value=2e-47, Identity=67%"; Hit description =Cyclic nucleotide-gated channel A
  Pfam annotation: Domain name=cNMP_binding; Domain location=153-253; Score=31.2; E_value=3.6e-06; Accession=PF00027.19; Description =Cyclic nucleotide-binding domain
MGRRLEKMKNWRRDSDVLPVSDGQRTRKKILDPQGFVAPSSRVFGRGELTDDPVAIMKRYLTSHFIIDILSIIPLSQYMPRLWRIYPLYQEVTKTSGILTEKAWAGATFNLFLFMIASHVIGAIWCMLSIESEVWSNQQRFFIRSSSTAFGGTVLYAENSFIVREGDPVEEMLFIMSRKVSSVTTNGGRTGFFNSLFLMAGDFCGEEILIWASDPSSSSKLPISTRTVQTISEVEAFALMSEDLKLLASEFRNHGGKQLHHALRQGSIPGSRGHGLPVSYKQLGADTGKRRLRGHCMKPKTS

SEQ ID NO: 204208 - protein, 1357 aa, Glycine max
  Coding DNA Sequence Number=SeqID_87430
  Gene Ontology: Mol. function=voltage-gated potassium channel activity; Cellular component=integral to membrane; Biological process=potassium ion transport
  Homolog annotation: Hit_ID=O65717; Match level="QueryCoverage=48%, HitCoverage=98%, E-value=0.0, Identity=60%"; Hit description=Cyclic nucleotide-gated ion channel 1
  Pfam annotation: Domain name=Ion_trans; Domain location=820-1065; Score=55.6; E_value=1.6e-13; Accession=PF00520.21; Description=Ion transport protein
  Pfam annotation: Domain name=Lipase_3; Domain location=397-536; Score= 100.0; E_value=7.2e-27; Accession=PF01764.16; Description=Lipase (class 3)
  Pfam annotation: Domain name=cNMP_binding; Domain location=1166-1266; Score=22.0; E_value=0.0021; Accession=PF00027.19; Description=Cyclic nucleotide-binding domain
  Pfam module annotation: Pfam domain module=Ion_trans::Lipase_3::cNMP _binding; Domain location=820-1065::397-536::1166-1266
  Subcellular localization annotation: CTP_CleavageSite=40; ConfidenceScore=5.16e-01
MAYTAVAMPTSPAATSATVDIAKEHNGLRRSQSSKELHTRAVMRRSYSDNHLCCSINRVQATSVPPKLKSNQPMGISPFQFSGSILPNSLRSFLFDPETSNDLVVEEKVVSIEENMVESSKEEIVNRANWVERLMEIKKHWRNRLPKESMNTDAICNDNTYDECECDGDGDDNVCVVGEDEDEQEVTYDRDSFSSFLVQVPWSDTKLYSQLAFLCNMAYVIPQIKAKDLRRYYSLQFITSSLEKKAEVAKLKVQLNQDSTCVPVDDSVASQDVSKKDKDNTKKPQIKLAYDIAASAASYVQLRAKDLLHRAAKSQDTQQTENEDSNEREDLPGREELEGTSRGYKSEVAAYVAASTMTAVVAAGEKEKQETANDLQSLHSSPCEWFVCDDPGNYTRCFVIQGSDSLASWQANLFFEPTKFEGTDVLVHRGIYEAAKGIYKQFMPEIMEHLKRHGDRAKLQFTGHSLGGSLSLLVHLMLLTNKVVSPSTLGPIVTFGSPFVFCGGQQIIDELGLDESQIHCVMMHRDIVPRAFSCNYPNHVALVLKRLHTSFRSHPCLLKNKLLYSPLGKIFILQPDEKTSPPHPLLPRGSAFYALDNTKCPSVLRTFLNQPHPIDTLSDPTAYGSEGTILRDHDSSNYLKAINGVLRKHSKIIVGRVRKQRINQLWPLLTSPSPHSRSHEQNSERCSLRTKEIVTGDWKSESSFSPEQENSINNGNHKRRPSVGAVLKSIGRRLESVSEKMKNLTRASAVHPVSDGKKKLPPRKKILDPQGPILQKWNKIFVITCVMAVSVDPLFFYIPVINNARKRVDLDGVLQITASVLRTFFDLFYILRIIFQFKTGFIAPSSRVFGRGELIDDPMAIMKRYLTSHFIIDVLSIIPLPQVILLAINRNLKTSDPFVAKDLLKYSVLIQYVPRLLRIYPLFKEVTRTSGILTETAWAGAASNLFLYMLASHVVGANWYMLSVESETLLNQTVLNQTCSLVDPDTIKDPKTFNFGIFSDALDSHVVESTTDFPQKFFYCFWWGLRNLSSLGQNLKTSTDVSEIAFAIFIAIFGLVLFSLLIGNMQKYLQSTTVRVEEMRVKRQDAEQWMSHRMLPENLKERIRKYEQYQWQENKGVEEEALIRNLPKDLRRDIKRHLCLALVKKVPMFEKMDEQLLDAMCDRLKPVLYTEKSYIVREEDPVDEMLFIMRGKVSTMTTNGGRTGFFNSMFLMAGDFCGEELLTWALDPNSSSNLPISTRTVETISEVEAFALMADDLKFYSSQWKTWAATFIQAAWRRYWKKKIERSLCKAEADLQDALANEEGSSLSLGATIYASRFAVNALRNLRENSRHNTMQQRLLSLLPPKPAEPDFTAQKH

SEQ ID NO: 204209 - protein, 239 aa, Glycine max
  Coding DNA Sequence Number=SeqID_87431
  Homolog annotation: Hit_ID=Q8LHF3; Match level="QueryCoverage=66%, HitCoverage=34%, E-value=4e-22, Identity=41%"; Hit description =Splicing factor-like
MGKRKLNESDSDDSDEEVEIEKSDLLNGPNESGSNKAEGSLGSVNGGGGSSGAGSCESGSEEEKEAAVEGNVGSVAMLGGESIQAAAEPVINDEATEMPKESVVAGINAEDNGYQDCYVGVPDKFDGAVNQASTVMGSETVASAGESNYMEIDGSLEHKAAVNEESSPSTSVPVLEEPLNFDAFNSAAELEVLGLERLKSELQSRGLKCGGTLKERAARLFLLKSTPLDELPKKLLAKK

SEQ ID NO: 204210 - protein, 302 aa, Glycine max
  Coding DNA Sequence Number=SeqID_87432
  Homolog annotation: Hit_ID=Q69UI7; Match level="QueryCoverage=79%, HitCoverage=39%, E-value=7e-22, Identity=31%"; Hit description=VPS13- like protein
MVIHDLITKLGYNHAVLPLGYFIDEEVLLENVELILDAFDYLQLPFALKQGRVGKLSIKIPWKKPWDPIIIILEDVFISASQRGDQEWSADAVEQREFAGKKAKLAAAELGKLSRRVCGSQAGQSFISHVTTKQEPNTWPHGQRDSNTMSMTISLIAFRLLCIDVGMILDSIQVDIRNFHVLYCDMQNDLGHIMFGLKFTSLTMKQNLIGSSNGRVRVGQEHKIVEVKGLEFYSRMFHGSMDLVNMNNMGNSYSANSIRSEGKHYYSILAPCDVTLILSRETVCMIFSWSLSRCFFVRHAKQ

SEQ ID NO: 204211 - protein, 114 aa, Glycine max
  Coding DNA Sequence Number=SeqID_87433
  Gene Ontology: Mol. function=unfolded protein binding; Biological process=protein folding
  Homolog annotation: Hit_ID=Q08277; Match level="QueryCoverage=74%, HitCoverage=16%, E-value=8e-16, Identity=45%"; Hit description=Heat shock protein 82
MYIGVKSIKDMIGKWKQLERGTKVTLFLKDNQLEYLEETRIKDLVNKLFEFISHPIYMWTENKIGDVDEDKDKGSKIKEVEISHRRNLWVPLVESIIRTTYLMILHSPFCQICL

SEQ ID NO: 204212 - protein, 122 aa, Glycine max
  Coding DNA Sequence Number=SeqID_87434
  Homolog annotation: Hit_ID=Q9FT44; Match level="QueryCoverage=69%, HitCoverage=2%, E-value=3e-19, Identity=56%"; Hit description=VPS13 -like protein
MEKESDLDDILNYRSAAEYEMQEFLSRCSMPNNGKINNDIPTEKSCNDEHTVKSRGWLNWLSRGMLGAGGTDDSSQFSGVVSYDVKMTAKLLEGWQVVDDHYYDVLRFTLSNLYYTSINAEK

SEQ ID NO: 204213 - protein, 164 aa, Glycine max
  Coding DNA Sequence Number=SeqID_87435
  Gene Ontology: Mol. function=nucleic acid binding; Cellular component= endoplasmic reticulum membrane; Biological process=DNA integration
  Homolog annotation: Hit_ID=Q1S4N1; Match level="QueryCoverage=99%, HitCoverage=20%, E-value=2e-44, Identity=41%"; Hit description =Peptidase S8 and S53, subtilisin, kexin, sedolisin; Integrase, catalytic region; Zinc ...
  Homolog annotation: Hit description=finger, CCHC-type; Peptidase aspartic, catalytic
MDVKSAFLNRYLEEEIFVEQPEGFFVQGQEEKVDNDILVVSLYVDDLFVIGSHNELIDKFKERMKDAFEMIDLGNMKFFLECKPTATPMNQKEKFCKEDEAKRVDERYMHCASEIHFQAAKRILRYVKGTIDYGIRFSQVKSFNLLGYSDSDWAGCVDDKRSTS

SEQ ID NO: 204214 - protein, 1646 aa, Glycine max
  Coding DNA Sequence Number=SeqID_87436
  Gene Ontology: Biological process=protein localization
  Homolog annotation: Hit_ID=Q9FT44; Match level="QueryCoverage=92%, HitCoverage=49%, E-value=0.0, Identity=40%"; Hit description=VPS13 -like protein
MKEEKDSQVVLLSGNLSSPGAAVGEDCVSGPNIEVDQYSDVAMLADACFAMHYESSRTDVLCHKIFMYLNNADIHCYPHIAGLLIGFFHRLSAYSSSFEKSSASNTVDISKIFSSFGLQKFGFSNYFEFGFTDSACIPLDCFPFVTIHNSGSLGNLESALVHAIPDWRKYFILRDRKIKSSNINMRRGSKFFQVSPSKSKSDFVYSHETGIASTCDIFSTELHLFGIRAHFHDSSCIIGTIMVPTSKSSLLFCEDSMDILSSSEGLALTSSWGPQNFQDNLWGPSSPNLSPILNVRVRKGQNISSTIDLEISIGIQHVYCMLPSEYLSIIIGYFSLSDWGGASGDQCFSDEQSDTDVKNEMKITYKFEILDSNLIFPVVSNDRQFIKIEMPQLYCSFIENSGVDEVLKNIPPECLVPIHKLAKRNDCLNVFGRDLFVSFLLYKNDLLGLATVERNTEFLTSALIAPINADVWVRIPVGGKSNCKSTSSICFMTSISSCHIVAEDLGFSSVVFYSPRDSILAKCTPTSFSMSVLSISFSQSIGGKNKLDLCLSSIDIWLHLAEWTEVVKFLNHFRLHLERTPVNAITNSLSVDASNSVKKSTVQHSSSFLDSESTSAPFTSQEIENDVFIIKSENFCITFHIPVWVGEEPHVEFQHSQGLNVTPLSVSSDIVEEKDAKFLTVSFNMNGFELVIRSRDIQLTSKMEKLSSVIMIVENGRHTSCPLLDVIEVQVDAVLCKNHTNTIELNVEIACDNSNVWISHPTFHLWNAVKFDVPESGPSQYSTSGITFKFQMRKVSILLTDGRWSYNGPELEILVRNILFHTIASGKHMECSVNGDLQVNYNNIEKVSWEPFIEPWKFVLTLVREQEMSVMPNRSVSTDIILKSTTQLNINITESLVECLSRATEMFSDALGLMVLDDHEGNKLVHSPCAEYMCTRKCGAPYVLQNLTSVPLLYQVFHGLVNPDDLHDSDENHAKYVQPGSSIPIYMDENAEQQLSRFRPSHSSDSLNEPRSNGFAHHYITVQLEGTSRSSGPISMDLVGLTCFEVNFSKTYNDTAEDNSLNTSPTFVVPVVFDVSVLRHSKLIRIYSTVVLLNATSTPVELRFDIPFSVSPTLLGPIQPGQQFPLPLHLAEAGCVRWRPMGNSYLWSEAHNLTNLLSVNSKVGNFKSFMCYPSHPSSRPFRCCLSVKNISLTSSGWLKNNVPANDVKKHYIHHLILSAPLIINNYLPKEILLISESGGVGHTVRVSEVGTSVYHIDPSHDLGLEICIDGFKCSNFKFPRLETFCTMAKFTEPKFSFSETLIFEPNSSNGPVYVTVEKVMDAYSGSRELIFFVPFILYNCMGFPLCVTEATGETNEREFVIPSYFDGGENETLSYKKDGLSLLTSNRELPVEVPHNPRSYMKNHTISYREDGSANSIGNYHKNLGRQHSKIDSIFRNSSSGKLKSMLSSKIQSTWKDSGSGNHEREKVQPCIYSPSPDSSVNDAFVKVCRCFSEDAKEQLPYSLWSNPFSLLPPSGSSTILVPQLTSNSAFILAMTCNSVTEQYAGRINAITFQPRYVISNACSKEISYKQKGTDAVFYLGIGKHDHLHWTDTTRELLVSICYNESGWQWSGSFLPDHLGDTQLKMRNYVFGTSNMIRVELHYFSS

SEQ ID NO: 204215 - protein, 287 aa, Glycine max
  Coding DNA Sequence Number=SeqID_87437
  Homolog annotation: Hit_ID=Q9FT44; Match level="QueryCoverage=70%, HitCoverage=5%, E-value=5e-14, Identity=29%"; Hit description=VPS13 -like protein
  Subcellular localization annotation: CTP_CleavageSite=12; ConfidenceScore=5.10e-01
MAQGGHRSKGPVAGSSENSSHETNLREVLKSRSLCCKSTNSLESFSSKVEEQPYSLKNFLNSISTSGICLGIQLQDLYDYFDVTLNDFKIIMVNSDQSQKVYILEKFSVSFFLALCMIPDESILKQLEVYVLIESLKVHFSPSIYGAFIELTNHLGTLHVTGESGVLNSPHPPNIVSVLPTYSTFGISIVSIIDSIDLDVDLEDSGDNSSKLMVSLQKMVLRYHQHLQYPEGTLYWSPVISQDINEEPVSEMLRHGNGAGRVRVLSSQSLTPTPQHIPIPVPDTRRV

SEQ ID NO: 204216 - protein, 243 aa, Glycine max
  Coding DNA Sequence Number=SeqID_87438
MGSTGSNTPCLASINALEIRSFTRVRLESLLSGYVNELAGVGVPVRHGEHINAILQGLPSGYAPVVSVIESKKCTPSIAEIETLRGGYGRSNGGRNTLFDRGVGHSGSGRSSNTRVNPSSKSVAQLTNQPSVMLTTSASHGNVQASGFQILELVSIHGKKTRTRGYPPESVPTLTGNTRVDRVWFGFGFSPITKSRVQYGDGTINSNPSGIGYGYGDMLRSRGKGLGRQYPYPTRPIAMSKHF

SEQ ID NO: 204217 - protein, 103 aa, Glycine max
  Coding DNA Sequence Number=SeqID_87439
MEGSNEGPHRYSNLNLEEKKTQTIKQRIKNKYLAIEKVNCYCFFVHLREKEPSTIFHPHGCYYALGCHCVSLLKDGKGFNKEHKTRLLRFVTCTSKVYCYPGL

SEQ ID NO: 204218 - protein, 474 aa, Glycine max
  Coding DNA Sequence Number=SeqID_87440
  Gene Ontology: Mol. function=protein binding; Cellular component =cytosol; Biological process=protein localization
  Homolog annotation: Hit_ID=Q9FT44; Match level="QueryCoverage=94%, HitCoverage=14%, E-value=1e-116, Identity=49%"; Hit description =VPS13-like protein
MKPARTFYLSVHAEGATKVLSVLDSNYHIFNDVKKSSVPLPTEKRLCDHSLVRASEYKEKISICVPYIGISLIDSYPQELLFACIKDVEMNLLQSLDRQCLSLLILFIQIDNQLRSTPYPVMLSFDSGYRSGHVDHMKSRDDVNAYHIMLNSCRMEDFRLEIEQEVILSLFEFFTNVSSGMQYGIMPSSDPYDGVSLENSSSFVQTSENFRLSAHQCSPRISPMFDEKSKRIASLPSVVPIGAPWQEIFLLARTQKKIYIEMLELSPIKLTLSFSSAPWMLRNRILTSKEFLIHRGLMALADVEGAHIYLKDLIIAHHMASWESIQEILIRHYNRQLLHETYKLFGSAGVIGNPLGFARSMGLGIRDFLSVPAKSIVRSPTGLIMGMAQGTTSLLSNTVYAISDAASQFSKAARKGIVAFTYDDQAVSRMEKHQAIVASDSKGVINEVLECGMPKRNIDRKAFSLYNGFRDDTC

SEQ ID NO: 204219 - protein, 266 aa, Glycine max
  Coding DNA Sequence Number=SeqID_87441
  Homolog annotation: Hit_ID=Q9FT44; Match level="QueryCoverage=95%, HitCoverage=7%, E-value=2e-68, Identity=55%"; Hit description=VPS13 -like protein
MYQPPAVPLGLTGLLQFPVTGAERHGLPGVLSGVALGITGLVAKPAASILEVTGKTALSIRNRSKPSQLRLQHFRVRLQRPLCREFPLKPYSWEEAVGTSVLVEADDGLKFKDEKLVACKALKEAGKFVVITERFVLVVFSASLINLGKPEFRGIPVDLEWIIEWEIGLENIIHADCSEGVVHIVGSRPDSLLRQNQHSPKGGSGGRTRSVRWNQFATHLPFPQTNLELASEEDAANLLQILLSAIEKEKGKAWDGGRILHRSRMK

SEQ ID NO: 204220 - protein, 56 aa, Glycine max
  Coding DNA Sequence Number=SeqID_87442
MECMKDCKQTDGSGGAYVRRIYFSVQAGKGEMVPEGGHVNGINWKQETVSERKNWH

SEQ ID NO: 204221 - protein, 333 aa, Glycine max
  Coding DNA Sequence Number=SeqID_87443
  Gene Ontology: Mol. function=protein serine/threonine kinase activity; Cellular component=integral to membrane; Biological process=protein amino acid phosphorylation
  Homolog annotation: Hit_ID=Q9FNL4; Match level="QueryCoverage=98%, HitCoverage=99%, E-value=2e-92, Identity=54%"; Hit description =Serine/threonine protein kinase-like protein
  Pfam annotation: Domain name=Pkinase; Domain location=63-324; Score =42.7; E_value=4.2e-11; Accession=PF00069.15; Description=Protein kinase domain
  Pfam annotation: Domain name=Pkinase_Tyr; Domain location=63-324; Score=-36.3; E_value=3e-10; Accession=PF07714.7; Description=Protein tyrosine kinase
  Pfam module annotation: Pfam domain module=Pkinase::Pkinase_Tyr; Domain location=63-324::63-324
MNHGTYIAYDVVMVTLSISFFVLAVVLYLVCKKKPVESEETLAVKHCARAYSLMDIHAATDGFNHSRILGKGRVGTVYAGVQENGELVAVKRIHSVLVLSNAGFGFSSVLKWLSSAQHPNIVSILGFSEAPGERIIVMEFGRMVSLDFYLHQNVNGASLLDWNKRIRIASGAARGIQYLHEVATPNIVHGCVKSSNVLIDVNFCPRICDYGLNFLAPREKRGLVGYVDDEYWNEEGGGAGKESDVYGLGVIMLELLSGRGCEEGLIAKWALPLIKETSFGELLDARLVIPSDMKPLVRLAKVASACVGNSRKCRPSIAQVTTILNNIEMEVCI

SEQ ID NO: 204222 - protein, 601 aa, Glycine max
  Coding DNA Sequence Number=SeqID_87444
  Gene Ontology: Mol. function=phosphotransferase activity, alcohol group as acceptor; Biological process=protein modification process
  Homolog annotation: Hit_ID=Q9ZPY9; Match level="QueryCoverage=98%, HitCoverage=99%, E-value=0.0, Identity=58%"; Hit description =Expressed protein
  Pfam annotation: Domain name=PI3_PI4_kinase; Domain location=294-553; Score=281.8; E_value=1.3e-81; Accession=PF00454.17; Description =Phosphatidylinositol 3- and 4-kinase
  Pfam annotation: Domain name=ubiquitin; Domain location=121-192; Score=21.5; E_value=0.0017; Accession=PF00240.13; Description =Ubiquitin family
  Pfam annotation: Domain name=ubiquitin; Domain location=42-113; Score= 68.1; E_value=2.9e-17; Accession=PF00240.13; Description=Ubiquitin family
  Pfam module annotation: Pfam domain module=PI3_PI4_kinase::ubiquitin:: ubiquitin; Domain location=294-553::121-192::42-113
MSSAGVSTLTVVPTEPLLSPKAFPFPIPSHLSLEDKSIFIYLSFSGSLTPIRVMEWDTIESVKFKIQRCESLPFLTNKQKLVYAGRELARSDTPLKDYGVTDGNVLHLVIKLSDLQVINVKTSCGKEFTFQVERGRDVGYIKQRIARREKQFDDPEEQELVCNGERLEDQRLIDDICCKHNDAAVHLFVRKKHVKVQRRPLELSIVAKDLIDKKKNDVNGNTNRRSYDVGKEDTIRKSDVIQRAVPRKPPGRDFILEPVIINHKIELAPAIRNMVNSTYEGLGSGKCPIRSAEGTGGAYFMLDSAEQKYVSVFKPIDEEPMAVNNPRGLPLSLDGEGLKKGTRVGQGAFREVAAYVLDHPLSGCQRHSLFGDGKGFAGVPPTLMVKCLHKAFNYPRELTPKIGSLQMFTENSGSCEDMGPGAFPVKEVHKITVLDIRLANADRHAGNILISKEEDNNQSVLIPIDHGYCLPTSFEDCTFEWLYWPQARQPYSSETIDYIKSLDAEEDIALLKFHGWDLPVECARTLRISTMLLKKGVERGLTPFAIGSLMCRESLNKESVIEEVVQAALDSVLPGTSEATLLDSVSQILDLHLDEIVRSHL

SEQ ID NO: 204223 - protein, 201 aa, Glycine max
  Coding DNA Sequence Number=SeqID_87445
  Gene Ontology: Mol. function=nucleic acid binding
MAAKWKRKRERRRHWELMDKFQRLKQGSMSVEEYRQQMELLFLRAGLREEKRTSIARFLSELNMKVSDKVKLLPYRDLDELVQLCIRVKQQLKRKSSLKSYGFHSYPRKDQAQRILGAAPSKPKEDKGKTIEKSINPKAFYCIFSPIFLESSIQCPWGVGLHQKRHKSPLVTVNFNAECGVGSVSVFLASLRSQLFFLNIP

SEQ ID NO: 204224 - protein, 307 aa, Glycine max
  Coding DNA Sequence Number=SeqID_87446
  Gene Ontology: Mol. function=zinc ion binding; Cellular component =nucleus; Biological process=ubiquitin-dependent protein catabolic process
  Homolog annotation: Hit_ID=Q6KAC3; Match level="QueryCoverage=80%, HitCoverage=71%, E-value=1e-138, Identity=89%"; Hit description =Putative Ubiquitin ligase SINAT5
  Pfam annotation: Domain name=Sina; Domain location=87-286; Score =418.7; E_value=8e-123; Accession=PF03145.7; Description=Seven in absentia protein family
  Subcellular localization annotation: CTP_CleavageSite=88; ConfidenceScore=5.02e-01
MVAPRFDLMHSTPSRTTRPTLVDKCPILHAPNVQFWMKSSKRGGARAPAPPPLDLSLHCHNGHTLCSTCKTRVHNRCPTCRQELGDIRCLALEKIAESLELPCRYISLGCPEIFPYYSKLKHEAICNFRPYNCPYAGSDCSVVGDIPCLVAHLRDDHRVDMHSGCTFNHRYVKSNPMEVENATWMLTVFHCFGQYFCLHFEAFQLGMAPVYMAFLRFMGDEREARNYSYSLEVGGNGRKLTFEGSPRSIRDSHKKVRDSHDGLIIYRNMALFFSGGDRKELKLRVTGRIWKEQQNPEGGVCIPNLCS

SEQ ID NO: 204225 - protein, 87 aa, Glycine max
  Coding DNA Sequence Number=SeqID_87447
  Pfam annotation: Domain name=DUF212; Domain location=4-82; Score= -59.1; E_value=0.076; Accession=PF02681.5; Description=Divergent PAP2 family
MSKIIEIITCTLLSQHTPMAFYCYGSLGYQEVYLKCNLIVADLFQGHPISERKLKELLGHTPSQVFAGALLGFLVACFSCQAYMVGA

SEQ ID NO: 204226 - protein, 319 aa, Glycine max
  Coding DNA Sequence Number=SeqID_87448
  Gene Ontology: Mol. function=binding
  Homolog annotation: Hit_ID=Q7EY18; Match level="QueryCoverage=77%, HitCoverage=15%, E-value=8e-29, Identity=30%"; Hit description =Putative tetratricopeptide repeat(TPR)-containing protein
MIDAVEDPVDSHKLKIDTSNSDCFESPNHTNAIMQEGEELRVSLSPSSQGDSQGIPYKKLSASAAPFNPSPGIARAAPFAMNTTLPSAAGAVSPIGPWPVNMNVHHGPATMLPAVIPMCSSPHHTYPSPPPTPNMMIQPLPYMYPPYTQPQSIPTNNFPVTSSGFHVNQFSWQSFVLPEDINNVSENKKDVQALESETSDDEVGRVNAESVKENGNPNFHGFENAANKPNRNIGLNNISRNEKNIDGEKTFSILIRGRRNRKQTLRMPISLLTRPNSSQSFKVLYITVWSEEVMYPSPSACLLEGIVQLLLNPHFFCCY

SEQ ID NO: 204227 - protein, 134 aa, Glycine max
  Coding DNA Sequence Number=SeqID_87449
MRCTHGPEIYPKAHKNPRAFSCISGPIYLEFSIQCPCGVGLHQLSKWKKFSNNSAKILVSPFGILLVCVDVKSTSKCTGSSTINVNKCENKYLKALGPLTKKIDAIKDVSLIKDVFVFYAEGSSAKHQCLLSLA

SEQ ID NO: 204228 - protein, 329 aa, Glycine max
  Coding DNA Sequence Number=SeqID_87450
  Homolog annotation: Hit_ID=Q4SVC5; Match level="QueryCoverage=77%, HitCoverage=34%, E-value=1e-08, Identity=26%"; Hit description =Chromosome undetermined SCAF13766, whole genome shotgun sequence
MDEIDECLEILHAKQESVSDDILDDEELGDFRSLELQQLRLEALKEGEKVYEDNDNKSDDSGTDSLLHRGREVESNTPRSKLKAEAPVVRWSSYLDNWGSNTVFMANQRGLELESHWGRVDNDAVIPADKIAELNVHAMPYEEKEIEIQPCLAPLRKGGLCQRRDLKVCPFHGSIIPRDDEGRPLNENSSDGMNIDLRTDLVEQLAKQAVKNVRERDQEVARKREIDEQSLKRAKLAKVREHNEAVLRDAALASTSRSAMLGEDGEATNEDKLSARDKKQSLASMLRKKVTSKDRIAQKLLSSRARVTADRQHVSCEDAKYREAFPNQW

SEQ ID NO: 204229 - protein, 65 aa, Glycine max
  Coding DNA Sequence Number=SeqID_87451
MGTEEGAHGKVTKVVSLIEKATNSTAPEVDPRLLKAIKTVVRYSDSELRLATQTLMDLMKRFYSQ

SEQ ID NO: 204230 - protein, 96 aa, Glycine max
  Coding DNA Sequence Number=SeqID_87452
MSLPSAVHVFSLIKCEASGDWEARYSVVFQIGSFAKTDEISPIFAFLLSPMRGSRLACSVKFGNVAEVEKRKQPGSPGRAELAWASWAANISPILL

SEQ ID NO: 204231 - protein, 50 aa, Glycine max
  Coding DNA Sequence Number=SeqID_87453
MNYFIHHALQIFGKLEAIGTDEDSVKTSLDGWSTALLPRLASGKAHQSLR

SEQ ID NO: 204232 - protein, 213 aa, Glycine max
  Coding DNA Sequence Number=SeqID_87454
MHINTGIVRSSDSTELAPMSKISGMMIRILELGSENFKKILNGTYSGLLLKVDGLSETKFKVTVPSKLHHSNGEANYPWFLLIEIKNQTYQQTQTQVKRLPNSASSPPLQFQYSLEVHQILPKVEETSLLHLSYSQSVVLGGGDGYVRVTWQTSVFSQVATRGSATDVENGVHCENKERGMWYGMVDGVGFEKRKCPPKDFLWCLHSLILMTI

SEQ ID NO: 204233 - protein, 542 aa, Glycine max
  Coding DNA Sequence Number=SeqID_87455
  Gene Ontology: Mol. function=transcription regulator activity; Cellular component=nucleus; Biological process=regulation of transcription
  Homolog annotation: Hit_ID=Q5N8F6; Match level="QueryCoverage=95%, HitCoverage=97%, E-value=1e-82, Identity=40%"; Hit description=BHLH protein-like
  Pfam annotation: Domain name=HLH; Domain location=378-427; Score =50.2; E_value=7.1e-12; Accession=PF00010.16; Description=Helix-loop -helix DNA-binding domain
MKVDAGLGRVVWDDEDKAMLGAVLGGRALEFLMTNSVPNESVLMAVGSDEGLQKKLSDLVERPHVSNFSWNYAIFWQLSQSKSGDWVLGWGDGCCREPNEEEEEGAVTVRRRTLRVDEEEMQQRMRKLVLQKLHTTFGGEDDDNYAFGLDHVTDTEMFFLASMYFSFPRGHGAPGKCFASGNHFWLKSVSVSDHCVRSSLANSAGIQTIVLVPTDLGVVELGSVRMLPESFELLQAVKSVFSTPIPKVLVNTIRNQTHFREKLAVRKMEDNRPWNNNNVSFPNVRSNGLHVSSCWPVNSGLRQPAPRVVAELANGVRQDLRLSNSYEPQRQVQMQIDFSGGTSRPSDVEASCKEEQPSVADERKPRKRGRKPANGREEPLNHVEAERQRREKLNQRFYALRSVVPNISKMDKASLLGDTIAYINELQAKVKIMEAERERFESISNQEKEAPADVDIQAVQDDEVIVRVSCPLDNHPLSKVIQTFNQTQISVVESKLASANDAIFHTFVIKSQGSEQLTKDKLIAVFSPTESNSLQPLSSVGW

SEQ ID NO: 204234 - protein, 591 aa, Glycine max
  Coding DNA Sequence Number=SeqID_87456
  Gene Ontology: Mol. function=transcription coactivator activity; Biological process=regulation of transcription, DNA-dependent
  Homolog annotation: Hit_ID=Q93YB6; Match level="QueryCoverage=98%, HitCoverage=88%, E-value=9e-73, Identity=31%"; Hit description=PBF68 protein
  Pfam annotation: Domain name=DEK_C; Domain location=5-60; Score=38.5; E_value=2.2e-08; Accession=PF08766.1; Description=DEK C terminal domain
  Pfam annotation: Domain name=PC4; Domain location=65-212; Score=41.2; E_value=3.4e-09; Accession=PF02229.6; Description=Transcriptional Coactivator p15 (PC4)
  Pfam annotation: Domain name=zf-CCHC; Domain location=546-563; Score =17.5; E_value=0.0013; Accession=PF00098.13; Description=Zinc knuckle
  Pfam module annotation: Pfam domain module=DEK_C::PC4::zf-CCHC; Domain location=5-60::65-212::546-563
MEAETRRKVEEMVLDILKKSNIKEATEFTIRVAASERLGIDLSDTASKHFVRSVVESFLLSVAANEKSKDAEKKKENEDIAAKNDDVAKKEDVVVANEEESRETELSNRRNVAVKDFKGTTLVSIREFYMKDGKPLPGSKVLSLFSVSHCSVSGNPWFWHYDLLVSVIEICRWQTQPLLLLPHLVFMSCGISLSSEQWSTFKKSVPAIEEAIKKMEERIGSEPNGKQNGDVSNSVVDVAYLEPNSKQKGDASNSVVDVATLEPHGKQNGDASNSVVDVAPLEPHGKQNGDASNSVVDVAPLEPVVPIEVIRFDGKNFQFWAPQMELLLKQLKIDYVLDEPCPNPTLGKSAKAEDIAATKAAERRWLNDDLTCQRNILSHLSDPLYNLYANRKMSAKDLWEELKLVYLYEEFGTKRSQVKKYLEFQMVEEKAVIEQIRELNGIADSIAAAGIFIDDNFHVSAIISKLPPSWKDFCIKLMREEYLPYRKLMERIQIEEEYRYGVKRVVEYSYSMGGYHQAYKGGHRRADYKPALGMCRNRPEIIARSVPCTVCGKRGHLSKHCWRRNDRQTNERKSEEDVRIPTEVDTQGATQ

SEQ ID NO: 204235 - protein, 186 aa, Glycine max
  Coding DNA Sequence Number=SeqID_87457
  Pfam annotation: Domain name=FAR1; Domain location=21-175; Score= -59.7; E_value=0.027; Accession=PF03101.5; Description=FAR1 family
MVLGMEHIDEEVDANDENGINERGFSLMMPWLVTYFHTFVCSRQGVHKDRRLTAKTRKHEPRNDIRCKCLAKFVHVKKNHGRRGVKEFTNDHKHELLEKDYCSLVPSHKKMTPGDVLKIKNLRKTDIMTPQIFGSLANISGGYDTQFIDTMKGKALVFIITDGDLAMKNAIEVVFLVQIISYAHGS

SEQ ID NO: 204236 - protein, 41 aa, Glycine max
  Coding DNA Sequence Number=SeqID_87458
MESTASFILPHYEVVKTRQHLVPLSPTLGQRKAPCKNLKRT

SEQ ID NO: 204237 - protein, 164 aa, Glycine max
  Coding DNA Sequence Number=SeqID_87459
  Gene Ontology: Mol. function=protein binding; Cellular component =membrane; Biological process=defense response
  Homolog annotation: Hit_ID=Q1T2T9; Match level="QueryCoverage=72%, HitCoverage=11%, E-value=5e-22, Identity=43%"; Hit description =Disease resistance protein; AAA ATPase; Tumor Necrosis Factor
EIPKWFHYVNKGRFPDFKARGKFPAVAIAFVFGEVNAIDKANRSINVGIHLLIEDERRKFRNVPVPENHVFLCDLRGLFSLEEWEDVGVGVGNDWKTIQVYCDTKLPLCSWGVYVYKSETDYAATSYQIGALIKERGFPVYLNPNNEVTLGFNIEDEEEDDEID

SEQ ID NO: 204238 - protein, 884 aa, Glycine max
  Coding DNA Sequence Number=SeqID_87460
  Gene Ontology: Mol. function=transmembrane receptor activity; Cellular component=membrane; Biological process=defense response
  Homolog annotation: Hit_ID=Q1T2S2; Match level="QueryCoverage=98%, HitCoverage=63%, E-value=0.0, Identity=46%"; Hit description=TIR; Disease resistance protein; AAA ATPase; Tumor Necrosis Factor
  Pfam annotation: Domain name=LRR_1; Domain location=557-582; Score =8.1; E_value=8.6; Accession=PF00560.23; Description=Leucine Rich Repeat
  Pfam annotation: Domain name=LRR_1; Domain location=620-642; Score =5.9; E_value=23; Accession=PF00560.23; Description=Leucine Rich Repeat
  Pfam annotation: Domain name=LRR_1; Domain location=643-665; Score =13.3; E_value=0.87; Accession=PF00560.23; Description=Leucine Rich Repeat
  Pfam annotation: Domain name=LRR_1; Domain location=667-691; Score =5.7; E_value=25; Accession=PF00560.23; Description=Leucine Rich Repeat
  Pfam annotation: Domain name=LRR_1; Domain location=714-735; Score =0.7; E_value=2.1e+02; Accession=PF00560.23; Description=Leucine Rich Repeat
  Pfam annotation: Domain name=LRR_1; Domain location=737-759; Score =9.2; E_value=5.5; Accession=PF00560.23; Description=Leucine Rich Repeat
  Pfam annotation: Domain name=LRR_1; Domain location=789-811; Score =2.2; E_value=1.1e+02; Accession=PF00560.23; Description=Leucine Rich Repeat
  Pfam annotation: Domain name=LRR_1; Domain location=814-835; Score =10.7; E_value=2.9; Accession=PF00560.23; Description=Leucine Rich Repeat
  Pfam annotation: Domain name=LRR_1; Domain location=837-859; Score =9.2; E_value=5.5; Accession=PF00560.23; Description=Leucine Rich Repeat
  Pfam annotation: Domain name=NACHT; Domain location=213-366; Score= -3.5; E_value=0.00011; Accession=PF05729.3; Description=NACHT domain
  Pfam annotation: Domain name=NB-ARC; Domain location=174-468; Score =175.3; E_value=1.5e-49; Accession=PF00931.13; Description=NB-ARC domain
  Pfam annotation: Domain name=TIR; Domain location=16-149; Score =168.3; E_value=2e-47; Accession=PF01582.10; Description=TIR domain
  Pfam module annotation: Pfam domain module=LRR_1::LRR_1::LRR_1::LRR _1::LRR_1::LRR_1::LRR_1::LRR_1::LRR_1::NACHT::NB-ARC::TIR; Domain location=557-582::620-642::643-665::667-691::714-735::737-759::789 -811::814-835::...
  Pfam module annotation: Domain location=837-859::213-366::174-468::16- 149
MENHGAVSETKCTFDVFLSFRGEDTRHTFTCKLYDALWLKGIDTFMDNKELKNGDKIGPTLHKAIEEARISVVVLSENYADSSWCLDELVKIHECMESKNQLVWPIFYKVNPSDVRHQKGSYGVAMTKHETSPGIDLEKVHKWRSTLNEIANLKGKYLEEGRDESKFIDDLATDIFKIVSSKDLSREMFIVGREYRVKELKLLLDLESRDITCLLGIHGTGGIGKTTLAKALYDSIYKQFDGTSFLNVGETSNPKTDLKHLQEKLLSEILEDDKIHWRNIEEGTAKIERRLGFKRVLIVLDNVDDIKQLNNLAGKCAWFGPGSRIIITTRDKHLLDLGEVEKRYEVKMLDEKESLELFCHYAFRKSCPESNYKDLSNRAMSCCKGLPLALEVLGSHLFKKNVDVWKDALDRYEKSPHGNVQKVLRISYDSLFRHEKSIFLDVACFFKGQRLDYVKTVLDASDFSSGDGITTLVNKSLLTVDYDCLWMHDLIQDMGREIVKEKAYNKIGERSRLWHHEDVLQVLEDDNGSSEIEGIMLDPPHRKEINCIDTVFEKMKNLRILIVRNTSFSHEPRYLPKNLRLLDWKNYPSKSLPSEFNPTKISAFNGSPQLLLEKPFQFDHLTYMNISGCDKVSEFPDVSRAMNLRKLILDGCENLVSIHKSVGHLANLVSLSASNCTQLHSFVPTIYLPSLESLSFVLCTTLAHFPDIEGKMDKPLEIVMSYTAIQKLPDSIKELNGLTYLEMTGCEELRYLPSSLFKLPNLVTLKLAECAFLPRSLRMFIGSPSTCAKLETLHFDNTGLTDYDLKTIVAIFPNLKDLNVSRNRFSDLTLSIGKFTNLTSLDVSYCTDLKGMPSILPSSVQKVDARECRSLNQFSSNALWIQVY

SEQ ID NO: 204239 - protein, 497 aa, Glycine max
  Coding DNA Sequence Number=SeqID_87461
  Gene Ontology: Mol. function=hydrolase activity, hydrolyzing O -glycosyl compounds; Cellular component=integral to membrane; Biological process=polysaccharide catabolic process
  Homolog annotation: Hit_ID=Q1SFD1; Match level="QueryCoverage=95%, HitCoverage=76%, E-value=0.0, Identity=75%"; Hit description =Glycoside transferase, six-hairpin, subgroup
  Pfam annotation: Domain name=Glyco_hydro_9; Domain location=1-461; Score=614.7; E_value=8e-182; Accession=PF00759.9; Description =Glycosyl hydrolase family 9
MAGRLPKSNGIPWRGNSGLNDGNDTTDVKGGLVGGYYDAGDNTKFHFPMAFAMTMLSWSVLEYKQKYMAINEYAHTRELIKWGTDYLLLTFNNSATKIDKIYGQVGGSLNGSTTPDDHYCWQRPEDMEYQRRTISIHQGADLAGEMAAALASASIVFQDDVAYSKKLIKGAQTVFDFARDSGKRKPYSRGEPYIEPFYNSSGYYDEYMWGAAWLYYATGNSTYISLATNPSIFKNSKAYFLTPDFSVLSWDNKLPAAMLLLTRFRMFLNPGYPYEDMLKMYHNVTSLTMCSYLHHYKVFNRTRGGLIQLNHGQPQSLQYAANAAFMASLFADYMLEIDVPGWQCGSTYFPISALKAFATSQIEYILGKNPMKMSYIVGFGNKFPKHVHHRGASIPNDHKHRSCTGGWKWRDTPNPNPNTITGAMVGGPDRFDQFRDSRKNYNFTEPTLAGNAGLVAALISLTSTTGSGIDRNTIFSAIPPLGPQNPPPPPPWKPIKT

SEQ ID NO: 204240 - protein, 320 aa, Glycine max
  Coding DNA Sequence Number=SeqID_87462
  Homolog annotation: Hit_ID=Q9LUA7; Match level="QueryCoverage=87%, HitCoverage=89%, E-value=8e-85, Identity=57%"; Hit description =Arabidopsis thaliana genomic DNA, chromosome 5, P1 clone:MIF21
  Pfam annotation: Domain name=DUF868; Domain location=39-319; Score =500.5; E_value=2e-147; Accession=PF05910.3; Description=Plant protein of unknown function (DUF868)
  Subcellular localization annotation: CTP_CleavageSite=50; ConfidenceScore=5.07e-01
MRRSFRVSMTRAALGGRVAATGRSSLVERVSEELLPFPSKSSQSTVTFIYQANVAGYSRHVSVLWCKNLMNHTLNLKVDSTRGDFSYTCKIQVKPWYFWNKKGYKSFEVDGHQVEVYWDLRSARFVGSSPEPGSDYYLAMVSDEEVVLLLGDQKKKAYKRMKMRPSIVEALLLVKRESVFAKKSFATKARFDEKRKENDIVVESSTFGNKEPEMWISIDGIVLIHVKNLQWNFRGNQTVMVNKQPVQVFWDVHDWLFSVPGSGPGLFIFKAGPVEVESEKEERVNEGCDSDNGSCASGYYSTLSYAPSESCLVLYAYKLE

SEQ ID NO: 204241 - protein, 134 aa, Glycine max
  Coding DNA Sequence Number=SeqID_87463
  Gene Ontology: Mol. function=hydrolase activity, hydrolyzing O -glycosyl compounds; Cellular component=integral to membrane; Biological process=polysaccharide catabolic process
  Homolog annotation: Hit_ID=Q1SFD1; Match level="QueryCoverage=99%, HitCoverage=21%, E-value=9e-38, Identity=58%"; Hit description =Glycoside transferase, six-hairpin, subgroup
MHSRNNWGGSFEMSSSGEEVSGYEANNNHNKEWDRAALLERYHPQSQDLDETLQSWVLGRGEKSKKTKYVDFGCIMISHKALKWLFGSIFLAFIVIGLPIIIVKSLPKHHSPPTPPDNYTLALHKALLFFNAQK

SEQ ID NO: 204242 - protein, 41 aa, Glycine max
  Coding DNA Sequence Number=SeqID_87464
MKKNSELVANVEKHVHGNWCSVPAKKQMINHNISQLVQYNK

SEQ ID NO: 204243 - protein, 234 aa, Glycine max
  Coding DNA Sequence Number=SeqID_87465
  Gene Ontology: Mol. function=oxidoreductase activity, acting on single donors with incorporation of molecular oxygen, incorporation of two atoms of oxygen
  Homolog annotation: Hit_ID=O49561; Match level="QueryCoverage=98%, HitCoverage=94%, E-value=1e-52, Identity=42%"; Hit description =Gibberellin 2-beta-dioxygenase 8
  Pfam annotation: Domain name=2OG-FeII_Oxy; Domain location=103-200; Score=112.2; E_value=1.5e-30; Accession=PF03171.10; Description=2OG -Fe(II) oxygenase superfamily
MDYEPPFLEFYKPLLLQGSHRVDVAISGGAIRNDKSEWCELPLIDLGRLSLGGGGEKEECMREISEAARTWGFFQVVNHGVSQELLQSLRHQQVEVFRTPFARKSQESFFNLPARSYRVFGLLSHTDSSFLTIVNQDQIGGLQIMKDGNWVGVKPNPQALVVNIGDLFQALSNDIYISAKHRVVAAEKVERFSVAYFYNPSKDALIESHIMPPMYRKFTFGEYRGQIEKDVKET

SEQ ID NO: 204244 - protein, 78 aa, Glycine max
  Coding DNA Sequence Number=SeqID_87466
  Homolog annotation: Hit_ID=Q6R062; Match level="QueryCoverage=70%, HitCoverage=28%, E-value=2e-07, Identity=31%"; Hit description=MYB transcription factor
MKKNSKLVAYAKKHGHGNWRTVPAKALLRNKWSIIASHLSKQTNKETMNYWNTNIKKLKVYQNGRHTFNYTQTKSQHL

SEQ ID NO: 204245 - protein, 989 aa, Glycine max
  Coding DNA Sequence Number=SeqID_87467
  Gene Ontology: Mol. function=protein serine/threonine kinase activity; Cellular component=integral to membrane; Biological process=protein amino acid phosphorylation
  Homolog annotation: Hit_ID=O82432; Match level="QueryCoverage=99%, HitCoverage=98%, E-value=0.0, Identity=66%"; Hit description=Leucine- rich receptor-like protein kinase
  Pfam annotation: Domain name=LRRNT_2; Domain location=15-55; Score =62.1; E_value=1.8e-15; Accession=PF08263.3; Description=Leucine rich repeat N-terminal domain
  Pfam annotation: Domain name=LRR_1; Domain location=110-132; Score =16.4; E_value=0.1; Accession=PF00560.23; Description=Leucine Rich Repeat
  Pfam annotation: Domain name=LRR_1; Domain location=134-156; Score =21.0; E_value=0.0042; Accession=PF00560.23; Description=Leucine Rich Repeat
  Pfam annotation: Domain name=LRR_1; Domain location=158-180; Score =15.1; E_value=0.26; Accession=PF00560.23; Description=Leucine Rich Repeat
  Pfam annotation: Domain name=LRR_1; Domain location=182-205; Score =12.8; E_value=1.2; Accession=PF00560.23; Description=Leucine Rich Repeat
  Pfam annotation: Domain name=LRR_1; Domain location=207-229; Score =12.4; E_value=1.4; Accession=PF00560.23; Description=Leucine Rich Repeat
  Pfam annotation: Domain name=LRR_1; Domain location=231-253; Score =9.9; E_value=3.9; Accession=PF00560.23; Description=Leucine Rich Repeat
  Pfam annotation: Domain name=LRR_1; Domain location=255-277; Score =15.2; E_value=0.24; Accession=PF00560.23; Description=Leucine Rich Repeat
  Pfam annotation: Domain name=LRR_1; Domain location=279-301; Score =10.1; E_value=3.7; Accession=PF00560.23; Description=Leucine Rich Repeat
  Pfam annotation: Domain name=LRR_1; Domain location=302-324; Score =9.8; E_value=4.1; Accession=PF00560.23; Description=Leucine Rich Repeat
  Pfam annotation: Domain name=LRR_1; Domain location=326-348; Score =12.7; E_value=1.2; Accession=PF00560.23; Description=Leucine Rich Repeat
  Pfam annotation: Domain name=LRR_1; Domain location=350-369; Score =7.6; E_value=11; Accession=PF00560.23; Description=Leucine Rich Repeat
  Pfam annotation: Domain name=LRR_1; Domain location=374-396; Score =7.3; E_value=12; Accession=PF00560.23; Description=Leucine Rich Repeat
  Pfam annotation: Domain name=LRR_1; Domain location=398-420; Score =11.2; E_value=2.3; Accession=PF00560.23; Description=Leucine Rich Repeat
  Pfam annotation: Domain name=LRR_1; Domain location=422-444; Score =4.3; E_value=45; Accession=PF00560.23; Description=Leucine Rich Repeat
  Pfam annotation: Domain name=LRR_1; Domain location=446-465; Score =8.9; E_value=6.3; Accession=PF00560.23; Description=Leucine Rich Repeat
  Pfam annotation: Domain name=LRR_1; Domain location=470-492; Score =13.0; E_value=1.1; Accession=PF00560.23; Description=Leucine Rich Repeat
  Pfam annotation: Domain name=LRR_1; Domain location=494-516; Score =5.3; E_value=29; Accession=PF00560.23; Description=Leucine Rich Repeat
  Pfam annotation: Domain name=LRR_1; Domain location=518-540; Score =10.5; E_value=3.1; Accession=PF00560.23; Description=Leucine Rich Repeat
  Pfam annotation: Domain name=LRR_1; Domain location=542-564; Score =10.6; E_value=3; Accession=PF00560.23; Description=Leucine Rich Repeat
  Pfam annotation: Domain name=LRR_1; Domain location=565-588; Score =13.2; E_value=0.98; Accession=PF00560.23; Description=Leucine Rich Repeat
  Pfam annotation: Domain name=LRR_1; Domain location=61-84; Score=6.9; E_value=15; Accession=PF00560.23; Description=Leucine Rich Repeat
  Pfam annotation: Domain name=LRR_1; Domain location=86-108; Score =7.2; E_value=13; Accession=PF00560.23; Description=Leucine Rich Repeat
  Pfam annotation: Domain name=Pkinase; Domain location=678-959; Score =111.7; E_value=2.1e-30; Accession=PF00069.15; Description=Protein kinase domain
  Pfam annotation: Domain name=Pkinase_Tyr; Domain location=678-959; Score=78.6; E_value=2e-20; Accession=PF07714.7; Description=Protein tyrosine kinase
  Pfam module annotation: Pfam domain module=LRRNT_2::LRR_1::LRR_1::LRR_ 1::LRR_1::LRR_1::LRR_1::LRR_1::LRR_1::LRR_1::LRR_1::LRR_1::LRR_1::LRR_ 1::LRR_1::LRR_1::LRR_1::LRR_1::LRR_1::LRR_1::LRR_1::LRR_1::LRR _1::Pkinase::...
  Pfam module annotation: Pfam domain module=Pkinase_Tyr; Domain location=15-55::110-132::134-156::158-180::182-205::207-229::231 -253::255-277::279-301::302-324::326-348::350-369::374-396::398 -420::422-444::446-465::...
  Pfam module annotation: Domain location=470-492::494-516::518 -540::542-564::565-588::61-84::86-108::678-959::678-959
YILFFSLATTLVSCLNQEGLYLYQLKLSLDDPDSKLSSWNSRDATPCNWYGVTCDAATNTTVTELDLSDTNIGGPFLSNILCRLPNLVSVNLFNNSINETLPSEISLCKNLIHLDLSQNLLTGPLPNTLPQLLNLRYLDLTGNNFSGPIPDSFGTFQNLEVLSLVSNLLEGTIPSSLGNVSTLKMLNLSYNPFFPGRIPPEIGNLTNLQVLWLTQCNLVGVIPTSLGRLGKLQDLDLALNDLYGSIPSSLTELTSLRQIELYNNSLSGELPKGMGNLTNLRLIDASMNHLTGRIPEELCSLPLESLNLYENRFEGELPASIADSPNLYELRLFGNRLTGKLPENLGRNSPLRWLDVSSNQFWGPIPATLCDKGALEELLVIYNLFSGEIPASLGTCQSLTRVRLGFNRLSGEVPAGIWGLPHVYLLELVDNSFSGSIARTIAGAANLSLLILSKNNFTGTIPDEVGWLENLVEFSASDNKFTGSLPDSIVNLGQLGILDFHKNKLSGELPKGIRSWKKLNDLNLANNEIGGRIPDEIGGLSVLNFLDLSRNRFLGKVPHGLQNLKLNQLNLSYNRLSGELPPLLAKDMYRSSFLGNPGLCGDLKGLCDGRGEEKSVGYVWLLRTIFVVATLVFLVGVVWFYFRYKNFQDSKRAIDKSKWTLMSFHKLGFSEDEILNCLDEDNVIGSGSSGKVYKVVLSSGEVVAVKKIWGGVKKEVESGDVEKGGRVQDNAFDAEVETLGKIRHKNIVKLWCCCTTRDCKLLVYEYMPNGSLGDLLHSSKGGLLDWPTRYKIAVDAAEGLSYLHHDCVPAIVHRDVKSNNILLDVDFGARVADFGVAKAVETTPKGAKSMSVIAGSCGYIAPEYAYTLRVNEKSDIYSFGVVILELVTGKRPVDPEFGEKDLVKWVCTTLDQKGVDHLIDPRLDTCFKEEICKVFNIGLMCTSPLPIHRPSMRRVVKMLQEVGTENQTKSAKKDGKLSPYYYDDASDHG

SEQ ID NO: 204246 - protein, 188 aa, Glycine max
  Coding DNA Sequence Number=SeqID_87468
MKYQLLVNYLTLTYMYWNVKDAYDDKFVRIDTTLEKLVKSVSDLAMIFYSQRQNNTHNTTPSLVHMKQQKSTTPKQSSIRKTKKASLSKKAKAHNTKCEAIVNEGGLKKKFFEHTITSNDFGLFSNVEPLYNATYDGMTTIVDIPMWLPMTFRPPLNMILDEVHSLVAAYIFGRNKGDEDNGYDMPLT

SEQ ID NO: 204247 - protein, 225 aa, Glycine max
  Coding DNA Sequence Number=SeqID_87469
  Gene Ontology: Mol. function=steroid hormone receptor activity; Cellular component=nucleus; Biological process=regulation of transcription, DNA-dependent
  Homolog annotation: Hit_ID=Q1SFD4; Match level="QueryCoverage=100%, HitCoverage=40%, E-value=1e-101, Identity=78%"; Hit description =Steroid nuclear receptor, ligand-binding
MDELRENLPHHEKPLDIQLSLLPCCLLVIMVGVPLDMALITCIAIWKSPYMLFIGWKRLLEDLIGRKGPFLETECVPFAGLAIILWPLAVVVAVLAATIFSLFLALYSGVVVHQEDSVKMGFAYIVSVVSLFDEYVNDLLYLREGSCFPRPIYRRNKSHAIERKNLGGGDNDLRNWRDGSQNSKHAIQQSRSLKWRIQQYRPVQVWDWLFKSCEVNGRILLRDGL

SEQ ID NO: 204248 - protein, 217 aa, Glycine max
  Coding DNA Sequence Number=SeqID_87470
  Homolog annotation: Hit_ID=Q9FNL3; Match level="QueryCoverage=90%, HitCoverage=93%, E-value=1e-67, Identity=60%"; Hit description =Arabidopsis thaliana genomic DNA, chromosome 5, P1 clone:MCL19
  Pfam annotation: Domain name=DUF679; Domain location=47-212; Score =334.9; E_value=1.4e-97; Accession=PF05078.3; Description=Protein of unknown function (DUF679)
MDVIVQEDMYMYNNSKNHDEQKLPLLHNIMEVPDDAKRSLIQRAMSQAFQSTAHLANLLPTGTVLSFQFLSPIVTNQGNCDLVCKFMTSMLVALCGASCFLQCFTDSFRDDKGNVCYGLATFRGMWVIDGSTTISPELGAKYRLKPIDFVHAVMSILVFAAVVLFDQNVVSCFFPSPSNEAREILTVLPVAIGAFCSMLFVAFPTQRHGIGFPLSTK

SEQ ID NO: 204249 - protein, 59 aa, Glycine max
  Coding DNA Sequence Number=SeqID_87471
RISETKQMLWGTDRTRPALVLVVAKDKTKGTICFDDVEQLNETWLETHFGMIVGRKFTG

SEQ ID NO: 204250 - protein, 75 aa, Glycine max
  Coding DNA Sequence Number=SeqID_87472
MLKEQDSVREVRGGCGLSEEIGGVLLSVGERFVSRVEWMIGGEDTRVYVCSLFFKSRPYRLLFLSYVWLGKVVTE

SEQ ID NO: 204251 - protein, 61 aa, Glycine max
  Coding DNA Sequence Number=SeqID_87473
MAGHSNYTSGRCHTGHRHGLSHVLTARAPLHTMGVAERARFQGTFRGLSERHNCIGKAKHN

SEQ ID NO: 204252 - protein, 246 aa, Glycine max
  Coding DNA Sequence Number=SeqID_87474
  Gene Ontology: Mol. function=protein serine/threonine kinase activity; Cellular component=nucleus; Biological process=response to high light intensity
  Homolog annotation: Hit_ID=P04795; Match level="QueryCoverage=98%, HitCoverage=99%, E-value=2e-64, Identity=81%"; Hit description=17.6 kDa class I heat shock protein
  Pfam annotation: Domain name=CS; Domain location=47-139; Score=0.9; E_ value=0.018; Accession=PF04969.6; Description=CS domain
  Pfam annotation: Domain name=HSP20; Domain location=171-246; Score =39.1; E_value=1.6e-08; Accession=PF00011.11; Description=Hsp20alpha crystallin family
  Pfam annotation: Domain name=HSP20; Domain location=50-153; Score =177.1; E_value=4.4e-50; Accession=PF00011.11; Description=Hsp20alpha crystallin family
  Pfam module annotation: Pfam domain module=CS::HSP20::HSP20; Domain location=47-139::171-246::50-153
MSLIPGFFGARRSNVFDPFSLDIWDPFKDFHVPTSSVSAENSAFVSTRVDWKETPEAHVFKADIPGLKKEEVKVQIEDDRVLQISGERNVEKEDKNDTWHRVERSSGKFVRRFRLPENAKVNEVKASMENGVLTVTVPKEEVKKPDVKAIEISEKLHLPTSTPPMPPPPTVAWQPSNVEIEDDRVLQISGERNVEKKDKNDTWHHVERSSGKFMRRFTLQENAKVNEVKASMENGVHTVTVSKERN

SEQ ID NO: 204253 - protein, 161 aa, Glycine max
  Coding DNA Sequence Number=SeqID_87475
MTKDGEGVWVMASQSYGEPREVQRWRRRTIFGGESGWRWEADNDGKISRRVSTVHYSDPKELENLNSTNAKHAHGNSSGVTGTTSSRYFPMQSSGAASSKGSRQRSSLTEASEPSSISKRRHASKSKSNLSEASHGHSTGISSMSPDHSHEGKAKRRKHKE

SEQ ID NO: 204254 - protein, 180 aa, Glycine max
  Coding DNA Sequence Number=SeqID_87476
  Gene Ontology: Mol. function=nucleic acid binding; Cellular component= intracellular
  Homolog annotation: Hit_ID=Q6H6E6; Match level="QueryCoverage=99%, HitCoverage=100%, E-value=5e-27, Identity=36%"; Hit description =Putative fiber protein Fb2
  Pfam annotation: Domain name=Di19; Domain location=10-177; Score =29.5; E_value=1.3e-11; Accession=PF05605.3; Description=Drought induced 19 protein (Di19)
MDSDFWTSRLAAAKRQYTLQHHHPNSHLDRLGIDDFDMEEEVRPDFPCPYCYEDFDIASLCSHLEDEHSCESRVTVLLGGGGGGGYRSNSVAAAVSNAAATDPFLSSFILNFPACEAEEISKSVVTSAENSSAKNATPEHIWKSSFGPSLSTEEREKRMRQAAGRSGFVQELFLSTLLGE

SEQ ID NO: 204255 - protein, 109 aa, Glycine max
  Coding DNA Sequence Number=SeqID_87477
MKSWHIYGSELGRNTYLFEPNVSSKWSFRNEMLNIQNLICGCEKISSAYSPSPVDTLFFIRKAYVALISWKFSLFTKACSHFSEENTETIFSLTSYPELRRSEFLIEDT

SEQ ID NO: 204256 - protein, 90 aa, Glycine max
  Coding DNA Sequence Number=SeqID_87478
MSASYLLLKINVLIVPELDAPLSVEQPSFDGLEALLVHGAPETVTIKLGGGTGPFSRGVLPRSLCGKLFRSHFLLEMNNRAKWNQKCEKW

SEQ ID NO: 204257 - protein, 164 aa, Glycine max
  Coding DNA Sequence Number=SeqID_87479
  Homolog annotation: Hit_ID=Q0KIN0; Match level="QueryCoverage=57%, HitCoverage=5%, E-value=9e-12, Identity=31%"; Hit description =Integrase core domain containing protein
  Subcellular localization annotation: CTP_CleavageSite=49; ConfidenceScore=5.44e-01
MPPHLSSTIPRSGSSSSAHPNPGGFEVRNINMHSHAPLLHVSFSSVCIPRSHLRSLELRRDTWVLGTDHLEKDASEIPVENRNQWKTLDFQLCIVLWQSIEPNVLEILRSFKTCCSLWKNAQDIFANDIQSLFDSANRAFSLKQTNHDMTSHIAKAKAAVEELK

SEQ ID NO: 204258 - protein, 112 aa, Glycine max
  Coding DNA Sequence Number=SeqID_87480
  Subcellular localization annotation: CTP_CleavageSite=42; ConfidenceScore=5.01e-01
MGTLEVFKGSERILLTGERANAPVLTALGVGFRGTNSSSLARSVARSSVSYDFSVYDSVTPFRVGALQMSMVDLEGKEGYRPSTEYVEDSNETLINLTDSTELLFLKLPSSN

SEQ ID NO: 204259 - protein, 401 aa, Glycine max
  Coding DNA Sequence Number=SeqID_87481
  Gene Ontology: Mol. function=ATP-dependent peptidase activity; Cellular component=integral to membrane; Biological process=ATP -dependent proteolysis
  Homolog annotation: Hit_ID=Q6Z001; Match level="QueryCoverage=87%, HitCoverage=86%, E-value=1e-88, Identity=45%"; Hit description =Membrane protein-like
  Pfam annotation: Domain name=DUF81; Domain location=80-393; Score= -1.2; E_value=1.6e-05; Accession=PF01925.9; Description=Domain of unknown function DUF81
MAVKGSPQRWDMRLVLTITLLLISVSVSALQHVSHKNINPTTVETTQTSFLGKVVNFLWSSSGSGYQHTWPDIEFGWRIITGTIIGFLGSAFGTVGGVGGGGIFVTMLSLIIGFDAKSATAISKCMITGGAAATVFYNLKQKHPTLDMPVIDYDLALLFQPVLVLGISIGVAFNVAYEPLPGGPNTSNHNEPKKSKETTGSVLENVRWKALGVLFTVWVLILASEIAKSHTTTCSVEYWILNLLQVPVALGATSYQAVLLYTGKRVIASKGDQRTQWRAHQLVLYCSCGICAGIVGGLLGLGGGFILGPLFLELGIPPQVSSATATFAMTFSASMSVVEYYLLKRFPIPYTLYFVAVSTFAAFVGQVLVRKLVAILGRASLIIFILSGTIFVSAISLGKCH

SEQ ID NO: 204260 - protein, 518 aa, Glycine max
  Coding DNA Sequence Number=SeqID_87482
  Gene Ontology: Mol. function=isomerase activity; Cellular component =endoplasmic reticulum; Biological process=cell redox homeostasis
  Homolog annotation: Hit_ID=Q56YD5; Match level="QueryCoverage=89%, HitCoverage=88%, E-value=1e-156, Identity=56%"; Hit description =Disulfide isomerase like protein
  Pfam annotation: Domain name=Thioredoxin; Domain location=401-506; Score=34.0; E_value=2.8e-07; Accession=PF00085.10; Description =Thioredoxin
  Pfam annotation: Domain name=Thioredoxin; Domain location=63-167; Score=61.6; E_value=2.6e-15; Accession=PF00085.10; Description =Thioredoxin
  Pfam module annotation: Pfam domain module=Thioredoxin::Thioredoxin; Domain location=401-506::63-167
MKPTLRFIVFLLTLLLVLRFNVATEVKDELEELLAVDEEVEREAEKGGEKLSEAEVLSKAQRIVIELKNENTERVVNGNEFVLVLGYAPWCPRSAELMPHFAEAATSLKELGSPLIMAKLDADRYPKPASFLGVKGFPTLLLFVNGTSQPYSGGFTADDIVIWAQKKTSTPVIRISSVAEAEKFLTKYQTFLIGRFENFETRGSKLTGGVDLWELWSCSINVGPDYEEFVSAAKSDNEIQFVETSQVELAQVLYPDIKPTDRFLGIVKSEPERYSAYDGAFILNKILEFVDYNKFPLVTKLTEMNSVRVYSSPIKLQVLVFANIDDFKNLLDTLQDVAKTFKSKIMFIYVDINDENLAKPFLTLFGLEESKNTVEFCNNLMQGSLSPYFKSQPIPDNTEASVRAIVGKTFDDEILSSKKDVLLEVFTPWCMNCEATSKQVEKLAKHYKGSSNLIFARTDASANEHPKLQVNDYPTLLFYRADDKANPIKLSTKSSLKELAASINKYLKVKNQVLKDEL

SEQ ID NO: 204261 - protein, 140 aa, Glycine max
  Coding DNA Sequence Number=SeqID_87483
  Gene Ontology: Mol. function=DNA binding; Biological process=DNA integration
  Homolog annotation: Hit_ID=Q1S9A8; Match level="QueryCoverage=97%, HitCoverage=95%, E-value=2e-23, Identity=59%"; Hit description =Integrase, catalytic region
  Pfam annotation: Domain name=rve; Domain location=24-140; Score=17.9; E_value=0.00019; Accession=PF00665.16; Description=Integrase core domain
MSLNRMFILHAISLLVAPTCFNIVTEDVAQLWHCKFGHLSFKGLQTLQQKGMVEEKSEAFTVFKSFKLHVEKATDMSPKGLCTNRGGEFTSQEFNNFCKVHGVQRQLTVAYSPQQKGVAERKNRTIMNLVHSMLFGKKSA

SEQ ID NO: 204262 - protein, 245 aa, Glycine max
  Coding DNA Sequence Number=SeqID_87484
  Homolog annotation: Hit_ID=Q1S1U2; Match level="QueryCoverage=94%, HitCoverage=37%, E-value=2e-58, Identity=51%"; Hit description =Membrane attack complex component/perforin/complement C9
FLHCELFRNHPGIVLKVDSGNRPVTGIRLYLEGKKSDHLAIHLQHLSEVPGALEISEDHGYDPVDEPEERGYYEPVKWSMFSHVYTAPVQYSSSSMDESTAIVTKAWFEVKLVGMKKVLFLRLGFSTVASATIRRSEWDGPSTTSRKSGFFSALMSTRLSKELQSPDQKPNKVDINSAIYNVGPPVPTRVPKMLSFVDTKEMVRGPEDTPGYWVVTGAKLCVEGGRISIKAKYSLLTILSEESLL

SEQ ID NO: 204263 - protein, 248 aa, Glycine max
  Coding DNA Sequence Number=SeqID_87485
  Gene Ontology: Mol. function=protein-tyrosine kinase activity; Cellular component=integral to membrane; Biological process=protein amino acid phosphorylation
  Homolog annotation: Hit_ID=Q1T4P8; Match level="QueryCoverage=97%, HitCoverage=86%, E-value=1e-59, Identity=48%"; Hit description =Harpin-induced 1
  Pfam annotation: Domain name=Hin1; Domain location=118-248; Score =22.9; E_value=1.8e-05; Accession=PF07320.4; Description=Harpin -induced protein 1 (Hin1)
  Subcellular localization annotation: CTP_CleavageSite=35; ConfidenceScore=5.50e-01
MTLSAKSESDITSLAPSSPSRSPKRPVYYVQSPSRDSHDGDKSSSMQATPISNSPMESPSHPSFGRHSRNSSASRFSGIFRSSSGRKGSRKRNDKGWPECDALITFVVVFAVFCLIIWGASRPYKAQIAVKSLTVHNFYVGEGSDFTSVPTKMLTVNGTLRMSIYNPATLFGIHVHSTPINLVFSDITVATGELKKHYQPRKSHRIISVNLEGTKVPLYGAGSTITVSQTGVEVGLTLNFEIRSHGNV

SEQ ID NO: 204264 - protein, 216 aa, Glycine max
  Coding DNA Sequence Number=SeqID_87486
  Gene Ontology: Mol. function=nucleic acid binding; Cellular component= beta-galactosidase complex; Biological process=DNA integration
  Homolog annotation: Hit_ID=Q1RWN2; Match level="QueryCoverage=89%, HitCoverage=20%, E-value=1e-56, Identity=46%"; Hit description =Peptidase S8 and S53, subtilisin, kexin, sedolisin; Integrase, catalytic region; Zinc finger, CCHC-type
MDVEIAVYLAFFALYTVGVDPLNFEEAVKIGKWRNVMDAEIAAIEKNGTWELINLPTGAKLVGVKWVYKTKLNEKGEVDKVKARLVVKGYVQQYGVDYREVFALVARMETVRLKGNEEKVYKLKKALYGLKQTPRAWYSRIEAYFVKEGNDKSMFTKFKNLMMFEFDMTDLGKMKYFLDLEALQKSSGIFICQKKHVEEMLQRFGMNNATQFKLQL

SEQ ID NO: 204265 - protein, 330 aa, Glycine max
  Coding DNA Sequence Number=SeqID_87487
  Homolog annotation: Hit_ID=Q1SKW8; Match level="QueryCoverage=90%, HitCoverage=50%, E-value=5e-71, Identity=48%"; Hit description =Membrane attack complex component/perforin/complement C9
  Pfam annotation: Domain name=MACPF; Domain location=125-316; Score =57.5; E_value=4.5e-14; Accession=PF01823.10; Description=MACPerforin domain
MGMINVSIAGLDPQMAAEKAVNVIGQGYDLCSDIKFSACRNRLIEIDKTHSRDLVFPGGVVVSDVPSSIKCDKGERTRFHSDVLPFNQMSEHFNKQISLSGKIPSGQFNIMFNMKKCWPTDAASTKNLAYDGWFITLYNVELDRTNITLSESVKKDVPYSWNPAALAEFIEKYGTHIIVGVQMGGKDVVHIKQTKNSDLQQAELQKLLKQLADERFSEASNHSSNVDPADKSRKVKDNRAKMWGSKPIPVAGRPVDIVSISVRRGGIDNGQSYNQWLSTISQSPNVISMSFVPITSLLNSVPGNGFLSHAMNLYLRYLISIRRDQDISGE

SEQ ID NO: 204266 - protein, 176 aa, Glycine max
  Coding DNA Sequence Number=SeqID_87488
  Gene Ontology: Mol. function=structural constituent of ribosome; Cellular component=ribonucleoprotein complex; Biological process =translation
  Homolog annotation: Hit_ID=P16180; Match level="QueryCoverage=77%, HitCoverage=89%, E-value=3e-32, Identity=55%"; Hit description=30S ribosomal protein S17, chloroplast precursor
  Pfam annotation: Domain name=Ribosomal_S17; Domain location=85-153; Score=137.7; E_value=3.1e-38; Accession=PF00366.10; Description =Ribosomal protein S17
MVQRAPQWHRMKRDRDRDKYMVEKRECECSDRDKKMWLVQLSTPFLNGHGHSTTLLSKHSSAVTQTHWAPPSFLPQINAMKTMQGRVVCSTSDKTVAVEVVRLAPHPKYKRRVRKKKKYQAHDPDNQFKVGDIVQLQKTRPISKTKAFLALPVPKRPSSRPEAQPEELSIPFESQP

SEQ ID NO: 204267 - protein, 534 aa, Glycine max
  Coding DNA Sequence Number=SeqID_87489
  Gene Ontology: Mol. function=kinase activity
  Homolog annotation: Hit_ID=Q5DK69; Match level="QueryCoverage=87%, HitCoverage=93%, E-value=1e-166, Identity=66%"; Hit description =Pollen-specific kinase partner protein
  Pfam annotation: Domain name=DUF315; Domain location=1-442; Score =732.6; E_value=2.6e-217; Accession=PF03759.4; Description=Domain of unknown function (DUF315)
MVRAGEQEQEGYKAKLFNFRGIFEGTGRLTKSLSVDTATVLEPTEDGAASSRSQGSKPLNDLDKMIPKARVISKEEISVKEAKEKLLQDMEQMKERFSKLLLGEDMSGGGKGVSSALALSNAFTNLAASIFGEQKRLEPMPAERKAKWRKEIDWLLSVTDYVVEMVPSQQKSKDGSNMEIMTTRQRTDLHMNVPALRKLDAMLLECLDNFKDQNEFYYVSKNSDDSDQGSAKTKNDDKWWLPTPKVPAEGLSDMARKFLQYQKDCVNQVLKAAMAINAQILTEMEIPESYIDSLPKNGRASLGDSNYRSITVEFFDPDQFLSTMDLSSEHKILDLKNRIEASIVIWKRKMHQKDSKSAWGSAVSLEKRELFEERAETILLLLKHRFPGLPQSALDISKIQYNRDVGQAVLESYSRVLESLAFTVLSRIDDVLQADYQIQSQNLSGRRRSSVSRPFREEIDKASAEAGSMTLSDFMGWGSDQGEADMKKDPYAISDDLCKDDDDPKQQKLPTIVTNKKVSYLETLGVMRSPTSRH

SEQ ID NO: 204268 - protein, 355 aa, Glycine max
  Coding DNA Sequence Number=SeqID_87490
  Gene Ontology: Mol. function=DNA binding; Cellular component=oxygen evolving complex; Biological process=DNA integration
  Homolog annotation: Hit_ID=Q1S1E0; Match level="QueryCoverage=78%, HitCoverage=26%, E-value=3e-67, Identity=43%"; Hit description =Integrase, catalytic region
MVSLKIILIEEEKTIKAILHGYPLGHRLHNSQSSNINNVNAMKEEGDNSTLNQNQDAQNEDEPQIMSGWVQLNMKEGFYKLKMSPVKSEYNPDSICPIISSVLAFSSAINQWYFKKLDVNNAFLHGDLNEEVYMTLLQGMQVAKPRQVCKLQRLSSFLISHGFKQCASDHSLFLKHGYKTITALLVYVDDIVLSGNDLAEIQSITQLLDNAFKIKDLGDPRYFLGFEAARKSIGINLCQRKYALDILSDVGMLGSKPISTPSNYTTKLHQHSGTLISMEDASFFRRLIGKYLKGTPGVGISLSVASNIHLKGFSDLDWAGCIDTKRSIIGYAIYIGDSFISWKSKKQAIVSKSSS

SEQ ID NO: 204269 - protein, 895 aa, Glycine max
  Coding DNA Sequence Number=SeqID_87491
  Gene Ontology: Mol. function=sequence-specific DNA binding; Cellular component=nucleus; Biological process=regulation of transcription, DNA-dependent
  Homolog annotation: Hit_ID=P46607; Match level="QueryCoverage=84%, HitCoverage=99%, E-value=0.0, Identity=58%"; Hit description =Homeobox protein GLABRA2
  Pfam annotation: Domain name=Homeobox; Domain location=108-164; Score= 85.9; E_value=1.3e-22; Accession=PF00046.19; Description=Homeobox domain
  Pfam annotation: Domain name=START; Domain location=276-501; Score =301.5; E_value=1.6e-87; Accession=PF01852.10; Description=START domain
  Pfam module annotation: Pfam domain module=Homeobox::START; Domain location=108-164::276-501
  Subcellular localization annotation: CTP_CleavageSite=40; ConfidenceScore=5.11e-01
MGADMSNNNNPPPTSHAKDLFASPALSLSLAGIFRHAGVAAADEAATSVEEGEEGSGGAAERLEEISSENSGPTRSRSEDDFEGGEAEPEDDDDAHGDNKNKKTKKKRKKYHRHTADQIREMEALFKESPHPDEKQRQQLSKQLGLAPRQVKFWFQNRRTQIKAIQERHENSLLKSEIEKLKEKNKSLRETINKACCPNCGVPTTSRDGVMPTEEQQLRIENAKLKAEVEKLRAALGKYAPGSTSPSCSSGHDQENRSSLDFYTGIFGLDKSRIMDIVNQAMEELIKMATVGEPLWLRSFETGREILNYDEYVKEFAVENSSSSGKPKRSIEASRDTAVVFVDLPSLVQSFLDVNQWKEMFPCLISKAATVDVICNGEGLSRNGAVQLMFAELQMLTPMVPTREVYFVRFCKQLSAEQWAIVDVSIDKVEDNIDASLVKCRKRPSGCIIEDKSNGHCKVIWVEHSECQKSAVHSMYRTIVNSGLAFGARHWIATLQLQCERLVFFMATNVPMKDSTGVATLAGRKSILKLAQRMTWSFCHAIGASSIHAWTKVTSKTGEDIRISSRKNLNDPGEPLGLILCAVCSVWLPVSPNVLFDFLRDENRRTEWDIMSSGGTVQSIANLAKGQDRGNAVAIQTIKLKENSVWILQDSCTNLYESMVAYACVDITGIQSVMTGCDSSNLAILPSGFSIIPDGLESRPLVISSRQEEKNTEGGSLFTMAFQILTNASPTAKLTLESVDSVNTLVSCTLRNIRTSLQCEDGLGLEGNGKFLGLGLGPAGGPFGNGECEKGLGLADGPGLLELDDVADFELVIGVVGLVLLLLPHAPLVLWVRGQPHHLHCHRLVAGGAHHSPLHCLHRIDLRQETRWGPVGLSHRRTVLGEKGGGMTMSVQKWG

SEQ ID NO: 204270 - protein, 117 aa, Glycine max
  Coding DNA Sequence Number=SeqID_87492
  Gene Ontology: Mol. function=threonine endopeptidase activity; Cellular component=proteasome core complex (sensu Eukaryota); Biological process=ubiquitin-dependent protein catabolic process
  Homolog annotation: Hit_ID=P34066; Match level="QueryCoverage=66%, HitCoverage=28%, E-value=3e-33, Identity=84%"; Hit description =Proteasome subunit alpha type 1-A
VCTQQSWKHPYGVGHLVAGLDESGAHLYYNCPSGNYFEYQAFAIGSRSQAAKTYLERKFENFVGSSLEDLIKDALIATREEEEAAPAEEEAQPAAEQDAPTDQGAAAVDQGGSPMDI

SEQ ID NO: 204271 - protein, 74 aa, Glycine max
  Coding DNA Sequence Number=SeqID_87493
  Homolog annotation: Hit_ID=Q2HU50; Match level="QueryCoverage=98%, HitCoverage=56%, E-value=1e-17, Identity=53%"; Hit description =Uncharacterized Cys-rich domain
MQATEDQKIQQNEPIGLIAPSYEADTIPQIGNPWSTGLFDCHENQTNGCHLGSFIYLLMMPACALNGLWGQSTG

SEQ ID NO: 204272 - protein, 190 aa, Glycine max
  Coding DNA Sequence Number=SeqID_87494
  Gene Ontology: Mol. function=catalytic activity; Cellular component =intracellular; Biological process=metabolic process
  Homolog annotation: Hit_ID=Q2HU53; Match level="QueryCoverage=83%, HitCoverage=55%, E-value=1e-66, Identity=47%"; Hit description =Tetratricopeptide-like helical
  Pfam annotation: Domain name=PPR; Domain location=89-123; Score=40.5; E_value=5.7e-09; Accession=PF01535.11; Description=PPR repeat
MVGPNWRVTISNIDREANRATDFLANLGHYSTSVPFALEPGKQLHARLCQLGIAYNLDLATKVVDFYSVCNSLWNAHHLFDKIPKGNLFLWNVLIRAYAWNGPHEAAISLYHQMLEYGLKPDNFTLPFVLKACSALSTIGEGRIIHELVIRSGWERDVFVGAALVDMYAKCGCVVDARHVFDKIVERDAV

SEQ ID NO: 204273 - protein, 1034 aa, Glycine max
  Coding DNA Sequence Number=SeqID_87495
  Gene Ontology: Mol. function=RNA polymerase II transcription factor activity; Biological process=transcription from RNA polymerase II promoter
  Homolog annotation: Hit_ID=Q2HU52; Match level="QueryCoverage=98%, HitCoverage=99%, E-value=0.0, Identity=65%"; Hit description =Tropomyosin; tRNA-binding arm; t-snare
  Pfam annotation: Domain name=Tropomyosin; Domain location=530-775; Score=-119.7; E_value=0.091; Accession=PF00261.10; Description =Tropomyosin
MAWFSGKNTWGNFPDLAGAVNKLQESVKNIEKNFDSALGFEEKGESSNEDAGSWPIPADRKTLFNPVISFMGNKSEETTEEMSEKDESSQQDSEMEKSLEQPESLDHTSVAEGSNALETDNTVHMEAEENTTKEENKVLKEEEDGEHTESVDGTVAQNLDHGKEENHLLELPVELPESPVEKFESSDSVEHSQEKEIADPGTSGSPVSVQFMPSNLGDNVVEGITRESDESHDISDGHENSQVETKEESKEEERVQAEESEKRISSVQPKASTDSEKGDDTDTSVLQSVASEETNNTDQSNIEHLSSVTPPNESSKVVTDMFSPENETSAKENEREHFAHDVETDMKEHHLSSERTMSDSGSMLELERVKREIKMMEAALQGAAKQAQAKADEIAKLMNENEQLKAVIEDFKRKSNEAEVESLREEYHQRVATLERKVYALTKERDTLRREQNKKSDAAALLKEKDEIINQVMAEGSLDGIALGLVMEIDGDYVASVLWGIQHVNSTWVWNNSVGGEELSKKQAAQESTIRKLRAQIRDFEEEKKGLTTKLQVEENKVESIKRDKTATEKLLQETIEKHQNEIAAQKEYYTNALAAAKEAEALAEARANNEARTELESRLREAEERESMLVQALEELRQTLSRKEQQAVFKEDMLRRDIEDLQKRYQASERRCEELITQVPESTRPLLRQIEAMQETNARKAEAWAAVERTLNSRLQEAEAKAATAEERERSVNERLSQTLSRINVLEAQISCLRAEQTQLSRTLEKERQRAAESRQEYLAAKEEADTQEGRVRQLEEEIRDIRQKYKQELQEALMQREHLQQEIEKEKAARSELEKTVRAQSAPLSDQTPTTKLNSAFENGNLSRKLSSASSLGSLEESHFLQASLDSSDGISERRNPGELNMSPYYVKSMTPSSFEAALRQKEGELASYMSRLASLESIRDSLADELVKMTEQCEKLRGEAAVLPGLRSELEALRRRHSAALELMGERDEEELRADIVDLKEMYREQVNLLVNKFITLMHLFTDPDYGSING

SEQ ID NO: 204274 - protein, 436 aa, Glycine max
  Coding DNA Sequence Number=SeqID_87496
  Gene Ontology: Mol. function=protein binding; Cellular component =integral to membrane; Biological process=protein amino acid phosphorylation
  Homolog annotation: Hit_ID=Q0PY41; Match level="QueryCoverage=91%, HitCoverage=66%, E-value=1e-149, Identity=62%"; Hit description =Leucine-rich repeat family protein
  Pfam annotation: Domain name=LRRNT_2; Domain location=383-423; Score =15.7; E_value=0.02; Accession=PF08263.3; Description=Leucine rich repeat N-terminal domain
  Subcellular localization annotation: CTP_CleavageSite=40; ConfidenceScore=5.57e-01
MRLSSMEATACSPSLSFAPTSSKLERRRFSKRDPFALRLSCGARQNVHSKPTNTLWREDFGYTGGIAANATLPSLITPPLNTLRYFPWSEGPQNCYNINKVPKGHYSIRIFFGLVGQSKDISEPLFDISIEGTQLYSLKPGWNYQIDQVFAEALVFLTNDSVSICFHSTGHGDPAILSIEIQQIDDKAYYFDPQWSQGIILRTVKRLSCGFGQSKFDVDYGGDSRGGDRFWQHIKSFGEEYESDQPRSVETRIKHASHPPNFYPETLYQSALVSTDSQPDLTYTLEVDPNRNYSIWLHFAEIDNSVTAAGQRVFNIIINDDLVFKDVDIVELSGDIYNALVLNTTVTVNGRILTIILKPKEGNLAIINAIEIFEVIMAESKTISEEVSALQTLKKALGLPPRFGWNGDPCVPQQHPWIGVDCQLNKSSGSWVIDGL

SEQ ID NO: 204275 - protein, 577 aa, Glycine max
  Coding DNA Sequence Number=SeqID_87497
  Gene Ontology: Mol. function=transferase activity; Cellular component= mitochondrion; Biological process=metabolic process
  Homolog annotation: Hit_ID=Q1SLE2; Match level="QueryCoverage=66%, HitCoverage=82%, E-value=3e-68, Identity=43%"; Hit description =Tetratricopeptide-like helical
  Pfam annotation: Domain name=PPR; Domain location=235-269; Score =21.0; E_value=0.0042; Accession=PF01535.11; Description=PPR repeat
  Pfam annotation: Domain name=PPR; Domain location=270-304; Score=6.3; E_value=1.3; Accession=PF01535.11; Description=PPR repeat
  Pfam annotation: Domain name=PPR; Domain location=376-410; Score =22.8; E_value=0.0013; Accession=PF01535.11; Description=PPR repeat
  Pfam annotation: Domain name=PPR; Domain location=411-445; Score =37.3; E_value=5.4e-08; Accession=PF01535.11; Description=PPR repeat
  Pfam annotation: Domain name=PPR; Domain location=446-480; Score =25.8; E_value=0.00015; Accession=PF01535.11; Description=PPR repeat
  Pfam annotation: Domain name=PPR; Domain location=481-515; Score =47.6; E_value=4.1e-11; Accession=PF01535.11; Description=PPR repeat
  Pfam module annotation: Pfam domain module=PPR::PPR::PPR::PPR::PPR::PP R; Domain location=235-269::270-304::376-410::411-445::446-480::481 -515
MSEWLRRQTRNLLGFACAGYAVKRAEEHQINNFWRRRRMWTRILARATRAVAVAGNYSLINQPISDPIFLKIPKSTFPQIFNNPRFLVTSNLDNELSPDSSVNGGDRQLAEQEEGGGGGDTYEVDSDTLESVLRLLQTSADGSLESCLDDMDLTLHQQLVTKITETPFVLSENLIRFFWWAWSERSLEVTTPMVESLVLAICGNDDVRKKKEVVYSLWDLVKEIGEKESGLLNVRILNELISSFSRLRKGKAALEVFDKFEAFHCVPDADTYYFTIEALCRRRAFDWACGVCQKMVDARTLPDAEKVGAILSWLCKGKKAKEAHGVYVVATEKGKLPPVNVVSFLVLKLCGEDETVKSALEILEDIPEEKRERAIKPFLAVVRALCRIKEVDKAKELLLKMIENGPPPGNAVFNFVVTAYSKAGEMGKAVEMMRLMESRGLRPDVYTYTVLASAYSNGGEMEEAQKILAEAKKKHVKLGPVMFHTLIRGYCKLEQFDEALKLLAEMKDYGVRPSVDEYDKLIQSLCLKALDWKMAEKLQEEMKESGLHLKGITRGLIRAVKEMEKEVVEAESITAVV

SEQ ID NO: 204276 - protein, 183 aa, Glycine max
  Coding DNA Sequence Number=SeqID_87498
MGTRQGNKPSSKKSHAAEDSISADSLSFAGLVSIQDQNSKPPIPNHTTHYYKVSKQDLDFEFSTIQEHLNSGSNPFKITPADVLISNGKIKPFQPNRPVLTDPPISLRSLLAIDHANNSKMSNVQQARKYDEQRVKARIHKSKERSSSVTRTWFGHKVFRSFLSPCRKCQATQPGAVKGQSVK

SEQ ID NO: 204277 - protein, 280 aa, Glycine max
  Coding DNA Sequence Number=SeqID_87499
  Gene Ontology: Mol. function=S-adenosylmethionine-dependent methyltransferase activity
  Subcellular localization annotation: CTP_CleavageSite=48; ConfidenceScore=5.62e-01
MPFFLLKNSLGAKMKKGIKTFCNNNGSTSTLNQQNSHNNNSDFTSKVSSSNSPTLEDLILQLELEEEMARKAKLNNISEYSGIMRGRMSCVNNSDILRSARNALNQYPRFSLDGRDAMYRSSFGNIEGRRSVCSEISLGGKKENDLDNNNNHKGMCFLPPTLAGESVVWQKPGVVAKLMGLEAMPVPIGSSSRISCENNNKEKLSAVVRRQNLIRRRFERHDLERKLLTMEMQHQGCGYNNNNNNNNNNRRHTNNNNGCSNNGYCIMKPVCSRGSGRGPG

SEQ ID NO: 204278 - protein, 144 aa, Glycine max
  Coding DNA Sequence Number=SeqID_87500
  Homolog annotation: Hit_ID=Q6AVF2; Match level="QueryCoverage=40%, HitCoverage=20%, E-value=4e-13, Identity=64%"; Hit description =Expressed protein
MKQAICGIIHISFGEEENVSPKKPTSLLELAKQRDLSGTLQSEDCILKKQLSDAKCNELSGHDIFAPPPEIKPKPITPRILELKGSINIGECQQRPLIKGVLLGAPSIIAGAPSILEKCQNYPYLVFHFRISLIRKSLPDQVNP

SEQ ID NO: 204279 - protein, 442 aa, Glycine max
  Coding DNA Sequence Number=SeqID_87501
  Gene Ontology: Mol. function=RNA-directed DNA polymerase activity; Cellular component=intracellular; Biological process=RNA-dependent DNA replication
  Pfam annotation: Domain name=RnaseH; Domain location=320-440; Score =36.3; E_value=2.4e-08; Accession=PF00075.14; Description=RNase H
MMHKEIEVYVDDMIVKSGTEEEHVEYLLKMFQRLRKYQLRLNPNKCTFGVRSGKLLGFIVSQKGIEVDPDKVKAIREMPVPQTEKQVKGFLGRLNYISRFISHMTATCGPIFKLLRKDQGVVWTEDCQKAFDSIKNYLLEPPILIPPVEGRPLIMYLTVLEDSMGCVLGQQDETGRKEHAIYYLSKKFTDCESRYSLLEKTCCALAWAAKRLRHYMINHTTWLISKMDPIKYIFEKPALTGRIARWQMLLSEYDIKYRTQKAIKGSVLADHLAYQPIEDYQPIKFDFPDEEIMYLKMEDCDDPLLGEGPDPESRWGLIFDGAVNVFGNGIGAVIITPEGNHLPFAARLQFDCTNNMAEYEACILGIEKAIDLRIKNLDIYGDSALVINQIKGEWETRHPGLIPYKDYARRLLTFFNKVELHHIPRDENQMADALATLSSMYE

SEQ ID NO: 204280 - protein, 71 aa, Glycine max
  Coding DNA Sequence Number=SeqID_87502
MNEARRRPMKVTKKTQPSFFERKKKDSKKDSKKDAKVTNEGHEEATMARKKRNGEEEEEAAEIAKKKKWQK

SEQ ID NO: 204281 - protein, 280 aa, Glycine max
  Coding DNA Sequence Number=SeqID_87503
MDQEDNKMGTVNPPEMSSNPLSLGKDETMGTENPLSSGKDDVVGTENPPEVSSNSLSSAKDGMVDAANPTKVSSNHTPSVKDNMMGTENHPSSGKDGEMCAENPPEVSSNSPSSGKDSFMSSVNPTEVFSNPPSSGKDDMMSTENIPEVTSDHPTSGKDDGKKETDPPEGSSKLELSDKNTPQSLKAKSKIVKKSQAVKLKAKKNNGSKQICGKIILSSKEVVCNAESCHSADEKQISDNSELKKTNDEPPKGKSEEAENKMKESQNMSTGDKSPNEESD

SEQ ID NO: 204282 - protein, 516 aa, Glycine max
  Coding DNA Sequence Number=SeqID_87504
  Homolog annotation: Hit_ID=Q2R3D9; Match level="QueryCoverage=39%, HitCoverage=62%, E-value=7e-21, Identity=34%"; Hit description =Expressed protein
EKQISDSSELKETNDEPPKGKSEEAENKVKEGQNTSISEKSPKEESDVSQLKDTDPPDGSSKLELSDKNTPQPLKAKSIIVKKSQAGKLKAKKNNGSQQIRGKRRIKTSKKVDNAESCHNADEKQILDNSQLKETNDELPKGKSQEAENKVKESQNRSTSGKSPREKSQQAQKDKTSQLDKVEQKQESKEKHRELSKGSSSRKNKGKSSGMERSQLKGEKGEKIGGFIFLCNAKTKPDCFRYHVMGVSAGKKDDVLQIKPGLKLFLYDFDLKLLYGIYKASSSGAMKLEPKAFGGKFPAQVRFKIASDCFPLPESIFKKAIKDNYNEKHKFRTELTVRQVRKLTQLFRPVGIHSAVHPVHSQPKVIIREREIHSAVHPVHSQPKGDYQPHHLDRGYPRNAPAHVESLRTDPLYLDGSRDPYHAYRRGVSPMDAYFAPLSREEISPNSYLVGGRPFVGTDNLPKREAVQDRCYPIYSAPDALSDHHRRRQYHGDKLEASGGPVSSRYSFAGPSFHRQ

SEQ ID NO: 204283 - protein, 78 aa, Glycine max
  Coding DNA Sequence Number=SeqID_87505
MFILVLIAINSFLTSKRAHVSILTVIRISPSKNIILQIPTVQEKERVLGGGEGKTKLRERGGVGGIISLKTDLRCLYL

SEQ ID NO: 204284 - protein, 92 aa, Glycine max
  Coding DNA Sequence Number=SeqID_87506
  Gene Ontology: Mol. function=zinc ion binding; Cellular component =integral to membrane; Biological process=regulation of transcription, DNA-dependent
  Homolog annotation: Hit_ID=Q6L4V6; Match level="QueryCoverage=77%, HitCoverage=8%, E-value=6e-27, Identity=72%"; Hit description =Putative zinc finger protein
  Pfam annotation: Domain name=zf-C3HC4; Domain location=5-43; Score =23.2; E_value=0.00062; Accession=PF00097.15; Description=Zinc finger, C3HC4 type (RING finger)
MVDSAICEGILRKTKAVMECMHRFCGKCIEKSMRLSNNECPVCRVHCPSRRSLRDDPNFDNIIAAIYPDIDKYEEEEELAMYESERTHNKEV

SEQ ID NO: 204285 - protein, 135 aa, Glycine max
  Coding DNA Sequence Number=SeqID_87507
MSPKRLPHQTSAKLALRNNHEQPQDEVQPEEIDQSCLLSDEYKDENKDKSLSDERQEFEKKVIATQSLPQETPTEIAPRNDHEQLEAEVQPVEEVDLDQSYSMSEGDKDEDGDEDGDEDEDEEEYVKLICHSKFL

SEQ ID NO: 204286 - protein, 154 aa, Glycine max
  Coding DNA Sequence Number=SeqID_87508
  Subcellular localization annotation: CTP_CleavageSite=65; ConfidenceScore=5.23e-01
MDLGGSPLYQVKVAPLRDIWKRRHMIGSSLVYRFAWVRNTSRCSSGLAVQSYRSRLSGFQPRGMLASMMWSTKGCQQVVFPSGRCMWERLGSSWVLTVCQGLQDKFYRGPTVGTNCTYQNLELSHVRMDMAEIGSMISHVGLRVSFVKRTRVGT

SEQ ID NO: 204287 - protein, 43 aa, Glycine max
  Coding DNA Sequence Number=SeqID_87509
MAEISSSGYKEYVAGLSAGVAVVATGHPFDTVKLKIVSGIVLS

SEQ ID NO: 204288 - protein, 192 aa, Glycine max
  Coding DNA Sequence Number=SeqID_87510
  Homolog annotation: Hit_ID=Q9MD97; Match level="QueryCoverage=13%, HitCoverage=50%, E-value=5e-09, Identity=92%"; Hit description =Hypothetical protein rps12
MIALHFSRFGSLIYAMIYHSWTLIRSFHLAAPLGWHSLKVKGEVQTKKGLWWIPRHPETRKGVVKRRNAFGELKISVDPGIPDIGQPFELLLNPRAGKRQPESKSDSRSSGERNGSSLNRENGVVGELYKCRAARRSSRECCTLDGESPVAESITSLRSDPSSMGHVESRVNQQGPPCKAKYSWVTDSEVVP

SEQ ID NO: 204289 - protein, 200 aa, Glycine max
  Coding DNA Sequence Number=SeqID_87511
MGFTLVDLHKVAYKDKPFIMVEQAKHVFYVQDPSDSRWSMVLQGRTSCISHQNDDSTVDICETPSVYTHMAFITEEHEVDDVHANHNDHDEGLWENIHTQLHYIKIHGNTTKVPPSLEDPLEYKEGQDDQTPCDQTTCFKYGLDPQRWVEFAASCKTPTWQGIKKKAWEIQKFNDCPYILSREGYELLEKKLMDEKRKNR

SEQ ID NO: 204290 - protein, 38 aa, Glycine max
  Coding DNA Sequence Number=SeqID_87512
MKTAKRTIGIVATTVTIENNPTMPRMNPSKITYLRGPR

SEQ ID NO: 204291 - protein, 149 aa, Glycine max
  Coding DNA Sequence Number=SeqID_87513
  Gene Ontology: Mol. function=DNA binding; Cellular component=nucleus; Biological process=regulation of transcription, DNA-dependent
  Homolog annotation: Hit_ID=Q1S7P2; Match level="QueryCoverage=69%, HitCoverage=72%, E-value=1e-20, Identity=52%"; Hit description=SBP
  Pfam annotation: Domain name=SBP; Domain location=64-122; Score=55.4; E_value=1.9e-13; Accession=PF03110.5; Description=SBP domain
MDTSRSEGKRVMRYKEEDDDNDDEEEEEVVSEMGFEEDGRRNKRVIRDLYGKRGSKGGGSITPSCQVDNCDADLSEAKQYHRRHKVCEYHAKAPSVHMAGLQQRKLENNDEINVLRANNSTTITFFTKVGNDLKSISILISTNMIRHCW

SEQ ID NO: 204292 - protein, 287 aa, Glycine max
  Coding DNA Sequence Number=SeqID_87514
  Gene Ontology: Mol. function=protein serine/threonine kinase activity; Cellular component=membrane; Biological process=protein amino acid phosphorylation
  Homolog annotation: Hit_ID=Q49N13; Match level="QueryCoverage=96%, HitCoverage=50%, E-value=1e-137, Identity=89%"; Hit description =Putative receptor-like protein kinase 3
  Pfam annotation: Domain name=Pkinase; Domain location=3-236; Score= -22.0; E_value=3e-07; Accession=PF00069.15; Description=Protein kinase domain
  Pfam annotation: Domain name=Pkinase_Tyr; Domain location=1-236; Score=-53.2; E_value=3.3e-09; Accession=PF07714.7; Description =Protein tyrosine kinase
  Pfam module annotation: Pfam domain module=Pkinase::Pkinase_Tyr; Domain location=3-236::1-236
FIEPVINFRLLVYEYVNNGNLEQWLHGAMRQHGFLTWDARIKILLGTAKALAYLHEAIEPKVVHRDIKSSNILIDEDFNAKISDFGLAKLLGAGKSHITTRVMGTFGHDIMEIETASNFLIPLYMFALLFPRYVAPEYANSGLLNEKSDVYSFGILLLEAITGRDPVDYSRPAAEVNLVDWLKMMVGCRRSEEVLDPNIETRPSTSALKRALLTALRCVDPDAEKRPRMSQVVRMLESEEYPILREDRRRRRSQAGNMEVETQRENSDTDKSDNPDYKPSGRRNQRM

SEQ ID NO: 204293 - protein, 70 aa, Glycine max
  Coding DNA Sequence Number=SeqID_87515
MKYIAGKKIVLDQEQEQQMKMNHDKTPETENGRMNSGYEYACKYVYVCVSGSGAASLSISWGNNQQFSNQ

SEQ ID NO: 204294 - protein, 76 aa, Glycine max
  Coding DNA Sequence Number=SeqID_87516
  Gene Ontology: Mol. function=oxidoreductase activity; Cellular component=membrane; Biological process=electron transport
  Homolog annotation: Hit_ID=Q09J78; Match level="QueryCoverage=63%, HitCoverage=9%, E-value=1e-13, Identity=71%"; Hit description=(+) -abscisic acid 8'-hydroxylase
MVSMDLVYLIEDNAQRRRITDIISDIMSEDTTTSVLTWILKYLEDDHKLLEAIKAEKMGVYEANEGGSMPLTWGQT

SEQ ID NO: 204295 - protein, 100 aa, Glycine max
  Coding DNA Sequence Number=SeqID_87517
MKANIKAMKEQMNTMMEAMMSMKRMMEVNMAIVFAASTATEVDPSHPFSLNQVNRLVSDMVQKKHFFSPCGLPSIYTPPNVIHAPNENVDNSEPIPIESQ

SEQ ID NO: 204296 - protein, 115 aa, Glycine max
  Coding DNA Sequence Number=SeqID_87518
  Subcellular localization annotation: CTP_CleavageSite=39; ConfidenceScore=5.48e-01
MTLYSPKVWIWSTLKMRTRSPLKARACSPLQARMCSPLMARTYSPLKVIGTSTQGSTFMRKQEIDSSRGPVIQQDWTRDIDCPFEKGDNSCNLILSFANLSGNSLRVYILLDLVT

SEQ ID NO: 204297 - protein, 113 aa, Glycine max
  Coding DNA Sequence Number=SeqID_87519
  Gene Ontology: Mol. function=DNA binding; Biological process=DNA integration
  Homolog annotation: Hit_ID=Q1SKC8; Match level="QueryCoverage=99%, HitCoverage=42%, E-value=7e-35, Identity=45%"; Hit description =Integrase, catalytic region
MGHYRVTHKVASPYHPQTNGQAETAFKTPIGLSPFQMVYGKACHLPLLELEEMRLNAYDSSKLYKQKVKAYHDKKLLKKDFNPDQQVLLFNSRLKLFPGKLKSKWSGPFTIKE

SEQ ID NO: 204298 - protein, 175 aa, Glycine max
  Coding DNA Sequence Number=SeqID_87520
MARLVEVADQSELHNSLSAHLRVKPKNLSVSLAKRPLALSLLPFQFIVALSVILFLFGIRLSESYSLSHCYLSAKCAAGVKPLLLLFCCRAKRAMHAKRPSVISMASKKRCASSSRPQESYETSRFVSKIAWERYGTNIHQRNILLERNVELAYSHYDEFLQELECHQWHKNLTR

SEQ ID NO: 204299 - protein, 140 aa, Glycine max
  Coding DNA Sequence Number=SeqID_87521
MEAQKGEDIVRSVHLTGIVEAFLCHLRFLTHIPSSCLERAEISFEKCDQTLGVQQGMDMACVLSEEVKPFLIEDHLPNNTYADQGAKHICQSQEFYGKKGLDGAMVAIDDSGGGFRWRKGRRGKRKEEGEEGDNVTLRCQ

SEQ ID NO: 204300 - protein, 95 aa, Glycine max
  Coding DNA Sequence Number=SeqID_87522
MELIKNMAANDHAILRDKTHIPTKRKTLSKLPTQLQAAQPTHSTVMQIGGYCICGGAHESGCFISQDDASKEFNYMTNQSRKGFHIGDFSGYQQG

SEQ ID NO: 204301 - protein, 353 aa, Glycine max
  Coding DNA Sequence Number=SeqID_87523
  Gene Ontology: Mol. function=zinc ion binding; Biological process =regulation of transcription
  Homolog annotation: Hit_ID=Q0GLE0; Match level="QueryCoverage=42%, HitCoverage=100%, E-value=3e-55, Identity=70%"; Hit description=Dof12
  Pfam annotation: Domain name=zf-Dof; Domain location=51-113; Score =139.9; E_value=7.1e-39; Accession=PF02701.6; Description=Dof domain, zinc finger
MFGGNNCEKMVAVVTPQTASNKWTQTQQIDDHKAPMMGRVMEKPSQDLLQQQQQALKCPRCESSNTKFCYYNNYSLSQPRHFCKACKRYWTRGGTLRNVPVGGGCRKNKRVKRPTNHGDSSSSAANSPSSSNSNPPSQPHIDNIIASSSTTNHINNISPFFYGGDVMSSVPFPRFNLHSQLNALGLGFSTGVSENGFSTSNNNSFFSAYNSMFGSSSSSTCAPSTPVMASLLSSTLLQQKLMSGGGGGGVKGSSDHDQGGNTFHGLAPLQGLQVEGNNNNSNNIGTKEVRGEGQNRFDWSNNNNNNNGGGGCQNQMEHVGLSDPNSLYWNTATGLGAWSDQPNNIGPSVTSLI

SEQ ID NO: 204302 - protein, 79 aa, Glycine max
  Coding DNA Sequence Number=SeqID_87524
  Gene Ontology: Mol. function=small conjugating protein ligase activity; Cellular component=nucleus; Biological process=protein modification process
  Homolog annotation: Hit_ID=P25865; Match level="QueryCoverage=58%, HitCoverage=30%, E-value=5e-16, Identity=80%"; Hit description =Ubiquitin-conjugating enzyme E2-17 kDa 1
MKKGVEGILVIVKWFRHLQRRPLETSVRRVDGMVSNHSLLCDPNPNSPANSEAARMFSENKREYNRKVREIVEQSWTAD

SEQ ID NO: 204303 - protein, 396 aa, Glycine max
  Coding DNA Sequence Number=SeqID_87525
  Gene Ontology: Mol. function=transcription factor activity; Cellular component=nucleus; Biological process=regulation of transcription, DNA-dependent
  Homolog annotation: Hit_ID=Q1SQ04; Match level="QueryCoverage=85%, HitCoverage=87%, E-value=3e-83, Identity=50%"; Hit description =Pathogenesis-related transcriptional factor and ERF
  Pfam annotation: Domain name=AP2; Domain location=162-227; Score =106.6; E_value=7.4e-29; Accession=PF00847.10; Description=AP2 domain
  Pfam annotation: Domain name=AP2; Domain location=70-133; Score=73.4; E_value=7.3e-19; Accession=PF00847.10; Description=AP2 domain
  Pfam module annotation: Pfam domain module=AP2::AP2; Domain location =162-227::70-133
MELAPVKSELSPRSHRLLMIDGSEVIGTKCVKRRRRDSSTAVLGGNGQQGEQLEEQKQLGGQSTATTVKRSSRWTGRFEAHLWDKGTWNPTQKKKGKQGAYNDEEAAARAYDLAALKYWGISTFTNFPVSDYEKEIEIMKTVTKEEYLASLRRRSSGFSRGVSKYRGVARHHHNGRWEARIGRVFGNKYLYLGTYSTQEEAARAYDIAAIEYRGINAVTNFDLSTYIRWLRPGTHPTASHDQKPSTDAQPFATSNSMQARGNIEVSNSNKNSFPSGKLDSTKKRDFSKYMNPLSPCNKPSSPTALGLLLKSSVFRELMQRNLNSSSEEAEEVELKYPHEGNDGVGGIYDNENTNNSYFCSSNISRLPNLESSEESPLPMYHGTVQSLWNSAFNMSN

SEQ ID NO: 204304 - protein, 210 aa, Glycine max
  Coding DNA Sequence Number=SeqID_87526
  Gene Ontology: Mol. function=nucleic acid binding
  Homolog annotation: Hit_ID=Q8LEE4; Match level="QueryCoverage=99%, HitCoverage=56%, E-value=3e-66, Identity=70%"; Hit description=Zinc finger protein
MDSISESYLVQVAGEGVIPLVQGILTCHQCSGDRVIWEESIDEQPWERARSISPLKVKEDDEVDKLDIKLDVKKKSKRVYQSPPPEVGLKISRSLKSLNAKTGLFSNRMKIIHQDPKLQAQRVAAIKKAKGTVAARKHTSKIMKAYFSDPVNRQKRSMAMKGHFHSLAPVTSLLGIGDTTVQNSMIAWLIGDSRVGSAGGKATTEEHVES

SEQ ID NO: 204305 - protein, 305 aa, Glycine max
  Coding DNA Sequence Number=SeqID_87527
  Gene Ontology: Mol. function=DNA binding; Cellular component=plastid chromosome
  Homolog annotation: Hit_ID=Q9LL85; Match level="QueryCoverage=86%, HitCoverage=84%, E-value=1e-77, Identity=57%"; Hit description=DNA -binding protein p24
  Pfam annotation: Domain name=Whirly; Domain location=93-267; Score =291.8; E_value=1.3e-84; Accession=PF08536.2; Description=Whirly transcription factor
  Subcellular localization annotation: CTP_CleavageSite=78; ConfidenceScore=5.92e-01
MSNLQLQLHSPPPSSLLSSSSSPSSLYSSSSLKLFPNHPFSTKSLPFNNHKHFSLRCRHTDLFDQNTIASTPRPTRPSASVGALPPRVYVGYSIYKGKAALTLTPRPPEFMPLDSGAYKISKEGYVLLQFAPAVGTRQYDWNRKQGNIYAGVICQNREGCAWFSVGRYPTSVGKVFSLSVSEMGSVISLGARDSYELFHDPFKGKRCWGVGLSDEGKVRKILKVEPLPDGSGHFFNLSVQNNLVNVDESIYIPVTKAELAVLTSTFNFIMPYLLGWHTFANSIKPEDNGVNNANPRYGGDYEWNR

SEQ ID NO: 204306 - protein, 99 aa, Glycine max
  Coding DNA Sequence Number=SeqID_87528
MLMKEFNTFTANKRMNHNSNKAKIKERKVLAQISWVEKLESMVANLKANLCPVHETWEMKIADGEHQIGISINTIKLVAKDEDLLSQDDEIDDRIKNLD

SEQ ID NO: 204307 - protein, 154 aa, Glycine max
  Coding DNA Sequence Number=SeqID_87529
  Homolog annotation: Hit_ID=Q2HRX8; Match level="QueryCoverage=45%, HitCoverage=9%, E-value=5e-08, Identity=40%"; Hit description=IMP dehydrogenase/GMP reductase
  Pfam annotation: Domain name=DUF1723; Domain location=10-50; Score =9.6; E_value=0.037; Accession=PF08330.1; Description=Protein of unknown function (DUF1723)
LSFHGKKVQKSGRPAVKIEGFHIPVGEVTITLDDVASLLHLPITGTFHSFETLHVDEAVLMLVELLEVSVDEAKAETVQCHGTYCWIYEHFPFVVKAITIEDYHERSPCACRWTSTKALLGSTYQKHLDRMKFDDVCWMLYDYHRAVRDFKLIS

SEQ ID NO: 204308 - protein, 97 aa, Glycine max
  Coding DNA Sequence Number=SeqID_87530
MATMMEAMMSMKKIMEANAVTIAVTSTVAKVNPMPPSGLNQMNHPTLDMVGKDLGSTNAPMMCKFKTSTPSQHMACLPTYTNQCDEKTMLRPNLKLP

SEQ ID NO: 204309 - protein, 44 aa, Glycine max
  Coding DNA Sequence Number=SeqID_87531
MRVKENEFDVLLKKRILMRHGDNGVRHGTDSQCQLAPSSYDGQW

SEQ ID NO: 204310 - protein, 89 aa, Glycine max
  Coding DNA Sequence Number=SeqID_87532
  Subcellular localization annotation: CTP_CleavageSite=50; ConfidenceScore=5.02e-01
MENRNTGSDAGDVSSATAVLLGALAPGVNGPTWITLKSTFLLLGLCLAVMLALAFSSSDSWLIFHVAFLVLICLILFLLLSWYFHPYPL

SEQ ID NO: 204311 - protein, 783 aa, Glycine max
  Coding DNA Sequence Number=SeqID_87533
  Homolog annotation: Hit_ID=Q8W417; Match level="QueryCoverage=57%, HitCoverage=54%, E-value=2e-34, Identity=28%"; Hit description=Cig3
MTTNSSLPSGVHKEKHILFEIGNSERQLWALIHSKGLLHSDVQVLYHNIRSSYERAILNNHTHSELQEVEYSLWKLHYKHIDEFRKIMKRSSGNAENKKSGMPKDGVVQINNDNHIQAFKSFLSEATEFYQTLIVKLRKHYGVPEEALFHKKGCVSASFEPESMLKCQYLHHRCLVCMGDLARYKQHYENLNAQKQNWSVSATHYLEATRIWPDSGNPQNQLAVLATYIGDDFLALYHCVRSLAVKEPFPDAWDNLILLLEKLHKLPSLMILQNRSSHLECVSSEVCFDFFKPSQRISKETGTQPNNDSSNGNLFEGESNHFTDTKLWSHIVRTVSYLFITSSLEKFPIALASTIEVLDEIMELEDIKLKTMLESYGQMDLARKGPFRALQIVSILIFTLKNLIDKHEKDESKDKNDCQQLVLIQLALAAAFIFMGRFVERCQKSSPLNHCPLLPSVLVFMEWCASMLDTIEVYATDQKSETAISYFFYVLIELLNQLNENRKETRKLVDSSTPLWEDYELRGFASVAFSHVSLDFSCRWEHINNFESGTELRAQRMSEAAMRIANRSNNLQKWIICDELERKFYSARSDENHEKKETGNVESTDKWTSGDDPNQKTRKDNGEDGKCDTRDNPSSSSTNGKPSAVEEEEVILFRPLARYNSAPLYALFPPHEQMSSPKDKDDKVLPSDDCLRRTTSLPMAQNPFQIDPWGFQGDITNSRMNKSFQLLEPSMKESNAHTFSEGPISAGHPSLNAWALDTNRLHPIEELASSYLADLSIDRTQNA

SEQ ID NO: 204312 - protein, 72 aa, Glycine max
  Coding DNA Sequence Number=SeqID_87534
  Gene Ontology: Mol. function=structural constituent of ribosome; Cellular component=ribonucleoprotein complex; Biological process =translation
  Homolog annotation: Hit_ID=Q9M5M6; Match level="QueryCoverage=99%, HitCoverage=83%, E-value=4e-23, Identity=73%"; Hit description=60S ribosomal protein L30
MVAAKKTHESINKRLLLVMKSSKGKLIIIANNCTPLRKSEIEYYAMLAKVGVHHYKCGLGHCMRQILQSVLP

SEQ ID NO: 204313 - protein, 218 aa, Glycine max
  Coding DNA Sequence Number=SeqID_87535
MDRARLVYGLVTHMDMNIDTLISGQISSVAQSNSSRLRFPALITTLCRARGITSDSLTYESLSPAINLAYIKKNCWNMDYLIVNFRGARKARARPVDSLQVVAPPGTILTVKQFVEKVQDASSEATIPKPFVFKAGGTQVRQEAATPERSTQISPDPPTPMHEMPADPSTPLLEIPEDPASLVLGLTTTPLATLVLHFTDEEGTQDQDNQQDDQSQEF

SEQ ID NO: 204314 - protein, 95 aa, Glycine max
  Coding DNA Sequence Number=SeqID_87536
MGTDTIMPAPVPALMSVLAAVCRDASICRLTALASAGEASPAPRPAINSPPAISHALPAAASSSKPSMAVSAASMAVLRTPQRASSSVAPGVARQ

SEQ ID NO: 204315 - protein, 124 aa, Glycine max
  Coding DNA Sequence Number=SeqID_87537
  Gene Ontology: Mol. function=oxidoreductase activity; Cellular component=mitochondrion; Biological process=electron transport
  Homolog annotation: Hit_ID=Q8XTH4; Match level="QueryCoverage=98%, HitCoverage=29%, E-value=2e-45, Identity=72%"; Hit description =Probable nadh:flavin oxidoreductases oxidoreductase protein
  Pfam annotation: Domain name=Oxidored_FMN; Domain location=1-124; Score=-170.3; E_value=0.029; Accession=PF00724.10; Description =NADH:flavin oxidoreductase  NADH oxid
MWMQINHPGRQMPAALGQPALAPSAVALQMGALSKQFAPPKAMTEDDIDAVIARFIRSAELAERAGFSGVEIHAAHGYLLSQFLSPLSNQRNDRWGGCLPNRARLLLEIVQGVRAVVAPDFVLV

SEQ ID NO: 204316 - protein, 451 aa, Glycine max
  Coding DNA Sequence Number=SeqID_87538
  Gene Ontology: Mol. function=pectate lyase activity; Cellular component=anchored to membrane; Biological process=pathogenesis
  Homolog annotation: Hit_ID=Q9M9S2; Match level="QueryCoverage=99%, HitCoverage=98%, E-value=1e-139, Identity=55%"; Hit description =Probable pectate lyase 3 precursor
  Pfam annotation: Domain name=Pec_lyase_C; Domain location=181-366; Score=314.0; E_value=2.8e-91; Accession=PF00544.9; Description =Pectate lyase
  Pfam annotation: Domain name=Pec_lyase_N; Domain location=35-87; Score=21.2; E_value=3.3e-05; Accession=PF04431.4; Description =Pectate lyase, N terminus
  Pfam module annotation: Pfam domain module=Pec_lyase_C::Pec_lyase_N; Domain location=181-366::35-87
MANCQQYYFLLLSLAIFIPTLNANSLEKDEYWQSHVYEFDSYWQERAKAAKVDSQAAYFEDPYSVSSNFTSSVSELTIGKKDLRRNLKGKYRGDGPCIATNPIDRCWRCDPNWANNRQKLADCVQGFGRNTVGGKGGPFYVVTDPSDDDMVNPKPGTLRHAVTRDGPLWIIFARSMFITLQQELIMNSNKTIDGRGVDVYIAKGAGITVQFVKNIIIHGIKVFDIVIREGGMIRDSETHYGFRTKSDGDGISIFGSSNVWIDHVSMRNCSDGLIDAIMGSTAITISNSHFTDHNEVMLFGASDSYSDDKIMQITLAFNHFGKRLVQRMPRVRYGFVHSVNNDYTHWEMYAIGGSKNPTIISEGNRFIAPDNQFAKQITKREYAPENVWANWQWRSINDVYMNGAFFVQSGPELASRPFSREDMITAKVGNYVGRLTRYSGNLLKCRVGRPC

SEQ ID NO: 204317 - protein, 43 aa, Glycine max
  Coding DNA Sequence Number=SeqID_87539
PLVIVTLLREQCNYLEEVPTKRQSKCGAMRLDLIWSLEYEMEI

SEQ ID NO: 204318 - protein, 273 aa, Glycine max
  Coding DNA Sequence Number=SeqID_87540
  Gene Ontology: Mol. function=alpha-amylase activity; Cellular component=chloroplast; Biological process=carbohydrate metabolic process
  Homolog annotation: Hit_ID=Q5BLY3; Match level="QueryCoverage=99%, HitCoverage=25%, E-value=1e-119, Identity=73%"; Hit description =Plastid alpha-amylase
  Pfam annotation: Domain name=Alpha-amyl_C2; Domain location=212-272; Score=106.4; E_value=8.5e-29; Accession=PF07821.3; Description=Alpha- amylase C-terminal beta-sheet dom
EEIGYDGWRLDFVRGFWGGYVKDYLEASEPYFAVGEYWDSLSYTYGEMDHNQDAHRQRIVDWINATAGTAGAFDVTTKGILHSALNLFSKFELKLTAPLVRMLQKMSRKMCMLLTFFFLPDQQAALERCEYWRLSDQKGKPPGVLGWWPSRAVTFIENHDTGSTQGHWRFPSGKEMQGYAYTLTHPGTPSVFYDHIFSHYKTEIATLISIRKRNKIHCRSTLKICKAERDVYAAIVDDKVAMKIGPGHFEPPSGSQRWSSALEGRDYKIWEAS

SEQ ID NO: 204319 - protein, 145 aa, Glycine max
  Coding DNA Sequence Number=SeqID_87541
  Gene Ontology: Mol. function=alpha-amylase activity; Cellular component=chloroplast; Biological process=carbohydrate metabolic process
  Homolog annotation: Hit_ID=Q5BLY1; Match level="QueryCoverage=97%, HitCoverage=15%, E-value=1e-70, Identity=82%"; Hit description =Plastid alpha-amylase
MELKEKAAELASFGFTVIWLPPPTESVSPEGYMPKDLYNLNSRYGTIDELKDVVKTLHEVGIKVLGDAVLNHRCAHFKNQSGIWNLFGGRLNWDDRAIVADDPHFQGRGNKSSGDNFHAAPNIDHSQDFVRKDLKEWLCWMRFHF

SEQ ID NO: 204320 - protein, 364 aa, Glycine max
  Coding DNA Sequence Number=SeqID_87542
  Gene Ontology: Mol. function=alpha-amylase activity; Cellular component=chloroplast; Biological process=carbohydrate metabolic process
  Homolog annotation: Hit_ID=Q5BLY3; Match level="QueryCoverage=98%, HitCoverage=39%, E-value=1e-127, Identity=59%"; Hit description =Plastid alpha-amylase
RLDQGKDLGNWELTVGCNLPGKWILHWGVSRVDDVGSEWDQPPRDMIPPGSIPIKDYAIETPMKKSLSSAEGDILHEVKIDLKPNNDISAINFVLKDEETGAWYQHKGRDFKVPLVNYLKEDANIIGPKKGFSLWPGALGQISNILLKSEATHDKDQDDNSGSINTKVENSQLEGFYVDLSITKEVIVENSISVSIRKCSETAKNILYLETDIPGDILLHWGVCRDDLKWWEIPPAPHPPETIAFKDRALRTKLQSRDSGEGSSVQLSLGEEFSGFLFVLKLNDSTWINDMGDDFYIPLPSSGSIITGNREDQSEGVQKEVTEEAGQEESISAFTDEIINEIRHLVTDISSEKNRKTKSKGGIL

SEQ ID NO: 204321 - protein, 338 aa, Glycine max
  Coding DNA Sequence Number=SeqID_87543
  Homolog annotation: Hit_ID=Q207T5; Match level="QueryCoverage=25%, HitCoverage=42%, E-value=1e-17, Identity=55%"; Hit description =Quinone oxidoreductase
MGIDDLMYQLSKLLADVTKPKLRVYRPAEPRPCDFGKSHIGIIVHSGVFGSVVSVDFRTGSTNSAKSELASSAEFKLARSAEFVYLVQSNSNQLVHPNLNQLVQTNEVQVGPALVHLSYAQIGQNLQVLNKLPNQHNIQNGLVQLAKGVIQCGILQPWSITPPTSADQHGFQPMTLCEKQPKTIVMQNSAQSATSSIVEPGMLQVYGGKENRNEYHKLQLFPLSLTRTAFTWYSCLPSNLVQSLANMERVPETLSAEELAKLGEPTKAKSDVPIITPNELSKADGFFFGFPIIFGKMASQFKAFIDETGDLWKAEQLAAKPAGILITTCCQGGGKEIV

SEQ ID NO: 204322 - protein, 277 aa, Glycine max
  Coding DNA Sequence Number=SeqID_87544
  Homolog annotation: Hit_ID=Q1T4Z8; Match level="QueryCoverage=24%, HitCoverage=15%, E-value=7e-12, Identity=41%"; Hit description =Ribonuclease H
MGFKLAHGRLTTRIFYEVLEKVSSRLASWKGEILNRPGRITLANSVLFAIAAYTMHVLLNLLGVYSARSGYRWLIDKNHEHSNTRNWLWKSKLPENILFFIWQVCNHALPTSKMIQNRHIPISPTCPRKVVSFWQSLSLDIGISDVAGTTPSPDWCVILSSILVLFSQWLFEKFGKLETPSAWGCFVLQESEIGAVYPPFSPAVAVYVDGSCLGPQEETILFHKYAAIIAAIKELLRRQWSVNLLHFLKDGNACVDILAKMGNQHLWCFSWMLMRGV

SEQ ID NO: 204323 - protein, 129 aa, Glycine max
  Coding DNA Sequence Number=SeqID_87545
  Gene Ontology: Mol. function=RNA-directed DNA polymerase activity; Biological process=RNA-dependent DNA replication
MEKVDGRVEWTYLQKIPGFLPKARFEARGLPLPLFVCFMYERLGAKISEAFVNGDWAPISLSRGGSRGSWQIMCLFSQEKPSKLRFVLNLLNDFCLGSGFNVNVDKPKAFASKGVTNHRKSKLAAFIGS

SEQ ID NO: 204324 - protein, 164 aa, Glycine max
  Coding DNA Sequence Number=SeqID_87546
  Gene Ontology: Mol. function=voltage-gated ion-selective channel activity; Cellular component=mitochondrial outer membrane; Biological process=anion transport
  Homolog annotation: Hit_ID=Q9XH72; Match level="QueryCoverage=56%, HitCoverage=33%, E-value=5e-36, Identity=78%"; Hit description=Porin
NDKGDNLTASYYHIVNPLTNTAVGAELSHSFSGNENILTFGTQHALDPLTLLKSRVNNYGRASALIQHDWTPRTRFSLVGEVDTGAIEKSAKIHPNAIDLGSPLRKFFEHGKANQHSKHSSITDERRPFDPNLSRPSSQDPNLPNEQHCYSFLYMQDMTTLGLK

SEQ ID NO: 204325 - protein, 140 aa, Glycine max
  Coding DNA Sequence Number=SeqID_87547
  Gene Ontology: Cellular component=membrane
  Homolog annotation: Hit_ID=Q6UNT3; Match level="QueryCoverage=95%, HitCoverage=98%, E-value=1e-20, Identity=77%"; Hit description =Hypersensitive-induced response protein
MGLALGCLQVEQSTVAIKEVFGKHDDGLEPGFHCVPWFFCTQVAGYLSLRVQQLDVRCETKTKCLVSILPIKITLTVIPRIMFLWLTMTMFLVTQYFDTLKEIGASSKSNSVFVPHGPGAVRDIASQFRDSLLQGKVAQS

SEQ ID NO: 204326 - protein, 173 aa, Glycine max
  Coding DNA Sequence Number=SeqID_87548
  Gene Ontology: Mol. function=transcription regulator activity; Cellular component=nucleus; Biological process=regulation of transcription
  Pfam annotation: Domain name=HLH; Domain location=9-61; Score=35.5; E_ value=1.8e-07; Accession=PF00010.16; Description=Helix-loop-helix DNA- binding domain
MENNPSSSSRTDRKFIEQNRRNHLKDLFFKLNSVVPHQSSREAISRPDQIGEATNYIKNLQIKLEKMKEKKNNLIDIKRSKNVSMNMGLLKSPQFKIQQMGSTLEVFLITGLDCQFMFNETVRVLQEEGSDVVNASYTVVENEVFHTIHCHQVGESANGALRISEKLKKYFNG

SEQ ID NO: 204327 - protein, 153 aa, Glycine max
  Coding DNA Sequence Number=SeqID_87549
ETSLSTAIPLELEVIPQVKELLDEGLVRKSLNPCDLLVPKIGIIRHQIPMIGGMMNLLSGATLFCKITHAPDIFMICVHRDSLGRLVLIFCFNANLGAHVGHLRASHGEKSPLKDLIEAQRPSLHRSPTSKLPSSEDWAKGAREGPRVLMSLR

SEQ ID NO: 204328 - protein, 52 aa, Glycine max
  Coding DNA Sequence Number=SeqID_87550
IVVANSYRPIGGAKDDLGIGTKIQDCIFSNKGYARLLLLEKFIKHAGKQQLL

SEQ ID NO: 204329 - protein, 429 aa, Glycine max
  Coding DNA Sequence Number=SeqID_87551
  Gene Ontology: Mol. function=protein serine/threonine kinase activity; Cellular component=membrane; Biological process=protein amino acid phosphorylation
  Homolog annotation: Hit_ID=Q39886; Match level="QueryCoverage=98%, HitCoverage=82%, E-value=1e-149, Identity=67%"; Hit description =Protein kinase
  Pfam annotation: Domain name=Pkinase; Domain location=187-429; Score =115.2; E_value=1.9e-31; Accession=PF00069.15; Description=Protein kinase domain
  Pfam annotation: Domain name=Pkinase_Tyr; Domain location=187-429; Score=93.3; E_value=7.3e-25; Accession=PF07714.7; Description =Protein tyrosine kinase
  Pfam module annotation: Pfam domain module=Pkinase::Pkinase_Tyr; Domain location=187-429::187-429
  Subcellular localization annotation: CTP_CleavageSite=85; ConfidenceScore=5.47e-01
MDEDSSNSWIRRAKFSHTVCHRLNYSSSGFGSFSIQPRAQHSSSSLKSRPEVAFASNKAQKKPIMNKQRSLSPLPRTSLSETFKEARHEQKRFSTPGPRRKEQNKDKRIMGKLLNKDSHVSNSKSPRSSPITTKSPYSSPIRHLASMKLSSKQHRKDLGWTKYFDHGGGKVTAVETAEEWNVDLSKLFVGVRFAHGAHSRLYHGMYKDEAVAVKIITVPDDDENGMLVDRLEKQFIREVSLLSCLHHQNVIKLVAQLLFSDKNKFVAACRKPHVYCVITEYLSEGSLRSYLHKLERKTISLGKLIAFALDIARGMEYIHSQGVIHRDLKPENVLINEDFHLKIADFGIACEEAYCDLFADDPGTYRWMAPEMIKRKSYGRKVDVYSFGLILWEMVTGTIPYEDMTPIQAAFAVVNKEKVYSPIYPPKPL

SEQ ID NO: 204330 - protein, 60 aa, Glycine max
  Coding DNA Sequence Number=SeqID_87552
KNTSLVIRGGGGYRIVLLSCNGKNLVLERLNNGGKPRVWDVNREFPEENREFHAIDFQVK

SEQ ID NO: 204331 - protein, 67 aa, Glycine max
  Coding DNA Sequence Number=SeqID_87553
MIENDEVTLKRYAHRSRIDAYPTCGCEARITLIHWTILVGSVIEESVLRIKDDHKVVPRRQSHGVTV

SEQ ID NO: 204332 - protein, 150 aa, Glycine max
  Coding DNA Sequence Number=SeqID_87554
MDDSVCEKYGISKEKWAQFCQTRRDPSWEDVRKKAQAIQKQNTAPHVLSHGGYEYLEQKLLAEKTKKKLEEAAHSGSVDGVIDPPSPVRRHVKWKMARTKKIGEMTTEAAKEIAEKIATQGSFVPHGRQDVLTTVIGRPKHPRRVRAAGA

SEQ ID NO: 204333 - protein, 136 aa, Glycine max
  Coding DNA Sequence Number=SeqID_87555
MYNLKVPKEVIHVFDYIGYPSSPSTLNLEMKRWLIAHHLILEKNVMVSIAIQPPLQKLQHIFRIRTPCHNLPFDGRAHGKIKARVLMKRMCGVATNIYSRKTLEKPKRGLRILKIRVRELFAHREGISTPCPRHKG

SEQ ID NO: 204334 - protein, 78 aa, Glycine max
  Coding DNA Sequence Number=SeqID_87556
  Gene Ontology: Mol. function=ribonuclease H activity; Biological process=DNA integration
  Homolog annotation: Hit_ID=Q1SYR3; Match level="QueryCoverage=97%, HitCoverage=3%, E-value=2e-25, Identity=70%"; Hit description=RNase H, putative
MKNAFDKKVRLRKFHEGDLVLKKMSHAVKDNRGKWAPNYEGPFVVKRAFFGGALVLTNMDGDELPLPVNSDVVKRYYA

SEQ ID NO: 204335 - protein, 70 aa, Glycine max
  Coding DNA Sequence Number=SeqID_87557
  Homolog annotation: Hit_ID=O64438; Match level="QueryCoverage=45%, HitCoverage=13%, E-value=1e-09, Identity=87%"; Hit description=ARG10
MRIFTLVYVLFLFVPHDSVGGLRCYENPKNKITAVPVEEEDIWGAFFKVILELKKLELNIHYVTRIASCN

SEQ ID NO: 204336 - protein, 133 aa, Glycine max
  Coding DNA Sequence Number=SeqID_87558
  Subcellular localization annotation: CTP_CleavageSite=62; ConfidenceScore=5.23e-01
MSSPSTPFYVLQRPFMFLFIGPNTEFYISNRRKFIIDFKNKCSSSCGGSTASNNGSWWLSVVVGGGKRVSRISLSESLSGNPLLALSAISLGLGFALSTTHSCETRFSLAGRTGPTEIGGLTKPILLLDRLRN

SEQ ID NO: 204337 - protein, 494 aa, Glycine max
  Coding DNA Sequence Number=SeqID_87559
  Gene Ontology: Mol. function=protein serine/threonine kinase activity; Cellular component=chloroplast; Biological process=protein amino acid phosphorylation
  Homolog annotation: Hit_ID=Q5XWQ1; Match level="QueryCoverage=91%, HitCoverage=76%, E-value=0.0, Identity=75%"; Hit description =Serine/threonine protein kinase-like
  Pfam annotation: Domain name=Pkinase; Domain location=131-418; Score =131.2; E_value=2.9e-36; Accession=PF00069.15; Description=Protein kinase domain
  Pfam annotation: Domain name=Pkinase_Tyr; Domain location=131-418; Score=67.0; E_value=6.2e-17; Accession=PF07714.7; Description =Protein tyrosine kinase
  Pfam module annotation: Pfam domain module=Pkinase::Pkinase_Tyr; Domain location=131-418::131-418
MGLGGAENGKVVVESLDVCKSKGRKKKKKEDGEVEEEEETGCWFRLRFIGSCISSRSKVDSSVSGTSTNYAESKSTIDTSRDQPTLRVVSSTTTSNAESNSSTSKLEEELKVASRLRKFAFNDLKLATRNFRPESLLGEGGFGCVFKGWIEENGTAPVKPGTGLTVAVKTLNHDGLQGHKEWLAEVNYLGDLVHPHLVKLIGYCIEDDQSFSVMWMDYGLELQTSAYTLCFDYIHWSLPLPWSIRMKIALGAAKGLAFLHEEAERPVIYRDFKTSNILLDAEYNSKLSDFGLAKDGPEGDKTHVSTRVMGTYGYAAPEYVMTGHLTSRSDVYSFGVVLLEMLTGRRSMDKNRPNGEHNLVEWARPHLGERRRFYKLIDPRLEGHFSIKGAQKAAHLAAHCLSRDPKARPLMSEVVEALKPLPNLKDMASSSYYFQTMQADRFSVSPNTRNGRTQGALLTRNGQQQRSLSIPHGTHASPYHHQFPQPSPKPNGKA

SEQ ID NO: 204338 - protein, 172 aa, Glycine max
  Coding DNA Sequence Number=SeqID_87560
  Gene Ontology: Mol. function=RNA-directed DNA polymerase activity; Biological process=RNA-dependent DNA replication
  Subcellular localization annotation: CTP_CleavageSite=33; ConfidenceScore=5.03e-01
MPTPDAFVSTTKGKEKSGNPKTGALTQGFLQFRKSMISCRCPLELIIGQQGCEGSGQRGVPFYVTAVLHLASKRCGPSIPLAGWQMSILKVDRVIRVSRRWEGCQRLEEKGKLVNQGGDVGVGVLGRCNWGEDPDVEILASTVSLKHSPKLRGSDAIMVISELPFNSIKLPS

SEQ ID NO: 204339 - protein, 286 aa, Glycine max
  Coding DNA Sequence Number=SeqID_87561
  Homolog annotation: Hit_ID=Q10RM8; Match level="QueryCoverage=76%, HitCoverage=37%, E-value=4e-42, Identity=45%"; Hit description =Expressed protein
  Subcellular localization annotation: CTP_CleavageSite=45; ConfidenceScore=5.32e-01
APDESSQFSKVQSPNSAKSSISSKSPDRTKIASIDDQYAIMVSCRCNYTASRLFFKQATSWRPRSSRDIIISVASEMSGESPGPYERNSQLPVQVLTLQASNLTSEDLTLTVLAPASFTSPPSVVSLSSPISPMSPFIGFKEFLGRISVERHVGATQGGSFTSLIKDNEKQNDDVRPQSVSVNDDVISSSGLSCTHLWLQSRVPLGCIPSQSTATIKLELLPLTDGIITLDSLQIDVMEKESLMTHGHSNFRHAFYKVLASPRCDVSVPDTHLGPFYIVVLLVTSH

SEQ ID NO: 204340 - protein, 345 aa, Glycine max
  Coding DNA Sequence Number=SeqID_87562
  Gene Ontology: Mol. function=chromatin binding; Cellular component =chromatin; Biological process=chromatin assembly or disassembly
  Pfam annotation: Domain name=rve; Domain location=12-162; Score=7.3; E_value=0.0015; Accession=PF00665.16; Description=Integrase core domain
MAAILVGPPLSNPHKPHKLKGINGTDRLYLVAMRTSIVMLPTAVRANKRNMITGDHQGSHFGSGGPILEGNSFGPITATSYNLFHGQNELFKLNGMKLCMSSAYHPQIDGQTEAMNRVIEQYLRAFVHQKPATWGRFLIWAEWSYNTSIHSAMGMTPFEVTFGIKPPSIQQYLVGALNVEAVDDWLIQRDTIFTSLVKKLNKAQQRMKKLTDRHQWDWAGLFSEDTLWENWDTLKEDYNFEDKGSAPRIFLSAEWHNSDNMVIWKMSKDFPVKHAYYHIMENMLDNSAYCEDGDWMLTWSLNVPLNENVVAQRMIGIASLAVSMLERSLAESNLWPFMQWIDNAQ

SEQ ID NO: 204341 - protein, 337 aa, Glycine max
  Coding DNA Sequence Number=SeqID_87563
  Gene Ontology: Mol. function=RNA-directed DNA polymerase activity; Cellular component=chromatin; Biological process=chromatin assembly or disassembly
MAESTSSKSNMDRLEEAMAKLSSSHLHVTEKLDDLLLRVAALETTIHHSPSPSSSFAIPTPPNSTVNPPRMKLDLTTWPCFLQAIEACFAQSPYEDPTELLCKLTQKGYVPDYLTQFEALANRIVELPTSFLLSYFVSGLDLDIRREDHALQPLTLVHAVGLARLHEEKLLTHHKGHRCTSRFFLLIADEDHGEDISNPKIASPYPLPDNPHRPDPPNNPSLNLPQLEPLQAQISLHTLAGQTAPKTLRIRGRISHQLVVILVDEGSMHNFMQKRVVKSLGLQAQSSPTLRVLVRNGNELECCQVCLNVALYVHGRVFTVDLHVLPLCGADIVLGVQ

SEQ ID NO: 204342 - protein, 471 aa, Glycine max
  Coding DNA Sequence Number=SeqID_87564
  Homolog annotation: Hit_ID=Q10RM9; Match level="QueryCoverage=99%, HitCoverage=57%, E-value=1e-94, Identity=41%"; Hit description =Expressed protein
MSDDPYAQVEHFDGEAEGENGAQSSRNDAPVLAKHVDVSEDEGWITIPYKEIPENWNHVSDMQSLRSLDRSFLFPGEQVHILACLSACKQDMEIITPFKVAAVMSKNGMGHGPDKENGNVENRNDSVSGEGKLSPSRQEQKEEKQEKVKTDHQADASAGESLLRMEVHKRQTALLLQKFENSHFFATISESDEPLWSKRGSSEKFNSSELNGPKISSFEIKDTAKNASSISAVIDRANFDATISGGVARNSVQCCALPNGDIVVNVGVDFLRDPCIEILQYEKYQEKVLSSENQNNSVHTNQDPCGALLKWILPLDNTLPPATRPLSPPQFSLNSGIGNTSQRSNSSASPGSQLFSFGSHFRSYSMSALPQNTNAPSPPLKAASSKPSFDIEDWDQFPSQKLRKKNGVEELLSFRGVSLEPERFSVCCGLEGIYTPGRRWRRKFEIIQPVEIHSFAADCNSEDLLCVQIKV

SEQ ID NO: 204343 - protein, 90 aa, Glycine max
  Coding DNA Sequence Number=SeqID_87565
MGFRHSHWRDTPCPPSTPCIHPSAQHHPSSIAISASQSGEIAFVHPRGSASWSGEIGLAFMQKTNDMASCRVGSIPCFMHASYCYVGFNI

SEQ ID NO: 204344 - protein, 126 aa, Glycine max
  Coding DNA Sequence Number=SeqID_87566
MVTSKKTVKVRLGFVLNRNREASLEDSAPIEGFLSKKLGTLEIFLEEGRRKKWRFSKATRITKADTLKFFCSRKRKRFSHSGCRIADRNGQVVQKCLMNHQTKSQEDPTVNECRRAFLPRQLRQLP

SEQ ID NO: 204345 - protein, 379 aa, Glycine max
  Coding DNA Sequence Number=SeqID_87567
MTLTLKVDMLLVMQARFDVLGGGGECSACAILLHMFHSWSGHVLEMYSFLIMSSFLSGSAIGISNPWWTERSSSSAVPPQRRLVMGILTTNPLPQIGQGFHVVLVEALLASVGGHTLLLLFRGAKRIGGRDVRASLRVQRSHSPRSSSSPHAIASYEWVRANVLKYQSCITFAASVVALQHQLRLASPEDSCKIAVQACGSDDFPFLRVSSNSKIGRISLNNASKKLFEFGSNVFCRFKDHFFKVLATDVMADGLPLMFKSNPTKFKSFDEDLLTFVERVDKAILEQLLASLDAWTILSLPLANDSFTALDGIMEKGQLVVEVGPTIGVVEVSLNARSSVLAKRKLMPSLGRPSSLQDPPPAPLVVQASAPSPPPIASA

SEQ ID NO: 204346 - protein, 86 aa, Glycine max
  Coding DNA Sequence Number=SeqID_87568
KESTTSPRQAQGETPQQPGDGQQRATDAPPSPLEFTSAHPQKRLERCLRPMARPIGNQVQSQRTFPLSPNRWPNPDIYHDQSFYKP

SEQ ID NO: 204347 - protein, 107 aa, Glycine max
  Coding DNA Sequence Number=SeqID_87569
  Gene Ontology: Mol. function=protein serine/threonine kinase activity; Biological process=protein amino acid phosphorylation
  Homolog annotation: Hit_ID=Q1SHH6; Match level="QueryCoverage=91%, HitCoverage=23%, E-value=1e-40, Identity=80%"; Hit description =Protein kinase; Calcium-binding EF-hand
MDLKNAHPWLRDDSRPIPLDILVFKLVKAYLHATPFKRAAVKALSKALPEDQLPYLSAQFRLLEPNRDGHISLDNFKMALVRNATDAMRESRVLEIINAVRNYSYMY

SEQ ID NO: 204348 - protein, 93 aa, Glycine max
  Coding DNA Sequence Number=SeqID_87570
MWNLGTPYFPSPEGYKGKAPTFEVNYHLAVYNNKTPLFIWWKCCKENEKLFFNCTGLLLTSWLMQDGQASNYTINKMDVIVQFSILVPRHYSL

SEQ ID NO: 204349 - protein, 60 aa, Glycine max
  Coding DNA Sequence Number=SeqID_87571
MVYQPNHALVIWGQLNNLQRRRRKKGQLGALSACPGELSLSPEVRSSPRRAKCWPGQAGA

SEQ ID NO: 204350 - protein, 77 aa, Glycine max
  Coding DNA Sequence Number=SeqID_87572
MREFGTIAAHPGELMLSPEENGSPRLVGPFSPKQFGGPGPSQEAQSPQRKKSITSAMPPSSSAPSSSPGASMGPTST

SEQ ID NO: 204351 - protein, 120 aa, Glycine max
  Coding DNA Sequence Number=SeqID_87573
  Subcellular localization annotation: CTP_CleavageSite=54; ConfidenceScore=5.30e-01
MGGWGPGAIGAGYTGRSCHSTAPSPYSWLPGGQPNAACRAPSSACESRWTLEMVAAVEVAVDSIDQLTLRQREIKIMVVGKDVAEEKRHPDLCQSGHASAHDLHLPSRHASCKVLSWGAQ

SEQ ID NO: 204352 - protein, 166 aa, Glycine max
  Coding DNA Sequence Number=SeqID_87574
  Subcellular localization annotation: CTP_CleavageSite=61; ConfidenceScore=5.62e-01
MLFGYLGIGDCCLLSVGVATTSSPVMSLSLAPSVPPSAMLVSALPSTSSHPTFLWITYTLSAMLIRCWRNLAILKENRKRVECPKVANTIVTIAKALRSNHQLFSKVGGVLTKLLLTRLDVDELLEQCKGLWREKNELADKVESTMTEKDELAKVVADLEARLKES

SEQ ID NO: 204353 - protein, 45 aa, Glycine max
  Coding DNA Sequence Number=SeqID_87575
MRLKRYQIATVINFYIVLRSVFFIHHPVSFGFKDLGPHGALWLER

SEQ ID NO: 204354 - protein, 719 aa, Glycine max
  Coding DNA Sequence Number=SeqID_87576
  Gene Ontology: Mol. function=RNA-directed DNA polymerase activity; Cellular component=mitochondrion; Biological process=RNA-dependent DNA replication
  Pfam annotation: Domain name=rve; Domain location=611-718; Score=7.7; E_value=0.0013; Accession=PF00665.16; Description=Integrase core domain
MVFKVLIDQSNSIDILYWKTFHRLKVSPDTFQPHVGPLLGFVGERVEARDYLDLMTNLGQGQLSRSFINRKILNELGAIVSTLHLKMKFPTLTGEIVTIKPESDTLSSHQGASKASLQAGGALTVYQESLDDVFDVNPHDETSDKVLKPIKELIKLQLRPKPSQCTQLSRDLTIHEYILIANVLHRNINLFAWKPSDMSVDKLQKANFIREARYSIGLANFVMIKKANGYNQIRMHAPNEEKMTFITKDINFYYWQVLRLYDHTSRNRSQPDKCTTILKMHSPTNIQEVQKLNVRLASLSRFLPKLPEKAKPFNNPMSTQARSTPSSISLSCEVVSSTLIQDERKHQLPIYFTSRILHDAKKCYQMIEKVALALITSTRHLRPYFQSHQVIVKMNYPIKQVLQKPKLMGRMVACLYVDGSSNEKGSKTRIILEGPDNVTLEQALKLNFKASNNQAEYKELILPTNIYQTKETVLLKYYHIAKTLIDNFECFEMYHIPKESNTRADLFSKLANTKKIEHLKTIIQDMIQTPTINTEEVMAGEEEVDYIMRELHEGICGLYTGGSSFTTKVVCADYYWPTLRVDALGFTKRCRQYHEFTNIPCTPPNNLHSMNSPLPFAIWGMDILGPLPRTPRAFKYLLVVIDYFTKWVEARPLREIKINEAYDEFLTRLGINHLVTSTKHPQANGQVEIIRALHTGLNKSKGLWNEELPIILWAYHCSP

SEQ ID NO: 204355 - protein, 253 aa, Glycine max
  Coding DNA Sequence Number=SeqID_87577
MGMAHFPIYAEVVARVFAGGVSVFLDLLFCLFFCRHRDYCGAPLGFLRGPTIFHIVTIIEMDCSVIDRQGLSANLPGLRARRMECNATSRLARATDVIRCDRLVGYCELKCLTRVLKLSMDLGGSPPYQVNASPLRDVGKTEHKIMSSLVYRFAWEMCERSAHRLGGVWHKPPANHGQPLAFQTPPHVSVMVVGEGLEPSKGVSRLRPNRVLTMGEKERPHGMFYRGPTADAKYTYQNLELSHIRVDVDKVGS

SEQ ID NO: 204356 - protein, 111 aa, Glycine max
  Coding DNA Sequence Number=SeqID_87578
MERRHKEELRKLKADHDDLEARVRQPQGDEHSVHMIHERYSRGITPSVNHQHLRRSQPLAHTLPYEGPTTCRHPFVDCIMEVELPLGWKPLNLKCSDGTTDADEHLNAFLT

SEQ ID NO: 204357 - protein, 136 aa, Glycine max
  Coding DNA Sequence Number=SeqID_87579
  Gene Ontology: Mol. function=DNA binding; Biological process=DNA integration
MHDGAIRILTEVHHVLKLKKNLVLVDVMDSKDERKRGVSGNADFKTPIEVWSNKLIEYSMLKVFRCPTYYHVSEGKLQPRAKKGFFMGYGNGVKGFQVWSPSERKVIRNGDVAFDELSMLHSKFDEDLGKVEYVTR

SEQ ID NO: 204358 - protein, 97 aa, Glycine max
  Coding DNA Sequence Number=SeqID_87580
  Subcellular localization annotation: CTP_CleavageSite=72; ConfidenceScore=5.28e-01
MKGRMSTSNRALGFPALITGLCQSFGVQVTSNGVANYHNLPFCGRARRGSWVDKSGAFAPTYPPSKRKSDLRSSFKRGESSDSFYLEGGHLRRWTLK

SEQ ID NO: 204359 - protein, 124 aa, Glycine max
  Coding DNA Sequence Number=SeqID_87581
  Gene Ontology: Mol. function=protein serine/threonine kinase activity; Biological process=protein amino acid phosphorylation
  Homolog annotation: Hit_ID=Q1SHH6; Match level="QueryCoverage=79%, HitCoverage=23%, E-value=3e-44, Identity=87%"; Hit description =Protein kinase; Calcium-binding EF-hand
MEPLAYRKMDFEEFCAATISTHQLEAHDRWEDIASTAFEHFEREGNRLISVEELARELNLGPSAYSVLKDWIRNTDGKLSLLGYTKFLHGVTLRSSNPRQHRYSRSQKRKCIPEGKKGVQEAIA

SEQ ID NO: 204360 - protein, 89 aa, Glycine max
  Coding DNA Sequence Number=SeqID_87582
MVEVSIDLDEVVKMKLWDQCVDIIKDDVQEAMHKGAHYNRKFGENMLREMLKQLEDELVVPFCLENMILDKVPKVNCNPCLSCSVAFKE

SEQ ID NO: 204361 - protein, 161 aa, Glycine max
  Coding DNA Sequence Number=SeqID_87583
  Homolog annotation: Hit_ID=Q1SHH7; Match level="QueryCoverage=55%, HitCoverage=80%, E-value=2e-32, Identity=78%"; Hit description=Auxin responsive SAUR protein
  Pfam annotation: Domain name=Auxin_inducible; Domain location=1-95; Score=130.2; E_value=5.6e-36; Accession=PF02519.5; Description=Auxin responsive protein
MGIGEKSSSKSFNLHHREVKNKQQEFRGVPKGCMAIKVGQGEEQQRFVVPVIYINHPLFMQLLKEAEEEYGFDQKGTITIPCHVEEFRNIFSRAGIMGTPLFRKREKNWKRTAYILNDGLINCELLHGYGPERENEVCKEQSNEVGVWTISVSEIRNKLNH

SEQ ID NO: 204362 - protein, 66 aa, Glycine max
  Coding DNA Sequence Number=SeqID_87584
MNELHERAKDYIQMEEMSKFRNKARYLAQFLKRSDNNPTGARPRGHQDDNHKVHNADRKKEIAKDR

SEQ ID NO: 204363 - protein, 237 aa, Glycine max
  Coding DNA Sequence Number=SeqID_87585
  Gene Ontology: Mol. function=transporter activity; Cellular component= membrane; Biological process=oligopeptide transport
  Homolog annotation: Hit_ID=Q9CAR8; Match level="QueryCoverage=95%, HitCoverage=38%, E-value=4e-67, Identity=58%"; Hit description =Nitrate transporter (NTL1); 53025-56402
  Pfam annotation: Domain name=PTR2; Domain location=1-235; Score=-7.3; E_value=1.2e-05; Accession=PF00854.12; Description=POT family
MQGLIVLTAQARVPSLKPPACDAATPCNEVSGGKAAMLFAGLYLVALGVGGVKGSLPSHGAEQFDDNTPSGRRQRSTFFNYFVFCLSCGALIAVTFVVWVEDNKGWEWGFGISTIAIFVSIPVFLAGSTTYRSKIPSGSPLTTILKVLVAASLNSCFNSRNSSSAVVNMTSSPSNPHSGSRKQQAGKEASNTTNKEPEALTNTLKFLNKAADQNNNKPIYSSIECTVEQVGGCEDSA

SEQ ID NO: 204364 - protein, 118 aa, Glycine max
  Coding DNA Sequence Number=SeqID_87586
  Gene Ontology: Mol. function=transporter activity; Cellular component= membrane; Biological process=oligopeptide transport
  Homolog annotation: Hit_ID=Q9CAR8; Match level="QueryCoverage=96%, HitCoverage=19%, E-value=2e-31, Identity=59%"; Hit description =Nitrate transporter (NTL1); 53025-56402
MELEQNQRSWEGYVNWRNKPALRGRHGGMLAASFVLVVEILENLAFLANASNLVLYLRQYMHMSPSKSANNVTNFMGTAFLLALLGGFLSDAFFTTYHIYLISAVIEFLPTYLISLDF

SEQ ID NO: 204365 - protein, 153 aa, Glycine max
  Coding DNA Sequence Number=SeqID_87587
TIRGARRTRTRPAEAPSTSIAPPPACTLAAPSAPASANFQHLEAMLQSIHQGQIILLQSLQMVAPPDSIPSVEQFNEWVAWPRTQSSLHREDEGPTAQVPQQMEDESSKTTTPEPLVRRKKADETQEAAATFEKSLEATSEPSEPVADTTSHQ

SEQ ID NO: 204366 - protein, 65 aa, Glycine max
  Coding DNA Sequence Number=SeqID_87588
MEQLIFDGRMNEWHFIAFVALWQLYLVNEVTTSGNHISSIQASNAKASFGIIMIACFLFLRHLVS

SEQ ID NO: 204367 - protein, 122 aa, Glycine max
  Coding DNA Sequence Number=SeqID_87589
MQNGDVWLFYQFLQNVVTFNQTGSVMPVPFSSGSTLMLFCEWGVFADLIEIDAGHDFLSAWADINRGFRILQPGGVIFGHDYFTAADNRGVRRAVDLFAKVNNLKEGKTCGLFVIHCPFSGQ

SEQ ID NO: 204368 - protein, 123 aa, Glycine max
  Coding DNA Sequence Number=SeqID_87590
  Subcellular localization annotation: CTP_CleavageSite=77; ConfidenceScore=5.38e-01
MCIADAPRNVPTSTTVRGRTRRMRFSKTLPVEPHPLTLVVRRSFAAACGGGKFSNGEVPLKRRSTSVRRTDSGGIGSAQRVVTRNGFTSVVLIENRIIGSNDDGDGDDDGESGNEVEEGWWDK

SEQ ID NO: 204369 - protein, 53 aa, Glycine max
  Coding DNA Sequence Number=SeqID_87591
MQRYWAPRAREMKAKGAVTHGDHRRLHFHHQPLLKDPSTFTLEVWGGDGAKRY

SEQ ID NO: 204370 - protein, 460 aa, Glycine max
  Coding DNA Sequence Number=SeqID_87592
  Gene Ontology: Mol. function=transcription regulator activity; Cellular component=nucleus; Biological process=regulation of transcription
  Homolog annotation: Hit_ID=Q9LUK7; Match level="QueryCoverage=90%, HitCoverage=89%, E-value=5e-55, Identity=32%"; Hit description=BHLH transcription factor
  Pfam annotation: Domain name=HLH; Domain location=283-332; Score =48.1; E_value=3e-11; Accession=PF00010.16; Description=Helix-loop -helix DNA-binding domain
MEDLIISPSSSSSLVSLPHENPTPTPTLLQKLQFLLQSQPDWWVYAIFWQASHDDNGNLYLSFGEGHFQGTKETSPKSLTIPTKKFMRAPTNDTNNINDAEWFYVVSLTRTFAVNNNASSSSSSLPGKSFALGSVLWLNNMHELQFYNCERSNEAQVHGIETLICIPTQNGVVEMGSYDTIKQNWNLVQHVKSLFITPPDPVPVEILDDHTISFADIGIVAGVQETKKRRINQTQTQKPPRKNDNYVNSEHSDSDCPTLPTATTPTTSEPKKRGRKPILGRETPVNHVEAERQRREKLNHRFYALRAVVPNVSRMDKASLLSDAVAYISELKAKIEYLESQQPRDSSKKVKTEMTDTLDNHSTTTISTVVDQSGPEPRLGPSPLGLEVDVKIVGPDAMVRVQSENVNHPGARLMGALRDLEFQVHHASMSCVNDLMLQDVVVKLPNGMRSEEGLKSAILM

SEQ ID NO: 204371 - protein, 137 aa, Glycine max
  Coding DNA Sequence Number=SeqID_87593
  Gene Ontology: Mol. function=protein serine/threonine kinase activity; Cellular component=calcium- and calmodulin-dependent protein kinase complex; Biological process=protein amino acid phosphorylation
  Homolog annotation: Hit_ID=Q1SHH6; Match level="QueryCoverage=86%, HitCoverage=28%, E-value=1e-58, Identity=92%"; Hit description =Protein kinase; Calcium-binding EF-hand
  Pfam annotation: Domain name=Pkinase; Domain location=2-136; Score= -25.3; E_value=4.7e-07; Accession=PF00069.15; Description=Protein kinase domain
  Pfam annotation: Domain name=Pkinase_Tyr; Domain location=1-136; Score=-137.3; E_value=0.00048; Accession=PF07714.7; Description =Protein tyrosine kinase
  Pfam module annotation: Pfam domain module=Pkinase::Pkinase_Tyr; Domain location=2-136::1-136
MTTAIAIEDVRREVKILKALSGHKHLVKFHDAFEDANNVYIVMELCEGGELLDRILSRGGKYSEEDAKVIVLQILSVVAFCHLQGVVHRDLKPENFLYTSRSEDADMKLIDFGLSDFIRPASGVVCLVAHRMEIWLK

SEQ ID NO: 204372 - protein, 104 aa, Glycine max
  Coding DNA Sequence Number=SeqID_87594
  Subcellular localization annotation: CTP_CleavageSite=46; ConfidenceScore=5.19e-01
GENNTFANLPSLPVSQPTLLRASEARLTGASSKGGKCADSSPTFICGKHRKNRRKMVMKNILDSGVVFTFEEGINTSHVDISGALAPTYPPSKRKSDLRSSFLR

SEQ ID NO: 204373 - protein, 67 aa, Glycine max
  Coding DNA Sequence Number=SeqID_87595
VPPLLLAGWEGIGEREVSRPWSWRDRRERGCPALGAGGTGERVLQGGTASGGCGTGGERIPPLGSTG

SEQ ID NO: 204374 - protein, 60 aa, Glycine max
  Coding DNA Sequence Number=SeqID_87596
MEKTQERKSGRSINGKNPGKQRMNNVQNILREGKIRRGLRIVEHSMEYGKIGGGESSESL

SEQ ID NO: 204375 - protein, 86 aa, Glycine max
  Coding DNA Sequence Number=SeqID_87597
RKHRDNEKILSLWFNDQAAKIMKGVFVLSSRIDKPFCKYDGFTTRKCVAKVYINIVDLSLVESVRIPYMKNLPPYYILDACGSVCI

SEQ ID NO: 204376 - protein, 72 aa, Glycine max
  Coding DNA Sequence Number=SeqID_87598
MSRHNFQEKKQYTAKCILRKNLAGSSARRIESLRKKVPQVLPREENGAGGIRYSSLGSYGRRCSSASSCGRK

SEQ ID NO: 204377 - protein, 172 aa, Glycine max
  Coding DNA Sequence Number=SeqID_87599
MSKIEDEELLTSTMPTWRENTTLKMPGLLNTNEHHDRRTKTPSVEEEDDAHGGSAARRTSMVGQAFLKPTTTSHKQNERKKNTAKVRSGVRKETKTTSRQQEEEKMLGGLHDGLKIIISPFITKTKPPKTMLSSEVNLVNRGVWIDKDIASQRSLLRKLLKEATRKLLEEAS

SEQ ID NO: 204378 - protein, 46 aa, Glycine max
  Coding DNA Sequence Number=SeqID_87600
MQRGVACARQGDLDTCCLIFLSESVMWTRLGYFQINGTTLYFRVKS

SEQ ID NO: 204379 - protein, 66 aa, Glycine max
  Coding DNA Sequence Number=SeqID_87601
  Subcellular localization annotation: CTP_CleavageSite=60; ConfidenceScore=5.44e-01
MVSFQLLPAYAILRTAITTAMTTPQSARRRATRPQECRRALPRKDQPPAVNAAGKRVPCVSSVGWG

SEQ ID NO: 204380 - protein, 454 aa, Glycine max
  Coding DNA Sequence Number=SeqID_87602
  Gene Ontology: Biological process=DNA packaging
  Homolog annotation: Hit_ID=O64317; Match level="QueryCoverage=49%, HitCoverage=34%, E-value=2e-75, Identity=62%"; Hit description=Gp2
  Pfam annotation: Domain name=Phage_portal_2; Domain location=277-454; Score=18.2; E_value=2.3e-09; Accession=PF05136.4; Description=Phage portal protein, lambda family
  Pfam annotation: Domain name=Terminase_GpA; Domain location=1-200; Score=-281.1; E_value=0.0032; Accession=PF05876.3; Description=Phage terminase large subunit (GpA)
  Pfam module annotation: Pfam domain module=Phage_portal_2::Terminase _GpA; Domain location=277-454::1-200
LDRYEMRVWGWAPGEEAFLIDRVIIMGRHDEEETLLRVDEAINKQYQLADGTIMTIGRVCWDSGGIDPAIVYNRSKRLGLFRVIPIKGASVYGKPVANMPRKKNSHGVFLTEIGTDVAKEVIYSRYKLERSADGSPVPGLIHYPNNPAVFDLAEAEQMTAEELIEKYEKGKIKLLWDAKKRRNEALDSANNHRPASRPEIIMTWPLWRLNWEDNVATLAQLEEARKALHELLTGSTGVSQSASRSGEVRGMNKNQTLLGPDGTTPLREYAGYTGGGVGFGGQIAGWQPSSQSVDAALLPQFERGNARADDLVRNNGYAANGVQLHQDHIVGSFFRLSYRPNWRYLGIAEEESRAFSDEIEAAWREYAEDPDCCLDVERKRTFTMMIREGVAMHAFNGEVFTQPCWDRAPHRLFRTQFKMVSPKRIRNAPGVLDSQTQRAGVSLDKYGAAIGYNV

SEQ ID NO: 204381 - protein, 94 aa, Glycine max; identical to SEQ ID NO: 150943
  Coding DNA Sequence Number=SeqID_87603

SEQ ID NO: 204382 - protein, 105 aa, Glycine max
  Coding DNA Sequence Number=SeqID_87604
MELTSQCHTKNTKAEKNSYQKWRCVHFWKKKAFIRKKEARGIFAIYKFCWVHLAPLFIFSYTLKTHWAGLEYALLGVIGDIGENRIFTGQRDVYGNLKVSDRVQD

SEQ ID NO: 204383 - protein, 195 aa, Glycine max
  Coding DNA Sequence Number=SeqID_87605
  Homolog annotation: Hit_ID=Q69TU8; Match level="QueryCoverage=51%, HitCoverage=23%, E-value=8e-23, Identity=55%"; Hit description=Sac domain-containing inositol phosphatase-like
  Pfam annotation: Domain name=Syja_N; Domain location=1-178; Score= -107.6; E_value=5.8e-05; Accession=PF02383.9; Description=SacI homology domain
MASFSLHENAPPVILMIHAGAISHAHVGSASVLVGDIDDALDSEKRYLKRGVNDRGRVANDVETEQIVLDEESGSCKGKMSSVVQMRGSIPLFWSQEASRFSPKPDIIFLGAVASEVLDLTGFYCSGKPNIIKRANKSNQTSTGRDTSMRDLRASSVDLVRIGNSNEMLNSVVNQDKETDMNLNIAPSLSKKRVF

SEQ ID NO: 204384 - protein, 132 aa, Glycine max
  Coding DNA Sequence Number=SeqID_87606
MTQNFVCKLLDRSHGAVWTTTAPPSGPLTLISTGQDNYKVDANSKGRSHRLFREIIISDSIPNDKDEECLSLPTIQWETLASNLEDFSKVAEKFAISKSTVEVADSMKLQDDAIPTLEKLRKGTPSSLVVIF

SEQ ID NO: 204385 - protein, 127 aa, Glycine max
  Coding DNA Sequence Number=SeqID_87607
MSRVCVGAVLINRYITVASRLFSRKSRVAEVVETLQYMVSPQGRNTWTGDDLVPYVEKITILSEEQERIIEPVSHGPASERQFPAQQFHILQSSVETQGIDRRREAVEAEEYSQQMAERGHGMYYMP

SEQ ID NO: 204386 - protein, 69 aa, Glycine max
  Coding DNA Sequence Number=SeqID_87608
  Subcellular localization annotation: CTP_CleavageSite=36; ConfidenceScore=5.21e-01
MFNPPENPSRSASVSLPRCFHGRFRKGFPPFFIVLRSSTVLKELHRPDFLITIEEYVGARETPLSTTKR

SEQ ID NO: 204387 - protein, 124 aa, Glycine max
  Coding DNA Sequence Number=SeqID_87609
MYTERRLALSTVIFQSNSTGGTTRPVKDRSASPAEGTSRPVHTGGGPIDPTQAGITAAAGTRLALQWILVKGFRLYSFQLPDSMSPVLLFIVTTSPCQDWVICAPAAFLGCGSRFSGSLSGIEP

SEQ ID NO: 204388 - protein, 185 aa, Glycine max
  Coding DNA Sequence Number=SeqID_87610
  Gene Ontology: Mol. function=calcium ion binding; Cellular component =mitochondrion; Biological process=protein amino acid phosphorylation
  Homolog annotation: Hit_ID=Q1RSC6; Match level="QueryCoverage=84%, HitCoverage=61%, E-value=3e-52, Identity=48%"; Hit description =Pentatricopeptide repeat
  Pfam annotation: Domain name=PPR; Domain location=125-159; Score =17.3; E_value=0.057; Accession=PF01535.11; Description=PPR repeat
  Pfam annotation: Domain name=PPR; Domain location=55-89; Score=2.6; E_ value=3.7; Accession=PF01535.11; Description=PPR repeat
  Pfam annotation: Domain name=PPR; Domain location=90-124; Score=28.9; E_value=1.8e-05; Accession=PF01535.11; Description=PPR repeat
  Pfam module annotation: Pfam domain module=PPR::PPR::PPR; Domain location=125-159::55-89::90-124
MSLSFSLSRRLSSFLPNPIFPLCFHSQPPSIDNVVDDAVSQFNRMLLMRHTPPIIKFNKILGSPVKMKYYPAAISLSKQMEVKGIEPNLVTLNILINCFCHLGHMAFSFSVLGKILKLGYQPNTLTLTTLIKGLCLKDEVRKSLHFHDKLVAQGFQINHVSCGTLLNGLCKIGEMRGANEVAEGD

SEQ ID NO: 204389 - protein, 589 aa, Glycine max
  Coding DNA Sequence Number=SeqID_87611
  Gene Ontology: Mol. function=protein serine/threonine kinase activity; Cellular component=mitochondrion; Biological process =protein amino acid phosphorylation
  Homolog annotation: Hit_ID=Q1SMD3; Match level="QueryCoverage=86%, HitCoverage=92%, E-value=1e-179, Identity=38%"; Hit description=TonB box, N-terminal; Tetratricopeptide-like helical
  Pfam annotation: Domain name=PPR; Domain location=101-135; Score =26.8; E_value=7.8e-05; Accession=PF01535.11; Description=PPR repeat
  Pfam annotation: Domain name=PPR; Domain location=136-170; Score =19.5; E_value=0.012; Accession=PF01535.11; Description=PPR repeat
  Pfam annotation: Domain name=PPR; Domain location=171-205; Score =36.1; E_value=1.2e-07; Accession=PF01535.11; Description=PPR repeat
  Pfam annotation: Domain name=PPR; Domain location=206-240; Score =42.9; E_value=1.1e-09; Accession=PF01535.11; Description=PPR repeat
  Pfam annotation: Domain name=PPR; Domain location=241-275; Score =40.4; E_value=6.1e-09; Accession=PF01535.11; Description=PPR repeat
  Pfam annotation: Domain name=PPR; Domain location=276-310; Score =45.4; E_value=2e-10; Accession=PF01535.11; Description=PPR repeat
  Pfam annotation: Domain name=PPR; Domain location=311-345; Score =35.7; E_value=1.6e-07; Accession=PF01535.11; Description=PPR repeat
  Pfam annotation: Domain name=PPR; Domain location=346-380; Score =47.3; E_value=5e-11; Accession=PF01535.11; Description=PPR repeat
  Pfam annotation: Domain name=PPR; Domain location=381-415; Score =44.2; E_value=4.4e-10; Accession=PF01535.11; Description=PPR repeat
  Pfam annotation: Domain name=PPR; Domain location=416-450; Score =51.2; E_value=3.5e-12; Accession=PF01535.11; Description=PPR repeat
  Pfam annotation: Domain name=PPR; Domain location=451-485; Score =39.8; E_value=9.4e-09; Accession=PF01535.11; Description=PPR repeat
  Pfam annotation: Domain name=PPR; Domain location=486-520; Score =53.2; E_value=8.4e-13; Accession=PF01535.11; Description=PPR repeat
  Pfam annotation: Domain name=PPR; Domain location=521-555; Score =23.7; E_value=0.00065; Accession=PF01535.11; Description=PPR repeat
  Pfam annotation: Domain name=PPR; Domain location=66-100; Score=3.0; E_value=3.3; Accession=PF01535.11; Description=PPR repeat
  Pfam module annotation: Pfam domain module=PPR::PPR::PPR::PPR::PPR::PP R::PPR::PPR::PPR::PPR::PPR::PPR::PPR::PPR; Domain location=101 -135::136-170::171-205::206-240::241-275::276-310::311-345::346 -380::381-415::416-450::...
  Pfam module annotation: Domain location=451-485::486-520::521-555::66- 100
  Subcellular localization annotation: CTP_CleavageSite=46; ConfidenceScore=5.69e-01
MSFSFSLSRRLSSSPSLSIPTFPPSLPNPTFTLCFHSQPPSIENVVDDAVSQFNRMLLVRRTPPIIEFGKILGYLVKMEHYPTAIPLFRQMEVKGIEPNLVTLSILINCFCHLGQMAFSFSVLAKILKLGYQPDTITLTTLLKGLCLKGEVKKSLHFHDKVVAQGFQMNQVSYGILLNGLCKIGETRCAIKLLRKIEDRSIRPDVVMYSTIIDSLCKDKLVNEAYDFYSEMDARGIFPDVITYTTLICGFCLASQLMGAFSLLNEMILKNINPDVHTFSILIDALCKEGKVKEAKNLLAVMMKEGVKPNVVTYNTLMDGYCLVGEVQNTKQILHAMVQTGVNPNVRSYTIMINGLCKSKRMDEAMNLLREMLYKDMIPDTVTYSSLIDGFCKSGRITSALNLLKEMHHRGQPADVVTYNSLLDGLCKNQNLEKATALFMKMKERGIQPNKYTYTALIDGLCKGGRLKNAQKLFQNLLVKGCRINVWTYNVMISGLCKEGMFDEALAMKSKMEENGCIPDAVTFEIIIRSLFVKDQNDKAEKLLHEMIAKGLLPFRDFHGERSPVTNKVIVNFHEKEDLKPTAYLFASSE

SEQ ID NO: 204390 - protein, 552 aa, Glycine max
  Coding DNA Sequence Number=SeqID_87612
  Gene Ontology: Mol. function=calcium ion binding; Cellular component =mitochondrion; Biological process=protein amino acid phosphorylation
  Homolog annotation: Hit_ID=Q1SMD3; Match level="QueryCoverage=91%, HitCoverage=92%, E-value=0.0, Identity=50%"; Hit description=TonB box, N-terminal; Tetratricopeptide-like helical
  Pfam annotation: Domain name=PPR; Domain location=101-135; Score =30.4; E_value=6.2e-06; Accession=PF01535.11; Description=PPR repeat
  Pfam annotation: Domain name=PPR; Domain location=136-170; Score =20.1; E_value=0.0078; Accession=PF01535.11; Description=PPR repeat
  Pfam annotation: Domain name=PPR; Domain location=171-205; Score =32.4; E_value=1.6e-06; Accession=PF01535.11; Description=PPR repeat
  Pfam annotation: Domain name=PPR; Domain location=206-240; Score =38.1; E_value=3e-08; Accession=PF01535.11; Description=PPR repeat
  Pfam annotation: Domain name=PPR; Domain location=241-275; Score =43.0; E_value=9.9e-10; Accession=PF01535.11; Description=PPR repeat
  Pfam annotation: Domain name=PPR; Domain location=276-310; Score =49.3; E_value=1.3e-11; Accession=PF01535.11; Description=PPR repeat
  Pfam annotation: Domain name=PPR; Domain location=311-345; Score =43.8; E_value=6e-10; Accession=PF01535.11; Description=PPR repeat
  Pfam annotation: Domain name=PPR; Domain location=346-380; Score =43.9; E_value=5.5e-10; Accession=PF01535.11; Description=PPR repeat
  Pfam annotation: Domain name=PPR; Domain location=381-415; Score =41.5; E_value=2.8e-09; Accession=PF01535.11; Description=PPR repeat
  Pfam annotation: Domain name=PPR; Domain location=416-450; Score =45.4; E_value=2e-10; Accession=PF01535.11; Description=PPR repeat
  Pfam annotation: Domain name=PPR; Domain location=451-485; Score =39.6; E_value=1.1e-08; Accession=PF01535.11; Description=PPR repeat
  Pfam annotation: Domain name=PPR; Domain location=486-520; Score =50.6; E_value=5.2e-12; Accession=PF01535.11; Description=PPR repeat
  Pfam annotation: Domain name=PPR; Domain location=66-100; Score=3.4; E_value=2.9; Accession=PF01535.11; Description=PPR repeat
  Pfam module annotation: Pfam domain module=PPR::PPR::PPR::PPR::PPR::PP R::PPR::PPR::PPR::PPR::PPR::PPR::PPR; Domain location=101-135::136 -170::171-205::206-240::241-275::276-310::311-345::346-380::381 -415::416-450::451-485::486-520::66-100
  Subcellular localization annotation: CTP_CleavageSite=46; ConfidenceScore=5.58e-01
MSFSFSLSRRLSSSPSLSIPNFPPFLPNPTFPLCFHSQPPSIENVVDDTVSQFNRLLLVRHTPPIIEFGKILGYLVKMKHYPTAISLSRQMEVKGIEPNLVTLNILINCFCHLGQMAFSFSVLGKILKLGYQPDTITLNTLMKGLCLKGEVKRSLHFHDKVVAQGFQMNQVSYGTLLNGLCKIGETRCAVKLLRMIEDRSTRPDVVMYSTIIDGLCKDKIVNQAYDFFSEMNARGIFPNVITYSTLIWGFCLAGQLMGAFSLLNEMILKNINPNVYTYNILIDALCKEGKVKEAKKLLAVMMKEGVKLDVVSYNTLMDGYCLVGEVQNAKEIFQIMVQTGVNPNVCSSNIMINGLCKSKRVDEAMNLLREMLHKNMVPDTLTYNSLIDGLCKSGKITFALDLMKEMHHKGQPADVVTYNSVLDGLCKSQNLDKATALFMKMKKWGIQPNKYTYTALIDGLCKGGRLKNAQKLFQHLLVKGCCIDVRTYNVMISGLCKEGMFDKALAMKSKMEDNGCIPNAVTFDIIIRSLFEKDENDKAEKLLHGMIAKGLL

SEQ ID NO: 204391 - protein, 840 aa, Glycine max
  Coding DNA Sequence Number=SeqID_87613
  Homolog annotation: Hit_ID=Q7XDI4; Match level="QueryCoverage=99%, HitCoverage=83%, E-value=0.0, Identity=45%"; Hit description =Expressed protein
  Pfam annotation: Domain name=DUF810; Domain location=1-840; Score =1102.8; E_value=0; Accession=PF05664.2; Description=Protein of unknown function (DUF810)
MENGVISVLGRQAETIILPLELLRHLKPSEFNDSHEYHLWQKRQLKFLEVGLLLHPSIPIQKTNTFAMNLKEIIRSAEFKPLDTGKNSDTMRTFSNSVASLSMRSPDDTPTNVCHWANGYPVNIHLYISLLQSIFDLRDETSVLDEVDEQLGLIKKTWSTLGINRPIHNVCFTWVMFQQYVETGQIEPDLLCASHTLLNEVANDAKKERESLYIEILKSVLSSLQEWADKRFLNYHEYFQGGDIGQIENLLPVVLLASKILGDVTNSEERQEKGEKTRANSSEGRIDDYICSSLKNAFEKMMEAANAKSAESETKKEIGEVMLQLAQETEYLALKERQNYSPILKKWNTIAGAVAALTLNNCYGHLLKQYLSEMTTSITVEVVLVLQRAKILEDVLVQMVVEDSADCEDGGKTVVREMVPFEVESTIMIRIRKWIDESLHKGKECLQRAKESEAWNPKSKSEPYAKSAVELMNLAKKIVQEFFQIPIPITEVLVQELADGLQKIFREYTMFVAACGLKENYIPSLPPLTRCNRNSKFHKLWKIASPCSVSCEDPHIYGIYEANHPHSCTSRGTQRLYIRLNTLHYLLSHIPSLDKSLSLTPGVVPSNRHCFTSSDKTHSNRTSYFETTNTTILAACQHVSEVASYRLTFFDTNPFFYDSLYVGDVANARISQLLTILKHNIKLMTAILTERAQAPAAKEVMKASFDAFLTVLLAGGTTRVFNESDHESIREDFDSLKQLFCSFGEELIAETEVEKAAEIVEGVMALMGMSTEQLMENLSTLSNETSGIGVIGNAQKLPMPPTTGKWNRADPNTILRVLCYRNDRTASNFLKRTFQIAKRR

SEQ ID NO: 204392 - protein, 141 aa, Glycine max
  Coding DNA Sequence Number=SeqID_87614
  Homolog annotation: Hit_ID=O22159; Match level="QueryCoverage=92%, HitCoverage=24%, E-value=4e-18, Identity=38%"; Hit description =Expressed protein
  Pfam annotation: Domain name=DUF247; Domain location=2-141; Score= -176.9; E_value=0.028; Accession=PF03140.6; Description=Plant protein of unknown function
GVWTRPILNITENSEMFFRNILAFEECHLSDDTNIITQYLVILDFVINTEKDVNVLVDNKIIVNWMGDANKVATMVNNLDSNLAMPDFNSHYYSLCNSLNEFYENPRNKYKARFRLFINEYFDAPWTIASTVAAVVLLLLT

SEQ ID NO: 204393 - protein, 392 aa, Glycine max
  Coding DNA Sequence Number=SeqID_87615
  Homolog annotation: Hit_ID=O22159; Match level="QueryCoverage=92%, HitCoverage=74%, E-value=7e-41, Identity=31%"; Hit description =Expressed protein
  Pfam annotation: Domain name=DUF247; Domain location=32-392; Score =253.1; E_value=5.9e-73; Accession=PF03140.6; Description=Plant protein of unknown function
MEGQISDSLSKQQCLKTTLTNELQNVQPPEMYAFDMQCIYRVPPVIRETNPKAYTPQIVSIGPLHKARDAGKEDIIFESMEELKVKYLKAFLNRTQIPMGTFVVTLQALEDKIRSCYAVRIKYNSDDFLKMILIDGCFIIELFLRLYRYNYWRGKDPVLLKDWMRMQIKSDLILLENQLPFFVLKQLYNLAGMNQEFPSFLHISFNCLKRVGCGTWCPTESPKHFTDLMRTSIISSSKFVLRKEEECKVIKHVYSAGQLREAGLKFKVSPNENECLLDLTYSSDGVLTMPILNIADDSEVFFRNIVAFEECHLSDDTNIITQYRKILDFLINTEKDVNVLVDKKIIVNWMGDANAVATMVNSLGSNIGMPRFNPVYFSLCNSLNDFYESPCN

SEQ ID NO: 204394 - protein, 62 aa, Glycine max
  Coding DNA Sequence Number=SeqID_87616
MENIAGGQGKSKRATVKVRARCSFLGENVSTSTIYLAVTGLNIDQILTEVDKFKILSPVTKA

SEQ ID NO: 204395 - protein, 961 aa, Glycine max
  Coding DNA Sequence Number=SeqID_87617
  Gene Ontology: Mol. function=DNA binding; Cellular component=beta -galactosidase complex; Biological process=DNA integration
  Homolog annotation: Hit_ID=Q1SDN3; Match level="QueryCoverage=88%, HitCoverage=95%, E-value=1e-167, Identity=47%"; Hit description =Polynucleotidyl transferase, Ribonuclease H fold
  Pfam annotation: Domain name=zf-CCHC; Domain location=322-339; Score =11.2; E_value=0.014; Accession=PF00098.13; Description=Zinc knuckle
  Pfam annotation: Domain name=zf-CCHC; Domain location=358-375; Score =10.9; E_value=0.016; Accession=PF00098.13; Description=Zinc knuckle
  Pfam module annotation: Pfam domain module=RVT_2::zf-CCHC::zf-CCHC; Domain location=478-733::322-339::358-375
MARPLVMIHPLPNNYSHIGFTLVSLMVCAIALLTCASHSQKWHQWISCYAFAEEPVIEFNNEAVMSTCDDEQEEDGSLWQKNILMGGKCQLPDFSAAFNNVESYLYLHPSENPAAALVSPVLDSTNYHSWSRSMITALSAKNKLEFVDGSAPEPLKTDRTYVAASIRQSVLWMDKAEDIWRDLKSRYSQGDLLRISDLQQEASTLKQGALSVTKYFTKLRVIWDEIENFRPDPACTCNSRCSCSAFAIIAQRKLEDRAMQFLRGLNEQYTNIRSHVLLMDPIPAISKIFSYVAQQERQLLGNSSSPNFNFESKEISINATKSICDYCGRMGHTESVCYKKHGMPPNHEMRNKGNGGRKTCTHCGRIGHTVDVCYRKHGYPPGYKPFNGRSTVNNMVTMDNKTMDNQTQHHESQDLVQFSPEQYKALLALIQRPSIGNTASEQTKQVASMSSCTTDKLPNPVEPSSYAEASQHDCWLKAMKAELQALQLNETWQLTPLPPHKTAIGCRWVYKVKHKADGSIERYKARLVAKGYTQMEGLDYLDTFSPVAKLTTVRLLLAVAAMNHWHLRQLDVNNAFLHGELEEEVYMQVPPGLTVTNPNLVCRLQRSLYGLKQASRQWFMKLSGFLTVHGFQQSHSDHSLFLRFNGSVTTILLVYVDDIILTGNSNTAIQEVLTLLDQAFKIKDLGNLKYFLGLEIARSSEGIHLSQRKYTLDILSDSGMLGCRPNTTPMDSSTKLHATTGTPLSAEASSSYRRLIGRLIYLNNTHPDIAYAVQQLSQYMSSPTNAHLQAAYRILRYLKGTPGSDIFFSATGTPQLRAFSDSDWAGCQDSRRSTTGFVVYFGSSLISWQSKKQSTVSRSSSEAEYRALASTTCELQWLTYLLHDFRMTFVEPATIYCDNHSAIRIATNPVFHERTKHIEIDCHVVRQQVTSGHLKLLPVSSSLQLADIFTKALPSTIFQAS

SEQ ID NO: 204396 - protein, 370 aa, Glycine max
  Coding DNA Sequence Number=SeqID_87618
  Gene Ontology: Mol. function=inositol or phosphatidylinositol phosphatase activity; Biological process=abscisic acid mediated signaling
  Homolog annotation: Hit_ID=Q84MA2; Match level="QueryCoverage=90%, HitCoverage=50%, E-value=6e-61, Identity=41%"; Hit description=Type I inositol-1,4,5-trisphosphate 5-phosphatase 1
RGRQSQFADNRCNEDEASSESSEFLPKLRRQKSSTYRSQYINKNELRVCVGTWNVGGKLPPDDLDIDDWLGINEPADIYVLGLQEIVPLNPGNIFGAEDTRPVPKWENIIRETLNRVRPEMPKIKSFSDPPSPSKFKPSDDVPDIEEEILLESDSDIGEEVHPLDEENNICDGTFMGETVNTNLLASDAADIANTTLPVKTDLQRQFSFPKMFDRQKSFSENMDTSFAQQATKLTRMLSGSERVGLSWPEPPLHLLSQRVLDRPTSFKSLRSFKSSKSFKTYNSFKSIMDEMPGIVSLPEIDLEALIKRKRRSSYVRIVSKQMVGIFITIWVRRSLRKQIQNLKVSTVGVGVMGYIGNKSDHLTDIAVDY

SEQ ID NO: 204397 - protein, 115 aa, Glycine max
  Coding DNA Sequence Number=SeqID_87619
  Gene Ontology: Mol. function=inositol or phosphatidylinositol phosphatase activity; Cellular component=intracellular; Biological process=abscisic acid mediated signaling
  Homolog annotation: Hit_ID=Q84MA2; Match level="QueryCoverage=71%, HitCoverage=14%, E-value=7e-25, Identity=61%"; Hit description=Type I inositol-1,4,5-trisphosphate 5-phosphatase 1
MGKADTRLQKNTGQCLSQSRRIIWFGDLNYRINLSNVETKALISKKQWSKLVEKDQLMLELKNGVFGGWSEGVLNFPPTYKYEVNSDKYYGEDPKVGKRSPAWYAFILRFCFHVC

SEQ ID NO: 204398 - protein, 55 aa, Glycine max
  Coding DNA Sequence Number=SeqID_87620
MTLHHCSKWVPGITNKSEKNEDGVIEKIVKLSIHNSEGTKEFAVVDSGALTVQFS

SEQ ID NO: 204399 - protein, 238 aa, Glycine max
  Coding DNA Sequence Number=SeqID_87621
  Gene Ontology: Mol. function=RNA binding
  Homolog annotation: Hit_ID=Q5ZC75; Match level="QueryCoverage=51%, HitCoverage=27%, E-value=3e-26, Identity=51%"; Hit description=30S ribosomal protein S1-like
MEKEGSLLKDFFLATHVPFCSRNEEFVVDDRIQELETLELQDKPSLVPIKNESFSEIDVHSENDSTEEDVLAPFLKFFKGSNDSVVEEEEAGGVLEGSKERGNESENAEKFCAEYYEPKPGDFVVGVVVSGNENKLNVNVGSELPGTMLTKEVLPLYSKEMEHLLCDVNNAEESPTVQGKIGILKNDDAINGVPVPGGTVVEIGTILFAEVLGRTLAGRPLLSTRRLFRRIAWHRLRQ

SEQ ID NO: 204400 - protein, 847 aa, Glycine max
  Coding DNA Sequence Number=SeqID_87622
  Gene Ontology: Mol. function=glycerol-3-phosphate dehydrogenase activity; Cellular component=glycerol-3-phosphate dehydrogenase complex; Biological process=glycerol-3-phosphate metabolic process
  Homolog annotation: Hit_ID=Q8CWG4; Match level="QueryCoverage=56%, HitCoverage=93%, E-value=0.0, Identity=79%"; Hit description=Sn -glycerol-3-phosphate dehydrogenase
  Pfam annotation: Domain name=Phosphorylase; Domain location=1-368; Score=390.5; E_value=2.6e-114; Accession=PF00343.10; Description =Carbohydrate phosphorylase
MVQSLFADFARLFPNRFCNKTNGVTPRRWLALANPPLAAVLDDCIGQTWRTDLSQLSEIKANVDYPSFLQAVQRAKRQNKERLALYIAKTLNVVVNPDALFDVQIKRIHEYKRQLLNVLHVITLYNRLLDDPEIDRVPRVVIFAGKAASAYYAAKQIIRLINDVAKVINNDPRVHTQLKVVFIPNYGVSLAQIIIPAADLSEQISLAGTEASGTSNMKFALNGALTIGTLDGANVEMREHVGEENIFIFGNTAEQVEELRRNGYNPRQYYEQDPELHQALTQIATGVFSPEEPKRYGNLFDSLVNLGDHYQLLADYRSYVDTQDKVDEVYLNQDEWTRRAVLNIANMGYFSSDRTIQEYADEIWHIQPPGFHSRLLRFVQPHAELGAAPDGVGQLYDPLFLGQVAQFGFIQTVAEIFAQIGEAVGAGQDQLALATVGAGIAARQRFRQPAVGAAQFGRVAVAIAAEVTARQRGVFGPRRAAAWVVVGQFFHRVLGQLAVGGQLAAEDRQQRRLALFVVHVQRVIAGDRLRRIGFVVAQRTHAGVSPDDVVAAQLLLEVIVVHFQQISDFVLVDLHVLRIAFVLHVGGADDGELVIPRDHEHDAVVFVLQNVRLRLIVYARHHDVAAFDQADAVRRFQLQAVVEEVFHPRAGGVHQAFGAPGEGFAAVDIDRFHHPHAVFTPCAGHFGAGAHFAAAFFHFLRVQHHQASIVDPAVGIFETALQFRLQHRLWSKAQALAARQAGAFAQVIVQEQADTDHPGRAQVRLVRQAETHWERDVRRQLQQHFAFGQRFAHQTEFVVFQAKSCASSSSTDSPRPAASAAMPAPLMPPPITIKSLVSTSSSSRCSK

SEQ ID NO: 204401 - protein, 114 aa, Glycine max
  Coding DNA Sequence Number=SeqID_87623
MRIQGTNRLRILCLNTLEGTSIVAQVEGTSTWVVILRTREGTSLVDQFKWRVHPLGCSKRTREGTSLVDLWLVKDFTRVTEISRTVGCLGTGCRHRLLPNQYKSCVCLLLPYTL

SEQ ID NO: 204402 - protein, 326 aa, Glycine max
  Coding DNA Sequence Number=SeqID_87624
MASGKRKSIGSRPTAQYDTWRFRSLDAWNRYTNNVLGRNILPERKVELYHTEFDDFKTELERRNLHKCLTNLVDGSIDVALVKEFYANLYSSEGPSPKQARVRGHLVKIDVDSLNTFLETPVVLEEGETLPIYSRYCRLPSDPREIKATLCIPGRGFILNVEGHPGRILAQVWSVLSYSNLAATSHTSDLIMDRARLIFGLVSRMDMNIEALIFGQMTSIAQSNSSRLGFLALITTLCRARGVVSDSLTFEHLSPVINLAYFRKNCWNPDDLTVVIRGARRARPRPVDLPSTSAVPTPGSTSAAPSVQAQTDSQRFEAILQSIHQG

SEQ ID NO: 204403 - protein, 97 aa, Glycine max
  Coding DNA Sequence Number=SeqID_87625
  Subcellular localization annotation: CTP_CleavageSite=23; ConfidenceScore=5.04e-01
MWLRMPPDSWVTVTKSGVVNKSRAFAPTYPQFCDEDLRSTKFLLTVRLKIVSVFSSPKCEHALVKRQNFQLIRATYAFWMKNNVSIGEGEYADEIFS

SEQ ID NO: 204404 - protein, 141 aa, Glycine max
  Coding DNA Sequence Number=SeqID_87626
MADSMDDSSAIEETKVNSEFEEVLEAFNEMHEEAQRLAVLNNKLRSDLKLHNTKLASTQSELDKLRQENENLVSSYKATGCVCSSASLNMDDYKSWQIEFGKLKKDHYEERMKLQIELSYLKYLLRKMNKGKSDLSHLLSV

SEQ ID NO: 204405 - protein, 120 aa, Glycine max
  Coding DNA Sequence Number=SeqID_87627
MTLPLSNILPSDHNADLPLRKYQLVCAIVTYGSRPQDTQWTRRSPTGPWGFQLGLRAFVSPIGCSSPQQGIVPARHPVDPKKSNRVLGFLALITGLCQFYEAPVTPNKVIRPPINRAFIK

SEQ ID NO: 204406 - protein, 89 aa, Glycine max
  Coding DNA Sequence Number=SeqID_87628
MDGILISSVVLLADSRFTRPDMGFHPTKLNFVPSDADEAPLDVSICLHAFGIVGCGSFSGVKSGEREDPFHPGLFVGDAGGFQSPTREP

SEQ ID NO: 204407 - protein, 69 aa, Glycine max
  Coding DNA Sequence Number=SeqID_87629
MGEKSAMNRRFRESNLELEVWEEQIEGDEFQKATNPERSRRCTAQKVETAREEQSNRNTGFRNEEIHFR

SEQ ID NO: 204408 - protein, 81 aa, Glycine max
  Coding DNA Sequence Number=SeqID_87630
  Subcellular localization annotation: CTP_CleavageSite=34; ConfidenceScore=5.10e-01
GNQSSSSASMMVALNEGHEVISKESTTLKLSAVVAVRNSNDNKVFANEMVNNLLTFFMRLCNRLHQAMKPDVGKRKEPLMC

SEQ ID NO: 204409 - protein, 547 aa, Glycine max
  Coding DNA Sequence Number=SeqID_87631
  Homolog annotation: Hit_ID=Q5XWK4; Match level="QueryCoverage=61%, HitCoverage=91%, E-value=5e-63, Identity=41%"; Hit description =Expressed protein-like
  Pfam annotation: Domain name=DUF616; Domain location=183-477; Score =598.3; E_value=7e-177; Accession=PF04765.4; Description=Protein of unknown function (DUF616)
MSAPLGIGIRSGSYGSLDKQVHQNGTARKASKMLKEKEKERLFLWICKFAGRKKVGMLFLCLISAAVFIWVLYVGKAEDSQDGNTVSSINVNESVSASDSTSENSTTNAMGLTKRSVLPPPPAGYFLGYRLPPGHPCNSFTLPPPPADKKRTGPRPCPVCYLPVEEAIGLMPALPSPSPVLGNLTYVYEENLSRDGEFGGSDFGGYPTLKQRNDSFDIRESMSVHCGFVRGIKPGRNTGFDIDEADHFEMEQCNGVVVASAIFGNFDEINEPNNISDYSRKTVCFLMFVDEETEKYLISSGKLGISKKIGLWRIIVARNLPYPDARRTGKIPKLLLHRLVPNARYSIWLDGKLELVVDPYQILERYTPAEANKAAGKYENASIDFQIEFYKNEGLTPYTEAKLPLISDVPEGCVIVREHVPISNLFTCLWFNEVDRFTSRDQISFSTVRDKILSRVDFHFNMFLDCERRNFVVQKYHRDLLLRLAPPASPPPPSPPPPPPLPVLETSPEKGANSPIRRGPGRRGRDRRAGSRHHRKVVAGSREMEPS

SEQ ID NO: 204410 - protein, 67 aa, Glycine max
  Coding DNA Sequence Number=SeqID_87632
MTTKLGKGYGNVGGDCRLRWLKDYNGTVIRLDQRFGALWLWLELVAFSWFEVEVGTVGVMVMWWCPS

SEQ ID NO: 204411 - protein, 87 aa, Glycine max
  Coding DNA Sequence Number=SeqID_87633
  Subcellular localization annotation: CTP_CleavageSite=39; ConfidenceScore=5.12e-01
MDTNAWWSCLMVGGGSAAAFTTMRKKEVVKNGCKSHTVRGERGSRRRLGTEKRILNKGQRNMLSLTDLIRKHDKLDRLNDCKWWSVK

SEQ ID NO: 204412 - protein, 582 aa, Glycine max
  Coding DNA Sequence Number=SeqID_87634
  Gene Ontology: Mol. function=metal ion binding; Cellular component =intracellular; Biological process=metabolic process
  Homolog annotation: Hit_ID=Q2QWV0; Match level="QueryCoverage=98%, HitCoverage=98%, E-value=0.0, Identity=57%"; Hit description =Pentatricopeptide, putative, expressed
  Pfam annotation: Domain name=PPR; Domain location=175-209; Score =53.1; E_value=9.2e-13; Accession=PF01535.11; Description=PPR repeat
  Pfam annotation: Domain name=PPR; Domain location=210-244; Score =13.9; E_value=0.17; Accession=PF01535.11; Description=PPR repeat
  Pfam annotation: Domain name=PPR; Domain location=276-310; Score =51.1; E_value=3.7e-12; Accession=PF01535.11; Description=PPR repeat
  Pfam annotation: Domain name=PPR; Domain location=311-345; Score =20.1; E_value=0.008; Accession=PF01535.11; Description=PPR repeat
  Pfam annotation: Domain name=PPR; Domain location=347-381; Score=7.0; E_value=1.1; Accession=PF01535.11; Description=PPR repeat
  Pfam annotation: Domain name=PPR; Domain location=414-448; Score =10.0; E_value=0.49; Accession=PF01535.11; Description=PPR repeat
  Pfam annotation: Domain name=PPR; Domain location=74-108; Score=23.7; E_value=0.00067; Accession=PF01535.11; Description=PPR repeat
  Pfam module annotation: Pfam domain module=PPR::PPR::PPR::PPR::PPR::PP R::PPR; Domain location=175-209::210-244::276-310::311-345::347 -381::414-448::74-108
MDGKERKIKSAEYEAVVSAGPHLRRLQQAHAHLVVTGCHRSRALLTKLLTLSCAAGSIAYTRRLFRSVSDPDSFLFNSLIKASSKFGFSLDAVLFYRRMLLSRIVPSTYTFTSVIKACADLSLLCIGTLVHSHVFVSGYASDSFVQAALIAFYAKSCTPRVARKVFDEMPQRSIVAWNSMISGYEQNGLANEAVEVFNKMRESRVEPDSATFVSVLSACSQLGSLDFGCWLHDCIVGSGITMNVVLATSLVNMFSRCGDVGRARAVFYSMIEGNVVLWTAMISGYGMHGYGVEAMEVFHRMKARGVVPNSVTFVAVLSACAHAGLIDEGRSVFASMKQEYGVVPGVEHHVCMVDMFGRGGLLNEAYQFVKGLNSDELVPAVWTAMLGACKMHKNFDLGVEVAENLINAEPENPGHYVLLSNMYALAGRMDRVESVRNVMIQRGLKKQVGYSTIDVDNRSYLFSMGDKSHPETNEIYCFLDELIWRCKDAGYAPVPESAMHELEGEEREYALRYHSEKLAVAFGLMKTGDGVTLRIVKNLRICEDCHSAIKFISAVMNREIIVRDKLRFHHFREGSCSCSDYW

SEQ ID NO: 204413 - protein, 63 aa, Glycine max
  Coding DNA Sequence Number=SeqID_87635
MVAFLVLSRAHPPVALLGWNNGNGGNNDDGGGKSEVLWQWQWNGGGHSGGGCSGGDSVVMKEW

SEQ ID NO: 204414 - protein, 165 aa, Glycine max
  Coding DNA Sequence Number=SeqID_87636
MRVKENECREKKIYDWCVSREKNIDATWPKPSTSMNTSAMRLALTVSLTGGYNSTCSPTSAPINTSRAQMMFFEENDHRREGRVASSKMRFQNLLVTIFKLFIATEIDIDGFMANKKEVISTSAVFHHCRCCACAIARCIAPYMVDMSNLDDLEKKTIDLAKVIT

SEQ ID NO: 204415 - protein, 214 aa, Glycine max
  Coding DNA Sequence Number=SeqID_87637
  Homolog annotation: Hit_ID=Q851M5; Match level="QueryCoverage=56%, HitCoverage=46%, E-value=2e-20, Identity=44%"; Hit description =Myosin-like protein
MSATKSASRKRASESERAKSDKNKRSAPDNFDLDLDFDLSEFVFAAFAFSFIFFGIVLTVSYIARICSDIKGIVSALHLIRDKAQKDGQKKNEETISSVGSEVKSMIEGLRSKIEKDRQSFAKALSKSSKEEGICVLFKTGLIIAVTASMQYESSLKNETAKFQALHENFCKEKASSLQALKGILPVTLSSGGLISFMSVILLGLMILLTVSEN

SEQ ID NO: 204416 - protein, 137 aa, Glycine max
  Coding DNA Sequence Number=SeqID_87638
  Gene Ontology: Mol. function=nucleoside-triphosphatase activity; Cellular component=endoplasmic reticulum; Biological process=ER to Golgi vesicle-mediated transport
  Homolog annotation: Hit_ID=Q40495; Match level="QueryCoverage=82%, HitCoverage=15%, E-value=7e-38, Identity=68%"; Hit description=N -ethylmaleimide sensitive fusion protein
  Pfam annotation: Domain name=CDC48_2; Domain location=32-107; Score =23.5; E_value=0.00075; Accession=PF02933.7; Description=Cell division protein 48 (CDC48), dom
MSFNAGVSKFLPAIPCKFVPPEDFNLALLTLDLEFVKKGSKSEQIDAVLLAKQLRKRFMNQVMTVGQKVLFEYHGNNYSFTVSNAAVEGQEKSNSLERGMISDDTYIVFETSRDSGIKNQQRSGAIAIQRHYVGKPL

SEQ ID NO: 204417 - protein, 93 aa, Glycine max
  Coding DNA Sequence Number=SeqID_87639
MLQRQSSDEPSVYVALYGICDIFNLSLLISRISFVIAYGRQDVVLETLILDTFFIAFDMSSMDVDSTLSWAWEPQAVRALRKLYYKEGPIWFS

SEQ ID NO: 204418 - protein, 154 aa, Glycine max
  Coding DNA Sequence Number=SeqID_87640
MTVPFDFEPFVKVKRSFSIGVNVVSSFGYHKERDGSWVKKDALVQATEDRSPSPPPQRDDSSSFMHSILDRLDGLHTFVGERFDSLDSRIDAMDARFAGMDTRITKLEEDIVIIKKGEILEAMPSKIILMMPKNQESNKFQDSRIKRRLNQDKY

SEQ ID NO: 204419 - protein, 347 aa, Glycine max
  Coding DNA Sequence Number=SeqID_87641
  Gene Ontology: Mol. function=nucleoside-triphosphatase activity; Cellular component=endoplasmic reticulum; Biological process=ER to Golgi vesicle-mediated transport
  Homolog annotation: Hit_ID=Q40495; Match level="QueryCoverage=86%, HitCoverage=41%, E-value=1e-157, Identity=92%"; Hit description=N -ethylmaleimide sensitive fusion protein
  Pfam annotation: Domain name=AAA; Domain location=59-258; Score =284.5; E_value=2e-82; Accession=PF00004.19; Description=ATPase family associated with various cellular activities (AAA)
  Pfam annotation: Domain name=AAA_5; Domain location=59-202; Score= -10.0; E_value=0.01; Accession=PF07728.4; Description=ATPase family associated with various
  Pfam module annotation: Pfam domain module=AAA::AAA_5; Domain location=59-258::59-202
CHQREGATSNIFKQKEFNLQSLGIGGLSAEFADIFRRAFASRVFPPHVTSKLGIKHVKGMLLYGPPGTGKTLMARQIGKILNGKEPKIVNGPEVLSKFVGETEKNVRDLFADAEQDQRTRGDESDLHVIIFDEIDAICKSRGSTRDGTGVHDSIVNQLLTKIDGVESLNNVLLIGMTNRKDMLDEALLRPGRLEVQVEISLPDENGRLQILQIHTNKMKENSFLAADVNLQELAARTKNYSGAELEGVVKSAVSYALNRQLSLEDLTKPVEEENIKVTMDDFLNALHEVTSAFGASTDDLERCRHQPIDPEQLHIDKQGAWPELSLGQKTDQFPHAFFLHKEQAWAT

SEQ ID NO: 204420 - protein, 299 aa, Glycine max
  Coding DNA Sequence Number=SeqID_87642
  Gene Ontology: Mol. function=protein histidine kinase activity; Cellular component=integral to membrane; Biological process=two -component signal transduction system (phosphorelay)
  Homolog annotation: Hit_ID=Q6D5L1; Match level="QueryCoverage=96%, HitCoverage=48%, E-value=4e-90, Identity=62%"; Hit description =Nitrate/nitrite sensor kinase
  Pfam annotation: Domain name=HAMP; Domain location=155-225; Score =59.0; E_value=1.6e-14; Accession=PF00672.15; Description=HAMP domain
MKRLLAPLSIVNQVALLMLLSGILGVAGMGISAWMSQSIQGNAHAINKAGSLRMQSYRLLAQVPLDERHEALIRELERDENSPDLQRSVEQEGLTQPFDALRDYWQQTLQPRLRSAQRPADAAPQVAHFVQLLDKLVSDIDRQTERRLLMVTLVQAGFIALTLLLLIGTTCYLRRRLLHPWRQLVEMALAVGRGDFSRRFAQRGHQDEMASLGGALNTMSDELSATYSGLEQRVAEKTADLQQKNQVLSFLYRASRLLHASEPLCSRLTPLLNQLQTLTPLRAIQVRLYETTAGNRCCS

SEQ ID NO: 204421 - protein, 85 aa, Glycine max
  Coding DNA Sequence Number=SeqID_87643
MDFFSDESFECIQAFQNSNLIPFMSLKLPVYSELEKAFCRNLPFGGRATRGFTGASSMGGRCAESPPTFIRGKRQKNWKAMVYEL

SEQ ID NO: 204422 - protein, 129 aa, Glycine max
  Coding DNA Sequence Number=SeqID_87644
  Homolog annotation: Hit_ID=Q1SWQ8; Match level="QueryCoverage=43%, HitCoverage=20%, E-value=5e-07, Identity=42%"; Hit description =Nucleic acid-binding, OB-fold; TonB box, N-terminal
MLWLASLNVDYWLEVVFRQVSGKGRRVVFKLKDLSQQLLSCTLWDDYCLQFVKFLDDYKGDGPITVLLSHCRIKEAQGLQSWALRPGQVLNPMVKGVHSFQVLSNYHQKNHSLARLRQRLLLRLTPSLK

SEQ ID NO: 204423 - protein, 139 aa, Glycine max
  Coding DNA Sequence Number=SeqID_87645
  Gene Ontology: Mol. function=protein disulfide oxidoreductase activity; Cellular component=chloroplast; Biological process =glycerol ether metabolic process
  Homolog annotation: Hit_ID=Q6D1D1; Match level="QueryCoverage=99%, HitCoverage=100%, E-value=1e-63, Identity=77%"; Hit description =Thioredoxin 2
  Pfam annotation: Domain name=Redoxin; Domain location=33-139; Score= -11.3; E_value=0.029; Accession=PF08534.1; Description=Redoxin
  Pfam annotation: Domain name=Thioredoxin; Domain location=36-138; Score=118.9; E_value=1.5e-32; Accession=PF00085.10; Description =Thioredoxin
  Pfam module annotation: Pfam domain module=Redoxin::Thioredoxin; Domain location=33-139::36-138
MNTICASCQATNRVPEERLADGAKCGRCGDALFSGEVVNATAATLDKYLQDDLPVVVDFWAPWCGPCVNFAPVFKDVADERRGKVRFVKVNTEAEPALSTRFRIRSIPTIMLFKNGEMVDMLNGAMPKAPFNEWLDESL

SEQ ID NO: 204424 - protein, 338 aa, Glycine max
  Coding DNA Sequence Number=SeqID_87646
  Homolog annotation: Hit_ID=Q83K19; Match level="QueryCoverage=64%, HitCoverage=91%, E-value=2e-70, Identity=62%"; Hit description =Hypothetical protein yfiP
  Pfam annotation: Domain name=DTW; Domain location=27-219; Score =243.6; E_value=4.2e-70; Accession=PF03942.6; Description=DTW domain
MSENAVLRLRAQRLARATRPFLARGNRVLRCQRCLLPHKNCLCATLQPQQARSRFCLVMFDTEPMKPSNTGRLIADILPETQAFGWSRTEPDAALLAAVQTADYQPMVVFPGAYADADRQVLTTPPTGGKPPLFIMLDGTWTEARKMFRKSPWLDSFPVMSLNVATPSRYTLREAHAPVQHCTAEVAAALLEQAGDVPAAQALLQHFERFRQAYLAAGSQPDIDKSATGVKAFTIMPIPRAGANDEPTWTGSAVTTEINCGAGCVGKTGPRWLSDDAQSAGGRLWRSGVAGHAQIQGGQRRAGLAGCGHPALRPRSGDYLHPRQTQSGTFTAAGRKRL

SEQ ID NO: 204425 - protein, 106 aa, Glycine max
  Coding DNA Sequence Number=SeqID_87647
  Subcellular localization annotation: CTP_CleavageSite=46; ConfidenceScore=5.24e-01
MRRAVRSQIPVPAKAAVLLRARKRIVALVLAAPVIMKRAVVRAPPVAMMPGVRVVRVTIARAVAAAIGTIAASVIHRGAPCHVRQSPLKRMRVTKRPAASRLSTRN

SEQ ID NO: 204426 - protein, 433 aa, Glycine max
  Coding DNA Sequence Number=SeqID_87648
  Gene Ontology: Mol. function=transporter activity; Cellular component= integral to membrane; Biological process=transport
  Homolog annotation: Hit_ID=Q6D1C6; Match level="QueryCoverage=99%, HitCoverage=100%, E-value=1e-178, Identity=74%"; Hit description =Alpha-ketoglutarate permease
  Pfam annotation: Domain name=DUF368; Domain location=128-395; Score= -131.2; E_value=0.068; Accession=PF04018.4; Description=Domain of unknown function (DUF368)
  Pfam annotation: Domain name=MFS_1; Domain location=27-398; Score =76.2; E_value=1e-19; Accession=PF07690.6; Description=Major Facilitator Superfamily
  Pfam annotation: Domain name=PUCC; Domain location=66-432; Score= -228.7; E_value=0.058; Accession=PF03209.6; Description=PUCC protein
  Pfam annotation: Domain name=Sugar_tr; Domain location=22-433; Score =104.2; E_value=3.8e-28; Accession=PF00083.14; Description=Sugar (and other) transporter
  Pfam module annotation: Pfam domain module=DUF368::MFS_1::PUCC::Sugar_ tr; Domain location=128-395::27-398::66-432::22-433
MTDLQQNSAQPEAAAVSKQRIWAIVGASSGNLVEWFDFYVYSFFSLYFAHVFFPAGDTTTQLLQTAGVFSAGFLMRPIGGWLFGYIADRHGRKSSMLISVCMMCFGSLVIACLPGYGEIGIAAPVILLLARMFQGLSVGGEYGTSATYMSEVALEGRKGFYASFQYVTLIGGQLLAVLTVVVLQQILSDEALRSWGWRIPFFLGAVLAVVALWLRRSLNETSEKKHREHRDAGSILGLLRNHSRAFLMVLGFTAGGSLSFYTFTTYMQKYLVNTAGMDARSASALMTGALLVFMLIQPIVGALSDKIGRRASMMIFGAGAAICTVPILMLLQNVQSSGLAFVLVMLALIITSFYTAISGILKAEMFPPEVRALGVGLSYAVANAIFGGSAEYVALLLKKHGIETTFFWYVSAMGALAFLVSLMLHRKGKGIAL

SEQ ID NO: 204427 - protein, 123 aa, Glycine max
  Coding DNA Sequence Number=SeqID_87649
MLAYFLYNFRPLFHLKVLEILFSNSQLFSHADNALLQETPSELAKRRSGVGVGGHVELHVEAMLSKIILMMPKTQVKNQESSKFQESKICSIKACFKNQRVVQSKQVSRIKIKVKIQEKTQLR

SEQ ID NO: 204428 - protein, 163 aa, Glycine max
  Coding DNA Sequence Number=SeqID_87650
MVIDQSLFYDLTQLSSDGIPFKGTLNDNWKFDFSVHDARQLVCTNQADMTGRLLAGSLALEIHILHYLIVRILLPRSSNLAQSLFFLQHFNIPLDSEPYVPIKRSFLIGAAVLASFGYRKERDGSWVKRVLNKMMMKDNYLLKETLLSFKVFWTGSMDSTLML

SEQ ID NO: 204429 - protein, 286 aa, Glycine max
  Coding DNA Sequence Number=SeqID_87651
  Homolog annotation: Hit_ID=Q47522; Match level="QueryCoverage=16%, HitCoverage=59%, E-value=2e-21, Identity=97%"; Hit description=LacZ protein
MVKVGTSYVPINVSFRQKLAQGFPWLLFLSAVPPVQLLTGWCVTAKAPPDISAGKCSGRVPFAIQAAQLLGRAIGAGLFAITPAGERGMCCKAIKLGNARVFPVTTLNSIHNPRIFLIGDENILVFRIDRYQTQAILLSIDPFDIDQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 204430 - protein, 335 aa, Glycine max
  Coding DNA Sequence Number=SeqID_87652
  Homolog annotation: Hit_ID=Q1SP02; Match level="QueryCoverage=59%, HitCoverage=52%, E-value=3e-16, Identity=28%"; Hit description=IMP dehydrogenase/GMP reductase
  Subcellular localization annotation: CTP_CleavageSite=54; ConfidenceScore=5.03e-01
SASGHGSFKCFMVLALSCVLITVLGLFKSASGHGPFKCFMVLALSCVLINEPMVDAAAQDTGAETDAQDTGAETDGDESVGFPGGPKDPSVLTEYADHVAGSIWSGQKRSELKLCSHGRKVHKLGRPVPVIEDMETSSFHLPVGKVSITLDDIVSLLHLPIIGAFHDFQPLRTDEVVVLLVELLMVLAEVVLAERGQYGVPYAFHDLTLVGRYAWGAAGLVHMYDQLNDASLSTSQQLVGYITLLQCNADPDYDEVSPCACRCIATKKTVKKVSTATYRQRLDRLRIPNVCWMSYAKHRPVQDFHPISCFSGQLPWGPVVVRYRPERVMRQFGYV

SEQ ID NO: 204431 - protein, 74 aa, Glycine max
  Coding DNA Sequence Number=SeqID_87653
MTKLGLCLSSGPPPLDDKRVRITIRMTKLGLCLSSGPPPLDDKRGANNHKVSLAYHGVQNDQTWSLRAIGHDCV

SEQ ID NO: 204432 - protein, 170 aa, Glycine max
  Coding DNA Sequence Number=SeqID_87654
  Homolog annotation: Hit_ID=Q84VH5; Match level="QueryCoverage=83%, HitCoverage=25%, E-value=2e-55, Identity=69%"; Hit description =Envelope-like protein
KLSAGKLSVKYAILHRIGTANWVPTNHTSTVATESFAVKLPIAFPTVLCGIMLSQHPNILNNIDSVKKRESPLSLHYKLFEGTHVPDIVSTSGKAAASGAVSKDDLIAELKDTCKVLEATIKANTEKKMELEHLIKRLSDNGIDDGEAAEEEEDAAEDTESDDDDSDATP

SEQ ID NO: 204433 - protein, 116 aa, Glycine max
  Coding DNA Sequence Number=SeqID_87655
TVHVFSTFEFGAVIDDCLREDPQGNPPFSSFSGATEDPQGNPPYSTFVRSTMNVIALRCSCVSIIKCEAYGDWEARYSVVFQIEEKEEVEMRVVITEGAGRTKSVSYLCFPLIFDE

SEQ ID NO: 204434 - protein, 86 aa, Glycine max
  Coding DNA Sequence Number=SeqID_87656
GVVLAEVLLADSRFTRPDMGFHPTKLNFVPSDADEAPLDVSICLHAFGIVGCGSFSGVKSCEREDPFHPGLFAGDAGGFQSPTREP

SEQ ID NO: 204435 - protein, 82 aa, Glycine max
  Coding DNA Sequence Number=SeqID_87657
MASKKRKASSTPTQARYDRSRNVVVYYTKFDEFKEELERRHWDEKLTDFANNNMDIAIVKEFYANLYDPKDKPPKQVCTPEA

SEQ ID NO: 204436 - protein, 357 aa, Glycine max
  Coding DNA Sequence Number=SeqID_87658
  Gene Ontology: Mol. function=RNA-directed DNA polymerase activity; Cellular component=intracellular; Biological process=RNA-dependent DNA replication
MPYAFLKAVPYRYSATMLEGGQEVPLPSLTPAISVDNIASDGKVLRNGRVIPTLFAKKVNDPAVKQATVNGPGTRKEVGQSNGTSKNSDHDEILKLIQKSEYKVVDQLLQTPSKISILSLLLNSKAHREALMKVLDQAFVERDVTVNQLDSIVGNITACNNLSFSDEELPEEGRNHNLALHISVNCKSDALSNVLVDTGSSLNVMAKSILDQLSYRGPPMRRSGVVVKAFDGSRKSVIGEVDLPITIGPFVFQITFQVMDIQAAYSCLLGRPWIHEAGAVTSTLHQKLKFVRNGKLITMSGEEALLVSHLSAFSFIGADETEGTSFQGLTLEGKKPEKNEVSFATWKSAQKVVQEGT

SEQ ID NO: 204437 - protein, 80 aa, Glycine max
  Coding DNA Sequence Number=SeqID_87659
MEHASRESRVALPPKGRLRQWGSGLDDGGCMNSARQSIHGDPNLMRYTINSWGSGLDDGGCTNNTRQSICGAPDLMVEDA

SEQ ID NO: 204438 - protein, 81 aa, Glycine max
  Coding DNA Sequence Number=SeqID_87660
MTADKGKTHFEVVLPLDCYSRSFPTGDVLPHINKEEKTETPRNHVQNKVMVQLWFGIRVKEPGGPFGPKFRSYSEPHGLIA

SEQ ID NO: 204439 - protein, 159 aa, Glycine max
  Coding DNA Sequence Number=SeqID_87661
  Homolog annotation: Hit_ID=Q9AVH2; Match level="QueryCoverage=26%, HitCoverage=15%, E-value=9e-18, Identity=97%"; Hit description =Putative senescence-associated protein
CASVVDHHVITWQDTRSHAHTHTHTHAGTRGEEGLGREGRIKATRAESQWIVAARPLCHLQYPVAYLSRLQRILPAARWELRFKASRRANPPHEGHQRHVPLGGRGPLLLVGKRTAGARVASSPDSDLEAFSHNPTHGSFAPLAFQPSAMTNCANQRSS

SEQ ID NO: 204440 - protein, 122 aa, Glycine max
  Coding DNA Sequence Number=SeqID_87662
TGPGGCSAGRRRVATSSGWPSWIIDTEQYLRHLVHQQAANHRAHVQTHDCLYQLSLSLQSQGFTSFPCPTPDQFRAEAAWPGDWPEARAREAPAEASDEADEAREDEEMTDLLDFLGGSRAT

SEQ ID NO: 204441 - protein, 199 aa, Glycine max
  Coding DNA Sequence Number=SeqID_87663
MEYARADVLKSIEENPSAAFGHLNFLKKLHNPLTSDEILGKVIQIESIINQFASTVQKKRENDARLDAQKQAHILLLEKAQTAQHEVERLTKEAKEGSSEIKACDDNISSWEATIMDLLSQVDDLRQKIVTEQAKRKELQEKAAHSIQKLIAEKGREGLKAFSASQAVADEARVMEGADQVLTKEMATLKKLYEDLIMT

SEQ ID NO: 204442 - protein, 138 aa, Glycine max
  Coding DNA Sequence Number=SeqID_87664
MKMKANKKRNELKVSDSKTYRLKNEEQMKNGRKSSRNRLRKRLGSITEAPRLGFSSRKHVFSPKTAEMHSIGGKRGGACHPARPCEQGYGNFTEALRKSRKPFFYKTGEELVVQLAQASRWLPQEATKLPKCCGRAQI

SEQ ID NO: 204443 - protein, 109 aa, Glycine max
  Coding DNA Sequence Number=SeqID_87665
  Gene Ontology: Mol. function=ribonuclease H activity; Biological process=DNA integration
MNFYWGNAVFLGLWDGSAFDGHEPWAPVSTKDKERVRQEGTPAQVQLGGPCLKKTSHAIEDNRGKWAPNYEGPFFVKKAFCGGALALTNMDGEELPLPVNSDVVKRYYA

SEQ ID NO: 204444 - protein, 62 aa, Glycine max
  Coding DNA Sequence Number=SeqID_87666
MTPLTYRLKQKWGLWSTALYYAYLRETDTYRPFWAVGRVILLFFSFSGQEAELIVRNRTLKI

SEQ ID NO: 204445 - protein, 330 aa, Glycine max
  Coding DNA Sequence Number=SeqID_87667
  Gene Ontology: Mol. function=transferase activity
  Homolog annotation: Hit_ID=O22225; Match level="QueryCoverage=96%, HitCoverage=66%, E-value=8e-69, Identity=40%"; Hit description =Expressed protein
  Pfam annotation: Domain name=DUF563; Domain location=1-193; Score =149.6; E_value=8.1e-42; Accession=PF04577.5; Description=Protein of unknown function (DUF563)
MSNVKEVTLTLAPPKLSCGVTHHTPALVFSVGGYTGNFHHEINENFIPLFITINSLSPNQNVILVVLEGKSWWFKKYAELLSAFSPNHMIINTNNISTVHCFPSATIGLIKHGDMTIDPKLLPNPKTLLDFRAFLDKVYTKDDDTPFVYPNENGKPRLTLISRRGNVSRLLLNENDVIKVAEEIGFNVHVFEPKNTPMAKVYRLIHASDVLLGVHGAGLTNFLFLRPGSVLVQVVPIELYWASRTYYEKPPKFLGVDYIEYKIEPNESSLLERFGANSLVFKDPPAFHKGNWSKQRVYLKEQNVKINVVRFRKYLTKAYEKAKIFISKVN

SEQ ID NO: 204446 - protein, 49 aa, Glycine max
  Coding DNA Sequence Number=SeqID_87668
MQNVMNPIHPNLKTVGVTLCGTVIRGNNGSFVWAYSRRLGHCLILEAEL

SEQ ID NO: 204447 - protein, 120 aa, Glycine max
  Coding DNA Sequence Number=SeqID_87669
  Gene Ontology: Mol. function=nucleic acid binding; Cellular component= mitochondrion; Biological process=DNA integration
  Homolog annotation: Hit_ID=Q1T1E6; Match level="QueryCoverage=94%, HitCoverage=19%, E-value=1e-37, Identity=66%"; Hit description=Zinc finger, CCHC-type; Peptidase aspartic, catalytic
MTCLLAFAVNKLSQYMQAPPSIHMQALKCILCYLKHTIFHGLHLVVTRNLDLNAFCDADWGGDNVDWKSTGAYIVYLGPNTISWSCKKQSTGEYRSIGTTTSKLLWIQQLLMELRIQIPK

SEQ ID NO: 204448 - protein, 230 aa, Glycine max
  Coding DNA Sequence Number=SeqID_87670
MGGISMGKKLDRVIVDTFEHIIFPDAYAIEPMWGALGSLPYVGCTRNKLDKLKDTSKILNPSDVDGSCLYPLNLIGSGGVLHNHNSQWLLGFSSFAGTRDAEKAKLMAILNGLRTKKRNPILVGESELKAAIKEVIKKIENKELGDGAFANVNVIHLDKVFIDLGVFKWLVEQPVGFGVAGGLGNMQQLTLTKANKVAVAVAVAVAAAEMRKMVSKFGEGGIGGLLGHAT

SEQ ID NO: 204449 - protein, 232 aa, Glycine max
  Coding DNA Sequence Number=SeqID_87671
  Gene Ontology: Mol. function=chorismate mutase activity; Cellular component=chloroplast; Biological process=aromatic amino acid family biosynthetic process
  Homolog annotation: Hit_ID=Q9XF60; Match level="QueryCoverage=71%, HitCoverage=52%, E-value=6e-59, Identity=64%"; Hit description =Chorismate mutase 3
  Pfam annotation: Domain name=CM_2; Domain location=77-144; Score =11.3; E_value=0.008; Accession=PF01817.11; Description=Chorismate mutase type II
  Subcellular localization annotation: CTP_CleavageSite=43; ConfidenceScore=5.33e-01
MEAVLRLHQPHLGFGSRPITYFSSKSTIFHRQNSLSIKRCQVRVIAASSSPSPSFPFGDSGKKRVDESKILILDGIRHSLIREEDSIIVSLLERAKYSYNANAYDKDAFLVDGFSGSLVEYMVLETEKLHAQLGIYKKPDEHPFFPEYLPEPMIPPMQHPQVLHHCGDSININNTIWNMYFKHLLPRLVKAGNDDNCGCVAACDILCLQLTPSYKSHMVDFILHLKHVPDLT

SEQ ID NO: 204450 - protein, 59 aa, Glycine max
  Coding DNA Sequence Number=SeqID_87672
MERALTKVSSLKVGLGSSWISKKAKEEFSNISEDISEREREMCERVLVEHGEYRRMNGC

SEQ ID NO: 204451 - protein, 181 aa, Glycine max
  Coding DNA Sequence Number=SeqID_87673
  Gene Ontology: Mol. function=protein binding; Cellular component =nucleus; Biological process=mitotic spindle checkpoint
  Homolog annotation: Hit_ID=Q9C795; Match level="QueryCoverage=97%, HitCoverage=62%, E-value=7e-38, Identity=41%"; Hit description =Mitotic checkpoint protein, putative
MPDLGQLVTSGFDKKLLLWDMHTKKTSLCLRSLDAEVDSMSVSGFNVTIAIGASMHVYDLRYFDQPVESKEAFNGTHLRCVSSIPDAEDIKSDALAGFAVGSVDGRVSLQISYPSGSDEISVSGAFATGDNEGYVTIWDAGSRRRLVELPRYPNSVASLSYNHTGQLLAVASSHTYQEAKE

SEQ ID NO: 204452 - protein, 308 aa, Glycine max
  Coding DNA Sequence Number=SeqID_87674
  Gene Ontology: Mol. function=protein binding; Cellular component =chloroplast; Biological process=chloroplast fission
  Homolog annotation: Hit_ID=Q45RR9; Match level="QueryCoverage=99%, HitCoverage=100%, E-value=1e-105, Identity=99%"; Hit description =Plastid division regulator MinE
  Pfam annotation: Domain name=MinE; Domain location=173-266; Score= -15.9; E_value=0.088; Accession=PF03776.5; Description=Septum formation topological specificity factor MinE
  Subcellular localization annotation: CTP_CleavageSite=41; ConfidenceScore=5.24e-01
MAISGDLRVSATLPLYRSHSPPLRTSSQSSPKYAYILLAIPLMLISTPNYTQTVPFEALSRLRSYDFSAFSVLVHARIASMRDWSRIVGIACEVCGINKALSSPTITVSFCDVVLPRACSISEFTPKCPYLTIVRCNMRGYCKPVAAVLGGPKFTSNSVSQETENFLLDAVKMNFFERLNLAWKIIFPSATSRKNSNARIAKQRLKMILFSDRCEVSDEAKRKIVSNVVRALSDFVEIESQDKVQLSVSADTDLGTIYSVTVPVRRVKPEYQEMDEFGTITNVEYKDTGETSGSVDVTFDFYVPDERS

SEQ ID NO: 204453 - protein, 100 aa, Glycine max
  Coding DNA Sequence Number=SeqID_87675
  Homolog annotation: Hit_ID=Q9C795; Match level="QueryCoverage=79%, HitCoverage=25%, E-value=2e-19, Identity=56%"; Hit description =Mitotic checkpoint protein, putative
MKGNWSELELEKEFGDAISRTRFAPHSNNLLISSWDSNLRLYDVDASLLRLQAPSQAPLLDCCFQDDAVAFAAASDGLIRRTIMGQGDKTLLRVFNITEY

SEQ ID NO: 204454 - protein, 292 aa, Glycine max
  Coding DNA Sequence Number=SeqID_87676
  Gene Ontology: Cellular component=mitochondrion
  Homolog annotation: Hit_ID=Q017C3; Match level="QueryCoverage=48%, HitCoverage=40%, E-value=3e-16, Identity=35%"; Hit description=[S] KOG2861 Uncharacterized conserved protein
  Pfam annotation: Domain name=DUF155; Domain location=84-283; Score= -94.8; E_value=0.062; Accession=PF02582.5; Description=Uncharacterised ACR, YagE family COG1723
  Subcellular localization annotation: CTP_CleavageSite=37; ConfidenceScore=5.24e-01
MGGRWRTLSSFYNRITTSFSYSSKPHFPSFNRSISLAAAATSEIPDPDQFGFVDPELDPCVKIPVKAYFLSTSINLKGIQADNHRNVVPPSSRSSSNYVALRFCDFNLDSNSLNNFSHLIQGHGFHMKASNCRYMVVYQYGSAVLFNIEDHEVESYLELVKRHASGLLQDMRKDDYAIKEKPLQVEDMQGGPDYIVLKSLDTDGIRIIGSVLGQSIALDYFVSQVDGLVEEFAGINRGMEKTGTFTMDKKKLLQLVGKANSNLADVILKVGLFERYFILVLEKYTYGSVRIY

SEQ ID NO: 204455 - protein, 354 aa, Glycine max
  Coding DNA Sequence Number=SeqID_87677
  Gene Ontology: Mol. function=protein binding; Biological process =defense response
  Homolog annotation: Hit_ID=Q1SWW3; Match level="QueryCoverage=54%, HitCoverage=30%, E-value=2e-19, Identity=41%"; Hit description =Disease resistance protein
  Pfam annotation: Domain name=NB-ARC; Domain location=145-328; Score= -109.7; E_value=0.0027; Accession=PF00931.13; Description=NB-ARC domain
MTAVAEDGSWSVVKPKLQNSIELTVAAHDTTGGMKTKIAEAAMIAKLGIDVYIVKAATSHSLRALNGDLRSSIPDDWLGTLAKSAFNNIRKDTLKINKRYWIDLKDAAYELDDIMDECAYEELGMEYGGVKCCLSEMTTPERRNAVTDQRQTNPFINEPQVYGRNAETEKIVDFLLGDASHSADLSVYPILGLGGLGKTTLAQLIYNHERGASILVTTRLSKVAGIMGTMPPHELSELSKNYCWEFVGSAAFSKREKKEWLYVKESNLWSLSGDANSIMPMLRLSYLNLPIKHLRYLNLSEALQELSLIECSTLSSLPPQIGKLARRESSQFLISRYSLSFNLPNSAKRGQYVK

SEQ ID NO: 204456 - protein, 44 aa, Glycine max
  Coding DNA Sequence Number=SeqID_87678
MVTVATKATSWQLKRRWRGVCDGNNMTLMATWWLGKWGNMDSGC

SEQ ID NO: 204457 - protein, 79 aa, Glycine max
  Coding DNA Sequence Number=SeqID_87679
MYPLPNLSFILIHKIHQVYPRWYLRLNKMAWAGSTTHRNKLYKDYNLVCPSTHYNSEGNRRSDPHEAYRHAPTTSRWHK

SEQ ID NO: 204458 - protein, 183 aa, Glycine max
  Coding DNA Sequence Number=SeqID_87680
  Homolog annotation: Hit_ID=Q39818; Match level="QueryCoverage=21%, HitCoverage=19%, E-value=2e-08, Identity=80%"; Hit description=Heat shock 22 kDa protein, mitochondrial precursor
MCPPPIPNSNRSSPEPKSVNQNLDMGELTSITVRERLMLTVVVVAIEDLDHYEGEAGGLAYTTLAKGDDDDAGGEAGELGLAVPLEGGGGLGFRGDEGRMGVGRNTELEAVVVPKRMWREGIRKGREGEEEDEDESRKKRSTVVLLDKLYKIDQIKVEMKNNVLKVVVPKMKERKDVIKVNVE

SEQ ID NO: 204459 - protein, 95 aa, Glycine max
  Coding DNA Sequence Number=SeqID_87681
MVKGGQWFYTEKTIGVNIEDDDSTIDTCLSPFSIQMPPNVNEEEEEVDDVLANHNDHDEGELINIVPVVSQDPLSAYMVVNRTHWHTTYAATCTH

SEQ ID NO: 204460 - protein, 311 aa, Glycine max
  Coding DNA Sequence Number=SeqID_87682
  Subcellular localization annotation: CTP_CleavageSite=21; ConfidenceScore=5.44e-01
MATPFSSPPPPPLESVAPSPSTSKKTRKATQLRSLATEPIRPKRPVVHVDPTTWKVDSPHRKKLRIYVGIIAHNKIEFDIPKAFDLRTEKKILQTVRKRWMQFKLDLNSKWALVEGKEGEDDKGYDFLEEKLMEEKKKKRSKEVAQSGSNDTIVDPLCPIRQHVKWKMAFTKKFGQMTFEAVKEIADRIEEQGSQGSFVVHGRQDVLTASIGWLEHPSRVYAVGTDVTIKQYFGVASRSSRMSTSMAPKDLEKMTQKIKDQHEESLKKKSSPPGFPWKTTVHNVPLGNDQVKVGVEEDKLRAKRPAKPVDR

SEQ ID NO: 204461 - protein, 304 aa, Glycine max
  Coding DNA Sequence Number=SeqID_87683
  Gene Ontology: Mol. function=4 iron, 4 sulfur cluster binding; Cellular component=integral to membrane; Biological process=electron transport
  Homolog annotation: Hit_ID=Q01GW4; Match level="QueryCoverage=47%, HitCoverage=32%, E-value=4e-23, Identity=38%"; Hit description=[O] KOG0716 Molecular chaperone
  Pfam annotation: Domain name=DnaJ; Domain location=55-115; Score =82.2; E_value=1.6e-21; Accession=PF00226.21; Description=DnaJ domain
  Subcellular localization annotation: CTP_CleavageSite=40; ConfidenceScore=5.10e-01
MSVVVSGCSLLFWSQTCQVHGHLNFNNPMPRWRQNLAVIRCCNRGTWEIPMTQNNYYDLLGVSVDSNAHEIKEAYRKLQKKYHPDIFGQKGHEYTLMLNKAYEVLMTEDLRRKYDESIGPMRLRFGGNNTQALGYSIWKGPVKPQALFVDENACIGCRECVHHASHTFTMDETQGSARVKVQYGDNDQSIEVSVESCPVNCIHWVETEELPVLEFLIQPQPKDGYGVFGGGWERPANVFTAAKSFNKQLKRKSTIRHDQSPGGTFEESPAQAEAQARADMKIKMEGFLKIWNWVKETLGMNINK

SEQ ID NO: 204462 - protein, 167 aa, Glycine max
  Coding DNA Sequence Number=SeqID_87684
PKVQQRLNTQSIQGSTPTKLYLSLDLFCVFAFLSSAYQCLAEKEWRTHLYNQQLSGIDDDEETTISYYIMWGFTSISKLRYYEEVLLYFGLEEPRHDLEFRLTLMEYDEWGNALSCRMGLVRVTKVIEDRGDPLNMTFKDNEEYKELLWQLEHSYEEECDILREDMS

SEQ ID NO: 204463 - protein, 219 aa, Glycine max
  Coding DNA Sequence Number=SeqID_87685
  Gene Ontology: Mol. function=ribonuclease H activity; Cellular component=nucleus; Biological process=RNA-dependent DNA replication
  Homolog annotation: Hit_ID=Q1RYI2; Match level="QueryCoverage=64%, HitCoverage=21%, E-value=4e-16, Identity=36%"; Hit description =Ribonuclease H
  Pfam annotation: Domain name=RnaseH; Domain location=67-187; Score= -22.7; E_value=0.0075; Accession=PF00075.14; Description=RNase H
MNVEAGEVWQRLVFARDAISIQKALCIACVIVILQISIPENWEDNHWPLYFGIALSCSWSKFKLNCHAAVDMNGNAGTGGVLRDNNGNVVVTFVFKIGRCSVTQAELWAIVLGIQVAKSRGFSESLVESDSKLAISLIQHRCSPSYVCFQLVEMIRKFESDGGRFTWIPAYPEANQVAEILSKFGLSSDTHSRIFPLCPSFVFSAVMADIASVSVPRGY

SEQ ID NO: 204464 - protein, 101 aa, Glycine max
  Coding DNA Sequence Number=SeqID_87686
MARSMFALCPYLETYSSMKAHIKFHNSTIPKIGLTHKSPQWSRQLSQRALRGRARARLTGALSKGGKMRGVATNVYLWKTSGKPKETGQNENSKFGSCIYA

SEQ ID NO: 204465 - protein, 226 aa, Glycine max
  Coding DNA Sequence Number=SeqID_87687
  Gene Ontology: Mol. function=protein binding; Cellular component =cytoskeleton; Biological process=phagocytosis
  Homolog annotation: Hit_ID=O80516; Match level="QueryCoverage=87%, HitCoverage=75%, E-value=5e-59, Identity=57%"; Hit description =Expressed protein
  Pfam annotation: Domain name=ELMO_CED12; Domain location=52-208; Score=261.1; E_value=2.3e-75; Accession=PF04727.4; Description =ELMOCED-12 family
MVGSRSWIGGLFHRTTTKRDDKFIDYPLSPIEEERLQRLQERLQVPYDETRPDHQESLRALWHCSFPNVSLEGLISDQWKDMGWQGPNPSTDFRGCGFISLENLLFFARKYPESFHKLLLKKDGKRATWEYPFAVAGINISFMLIQMLDLCSEKPRCLPGMNFVKLLGENEEAFDVLYCIAFEMMDAQWLAMHASYMDFNVRFFIPCVFCISNPSCLFPPSPMLGT

SEQ ID NO: 204466 - protein, 68 aa, Glycine max
  Coding DNA Sequence Number=SeqID_87688
MLPKIVKTIVPVSDGASPQLHGELTKLVAFPLLTSVGDPSTLEEAMNSQEKDRWMGVMVEEMKSLQKN

SEQ ID NO: 204467 - protein, 119 aa, Glycine max
  Coding DNA Sequence Number=SeqID_87689
  Homolog annotation: Hit_ID=Q9ZU41; Match level="QueryCoverage=76%, HitCoverage=24%, E-value=4e-17, Identity=52%"; Hit description =Predicted by genscan and genefinder
  Pfam annotation: Domain name=DUF789; Domain location=12-112; Score= -43.3; E_value=7.6e-13; Accession=PF05623.3; Description=Protein of unknown function (DUF789)
MIFDEGSMQSKSNLDCFLRRTTPVVPSQFLPKHEIRNLNRLWHPWEREAVEYFTLGDLWNRFHEWSAYGAGVPITLSNGETLVQYYVPYLSAIQIFTSNTFSFESNHGLRVFVDVRIVI

SEQ ID NO: 204468 - protein, 72 aa, Glycine max
  Coding DNA Sequence Number=SeqID_87690
MKKRDTGRQSVSLENKRGDLTVLEIGNSGKVVIKQDMKGRRHKYGFNNNKLEKAEKKRVVDDETSDKHQLHE

SEQ ID NO: 204469 - protein, 362 aa, Glycine max
  Coding DNA Sequence Number=SeqID_87691
  Gene Ontology: Mol. function=RNA-directed DNA polymerase activity; Cellular component=mitochondrion; Biological process=RNA-dependent DNA replication
  Pfam annotation: Domain name=RnaseH; Domain location=245-362; Score= -16.4; E_value=0.0019; Accession=PF00075.14; Description=RNase H
MVIEVEGEIEEATKIVEDETIKEKDKSKTSHTHGATELETTFGVGKLSRTLLVQYVLINACTSYNILIGQTSLNVLRAIVSILHLAKKFPNPKGRGKILGFKIAYRGIEANPDKCEVVVAMRSPHNLKETFLATPPIPTRSTPEAEFLFYLYVSNSTISLALLQEDALINSTKRLRPFFQSHQIKVNTDHPLKQVMRKPKFTGRIVPWSVKLFEFNLKCEPKCPIKGQCLVDFIVKFASTESDIEGCWTLYVDGASNNKGSDTEVTLEGLDDISIEQSLRFNWKVSNNQAEYKALITSLKLTIEVDVKKLKCISDSKLVIEQVNKVFQARQAQTQKNYHLIKRLLEHFENHKLIHVDREKND

SEQ ID NO: 204470 - protein, 88 aa, Glycine max
  Coding DNA Sequence Number=SeqID_87692
MRQFSLFRVLLETNSQNRALLEIFPRGCFFCTYPTWEAPVEVATSCMCDKWQALDESADMVGDFTLQVAIPISALTAAGSGSNSTVRQ

SEQ ID NO: 204471 - protein, 241 aa, Glycine max
  Coding DNA Sequence Number=SeqID_87693
  Gene Ontology: Mol. function=oxidoreductase activity; Cellular component=vacuole; Biological process=hydrogen peroxide catabolic process
  Homolog annotation: Hit_ID=P22196; Match level="QueryCoverage=97%, HitCoverage=72%, E-value=1e-102, Identity=78%"; Hit description =Cationic peroxidase 2 precursor
  Pfam annotation: Domain name=peroxidase; Domain location=43-240; Score=344.3; E_value=2.1e-100; Accession=PF00141.13; Description =Peroxidase
  Subcellular localization annotation: CTP_CleavageSite=47; ConfidenceScore=5.13e-01
MEGQSLYSLVFLVLALAIVNTVHGQGTRVGFYSSTCPRAEFIVRSTVQSHVRSDPTLAAGLLRMHFHDCFVQGCDASVLIAGDGTERTAFANLGLRGFEVIDNAKTQLEAACPGVVSCADILALAARDSVSLSGGPNWQVPTGRRDGRISQASDVSNLPAPFDSVDVQKQKFAAKGLNTQDLVTLVGGHSIGTTACQFFSNRLYNFTANGPDSSINPLFLSQLRALCPQNSGGSNRVALDT

SEQ ID NO: 204472 - protein, 295 aa, Glycine max
  Coding DNA Sequence Number=SeqID_87694
MTPLPRPQSALGREALIKKGRVEDLSILHKFVRFHLMENLPFNLPHTIYINILRNPKGLGGVDDIYYVALINNMLWDQRVFHVFEKMDNDSKHTVITKAEEKSIPQRLIDLSETIDDKEEMHKLFSRSESNKESVASSSSGNESFEGSHVSPLRKRPFSTPKQCPTPSPIHLENPSTKVTPAIAWRNLQKYKDKRSTQNNIPKDLFEKYRRDPSQEVEPLKNYSMLGGPHAQMYIRNKASVYQPGLYISKATEIKVVVDMVSIWDTAKKKGFKLYYNKEMPSRKVKVELVNYSRN

SEQ ID NO: 204473 - protein, 85 aa, Glycine max
  Coding DNA Sequence Number=SeqID_87695
MRKSDLHSSFIFVCETKKVSVFNRLACPKLTKARLPLVDKGADNPWVSPHVITLMGRGDRTVGWSTKAGLLLLRILNCDEELKPM

SEQ ID NO: 204474 - protein, 212 aa, Glycine max
  Coding DNA Sequence Number=SeqID_87696
MTPKKLATKRARKTVAGEGSSITPPAYFDFDGHQFCSEEHQCHFELIKDWSFPNIAGKRLRIMPTNMITLTQIWMTFLLEPPWHPVDQEKSNKALGFPTLITGLYQFYGVSVTPAKPIRPPINRSFIDKYCMPSQVQQQEQFHQPQPIADPNPYPWPTPEKFRTTVAWPGGRPIFQEEVGPTDALEDAQGDGVRAEEDENMIDPIDYFIGGD

SEQ ID NO: 204475 - protein, 137 aa, Glycine max
  Coding DNA Sequence Number=SeqID_87697
  Gene Ontology: Mol. function=DNA binding; Biological process=DNA integration
  Homolog annotation: Hit_ID=Q1SFR5; Match level="QueryCoverage=93%, HitCoverage=24%, E-value=9e-14, Identity=40%"; Hit description =Integrase, catalytic region
MEGRKTQHIILPFIWIDNGIFLGYFETSKALRVYNSRTLEVEEAIHVKFNENELDKGLPKIDESFVDLRLDDEIKEKMYIQLRIRDRSDAILPRKGPVTRAISKRLQEDWARAAEEGSRVLMCGSNAFQGYFDDAKE

SEQ ID NO: 204476 - protein, 175 aa, Glycine max
  Coding DNA Sequence Number=SeqID_87698
  Gene Ontology: Mol. function=nucleic acid binding
MALQLADRTTKLPYGIVEDVLIKVDKFVFPVNFAVMDMDEDNEVQLILSRSFIKISKVMIDVDDGKLTVKEMREVEANENSKCLQQLKAFREIPYHQHLFEELKEEKPNEETKMKLKALPSHLKYVFLVGDSQKPVTSNSSISEEEEETGENFVGQHKRLDLIRCHRYQSFLFYS

SEQ ID NO: 204477 - protein, 319 aa, Glycine max
  Coding DNA Sequence Number=SeqID_87699
  Gene Ontology: Mol. function=RNA-directed DNA polymerase activity; Cellular component=chromatin; Biological process=chromatin assembly or disassembly
  Pfam annotation: Domain name=zf-H2C2; Domain location=170-211; Score =11.5; E_value=0.011; Accession=PF09337.1; Description=His(2)-Cys(2) zinc finger
  Subcellular localization annotation: CTP_CleavageSite=5; ConfidenceScore=5.23e-01
MGSVSTATRNTIGAIVAPLGGPFGPRDTPFSGSCQGSSGDASGGRMKHTQLHSTAIGANVVLGMQWLKSLGPVLTDYNSLSMKFFHDGCLVELKVLSDDHPVSTSKDLPLAIQALLNKFNSLFQAPHQLPSERDTDHHIHLLPNSTPVNYKPLFFSGTIGEEAGWVAEYHSTPTGGHMGVAKTVARISENLCWPGLRDDVAQFVAQCVNFQHTKYEAKKMAGLLCPLPVPHHPWEDLSLDFITGFPPYHDNLVILVVVDRFSKGIHLGMLPSSHTTHVVASLFMGIVGKIHGLPRSLVSDRDPLLVNKLAGAIPTQWHS

SEQ ID NO: 204478 - protein, 205 aa, Glycine max
  Coding DNA Sequence Number=SeqID_87700
  Gene Ontology: Mol. function=transcription factor activity; Cellular component=intracellular; Biological process=regulation of transcription, DNA-dependent
  Homolog annotation: Hit_ID=Q38895; Match level="QueryCoverage=90%, HitCoverage=79%, E-value=7e-17, Identity=36%"; Hit description =Transcriptional regulator SUPERMAN
  Pfam annotation: Domain name=zf-C2H2; Domain location=23-45; Score =21.5; E_value=0.003; Accession=PF00096.16; Description=Zinc finger, C2H2 type
MEGNFLTRNRFGFEEHSWPTRNYACSFCKREFKSAQALGGHMNVHRRDRARLRSCLPPSSWVSECPNKPNSIKPNPTHLSPSSPSSLCLSNNLLNCAHTFPLYSPSLTLSSSLTPASPNGDNKPRRVSPDPHLLPLLIPQSSEEIKMNKNKVSGLGVEEVQGCAIGEKLKVFKTSTSEHNIKLELGIGLLKQPEMLDLELRLGHS

SEQ ID NO: 204479 - protein, 96 aa, Glycine max
  Coding DNA Sequence Number=SeqID_87701
MEKLIDFEGHGLHGFAKGKLMGGESEDSILEFVWRTCGFSGIDHVNEKREMRVPKCLSLPKRPPSFQQDTLYHLAFLSYIILEANRHFNYSFGLAF

SEQ ID NO: 204480 - protein, 326 aa, Glycine max
  Coding DNA Sequence Number=SeqID_87702
  Gene Ontology: Mol. function=RNA binding; Biological process =gynoecium development
  Homolog annotation: Hit_ID=Q58T16; Match level="QueryCoverage=86%, HitCoverage=50%, E-value=5e-68, Identity=50%"; Hit description=FLK
  Pfam annotation: Domain name=KH_1; Domain location=219-281; Score =59.8; E_value=8.8e-15; Accession=PF00013.19; Description=KH domain
  Pfam annotation: Domain name=KH_1; Domain location=45-112; Score =65.7; E_value=1.5e-16; Accession=PF00013.19; Description=KH domain
  Pfam annotation: Domain name=KH_2; Domain location=45-90; Score=9.0; E_value=0.01; Accession=PF07650.7; Description=KH domain
  Pfam module annotation: Pfam domain module=KH_1::KH_1::KH_2; Domain location=219-281::45-112::45-90
MVSAKEEPDRPIPPAIDGLLRVHKQVINVDRDLVDSALAAGRSVVTRLLVADTQAGSLIGKQGSTIKSIQDGSGCTIRVLGSENLPVFALRDDSIVEIQGESAGVHKAVELIAVHLRKFLMQRPDVRVNQNVPPHQNWGPPPQGFPAPAGGGGGGPAFAPNHQYMPPSHHYDSYYPPTELPPMDKHLHQGPPPAYAKDASMGIHSSSAPPQQSVVTKVTQHMQIPLTYADAVIGASGTNISYIRRASGASITIQETRGVPGEMTVEISGTSSQIQAAQQLVQVFDFKVKSTSCILLVTCIVVGKVLKVYEAVLDFVVAGTQHDKSC

SEQ ID NO: 204481 - protein, 92 aa, Glycine max
  Coding DNA Sequence Number=SeqID_87703
  Gene Ontology: Mol. function=nucleic acid binding; Biological process= DNA integration
MEDEHWVKAMQEELDQFQKNDVWKLEELPKGNKAVGAKWVLRNKLDEAAHNKMKLCQMDVKSAFLNGLTQEEVYVEKPLGFESGTFPIMFSN

SEQ ID NO: 204482 - protein, 105 aa, Glycine max
  Coding DNA Sequence Number=SeqID_87704
MVRWCHSQRPRWVVVRRTLGGETGVIMEQDTRNKESELNTNKGTKFDMIKYRSLEQQGKAKNSCKPKDISFSSRWFYAELKLPEIIADDTTAPTWLNSIEYVSRF

SEQ ID NO: 204483 - protein, 193 aa, Glycine max
  Coding DNA Sequence Number=SeqID_87705
  Gene Ontology: Mol. function=RNA binding
  Homolog annotation: Hit_ID=Q58T16; Match level="QueryCoverage=62%, HitCoverage=20%, E-value=4e-27, Identity=53%"; Hit description=FLK
  Pfam annotation: Domain name=KH_1; Domain location=127-187; Score =50.2; E_value=7.1e-12; Accession=PF00013.19; Description=KH domain
MAEHDFDGHVVGYVPEDPNFPQNHSDEHDVGTVIDSSGFPHLLPDEDDAGNLVEDANFPENHFDGHEHDVGGFPGDTDSPQKEEHVEEGHGAGDVPEDFDSLLKQESEIDSKGNEIKKWPGWPGENVFRMLVPVQKVGSIIGRKGEFIKKITEETKARIKILDGPPGISERAVSLDFSVIYVLKDDLGYISVS

SEQ ID NO: 204484 - protein, 117 aa, Glycine max
  Coding DNA Sequence Number=SeqID_87706
MTPTKDEKRLKELPWALLVDGSFSGTRCGMTIFTKRIHLATIEMLKSGRAKVHLHRASANKQTSQGKKSIILRGLRKRVKEAKGTLVEQVPYVLWAYQRTPHSAVGEIGFPNQDKQI

SEQ ID NO: 204485 - protein, 149 aa, Glycine max
  Coding DNA Sequence Number=SeqID_87707
  Gene Ontology: Mol. function=protein serine/threonine kinase activity; Cellular component=nucleus; Biological process=response to high light intensity
  Homolog annotation: Hit_ID=P05478; Match level="QueryCoverage=76%, HitCoverage=71%, E-value=2e-46, Identity=76%"; Hit description=18.5 kDa class I heat shock protein
  Pfam annotation: Domain name=HSP20; Domain location=45-148; Score =141.5; E_value=2.3e-39; Accession=PF00011.11; Description=Hsp20alpha crystallin family
MTRSDNSSDDFEVVNVGYGESSTNNISVNGDVVVENSAFVNTSIDRKETQEAHVFKADVPRLKKDELKVEVEDHRVLQISGKRNLEKEDKNDTWHHVERSSGKFMRRLRLPENAKMDQIEASMENGVLTVTISKEEMKKPETKAAEISG

SEQ ID NO: 204486 - protein, 52 aa, Glycine max
  Coding DNA Sequence Number=SeqID_87708
MKKRFNKQGRCDDSDNYNRDNDKGKGNDDNYMIVINGDRDYGDGGDDMSDDK

SEQ ID NO: 204487 - protein, 272 aa, Glycine max
  Coding DNA Sequence Number=SeqID_87709
  Homolog annotation: Hit_ID=Q10GG7; Match level="QueryCoverage=70%, HitCoverage=36%, E-value=7e-49, Identity=48%"; Hit description=H1flk, putative, expressed
MSNDKDQRNEESNNYRIISSKRQNQKTQKFSYITDPVVSGSLIYGRYAECFTQIIVTSFIGLIFAVVFHFGLKQTRDRKIIPRIRLSRAGHLPKLERFSHYVARQMGFKDRRNCPHLCRLASEYIRKYEGFEDDIYAFFENEPDADSLYVKLVEEFERCILSYLGFHWNYGDLVMSQVLSSENEPKKKLKSIVMAATREQRIERLAKNLKVARVFNTLVEEMKAMRVATSDDSRCTEVMAPVAHSDRSPVLLLMGGGMGAGKSTVLKDILKE

SEQ ID NO: 204488 - protein, 131 aa, Glycine max
  Coding DNA Sequence Number=SeqID_87710
MHFEHSEYSVAGDSEYSDFEHLTTNFHTENIAQPPPHERTLREMTAPDFTYESLCIQYPDEGVPYVLKTGLIHLLPKFHGLIGEDPHKHLKEFHIVCSTMKPPDVQEDHIFLKAFPHSLEWQKIDYTTLLP

SEQ ID NO: 204489 - protein, 104 aa, Glycine max
  Coding DNA Sequence Number=SeqID_87711
  Gene Ontology: Mol. function=DNA binding; Cellular component =mitochondrion; Biological process=DNA integration
  Homolog annotation: Hit_ID=Q1SH28; Match level="QueryCoverage=73%, HitCoverage=8%, E-value=1e-18, Identity=53%"; Hit description =Integrase, catalytic region
MSLSADIEPLSYQKALQKQCWRDVMKAEIEALIMNETWTVVETPPNVQPIGCKWVDKIKRNPEGSIERYKVWLVAKGINEALGLNLELSLGLNPELGLDLKRAD

SEQ ID NO: 204490 - protein, 83 aa, Glycine max
  Coding DNA Sequence Number=SeqID_87712
MSATSSSMLSRPLHDPLPPQVCTHDNHHQPCHHMPLLARLHHRMRMMVMVLGNSLMKDCDGGIWMTPPFSLSDLSSFSNSCGF

SEQ ID NO: 204491 - protein, 281 aa, Glycine max
  Coding DNA Sequence Number=SeqID_87713
  Gene Ontology: Mol. function=RNA-directed DNA polymerase activity; Cellular component=extracellular region; Biological process=RNA -dependent DNA replication
MGMKSFKAPGLDGFQPFFFKQYWPIMGKDLQHMVHMSFQVITKVLVCHLCPYLDELIGTFQGSFIPRRGTMQNVILAHKALYTIKKSKAKKGLMAIKVDLEKAYNQVSWDYLKVTLVDFGFPSIITNLILWAVQGSSPLVLWNGLRLDGFLLSRGLRQRDPLLPYLFVMCMERLTLSIQNQLNTDVQYPGIMCTNHLGKCLGFQFLTDQVTKSNFDDVMEKVKSRLASWKDYALPKEILGVDIKYMILIAKVNPKVSYVWQSVIKARDALLDGFSLPLDDS

SEQ ID NO: 204492 - protein, 156 aa, Glycine max
  Coding DNA Sequence Number=SeqID_87714
  Gene Ontology: Mol. function=ribonuclease H activity
  Homolog annotation: Hit_ID=Q1SZM6; Match level="QueryCoverage=81%, HitCoverage=41%, E-value=3e-09, Identity=30%"; Hit description =Ribonuclease H
MCSCEDYTHFCTSNHGARNNMRWQCPSPSLVKVNVDVYGIYRNSCMGFGGVVRDHFGLWRKGFAVQFDGGDALIMEFLEFKKGLQHAWELGEQHIICESDCCDVVNAITNGDDRGSILHLHHDFVLNIQGLIHKDWQVDLHVIPREANTMVHTIVS

SEQ ID NO: 204493 - protein, 94 aa, Glycine max
  Coding DNA Sequence Number=SeqID_87715
MDGQGGEGNRPPRRTLGDYAYQQGPKHYNNIVIPLFSNKVVELKPAPLSLIGSDSFDGMDHEDPAIIAWSGDMPIFQKEDEDMADPVDYFIGGD

SEQ ID NO: 204494 - protein, 52 aa, Glycine max
  Coding DNA Sequence Number=SeqID_87716
MTKEEICSPNSAAPRLHFSFSPFPFRGHEGVCFRDNHGKIGGEALIGCHQWW

SEQ ID NO: 204495 - protein, 341 aa, Glycine max
  Coding DNA Sequence Number=SeqID_87717
  Gene Ontology: Mol. function=sequence-specific DNA binding; Cellular component=nucleus; Biological process=regulation of transcription, DNA-dependent
  Homolog annotation: Hit_ID=O04336; Match level="QueryCoverage=96%, HitCoverage=98%, E-value=3e-72, Identity=44%"; Hit description =Probable WRKY transcription factor 21
  Pfam annotation: Domain name=WRKY; Domain location=270-330; Score =141.1; E_value=3.1e-39; Accession=PF03106.6; Description=WRKY DNA -binding domain
MEDVEEANRAAVESCHRVLSMMSQPGNEVHCRNLMVETGGAIVRFKKVVSLLSSGLGHARVRKHKKLQIPFSENILLDNQICKTDHHSKCLQFPHTIFTENSVQGLGQTVRNSIYMMGNPSLELSSNERSPLNLTRQTSATHYHFLQQQQMKHQAEMMFRRNNSVVNLNFDSSSCTPSMSSSTRSFISSLSIDGSVANMDGNGSAFHLLGAAHSSYQNSQQQKRKCSARGDEGSVKCGSSARCHCSKKRKHRVKRSVKVPATSNKLADIPPDDYSWRKYGQKPIKGSPHPRGYYKCSSTRGCPARKHVERCLEEPSMLIVTYEGDHNHPKLQHNPQIRELH

SEQ ID NO: 204496 - protein, 201 aa, Glycine max
  Coding DNA Sequence Number=SeqID_87718
  Gene Ontology: Mol. function=receptor activity
  Homolog annotation: Hit_ID=Q2KK36; Match level="QueryCoverage=66%, HitCoverage=74%, E-value=4e-17, Identity=34%"; Hit description =Prenylated rab acceptor family protein
  Pfam annotation: Domain name=PRA1; Domain location=34-185; Score =189.6; E_value=7.6e-54; Accession=PF03208.9; Description=PRA1 family protein
  Subcellular localization annotation: CTP_CleavageSite=36; ConfidenceScore=5.82e-01
MTSTSSSAPHYSSLPSPSSSNSTASYFVTRPATTTRSSFATRRPWEEVFALFSFTRPYSIGEATMRVRRNLDHFRVNYFMIVLFVLFLSLLWHPVSIIVYLVALVVWFFLYFFRDEPLVVLGTAVDDRAVATVLAAATVVGLVLTGVWVNVVGSVIIGIVLVVLHASFRSTEDLYVDEHDGGLLSFVGGTPTKGTGGYTLI

SEQ ID NO: 204497 - protein, 111 aa, Glycine max
  Coding DNA Sequence Number=SeqID_87719
MKKKKNVQRVSICVSVYVCFWCLLKGSGGDVNLRGGKSGRFLEVGPVGKMNSLFTLLESEKDGVMSMMCIKSVKMRAMCWPSVTLVDALCLAQPWSSLLRCAHDPSYSSLI

SEQ ID NO: 204498 - protein, 72 aa, Glycine max
  Coding DNA Sequence Number=SeqID_87720
MTSRDGHQWSWVVDEEVLGLGWMFGEKNSGKIMFFTLKNRNTPFRVGIVLSALLTLSERSKIIICQIPTAKP

SEQ ID NO: 204499 - protein, 195 aa, Glycine max
  Coding DNA Sequence Number=SeqID_87721
  Gene Ontology: Mol. function=metal ion binding; Cellular component =integral to membrane
  Homolog annotation: Hit_ID=Q10GD6; Match level="QueryCoverage=83%, HitCoverage=30%, E-value=1e-13, Identity=33%"; Hit description=Zinc finger, C3HC4 type family protein, expressed
SISPCEGSQSIPNKGSENGAEPWDAKLDLWKPLNFLVEVASRSKSFKSNNVQGSDAKLETNQVNESDSQVQKTKNKENKRKAKIEDEKSSPYPVSSDTAKPNKLRRIRKKKETASGESGISPQAVLDSASNRLSRTGPIWFSLVASENQEGDAPLPQIPASYLRIKGMPFLEQCIAHVSLLTLTTIYVNFYTNIH

SEQ ID NO: 204500 - protein, 85 aa, Glycine max
  Coding DNA Sequence Number=SeqID_87722
MCNRLHLDGNYLSASLFNLSLSREISSSLLLTSKKGLRDRWSLVVKQFEYKGWVVLVWFRTCKGFLQVSGTLKQVAWGLDVGIRV

SEQ ID NO: 204501 - protein, 51 aa, Glycine max
  Coding DNA Sequence Number=SeqID_87723
MRVLGKGMRRRRDSDGGMKEQRTTLEIVIDRCNQRKDYGIACKNICTFLKF

SEQ ID NO: 204502 - protein, 223 aa, Glycine max
  Coding DNA Sequence Number=SeqID_87724
  Homolog annotation: Hit_ID=Q75KW5; Match level="QueryCoverage=31%, HitCoverage=15%, E-value=8e-17, Identity=61%"; Hit description =Expressed protein
MEKLVDRRPLAFLVGFVLLPVIAACVDTLGVLTTKDERDLSFLLAGNGTEVTTSGAFTFLPFKGKTLALTSCKLWSGLILKDQQYSTVVGVVKSSNTFSTSAQQYRTAEYAANQNNNVSDQHSRPHSSTEWASHACYNCVPSHFDHLIRHAASPSLLARTHSLLLHAMLCYHRAGTSRIYVHFDAIRLCIKNTNAQCEKEKEEASERGEWIEVLVMVAIGGDG

SEQ ID NO: 204503 - protein, 325 aa, Glycine max
  Coding DNA Sequence Number=SeqID_87725
  Gene Ontology: Mol. function=metal ion transporter activity; Cellular component=membrane; Biological process=metal ion transport
  Homolog annotation: Hit_ID=Q10D38; Match level="QueryCoverage=94%, HitCoverage=70%, E-value=3e-70, Identity=52%"; Hit description =Magnesium transporter CorA-like family protein, putative, expressed
  Pfam annotation: Domain name=CorA; Domain location=20-325; Score =136.5; E_value=7.3e-38; Accession=PF01544.9; Description=CorA-like Mg2+ transporter protein
MALASSVVELQPSSVKKKTAVSRSWILLDHYGKGTVLDADKYAIMRLVQIHARDLRILDPLLSYPSTILGREKHIKAIITADEVLLRDPMDDDVVPIVEELRRRLPQVSAAEQGQGKEEACAQDGEEFPFEIRALEALFEAICSFLDARTRELETSAYPALDELISKVLNCGCDLHLVALIDIVGKCVRCGHNCNHQQLKNLDAVDKVTISSRNLDRVRKLKCAMTRLTIRVQKIRDELESLLDDDDDMADLYLSRKLDASSSPTSSSDAPYWLYGSPNTGSKRHKSSRVSGTTVQRENDVEELEMLLEAYFMQIDGTLNKLATV

SEQ ID NO: 204504 - protein, 107 aa, Glycine max
  Coding DNA Sequence Number=SeqID_87726
  Homolog annotation: Hit_ID=Q66UA2; Match level="QueryCoverage=40%, HitCoverage=95%, E-value=1e-08, Identity=65%"; Hit description =Putative salivary protein
  Subcellular localization annotation: CTP_CleavageSite=93; ConfidenceScore=5.25e-01
MVPPYSDRVSRAPPYFSLAQYHQSVFTYRAITYYGRTFHSVLLTMFQFSRFASHTYVFSMRYPCGWVSPFRNLRIKAYLPAPRSLSQAITSFVAYHRQGIHHMLLVT

SEQ ID NO: 204505 - protein, 71 aa, Glycine max
  Coding DNA Sequence Number=SeqID_87727
MDSDLQSQRLKLLLLGHGGVKGNLTTPLCDRHVTAHPHLGPKKRASYINKYEDEAEPGSSASLNLDGQNLS

SEQ ID NO: 204506 - protein, 156 aa, Glycine max
  Coding DNA Sequence Number=SeqID_87728
  Subcellular localization annotation: CTP_CleavageSite=65; ConfidenceScore=5.04e-01
MTEDFPFQAHKPHIHTWLSLTLLSNNINITLWHGRHAFNPSSLLPRTPPTNSLQNLYEICNPSSLAMATTPSRDGEEETLITETGPNRLKLLLFGDGGVKVSEREIESEKVEGEMGAEGQAGKENILKKPTTNTIVGYFFYYQTQKFLYPQPAPFG

SEQ ID NO: 204507 - protein, 99 aa, Glycine max
  Coding DNA Sequence Number=SeqID_87729
  Subcellular localization annotation: CTP_CleavageSite=35; ConfidenceScore=5.19e-01
MTTDSPPLLMFPWTQWSRQLSQPTLRREGDVSLTGASSKKGKCTESPPTFIRGKHQKNRKRCGLQNLSVKGSGVVFTHGEGCFPRSYVFLNCDKEIKPM

SEQ ID NO: 204508 - protein, 110 aa, Glycine max
  Coding DNA Sequence Number=SeqID_87730
  Gene Ontology: Mol. function=triacylglycerol lipase activity; Biological process=lipid metabolic process
  Homolog annotation: Hit_ID=Q5VP27; Match level="QueryCoverage=67%, HitCoverage=17%, E-value=5e-13, Identity=50%"; Hit description =Lipase-like protein
MDQKGDSLLFKRRSQTSQHGLTEWQYHGKNRGFERTSERDLALVNKDCDFLKDEHSVPPRWRQDLNKNMVRTEDGRWVLADRPLAQDPHEDIDHHLGELGLASSHTHTHN

SEQ ID NO: 204509 - protein, 146 aa, Glycine max
  Coding DNA Sequence Number=SeqID_87731
VFVQRSLAILDENGQRHKEALSNITTLEVEVTKWRATAQILWKVKFPKVANAIVALVEAIRSNYQLLSRVDDVFAKLVSTRLDGNEVFKRYKYLLKEKNDFTGKVERAFKEKEVLKATVTKSAKVIADPQAQLIESKLTESSSKLS

SEQ ID NO: 204510 - protein, 571 aa, Glycine max
  Coding DNA Sequence Number=SeqID_87732
MDCDPKRKLSEMQHFECICAESPKVEVTLKDKEQKVHIEHFFNIESLENVGTAKVYRNEVIGGYFAGQGTPFELPQILFNCFATKLMTDKSIRKDIYHSVVLTKAFETHGVIRKFLYETSMVEQERIWMLLCPKLLMFNNIHLPLSLLLRQQTLSETKSDNDGLAFRKPKATPPLDETHEPQVKKRLEAKKSSIVVDTNNPPPLEIPLRTDSIVDLDDEVQHDVPLSPIHFDHFHHEGPPAIDPNLTDEDIARMQFPVAFLSKNAYNIQRRLHVKFQTSIDWTQFPLDVEEEVVTCPLSIHKTDQAASSSAKLDPPTGIEVLPSPTWKEMVSYNKDIIGWCQKIDALHINPSSDDFLAPFPKHIQLFTPMSKYFTKDATKKMVSLKLDTEFPALNERSFSPYQNPWVPGQGITAELQRKQDKFNHQLMEMQKEAEAKQQQQKLAFEELFNNLHAHLGPQIDVFGPLLVEVTSQPQPLIEDALTIISTSSIPLEITLLTTISSTSVSKERIQELLRLLQVDLEETMERRFPSSVQPPLAPPTTIPPPTTTENLVSMLAPSPPTIPQPLSTKG

SEQ ID NO: 204511 - protein, 41 aa, Glycine max
  Coding DNA Sequence Number=SeqID_87733
MDLHGGSLSTVSTGAQAIPGHSTRDDGHCMFWYCIDGFSDM

SEQ ID NO: 204512 - protein, 247 aa, Glycine max
  Coding DNA Sequence Number=SeqID_87734
  Homolog annotation: Hit_ID=UPI0000D9B3B9; Match level="QueryCoverage =99%, HitCoverage=81%, E-value=5e-10, Identity=25%"; Hit description =PREDICTED: similar to splicing factor 3a, subunit 2
  Subcellular localization annotation: CTP_CleavageSite=45; ConfidenceScore=5.42e-01
MNILPSAIHASSTNESRGPRIDCLALFASSPFSTLIRSPMNLFPSAVHVSSTFECGAPRIDCLAKFANSPFSTFIRSPMNPLPNAVHVSSTFESGAPRIDRLALFANSPFSTFIRSPMNLLPSAVHVSSTFESGARRIDCLALFANSPFSTFIRSPKNLLPSVVHVSSTFESGAPRIDCLALFANSPFSTFIRSPMNSLPNAVHVSSTFESGAARIDCLALFANSPFSTFNRSPMNSLPSAIHASST

SEQ ID NO: 204513 - protein, 135 aa, Glycine max
  Coding DNA Sequence Number=SeqID_87735
MGPQLGDGKIHTVCKKGEDVPSWTKIPTPAVFADTLLFSLTSHFDYENTAEPLSSYIPPCQSEDPRHEGKGREDDVDEDGNDGGVDGGSEREGEGEEGEEGACAEEQDNGVTRLVPDDNARDDFEVEDAEPEGED

SEQ ID NO: 204514 - protein, 88 aa, Glycine max
  Coding DNA Sequence Number=SeqID_87736
MMNKTRPCNAYFYLEAKSINIFVPLEIEESTAVKNLDGCIGCGTLKINFQRPTHFDIASNSFKVQTFSKYKLSELKGWIWTGRISQDH

SEQ ID NO: 204515 - protein, 267 aa, Glycine max
  Coding DNA Sequence Number=SeqID_87737
MGPKSTLRLMRTLGPFLAFLAQSSWSLLSNALGGPSFELGVIVGDNGIREAIPAYEAFLVELLHLAHCDFSQWSCLDPLGLRGTRVVEIVRRGARNVSEFLASSTLLCEVDGVCHECWLIVACVHHFGCKGVFPFWFLFFSGHNFLSVYGGNLEHLVDDSLKVPSPFGACQLGEQVCSGVSLPGYVVHLKAFEVMQSYPARALHRRLQEDWTGDAREGPRVLMSLRNKRGYISCGSVLVEGTSNRFKENKGGYIPCGSLLVKGFLQG

SEQ ID NO: 204516 - protein, 129 aa, Glycine max
  Coding DNA Sequence Number=SeqID_87738
MRCGDDGSKLIERFPTNQSKVRDANGDAPVDEDPGHHEVHDYDGDNHRLDTVDVDVLDGMEVGHSQVSVELIACVFANGVFVFLNLLGGDAILPRKGPATRAMSKRLQEDWARAAEEGPRVLMNLRVDF

SEQ ID NO: 204517 - protein, 91 aa, Glycine max
  Coding DNA Sequence Number=SeqID_87739
MVEKEKPQGMFYNNPMVSAKCTYQNPELSHVRVDVAKESMSEYEKSEREPGTYRVEELRALVYRGCYGDVTTLADNYRLVHNSQWITMAYR

SEQ ID NO: 204518 - protein, 301 aa, Glycine max
  Coding DNA Sequence Number=SeqID_87740
  Gene Ontology: Mol. function=RNA-directed DNA polymerase activity; Biological process=RNA-dependent DNA replication
MKFPSFMGEIVTVKANHKQARRYYAESLKVEPYPPTREPPRPHLTIGGGTQVMSVDECSDPDLGNACSSRGTLPAINIDTLLTSFIGTWTCSHGIHLTYRVSTTTDEVVSSAFIQEEGKYQLPIYFTSRILYDVEKRYQMIEKVALALITLARHLRPYFQSDKVPHEDAVHGKFSGNDQTTLDWWSLYIDSASNMKGCGAEYEALIAGLKLAREIRVKKLRCYTNSQLVQGQVANRYQTKEIVLLKKRERRHHFKEKMSLEEAHHHKRPWIRARRKKEMNEGRGREEQEILCSKRALKSEV

SEQ ID NO: 204519 - protein, 163 aa, Glycine max
  Coding DNA Sequence Number=SeqID_87741
MEAKIPLDWKPLNLERYDGTIDPDEHLDVFLTQANLYTNDDVILCHVFLTSLKGCCKKERVTKTESHKSNKRHKSDKRQSLPKGPRYERYTLVTTNYTTILEEAFNAELWSQHGRLLGPPDVSSIGACRPRIFFINGFLCFLEDKWKQNGEGRERGDATSRRR

SEQ ID NO: 204520 - protein, 52 aa, Glycine max
  Coding DNA Sequence Number=SeqID_87742
MKPSGAESCYSQCGRRSEDVKRLTKGVQVAKLQCNELGLVAYRVKVLGIEVL

SEQ ID NO: 204521 - protein, 63 aa, Glycine max
  Coding DNA Sequence Number=SeqID_87743
MDGNCGYWEIAVLLGMGEESWSLVRNHMHKELTSWSEEYINLVGGIKRFEELKRSLLVDRLSM

SEQ ID NO: 204522 - protein, 111 aa, Glycine max
  Coding DNA Sequence Number=SeqID_87744
MESRAPSGPLVSRTGCGMNRKLGYGAQLRANLDPTKGVGRLRQQDGGHGSRNPLRSVLPTLETAQPEVGSSGWKSTARRVVSGAPPAALENPEDRVPPTPGRTHNRIRSPR

SEQ ID NO: 204523 - protein, 56 aa, Glycine max
  Coding DNA Sequence Number=SeqID_87745
MRAHDSQESPRPSVRLVRPPLPMAHSDSSIGPIISKCLIRWKVLAPQAPVTKNNNL

SEQ ID NO: 204524 - protein, 272 aa, Glycine max
  Coding DNA Sequence Number=SeqID_87746
  Gene Ontology: Mol. function=protein binding
  Homolog annotation: Hit_ID=Q10GD4; Match level="QueryCoverage=58%, HitCoverage=27%, E-value=3e-54, Identity=66%"; Hit description =Leucine Rich Repeat family protein, expressed
SSVSDSGVSMICNVFSETLTRLLLALCPNVTSSGIQFATAQLPHLELMDCGMTICEPNSHHPTADENNRKLQKTSSTNLHLTNQKLIIKHSCLKKLSLWGCSGLDALYLNCPQLNDLNLNSCRNLHPERLLLQCPSLENVHASGCQDMLIEAIQSQGLFCNCLPGGSVFLLQSAPQTGAFMEHATRDTVRRTRQQEGSAPDAGASGSALPRPRLVAPCRWTRLAPGSCSRQGHYQSRPRAGHYQSRPAAGRYQTRPRQGRYPVAASCAALCH

SEQ ID NO: 204525 - protein, 101 aa, Glycine max
  Coding DNA Sequence Number=SeqID_87747
  Subcellular localization annotation: CTP_CleavageSite=19; ConfidenceScore=5.26e-01
MGDLICAQRQGATRGFRVRGAMRMMPRAPRCVNVSRSPWKRLPGGRFVCNAFTDMENPSPCKRLPDGSKRVQVPHLVNSESPEDEKKQRRKKRRLCNVVVD

SEQ ID NO: 204526 - protein, 62 aa, Glycine max
  Coding DNA Sequence Number=SeqID_87748
MNFSMSPRMFVESYRVSAPRKERRPLVSVLHQEPWQNPRTGARLVAQFMTCPILCNCGAQLA

SEQ ID NO: 204527 - protein, 191 aa, Glycine max
  Coding DNA Sequence Number=SeqID_87749
  Gene Ontology: Mol. function=uridine kinase activity; Biological process=biosynthetic process
  Homolog annotation: Hit_ID=Q2QMK2; Match level="QueryCoverage=68%, HitCoverage=47%, E-value=5e-22, Identity=38%"; Hit description =Phosphoribulokinase/uridine kinase family protein, putative, expressed
MKIGYKCQVCLWSTVQRTYYSYPSFANRFKGNVNHSYSNACLAAIVETYGAVDSSGKKRISRVDELYDTLVTRLLPSVSVSSNPNHKLLVGLAGPPGAGKSTLAHEVARRINKLWPEKASSFDSLVEPPDVAIVVPMDGFHLYRFELDAMENLEEAHARRGGKGSVYVPSFDHGVGDPVKMWSTHQHFINF

SEQ ID NO: 204528 - protein, 178 aa, Glycine max
  Coding DNA Sequence Number=SeqID_87750
  Gene Ontology: Mol. function=DNA binding; Biological process=DNA integration
  Homolog annotation: Hit_ID=Q1SKC8; Match level="QueryCoverage=60%, HitCoverage=32%, E-value=8e-26, Identity=44%"; Hit description =Integrase, catalytic region
MEHKAYWTLKFLNFDEVLFGGKRKLQPLELEEMGLNAYESSKLYNQKVKAYHDQKLLKKNFQPSQQVLLFNSRLKLFPDNPKRSWVVNGQRLKLYHGGNIERLSDELAKRTLRAKRGHEMASKKKCASSSRPQEPYASRFFFQKLLGSDMRLMSISENPSRSGMLSWPTPTMMNSFRN

SEQ ID NO: 204529 - protein, 152 aa, Glycine max
  Coding DNA Sequence Number=SeqID_87751
  Gene Ontology: Mol. function=helicase activity; Biological process =viral genome replication
  Homolog annotation: Hit_ID=Q1SM26; Match level="QueryCoverage=43%, HitCoverage=14%, E-value=2e-11, Identity=50%"; Hit description =Nucleic acid-binding, OB-fold
MNVVEAQYGGVFFLYGYGGTGKTFMWKTLASTIRSIGDIMLTVASSGIASLLLPGRRTAHSKFVIPLRLKGIFEMDARYRRWYTCEPNDGYVEITIPDEFLINDYNNPLEEIVNRTYPNLLQFYNNPEYLQSRSILASTIEVVDKVNEYVMS

SEQ ID NO: 204530 - protein, 236 aa, Glycine max
  Coding DNA Sequence Number=SeqID_87752
MVGSKIGATLSEDYFAEFRHLLQREERLEILVNVYDFTYFEDIIVGEAKLDTLVDIISVVVDIIEQHTQSPPYRVIVVLRDEKDVDMTITVWESYVAELGASLSKNKIEKQPLIVMLTLAKIKLPTEFILNSWYIIAYKYPLSVHNTKIASKMYINADMLEIHDFLKRYKLVIVMKHEGETKRFHFWDSVCIKMFNRSVVETRKQLQGLEQIIDKGKSIFTDTQSQETFLTVRLTM

SEQ ID NO: 204531 - protein, 117 aa, Glycine max
  Coding DNA Sequence Number=SeqID_87753
MKIQAGDTILKMGGKTLQDLFLVGSLGMQHTDSCDQTAITNGEFAEQRPCGMENATRDGDLVSGGTRHHDWRVCAWGCSGVGGAATVQAAAGAEGALTGLEIASHGGDLVVQKFFGL

SEQ ID NO: 204532 - protein, 115 aa, Glycine max
  Coding DNA Sequence Number=SeqID_87754
MEKDEGECLLQPFCPSSLYFSSSKNGWLDCGCGARVSENPLRELGRAKREKRQRAPWAGSLSQSALLSDAINVTKHLDAEDESSNLTFPSMVADSRQFEGDASSEKKRICAADTK

SEQ ID NO: 204533 - protein, 49 aa, Glycine max
  Coding DNA Sequence Number=SeqID_87755
MKDETSDKYRRNEAFGIGGSSTGWGPQRRKKKGWQKNENFSGADVVIGE

SEQ ID NO: 204534 - protein, 386 aa, Glycine max
  Coding DNA Sequence Number=SeqID_87756
  Homolog annotation: Hit_ID=Q8GSM4; Match level="QueryCoverage=14%, HitCoverage=16%, E-value=3e-08, Identity=44%"; Hit description=Ovate protein
  Pfam annotation: Domain name=DUF623; Domain location=326-385; Score =120.1; E_value=6.2e-33; Accession=PF04844.4; Description=Protein of unknown function, DUF623
  Subcellular localization annotation: CTP_CleavageSite=61; ConfidenceScore=5.15e-01
MGNYRFKLSDIIPNAWFYKLKDMGKTRKQTQTTNSRKKKQPSPVSTTKPSKPKQPHQYNLRKSYYFTRELTPNDRIYSSPTPTNNQNAKDNNSPEPPRKSSKQRLKKRTSRTSSPKLLVVSNNNNSSSSPHDNSSTESSEHPDPEFRTDRVLPTESFDETVPWANSCACRVHSNTKDIIIDVDNNSIARKDDKLEGYDYECDSFSDLVLPPIVTKPAKFNDLLSDAKKKETKTRSKMAAHEEEPNLNKGPLRVKIVKEDTASMKGQKNNYGRRFSVSSPGVRLRMNSPRIASRRVQANGRRSVSSAAAAAAARRSLSDSFAVVKSSLNPQRDFRESMVEMIVQNNIRTSKDLEDLLACYLSLNSDEYHDLIIKVFKQIWFDLTDNN

SEQ ID NO: 204535 - protein, 59 aa, Glycine max
  Coding DNA Sequence Number=SeqID_87757
MVGEGRATSGGIVDFSGFIRHNHELYTLFHFWSVWCSPTHFKGTEIGIPSTVTEMGYSH

SEQ ID NO: 204536 - protein, 101 aa, Glycine max
  Coding DNA Sequence Number=SeqID_87758
MAKFDPEIVLEFYANAWPIEEGVQDMRSWVRGQWIPFDADALSQFLGDPLVLEEGQECEFNQRRNRADGFDEEAIAQLLCIPGQDFARPLQGGGCGSCAPA

SEQ ID NO: 204537 - protein, 72 aa, Glycine max
  Coding DNA Sequence Number=SeqID_87759
MTRSLVSMLLLKVIFAAMLFVLFSLGVGNRLPFPNCHGTCLEFPDCAVHCKTIGYEIDGKCLPSSKGWCCCY

SEQ ID NO: 204538 - protein, 93 aa, Glycine max
  Coding DNA Sequence Number=SeqID_87760
MPSISKRPIKGCILSSNNPRTKLGYDKMKREKYASYSSHDSCKSLSEELSDYYRGRHRSHTKHHSQRREKDRRPQEVNISLPYFHGKDHVEAY

SEQ ID NO: 204539 - protein, 106 aa, Glycine max
  Coding DNA Sequence Number=SeqID_87761
  Subcellular localization annotation: CTP_CleavageSite=24; ConfidenceScore=5.07e-01
MATPPSSPPPPTKAASQSLFTLKPAGADRPVVHVDPATRKANDPHKKKLRTYLGIVARDKAEFDIPEASDVRTKKKVLQTVGERMCGKRHRSSKSKTLPPRVSWGL

SEQ ID NO: 204540 - protein, 136 aa, Glycine max
  Coding DNA Sequence Number=SeqID_87762
  Gene Ontology: Mol. function=transition metal ion binding
MSKNWVLKKHNKTFLDWFKDIIFADENASKMLRKLAYRLKRNVITWQGYDINKYSFYTKAQDEKSTMQNSGITLRAESQHFTTVLHGKTIGVNVEDDDSYIDTYVSPLSTQMSTNIVGEEEVDDVHTNRNDHDEGE

SEQ ID NO: 204541 - protein, 89 aa, Glycine max
  Coding DNA Sequence Number=SeqID_87763
MQSQGLALPSKPEVGPSAAHVSTMESCVDSSGNDPDTEGTSTWVVVNENKRGYISCGSVLVEGTSPRLFKENKGGYIPCGSLLVKGFLQ

SEQ ID NO: 204542 - protein, 308 aa, Glycine max
  Coding DNA Sequence Number=SeqID_87764
MADGKLIEMKGRVNLGLESENGVNPSLKCHLGLMRKLRLLGSGRFQADPNGHNVDFCARDFQNEDKGYVGVRELSEGGQLGMVGLCVICGCGELTCTIARPPPSTTCDGVVPRDMSRGSGDLGDVRRAPGSQPIKEQRPQSKEACVVAGQLLRNGTGMLKGPLVIDYQCCVIDYTEEQVTVEMECLEGAWETLEGNARCRFWGTIRFTATSLVHPEEPARTLQRTVEWILPTPTPYHLVEPVQVIEVTSSEEDPEEDPEELPPEPAVDALDFLEGDEDSLPEVDSPEDVMSASEADSTEECGPGEMAT

SEQ ID NO: 204543 - protein, 99 aa, Glycine max
  Coding DNA Sequence Number=SeqID_87765
MIDVGVLIRTRFYFTLVKHGINQKPSLKKRFYPVKVKSLGITSLRELGRLMGQLQRQAFRKAYGKIWDLARVEVSMEPIASLSQYYDQPLRCFTFRTSS

SEQ ID NO: 204544 - protein, 122 aa, Glycine max
  Coding DNA Sequence Number=SeqID_87766
MFSGLDLVVPKFCPGTIVVGAWTLVDHFETLDTHHRVIRKVPRCFKKKSAKNTKTGLHLSNLGVKLHPEHSRRWGVLINCGLRSENFLRNPLERDVNLSIGGCAQKSSLGSLWAATTSLFLL

SEQ ID NO: 204545 - protein, 84 aa, Glycine max
  Coding DNA Sequence Number=SeqID_87767
MRESYANIVALMEKHLGKSIATEGGTPEKKDKPESSEVKNDVTLEFRQSAKKVELPSFDGDDPAGWISRAEVYFRVQGTTPAVK

SEQ ID NO: 204546 - protein, 187 aa, Glycine max
  Coding DNA Sequence Number=SeqID_87768
  Gene Ontology: Mol. function=hydrolase activity
  Homolog annotation: Hit_ID=Q7XDP2; Match level="QueryCoverage=46%, HitCoverage=42%, E-value=9e-36, Identity=86%"; Hit description =Inosine triphosphate pyrophosphatase, putative, expressed
  Pfam annotation: Domain name=Ham1p_like; Domain location=13-155; Score=-50.3; E_value=4.7e-06; Accession=PF01725.7; Description=Ham1 family
MAAARGLVLSRPVTFVTANAKKLEEVRAILGNSIPFQSLKLDLPELQGEPEDISKEKARIAALQVNGPVLVEDTCLCFNALKGLPGPYMFSHGKKNRYKLEAQAVKHKGAMLGIMVQNLAFIWQWLLNLGNPQGLLLKFGIRKYDMATDMLMQLLLRPFYTEKLIWTASTRVRLSSNRQDNAYIFQT

SEQ ID NO: 204547 - protein, 49 aa, Glycine max
  Coding DNA Sequence Number=SeqID_87769
MTLKRYRRRRDSLGLMKGTISVRAQRHCWAIGQIALCGCIWLVKLIWQV

SEQ ID NO: 204548 - protein, 113 aa, Glycine max
  Coding DNA Sequence Number=SeqID_87770
  Gene Ontology: Mol. function=transferase activity; Cellular component= nucleus; Biological process=metabolic process
  Homolog annotation: Hit_ID=Q9M1G7; Match level="QueryCoverage=95%, HitCoverage=16%, E-value=1e-37, Identity=81%"; Hit description =Histon acetyltransferase HAT1
  Pfam annotation: Domain name=Bromodomain; Domain location=1-78; Score= 96.7; E_value=6.9e-26; Accession=PF00439.15; Description=Bromodomain
MFDHADAWPFKEPVDARDVPDYYDIIKDPMDLKTMSKRVDSEQYYVTFEMFVADARRMFANARTYNSPETIYYKCSTRHVLVLPPPGWVRSPLSKQSASRPPAWYQNSVGTLQ

SEQ ID NO: 204549 - protein, 461 aa, Glycine max
  Coding DNA Sequence Number=SeqID_87771
  Gene Ontology: Mol. function=N-acetyltransferase activity; Cellular component=Ada2/Gcn5/Ada3 transcription activator complex; Biological process=metabolic process
  Homolog annotation: Hit_ID=Q9M1G7; Match level="QueryCoverage=89%, HitCoverage=70%, E-value=1e-111, Identity=54%"; Hit description =Histon acetyltransferase HAT1
  Pfam annotation: Domain name=Acetyltransf_1; Domain location=242-320; Score=35.8; E_value=1.5e-07; Accession=PF00583.14; Description =Acetyltransferase (GNAT) family
  Subcellular localization annotation: CTP_CleavageSite=51; ConfidenceScore=5.47e-01
MDFHGGGPLRSRSSQSPSPSHSASASATSSIHKRKLVSEDHAPPFPPSSFSADTRDGALTSNDDLESISARGADSDSDSESEDAVVDDDEDDYDNDNDNDSSMRTFTASRLSNPPSAPRNTKLKTENSTVKIENSDGAKDAGAVGSGAAAAAGPVPGIVVKEDPTKIFTDNLQTSGAYTAREESLKKEEEAGKLKFVCLSNDGVDEHMVWLIGLKNIFARQLPNMPKEYIVRLVMDRSHKSVMVIRRNHVVGGITYRPYASQRFGEIAFCAITADEQVKGYGTRLMNHLKQFARDMDGLTHFLTYADNNAVGYFIKQKNRVTWLKGLTVLWNLYLVLRYSRSDAGICIFLLVLSFDSLEGIYKRDSLGERSMARDYDGGILMECKIDPKLPYTDLSTMIRRQRQAIDEKIRELSNCHIVYAGIDFQKKEAGIPKKIIDDIPGLNVNLLSKFLCTGANLFAA

SEQ ID NO: 204550 - protein, 376 aa, Glycine max
  Coding DNA Sequence Number=SeqID_87772
  Homolog annotation: Hit_ID=Q6V8P1; Match level="QueryCoverage=29%, HitCoverage=83%, E-value=2e-18, Identity=47%"; Hit description =Putative senescence-associated protein SAG102
  Pfam annotation: Domain name=DUF581; Domain location=291-349; Score =69.6; E_value=1e-17; Accession=PF04570.5; Description=Protein of unknown function (DUF581)
  Subcellular localization annotation: CTP_CleavageSite=41; ConfidenceScore=5.34e-01
MADSSSNFSLPCDALSLRQKSFSIFHTGGSRLGVGAKGLPDSESVWSPTSPLDCRLFSNLSNPFSAKSSRPSFQTGHKKQFDGSKVGLGIISSLANETKLNNDILAKFKRKGIIFGPQVKTGILKFSNNNQESLVPYLKSNSLPKNYVISLPSETTIPKSELENFDDVSGKKDDYWECEAFKSTITSLPDSFSPSSLINSTQNSNLGINELGVGNNASVLMSLPQVTSKVSQVGSLSAREIELSEDYTCIISHGPNPKRTHIFGDCILECHNHDFTEFSKKEEPAFSYSQVPSFSDGSAPYPSDNVLSFCYSCNKKLVKEEDIYRYRGEKAFCSFECGSEEILTGEELEKTCTNSAESSPDSSYHDLFLTGLLLSK

SEQ ID NO: 204551 - protein, 52 aa, Glycine max
  Coding DNA Sequence Number=SeqID_87773
MCPPTTSDAIAYRAVNRSSSIITTTSRILEIHTMEDEERGRTTDKKRRMKEK

SEQ ID NO: 204552 - protein, 160 aa, Glycine max
  Coding DNA Sequence Number=SeqID_87774
  Gene Ontology: Mol. function=RNA-directed DNA polymerase activity; Cellular component=nucleus; Biological process=RNA-dependent DNA replication
  Pfam annotation: Domain name=AT_hook; Domain location=116-128; Score =14.9; E_value=0.061; Accession=PF02178.9; Description=AT hook motif
MKVVETVAGVNVPIKLKGKFYRTAVRPAILYGTECWAVKSQHENKVGVAEMRMLRWMCGKTGQDKIKNEAIRERVGVAPIVEKMVKNRLRWFGHVERRPVDSVVRRVDQMERRQTIRGRGRPKKTIREVIKKDLEINGLDRSMILDRTLWWKLSRPHLVG

SEQ ID NO: 204553 - protein, 168 aa, Glycine max
  Coding DNA Sequence Number=SeqID_87775
MDGIEDDARYPPNPYGYGYQNSLYSPPVDTEYALDDNDENEEHVQLEGEDEVDVDQSNNLQLPQKDDDEEDGMDGGGDENDDDEEEEAEENKQIDYYPTKSDEDEVEWHPKKQKLKSLISTYELAPRVPAPSVAATAPSVPKPSSGGRNSLTDWTERETFVLLDAWGD

SEQ ID NO: 204554 - protein, 586 aa, Glycine max
  Coding DNA Sequence Number=SeqID_87776
  Gene Ontology: Mol. function=sulfate porter activity; Cellular component=integral to membrane; Biological process=sulfate transport
  Homolog annotation: Hit_ID=Q6ZXB7; Match level="QueryCoverage=99%, HitCoverage=99%, E-value=0.0, Identity=62%"; Hit description=Plasma membrane sulphate transporter
  Pfam annotation: Domain name=STAS; Domain location=459-574; Score =95.0; E_value=2.3e-25; Accession=PF01740.11; Description=STAS domain
  Pfam annotation: Domain name=Sulfate_transp; Domain location=186-436; Score=332.7; E_value=6.4e-97; Accession=PF00916.10; Description =Sulfate transporter family
  Pfam module annotation: Pfam domain module=STAS::Sulfate_transp; Domain location=459-574::186-436
MGVNSNRVEHFASHDSAIEETMQIHAVQLPPHQTTLHKLRHRVSEIFFPDDPLHRFKNQTRFKKFLLALQYLFPIFDWAPNYNLTLLRSDLISGLTIASLAIPQGISYAKLANLPPILGLYSSFVPPLIYSLLGSSRHLGVGPVSIASLVMGSMLSDKISYTQEPILYLGLAFTATFFAGVFQASLGILRLGFVIDFLSKATLVGFTGGAAIIVSLQQLKGLLGIVHFTSKMQIIPVTISVFKQRHEIGHLPKGVNPPSANMLYFNGPYLALAIKTGIITGILSLTEGIAVGRTFASLKNYQVDGNKEMMAIGLMNIAGSCSSCYVTTGSFSRSAVNYNAGAQTTVSNIIMAAAVLVTLLFLMPLFYYTPNVVLAAIIITAVIGLIDYQSAYKLWKVDKLDFLACLCSFFGVLFISVPLGLGIAVIISVLKILLHVTRPNTLVLGNIPGTQIFHNINQYKKALRVPSFLILAVESPIYFANSTYLQERILRWVREEEEHIKANNGAPLKCIILDMTATDTSGLDTLCELRKMLEKRSLEFVLANPVGNVMEKLHKSNILDSFGLKGVYLTVGEAVTDISSIWKAQP

SEQ ID NO: 204555 - protein, 631 aa, Glycine max
  Coding DNA Sequence Number=SeqID_87777
  Gene Ontology: Mol. function=binding; Cellular component =mitochondrion; Biological process=embryonic development ending in seed dormancy
  Homolog annotation: Hit_ID=Q6ETX2; Match level="QueryCoverage=98%, HitCoverage=97%, E-value=0.0, Identity=65%"; Hit description =Putative pentatricopeptide (PPR) repeat-containing protein
  Pfam annotation: Domain name=PPR; Domain location=119-153; Score=5.1; E_value=1.9; Accession=PF01535.11; Description=PPR repeat
  Pfam annotation: Domain name=PPR; Domain location=154-188; Score=4.3; E_value=2.3; Accession=PF01535.11; Description=PPR repeat
  Pfam annotation: Domain name=PPR; Domain location=189-223; Score =21.1; E_value=0.0041; Accession=PF01535.11; Description=PPR repeat
  Pfam annotation: Domain name=PPR; Domain location=225-259; Score =45.7; E_value=1.6e-10; Accession=PF01535.11; Description=PPR repeat
  Pfam annotation: Domain name=PPR; Domain location=260-294; Score =34.0; E_value=5.3e-07; Accession=PF01535.11; Description=PPR repeat
  Pfam annotation: Domain name=PPR; Domain location=295-329; Score =43.6; E_value=6.6e-10; Accession=PF01535.11; Description=PPR repeat
  Pfam annotation: Domain name=PPR; Domain location=330-364; Score =35.1; E_value=2.4e-07; Accession=PF01535.11; Description=PPR repeat
  Pfam annotation: Domain name=PPR; Domain location=365-400; Score=9.5; E_value=0.56; Accession=PF01535.11; Description=PPR repeat
  Pfam annotation: Domain name=PPR; Domain location=401-435; Score =49.0; E_value=1.5e-11; Accession=PF01535.11; Description=PPR repeat
  Pfam annotation: Domain name=PPR; Domain location=436-470; Score =12.7; E_value=0.23; Accession=PF01535.11; Description=PPR repeat
  Pfam annotation: Domain name=PPR; Domain location=471-505; Score =41.5; E_value=2.9e-09; Accession=PF01535.11; Description=PPR repeat
  Pfam annotation: Domain name=PPR; Domain location=506-540; Score =45.9; E_value=1.4e-10; Accession=PF01535.11; Description=PPR repeat
  Pfam annotation: Domain name=PPR; Domain location=541-575; Score =29.7; E_value=1e-05; Accession=PF01535.11; Description=PPR repeat
  Pfam annotation: Domain name=PPR; Domain location=576-610; Score =37.8; E_value=3.8e-08; Accession=PF01535.11; Description=PPR repeat
  Pfam module annotation: Pfam domain module=PPR::PPR::PPR::PPR::PPR::PP R::PPR::PPR::PPR::PPR::PPR::PPR::PPR::PPR; Domain location=119 -153::154-188::189-223::225-259::260-294::295-329::330-364::365 -400::401-435::436-470::...
  Pfam module annotation: Domain location=471-505::506-540::541 -575::576-610
MRRISTFPPFCQRLKQTENEIAQMFRLPNSHEGNHLNNSMKGGHVLRRDPYSRTLDERFIRILKIFKWGPDAEKALEVLKLKVDPRLVREILKIDVEVSVKIQFFKWAGKRRNFEHDSTTYMALIRCLDEHRMFGEVWKTIQDMVKGSCAMAPAELSEIVRILGKAKMVNRALSVFYQVKGRKCRPTASTYNSIILMLMQEGHHEKVHELYNEMCSEVHCFPDTVTYSALISAFAKLNRDDSAIRLFDEMKENGLQPTAKIYTTLMGIYFKVGKVEEALGLVKEMRARRCLLTVFTYTELIRGLGKSGRVEDAYMTYKNMLKDGCKPDVVLMNNLINILGRSNHLRDAIKLFDEMKLLNCAPNVVTYNTIIKSLFEAKAPLSEASSWFERMKKDGIVPSSFTYSILIDGYCKTNRVEKALLLLEEMDEKGFPPCPAAYCSLINTLGVAKRYDVANELFQELKENCGCSSARVYAVMIKHFGKCGRLNEAINLFNEMKKLGCTPDVYAYNALMTGMVRAERMDEAFSLFRTMEENGCTPDINSHNIILNGLARTGGPKGALEMFTKMKNSTIKPDVVSFNTILGCLSRAGLFEEAAKLMQEMSSKGFQYDLITYSSILEAVGKVDDCKMVES

SEQ ID NO: 204556 - protein, 726 aa, Glycine max
  Coding DNA Sequence Number=SeqID_87778
  Gene Ontology: Mol. function=peptidyl-prolyl cis-trans isomerase activity; Biological process=protein folding
  Homolog annotation: Hit_ID=Q9LY75; Match level="QueryCoverage=71%, HitCoverage=79%, E-value=6e-75, Identity=51%"; Hit description =Peptidyl-prolyl cis-trans isomerase
  Pfam annotation: Domain name=Pro_isomerase; Domain location=67-233; Score=321.3; E_value=1.7e-93; Accession=PF00160.11; Description =Cyclophilin type peptidyl-prolyl cis-
MANWANMDSPNVVRHSPRRMCFLSHCPKLRKKEPFFAIVSDTEPSPPFIHAFMCLLSKVMGLEKNPRVFFDVSIDGDPVERIVIQLFASIVPRTAENFRALCTGEKGIGESTGKPLHYKGTSLHRIIRGFMAQEKIFDPACTGGESIYGGKFADENFKLTHDGPGILSMANSGPNTNGSQFFITFKRQPHLDGKHVVFGKVVNGIDILKKIEQVGTSDGKPTQPVKIIDCGEVSETKIQHTAEKEKGKRRKSGKSLSSDDGSDKKSRGKRKKSSKDTRKRRRRYSTSDSDSYSSDSESDSDSESDSSVSDSSSSSDGKHQKRRRNKHKHGKKRKIGRKQRKRSQHGRTKKSRHKSRRSSEDSSDTNSDSASGSSSSDEKADRHASGRKAPADNKAQRNLDTGKQFSNPSCQRQTIPEQTMDPKVRRIVDKQSHEEGEFSPENGAFVNNRHDTQAEFSKPAKQHANSDDSNHNRGASPGRSPTRDSGELNQGRALLLASPGKKSPGQKASEPPAPKHGQGFSKSPSPNSMPKRIKKGRGFTERYAFARRYRTPSPERSPPHSYRYGDRNIRRNFDRNTSYRSYSGRSPPRRFRSPPGGRNRPRYQSRRSRSRSISGSPVRGRFRERDRSRSPRRSPSPEDRLPLISDRLKSRLGPRSDEGLRDRGRSRSRSKSRSKGSSHSRSPDATPPKRYDKRTSVPRSRSRSSSASGQKGLVSYGDASPDSGSR

SEQ ID NO: 204557 - protein, 40 aa, Glycine max
  Coding DNA Sequence Number=SeqID_87779
MYSSRPRDIDALRLGVDKRAWVHELARGIAVRAVLWVRPA

SEQ ID NO: 204558 - protein, 108 aa, Glycine max
  Coding DNA Sequence Number=SeqID_87780
  Gene Ontology: Mol. function=peroxidase activity
  Homolog annotation: Hit_ID=Q00XU9; Match level="QueryCoverage=70%, HitCoverage=20%, E-value=4e-13, Identity=40%"; Hit description =Homology to unknown gene
  Subcellular localization annotation: CTP_CleavageSite=42; ConfidenceScore=5.17e-01
MTMITPSSKLTLTKGNKSWYRAPPRGRRFLEETNCVGMCINLCKMPSQSFIKDTLGMPVNMVPNFDDMSCEMIFGQEPPASTDDPALKQPCYKLCKAYKKHGTDCLSS

SEQ ID NO: 204559 - protein, 1000 aa, Glycine max
  Coding DNA Sequence Number=SeqID_87781
  Gene Ontology: Mol. function=hydrolase activity, acting on acid anhydrides, in phosphorus-containing anhydrides; Cellular component =cellular_component; Biological process=nucleobase, nucleoside, nucleotide and nucleic acid metabolic process
  Homolog annotation: Hit_ID=UPI0000E8143C; Match level="QueryCoverage =71%, HitCoverage=59%, E-value=1e-153, Identity=39%"; Hit description= PREDICTED: similar to TNFRSF6B
  Pfam annotation: Domain name=DEAD; Domain location=18-273; Score= -40.3; E_value=0.014; Accession=PF00270.19; Description=DEADDEAH box helicase
  Pfam annotation: Domain name=DEAD_2; Domain location=99-263; Score =251.8; E_value=1.4e-72; Accession=PF06733.6; Description=DEAD_2
  Pfam module annotation: Pfam domain module=DEAD::DEAD_2; Domain location=18-273::99-263
MPTYKIRGIDVDFPYEAYESQLVYMDKVIQSLQEKCNALLESPTGTGKTLCLLCATLAWRKSLGSFTTGVSMQADDKSEGKNDVSSSQSESSRFSTIVYASRTHSQIRQVIQELKRTSYRPKMVVLGSREQLCIHDEVKLLRGKTQTNACRLLCRRRGKRHCNHFKKVPEYMKDNPQLGEEPVDIEDLVNIGRRFGPCPYYLSKELHKFVDIVFAPYNYLIDRGYRKSLQLSWSNSILIFDEAHNLESICADAASFDLPSWLLTACISEAESCIDLSIERRDKSNDKSQNPDDFAILRALLLKLEKRIAEVPIESKELGYTKPGPYIYELLADLNITHKTASKLRDIVAVASTLLEEHNQQKSTGTVCRLDRIGEILDMVFRDGRTAHAKYYRVHLREVEAWSGNGSKGKVSRTLSWWCFNPGIAMEDFPKYGVRSIILTSGTLSPMESFAQELKLDFPIRLENPHVITANQIWAGVLPVGPSGRTFNSSYRTRDSPEYKQELGNAIVNLARIVPDGLLVFFPSYYLLDQIIACWKSSNENSTSIWDRICKHKKPVIEPRDSSSFPLSIKDYMTTLNDTSASGAIFFAVCRGKVSEGLDFADHAGRAVVITGLPFATSTDPKVRLKREYLDQQSRPQGELFKHICLTGDEWYNQQASRAVNQAVGRVIRHRYDYGAIIFCDERFSHPHRQSQVSRWIQPHIKCFSRFGEVVFTLTRFFRDVGTQGPTKVSMLEAKNGGNIGEIPSSDQNMDKFHKEKLLSHLATPMTQNFSASSLLDTKKGCTSFLGEIVPANRSSLFSDNGKTVHCESSRNICGKVLLGERKTLQSQECDRLDLADDCQLGEKSKDTPIAPCSSKKRRFITGDYDLKQYFGNSNEHSSSASQSAQGGVDLRHKDGVASDSLELIRQKGNLPDDFVPSVGDETKGSAFLAQVRDKLSAAEYINFVGYMKALKTKTMKISEVLQCISRLFTGPDRLPLLKRFKDYIPAKYHSLYEHYVEKK

SEQ ID NO: 204560 - protein, 173 aa, Glycine max
  Coding DNA Sequence Number=SeqID_87782
  Gene Ontology: Mol. function=nucleotide binding; Cellular component =membrane; Biological process=small GTPase mediated signal transduction
  Homolog annotation: Hit_ID=Q2QLR7; Match level="QueryCoverage=80%, HitCoverage=47%, E-value=2e-34, Identity=60%"; Hit description=Ras -related protein RHN1, putative, expressed
  Pfam annotation: Domain name=Miro; Domain location=23-134; Score=2.4; E_value=0.0032; Accession=PF08477.3; Description=Miro-like protein
  Pfam annotation: Domain name=Ras; Domain location=23-163; Score=50.6; E_value=4.6e-13; Accession=PF00071.12; Description=Ras family
  Pfam module annotation: Pfam domain module=Miro::Ras; Domain location= 23-134::23-163
MARPGNKIIQAKLVVRYPIPSQVLLGDMGTGKTSIALRFVKGHFFPNQHSLGILPLIYAQEPTIGAAFFTQILSLSEATVKFDVWDTAGQERYHSLAPMYYRGAAAAIVVYDISSVDTFVRAKKMGSGIANTCNTSTSNGSEETSTRNGSKETHEGRPKRNATRPTYMNDYST

SEQ ID NO: 204561 - protein, 1053 aa, Glycine max
  Coding DNA Sequence Number=SeqID_87783
  Gene Ontology: Mol. function=hydrolase activity, acting on acid anhydrides, catalyzing transmembrane movement of substances; Cellular component=integral to membrane; Biological process=calcium ion transport
  Homolog annotation: Hit_ID=Q93YX6; Match level="QueryCoverage=99%, HitCoverage=100%, E-value=0.0, Identity=77%"; Hit description=Type IIB calcium ATPase
  Pfam annotation: Domain name=Cation_ATPase_C; Domain location=891 -1030; Score=49.2; E_value=1.4e-11; Accession=PF00689.11; Description= Cation transporting ATPase, C-terminus
  Pfam annotation: Domain name=Cation_ATPase_N; Domain location=109 -193; Score=37.1; E_value=6e-08; Accession=PF00690.16; Description =Cation transporterATPase, N-terminus
  Pfam annotation: Domain name=E1-E2_ATPase; Domain location=208-457; Score=209.6; E_value=7.1e-60; Accession=PF00122.10; Description=E1 -E2 ATPase
  Pfam annotation: Domain name=Hydrolase; Domain location=461-795; Score=67.3; E_value=4.9e-17; Accession=PF00702.16; Description =haloacid dehalogenase-like hydrolase
  Pfam annotation: Domain name=Hydrolase_3; Domain location=611-819; Score=-84.1; E_value=0.03; Accession=PF08282.2; Description=haloacid dehalogenase-like hydrolase
  Pfam module annotation: Pfam domain module=Cation_ATPase_C::Cation _ATPase_N::E1-E2_ATPase::Hydrolase::Hydrolase_3; Domain location=891 -1030::109-193::208-457::461-795::611-819
  Subcellular localization annotation: CTP_CleavageSite=46; ConfidenceScore=5.01e-01
MSNSQNPNYDGSSFLIDITTTVNYTISTAKKRWRFAYTAIYSRRVMLSLAKEIISKRNTNTHPYSKLFQTQSTGSGSTLDIIEPLIPQHGTNNHYSLVPDVDKARLASMVKDKNLEAFVEFGRVEGVANTLGTIPAKGISGDDDDVAKRCELFGSNTYQRPPPKVFVSFVVEAFNDTTILILLVCAGLSLGFGIKEHGPGEGWYEGGSIFVAVFLVVVVTALSNFRQERQFDKLSKISNNIKVGVVRNGRPQQISIFEVLVGDVVSLKIGDQIPADGLFLSGHSLQVDESSMTGESDHVEIEPSNSPFLLSGAKVVDGFAQMLVTSVGTNTAWGEMMSSISRDTKERTPLQARLDKLTSSIGKVGLAVAFLVLIVLLIRYFTGNSEDDKGNQEFQGSKTDVNDVFNAVVRIVAAAVTIVVVAIPEGLPLAVTLTLAYSMKRMMADQAMVRKLSACETMGSATVICTDKTGTLTLNQMRVTKFWLGLENGMENFSNAMAPNVLELFHQGVGLNTTGSIYKPSSESEPEISGSPTEKAILLWAVSDLGMDMDELKRTHEVLHVETFNSEKKRSGVAIRKETNNTVHVHWKGAAEIILAMCSNYIDYNGIEKSLDEDRSKLEKIIQGMAASSLRCIAFACMKISEDIDYNDKEKVHQILRKDGLTLLGIVGLKDPCRPDVKKAVETCKLAGVSIKMITGDNIFTAKAIATECGILDLDGHVNAGEVVQGVEFRNYTEEERMEKVEKIRVMARSSPLDKLLMVQCLKKKGHVVAVTGDGTNDAPALKEADIGLSMGIQGTEVAKESSDIVILDDNFNSVATVLRWGRCVYNNIQKFIQFQLTVNVAALVINFIAAVSSGDVPLTTVQLLWVNLIMDTLGALALATERPTKELMEKRPVGRTEPLITSIMWRNLLAQALYQIAVLLVLQFKGKSIFNVNGKVKDTLIFNTFVLCQVFNEFNSRSMEKLNVFQGIHKNHLFLGIVGITLVLQVLMVELLRKFADTERLTWEQWGICIVIAAVSWPIAWITKLVPVSDRTFFSHHVKWVKLWVFKIKHLF

SEQ ID NO: 204562 - protein, 90 aa, Glycine max
  Coding DNA Sequence Number=SeqID_87784
  Gene Ontology: Mol. function=binding; Cellular component =mitochondrial inner membrane; Biological process=transport
  Homolog annotation: Hit_ID=Q8LB35; Match level="QueryCoverage=86%, HitCoverage=26%, E-value=2e-19, Identity=58%"; Hit description =Putative carnitine/acylcarnitine translocase
  Pfam annotation: Domain name=Mito_carr; Domain location=11-87; Score =33.3; E_value=8.6e-07; Accession=PF00153.17; Description =Mitochondrial carrier protein
MEFWPEFLASSTGKEFVAGGFGGTAGIISGYPLDTLRVMQQSSNNGSAAFTILRNLVAKEGPTALYRGMAAPLASVTFQMYNCGSHLNGR

SEQ ID NO: 204563 - protein, 833 aa, Glycine max
  Coding DNA Sequence Number=SeqID_87785
  Gene Ontology: Mol. function=protein serine/threonine kinase activity; Biological process=protein amino acid phosphorylation
  Homolog annotation: Hit_ID=Q5JKA2; Match level="QueryCoverage=32%, HitCoverage=39%, E-value=1e-73, Identity=45%"; Hit description=KI domain interacting kinase 1-like protein
  Pfam annotation: Domain name=LysM; Domain location=111-154; Score =24.9; E_value=0.00028; Accession=PF01476.10; Description=LysM domain
  Pfam annotation: Domain name=LysM; Domain location=172-212; Score =1.3; E_value=0.44; Accession=PF01476.10; Description=LysM domain
  Pfam annotation: Domain name=Pkinase; Domain location=576-786; Score=- 1.9; E_value=1.9e-08; Accession=PF00069.15; Description=Protein kinase domain
  Pfam annotation: Domain name=Pkinase_Tyr; Domain location=576-786; Score=-17.4; E_value=2.1e-11; Accession=PF07714.7; Description =Protein tyrosine kinase
  Pfam module annotation: Pfam domain module=LysM::LysM::Pkinase::Pkinas e_Tyr; Domain location=111-154::172-212::576-786::576-786
MALVERVQVRIPLLLLLTLTPTAVAVGFRCWERTTCPALLGYKSPVPTTIGAIQRLFNVTGVADILAANNLPEWTLPNNFTVEENRLLRIPLECDCSGPGLYGEPSNPLVYTVRKGDNISYLATTVFSGLVASTDIQHGNNVTNLRTGQELRVPLPCSCGKVNGLDVLHFGLTLEYGSTTLEQIAHEYHVSSQTITTSNQPHLMFGRALDIPLPVCSSMVRKDSLDHPLLVPNGSYVYTANGCVKCYCDATKNWKLTCEPSKLRPTNWSTCPSMKCDSSISSNMYIGDTTYSSSHNLAICAYAGYGTQTIFTTLTAVYIPPVLDAIVDKGYSELIGAITTSCYSHFVQIRNYRLRPFHVATPISPTASRRSWHSKVGCKLCDMRITSTDGFDYFPSNKPTLTLQLQHSNSQTASLMRRCYVCVCEWHAMKHCHCHWAFQGPHLTITNNAHWARPGAAVKLCLGDLLVMSSNPETASLHMQGLFTMNVESRWWAWLIVIAGVFVVLIFGYLCCIIWRKCKIEADRKKKQKELLLEIGVSSVACIVYHKTKRHRKRSKVNYEMQIFSFPIIAAATGNFSVANKLGQGGFGPVYKGVLPDGQEIAIKRLSSRSGQGLVEFKNEAELVAKLQHTNLVRLSGLCIQNEENILIYEYLPNKSLDFHLFVILDSEVVEVKTKRVVGTYGYMSPEYVIKGIISTKTDVFSYGVLVLEIVSGKKNNSRYQADYPLNLIGFAWQLWNEGKGVELIDSSMLESCRTAEVLRCTQVALLCVQANAADRPSMLEVYSMLANETLFLPVPKQPAYFTDACANEKNALVGNGKSYSTNEVTISMMDAR

SEQ ID NO: 204564 - protein, 200 aa, Glycine max
  Coding DNA Sequence Number=SeqID_87786
  Homolog annotation: Hit_ID=Q10EQ8; Match level="QueryCoverage=59%, HitCoverage=53%, E-value=9e-16, Identity=37%"; Hit description =Expressed protein
MRFSKASFYTLLLRKPHNHHHQNYVVLSRRRVVTLPVGVLILLSALYIFWPSGPDLKIVGLKLRRIKVHPVPPITIDISMLLTLRVHNVDVYFMDFGAVNVAVAYRGKMLGHVTSRRMHVRARGSSYVDADVEFAGISVLPELVLLLEDVARETIFRDGQSVAVSIVSRSVSELVSYYQIRIFEAYDETRHCFIRLKIRL

SEQ ID NO: 204565 - protein, 750 aa, Glycine max
  Coding DNA Sequence Number=SeqID_87787
  Homolog annotation: Hit_ID=Q9C824; Match level="QueryCoverage=93%, HitCoverage=93%, E-value=1e-156, Identity=58%"; Hit description=BZIP protein, putative; 48652-45869
  Pfam annotation: Domain name=DUF630; Domain location=1-60; Score =117.7; E_value=3.3e-32; Accession=PF04783.3; Description=Protein of unknown function (DUF630)
  Pfam annotation: Domain name=DUF632; Domain location=288-618; Score =453.1; E_value=3.5e-133; Accession=PF04782.3; Description=Protein of unknown function (DUF632)
  Pfam module annotation: Pfam domain module=DUF630::DUF632; Domain location=1-60::288-618
MGCNQSKIENEEAVARCKERKRFMKDSVSSRNAFAAAHSSYATCLKNTGAALGDFAHGEVQNPQLHSNDNNTTSSSSSYVPAPQPFEIPLPPPPLPDFSPAQPLQRAASMPEIKINNPDSRPRPEPVTTIIEEDDEEDKELENEGSLRKRRSNRVNSNNRRVPEEEQQRQPPPPSSKQPDHVTHHHHHSSMAPDTQSGAWEYFFPSMENIAGTSLNAAEEDAVHKVHEIERKVFEEKPSRVVLEEDEAVTPVRKVQVPEPEPEPKPQPDPEPEPLNVPEEMMETPVSMKMKQTPSSVDGKRIVVQRSVNLLQIFANLDDHFLKASEAAHEVSKMLEATRLHYHSNFADNRGHIDHSARVMRVITWNRSFKGIPNLDDGKDDFDSDEHETHATILDKLLAWEKKLYDEVKAGELMKFEYQRKVAALNKLKKRGTHSEALEKAKAVVSHLHTRYIVDMQSLDSTVSEINRLRDEQLYPRLIQLVDGMATMWKTMLEHHVKQSDTVTSLRNLDISQSPKTTSEHHYDRTYQLVLVVQQWHSHFEKLVNHQKGYIKALNTWLKLNIIPIESNLKEKVSSPPRVRSPPIQGLLNAWNDRLDKLPDELARTAIGNFVNVIETIYHQQEEEIALKRKCEDTRKELSRKTRQFEDWYNKYMQKKIPDEYNPDRAEDANAPDEVVTERQFAVELVKKRLEDEEEAYARQCLQLGAVIVHVSGSCSIPLGPPFVGFLAAISSAGFLTAITSAGVAYTKIT

SEQ ID NO: 204566 - protein, 111 aa, Glycine max
  Coding DNA Sequence Number=SeqID_87788
MVLPLNKSFSPTHVNAAGRYTVVPTLRMEKCAMINWCALDSLSGDARAARHAIVKHGIRCGSKVEVATPCAIALNLVISNLSATSEKAVMEALKETETSMRIVGNRKDFAE

SEQ ID NO: 204567 - protein, 539 aa, Glycine max
  Coding DNA Sequence Number=SeqID_87789
  Gene Ontology: Mol. function=microtubule motor activity; Cellular component=microtubule associated complex; Biological process =microtubule-based movement
  Homolog annotation: Hit_ID=Q9AVP4; Match level="QueryCoverage=99%, HitCoverage=81%, E-value=0.0, Identity=73%"; Hit description=BY-2 kinesin-like protein 10
  Pfam annotation: Domain name=Kinesin; Domain location=35-348; Score =409.7; E_value=4.1e-120; Accession=PF00225.13; Description=Kinesin motor domain
MPASNAYDANSLYQPGGGRSFDDSEPYMLSKQTGRARAPENILKSFPADKEKTNSVAKIKVVVDLTQYVEKHEFVFDAVLNEEVTNDEVYRETVEPIVPIIFERTKATCFAYGQTGSGKTYTMKPLPLKASRDILRLMHHTYRNQGFQLFVSFFEIYGGKLFDLLNDRKKLCMREDGKQQVCIVGLQEYRVSDVENIKDLIEKGNSTRSTGTTGANEESSRSHAILQLAIKRSVDGNESKPPRLVGKLSFIDLAGSERGADTTDNDKQTRIEGAEINKSLLALKECIRALDNDQGHIPFRGSKLTEVLRDSFVGNSRTVMISCISPSTGSCEHTLNTLRYADRVKSLSKGNNSKKDVLSSNFNLKESSTVPLSSVTGSAYEDRTTDGWPDENEWDDFSPSEEYYEQVKPPLKKNGKMELYATTDDKLKKPSGQIKWKDLPKFEPQTTHAEDDLNALLQEEEDLVNAHRTQVEETMNIVREEMNLLVEADQPGNQLDDYITRLNAILSQKAAGILQLQTRLAHFQKRLKEHNVLVSSTGY

SEQ ID NO: 204568 - protein, 117 aa, Glycine max
  Coding DNA Sequence Number=SeqID_87790
MAKAPNRYPSPLTRILVLILVNETQNDREIRENETHRLAFCLIVNTSLIEVTTIFHHPRAMVGMPVLWLVMDELDRDWMASQGPVEETATKAHCILSTTHLLVMLCKLQIEEKLPKW

SEQ ID NO: 204569 - protein, 474 aa, Glycine max
  Coding DNA Sequence Number=SeqID_87791
MMTKVMTEKFKDQSKNNSSKSKINQRTTQVNQEEFKTQEESLESRIKIQGSRSQESSFKVQDLKNQDQDSRLKRRLNQDKGYIYLGLIENKRGYISCGSVLVEGTSTRFKENKGGYIPCGSLLVKGFLQGHSIQHQAPKHGQVLSGVECGNLDNCESCKCLKLFRPPSLDKCCLDCFRHVVRGRHVFGFANEDTCRGAFDSESSSSKSLRASRRTGGGISHLCERAQPSATSPTKEPILITMVLPPSASREQGEAVETLGCHPACGVAIALGIMGDIPWRPPSNVPSIVGEGGQPVGETSPVVVVVVVAKRKQDDYAEVLSPKKSRALMSLHALRQAVGLTPGSTHPSILQDLPSAVEAPTPAIFVIATPAPPPPLVVPIREVTSTNEVGALTILDGYVTASSPTAATPLLSVGVATTIASMIPPSPSSAHSVPPSVALAAKSPSPSSPPHVSLDHLYTSTNVDSLWGANYKPK

SEQ ID NO: 204570 - protein, 1069 aa, Glycine max
  Coding DNA Sequence Number=SeqID_87792
  Gene Ontology: Mol. function=RNA-directed DNA polymerase activity; Cellular component=chromatin; Biological process=chromatin assembly or disassembly
  Pfam annotation: Domain name=Chromo; Domain location=968-1022; Score =53.5; E_value=7e-13; Accession=PF00385.14; Description='chromo' (CHRromatin Organisation MOdifier
  Pfam annotation: Domain name=RnaseH; Domain location=437-558; Score= -14.5; E_value=0.0013; Accession=PF00075.14; Description=RNase H
  Pfam annotation: Domain name=rve; Domain location=692-822; Score =57.8; E_value=3.7e-14; Accession=PF00665.16; Description=Integrase core domain
  Pfam annotation: Domain name=zf-H2C2; Domain location=633-674; Score =15.2; E_value=0.0035; Accession=PF09337.1; Description=His(2)-Cys(2) zinc finger
  Pfam module annotation: Pfam domain module=Chromo::RVT_1::RnaseH::rve: :zf-H2C2; Domain location=968-1022::197-366::437-558::692-822::633-674
MNVKLGNGFQISTQGVCRGLEMCIGDLKMNPEMHLFELGGIDVVLGIDWLKTLGDTITNWKQQTMSFWKDKSWVTLKGHEGCRRQTVALQSILNRPKPTSQGLLWEMDNVKHKGKGVNELSIQQQAEMEVLLNKFEHVFRTPTGLPPKRNRDHAITLTDGHGPVNVRPYRYPHHHKNEIEKQVKEMLAAGIIRHSTSSFSSPVILVKKKDGTWRMCIDYRALNKATIPDKFPIPVIEELLDELHGARYFSKLDLKSGYHQVRVKDSDVGKTAFRTHEGHYEFLVMPFGLTNAPATFQGLMNDIFRPLLRKNVLVFFDDILVYSKDWETHLHHLEEVLRLLAAHSLVANQKKCYFGQRSIEYFGHMITEEGVAVDSRKVDSLTGYYRKFIRDYGKIAKPLTELTKKDGFKWGVEAQKAFDELKKRLTTAPVLTLPNFSKEFVIECDASGSGIGAILMQDKKPIAYFSKALGVRNLTKSAYKIELMAVVLAIQHWRPYLLGRKFVVSTDQKSLKQLLQQRIVTKEQQNWTAKLLGYDFEIVYKQGRLNKGADALSRIHETGELQVLHSQIKWLQEDQIKAENDKDERLRKIMSEVQQNPDKWPGYEYRHGVLLYEGRLVLSAHSIVIPTLLEEFHSTPQGGHSGFYKTYRRLAANVYWIGMKNHVQEFVRRCDTCQRQKYMATSPGGLLQPLPVPNQIWEDISMDFITGLPKSKGYEAVFVVVNRLSKYVHFIPLKHPYTARSIAEVFCKEVVRLHGMPLSIVSDRDPIFISSFWKEIFKLQGTKLRMSTAYHPETDGQTEVAEYWFNTTFHSATEKTPFEIVYGRPPPSLYRWVQGETRVEAVQRDLVDRDEALRQLRNQLLRAQEKMKAQADKRRSDQSFVCSEWVFVKLRAHRQQSVVTRINAKLAARYYGPYPIVEKIGPVAYKLKLPKGSRVHPVFHVSLLKKAVGTYQDDAELPELIEEPIEVYSPEAVLATRKVKHQNEEVRQVLIHWKGRTAEEAMWEDEIMIRSQFPSFDLEDKVNIEGGGVDRIHVAAEDRTPEQLIHHTTGGPRILYVYSRRKGTKGISG

SEQ ID NO: 204571 - protein, 68 aa, Glycine max
  Coding DNA Sequence Number=SeqID_87793
MDEQERVDKRSQGWTWPKWTPGLYTFGLRMAFIERTRGETCKTNNSNAQCVNDRAEGLMELDIYRNGA

SEQ ID NO: 204572 - protein, 167 aa, Glycine max
  Coding DNA Sequence Number=SeqID_87794
MACEVLIEPRALLRFRSELQLDKFFDDPLSMLMTRVPLVIVRVGNFIFKWGVETMASSSLSVLLRVKAKELALTEGGHQVHVASSLYYLACKSEEWTGVRVDSVGGDFESLKSLPMLDISGIFLVDKNPGHHEVCNDDGDNNEVIMVDRVGTLEVPIHKGDRKETQF

SEQ ID NO: 204573 - protein, 139 aa, Glycine max
  Coding DNA Sequence Number=SeqID_87795
  Gene Ontology: Mol. function=RNA-directed DNA polymerase activity; Cellular component=intracellular; Biological process=RNA-dependent DNA replication
MPRIYPSIIYHKLAICLQAKPISQKKRKMREERRKAIKEEVDKLLNESFIREVRACPKDAFPLPSIDKLVNGGSGFQVLSFLDTYSGFDQIRMHPPNEEKMKFIIEDDNFCYRVMPFGLKTTGATYQRLMDRVFEQQIG

SEQ ID NO: 204574 - protein, 288 aa, Glycine max
  Coding DNA Sequence Number=SeqID_87796
MGLTKGKPWFNEPGVCRARVMLLHTCHSWTSMRDGGELLHTCHSWSGMYCRRGGIVEAKLHDESRLIQRCFDDNKDDDKDVQDRIKNTSRFKRKVEEHFKTQEEKLKNTSRFKRKVEFKNQDSRIKLQESRSRFKTQDSRIKRRLNQDKYEKRVHLLGLLTENKRGYISCGSVLVEGTSARFKENKGGYIPCGSLLRRGGSLEHLLDDILKVSDLLGAGQLGEQDNSSVAFPGDIVHFETFEIVNESLRDVIVLEQHCFLGLVYVGNLSMDKLGVYVASQLLSSNFSY

SEQ ID NO: 204575 - protein, 63 aa, Glycine max
  Coding DNA Sequence Number=SeqID_87797
MDGASAPAPTIALLVSAGASRAAKVDQQQYTRCGKGNTAGYDDGGVRKESNGLWIYDDDDVLL

SEQ ID NO: 204576 - protein, 229 aa, Glycine max
  Coding DNA Sequence Number=SeqID_87798
  Gene Ontology: Mol. function=RNA-directed DNA polymerase activity; Biological process=RNA-dependent DNA replication
MGITPSMHSQYCKWLKSLPYALSNRADYVSTSFVDPIMEIDIPLGWKSLNLERYDGTIDPDKHLDAFQTQANLYTNNDVILCCVFPSSLKGATLTWHGGLPPRSINNFDTLIERFSVYLRTVYANSPPVAWMSCVNELEATSRWKKCPNSGMEPNKPDRSTTSEKLRLTYISWARGTSQTSAILSPTGPEAFNLEVPIRLPLMKPSRPGSDTTKYCRYRRDICHNIEDC

SEQ ID NO: 204577 - protein, 150 aa, Glycine max
  Coding DNA Sequence Number=SeqID_87799
  Gene Ontology: Mol. function=RNA-directed DNA polymerase activity; Cellular component=mitochondrion; Biological process=RNA-dependent DNA replication
MAFKKTIVIPPILSQHRPRVPLLLYLSVADKVVSSALVQEEGKHQLPIYFTSRILHDAEKSYQMIEKPVELSEFDIQYESPGPMKTQLMADFMAKFVGNDIANLDWWTFYFDGVSNVKGSGAGIILEGHDNITLEQALKLNLRASNNQVE

SEQ ID NO: 204578 - protein, 184 aa, Glycine max
  Coding DNA Sequence Number=SeqID_87800
MNLYWKSGIKERLLDLGVEVGPVLPLGDHGSSQVSGGSQLSSKDAFLSKAEVKTDSENNGISEDVVCVTLGTISKIVMDNHSWCYPACIQCHRKIDIQTGPFTCGCGKDNDQPVLSMYIARYRVEVMDGDLDLNVSPQALDRLLGYVLAFKVRIQSKFKNVVVLRYSNELDLINVVLEMLADSE

SEQ ID NO: 204579 - protein, 102 aa, Glycine max
  Coding DNA Sequence Number=SeqID_87801
  Subcellular localization annotation: CTP_CleavageSite=46; ConfidenceScore=5.12e-01
MTPHLGNSPKRVYTTPHLGNHAVFVEATQSCTVTPPPLGDQPRATRSFLPGDTPPSTRYILPQFILFPMSYEGRPTRSMNPPMDIHNIRCMNVGTIKYNDHG

SEQ ID NO: 204580 - protein, 66 aa, Glycine max
  Coding DNA Sequence Number=SeqID_87802
MCVQQEERLLMEMGESALLTTTYGKDKATESKLIKCGIVKIPPQAYIKKVAKCLFWYAKPKETSGK

SEQ ID NO: 204581 - protein, 73 aa, Glycine max
  Coding DNA Sequence Number=SeqID_87803
  Gene Ontology: Cellular component=integral to membrane; Biological process=transport
  Homolog annotation: Hit_ID=Q9LIL4; Match level="QueryCoverage=98%, HitCoverage=34%, E-value=7e-25, Identity=75%"; Hit description =Coated vesicle membrane protein-like
MNIAELREALESIISEQKYLKARDARHRHTSESTRKRVVFYTILEYVLFAATSLLQVVYIRRLFSKSFAYNRV

SEQ ID NO: 204582 - protein, 105 aa, Glycine max
  Coding DNA Sequence Number=SeqID_87804
MSFVGFDSSSKDTKTTLMSPRLVLPESWEPPRVDLVDLMSEGEREDLEEDTSYEEDPSMDEEDPVTEREVSLRLTCFANSLWHTILIYLYLVTRGGNESSQAKLY

SEQ ID NO: 204583 - protein, 51 aa, Glycine max
  Coding DNA Sequence Number=SeqID_87805
MECTSSCSHRVLMTLMYRMRESTLGSSSGPKNGHGILINHGYNFTLVRNAK

SEQ ID NO: 204584 - protein, 36 aa, Glycine max
  Coding DNA Sequence Number=SeqID_87806
  Homolog annotation: Hit_ID=Q9M9G7; Match level="QueryCoverage=94%, HitCoverage=13%, E-value=4e-08, Identity=77%"; Hit description =Probable F-actin capping protein subunit beta
MKLSVVDGHLCNMGRMIEEMESKLRNSLDQVIVSKE

SEQ ID NO: 204585 - protein, 738 aa, Glycine max
  Coding DNA Sequence Number=SeqID_87807
  Gene Ontology: Mol. function=binding; Cellular component=thylakoid; Biological process=ethylene mediated signaling pathway
  Homolog annotation: Hit_ID=Q1SMH2; Match level="QueryCoverage=93%, HitCoverage=98%, E-value=0.0, Identity=65%"; Hit description=BTB/POZ
  Pfam annotation: Domain name=BTB; Domain location=175-281; Score= -7.9; E_value=0.021; Accession=PF00651.21; Description=BTBPOZ domain
MRSFFPAESCKEAHPNALNPQSWLQIERGKLPKLSSSSHPSSASIESLIKVPQPAILPFFKPVDYVEVLAQIHEELESCPPQERSNLFLLQYQVFRGLGEVKLMRRSLQGAWQRAHTVHEKIIFGAWLKYEKQEEELIADLLAACGKCAKEFAPVDIASLLPFDVNAGSEGRTTNENCISQNVTFTIGSEKIICERQKISELSAPFRAMLKGHFSESLSETIDLSENNISPSGMKAISDFSLNGSLIEVLPNLLLEILVFANKYCCERLKDACDRRLASLVSSKEDAVELMEYALDEHSTVLAASCLQVLLRDLPNCLNDNRVVEIFVHANKQQLAVMVGPDTTAHILERLVEFAENDQQRLLALHQLGCVRLLRKEYDEARCLFEGAVNAGHIYSVAGLARLDYIKGDKLLSYGQLNSVISSVTPLGWMYQERSLYCDGDKRWEDLEKASNLDPTLIYPYTYRAASLMRTQNAQAALAEINRILGFKLSPECLEVRFFIHLSLEDYKAALCDVQTILTLRSDYRMFEGRVAASQLCTLVREHVERWTTADCWARLYDCWSAVDDIGSLSVIYQMLESDAAKGILYFRQSLLLLRLNCPEAAMRSLQLARQHASSEHERLVYEGWILYDTGHYEEGLWKAEESINIKRSFEAFFLKAYALADSSIDPSCSPTVISLLEDALKCPSDNLRKGQLTAALILSSLYILTMLPFHPNSHFLPKDFQWTWLSTESLKPTLAIY

SEQ ID NO: 204586 - protein, 59 aa, Glycine max
  Coding DNA Sequence Number=SeqID_87808
MRDPRQALERDAAVNAQRPMPESTLLQMYGHMKNDLGISFRIPVLGVRERESVRLSVKC

SEQ ID NO: 204587 - protein, 183 aa, Glycine max
  Coding DNA Sequence Number=SeqID_87809
  Gene Ontology: Mol. function=nucleic acid binding; Cellular component= intracellular; Biological process=regulation of transcription
  Homolog annotation: Hit_ID=O22759; Match level="QueryCoverage=86%, HitCoverage=47%, E-value=1e-57, Identity=67%"; Hit description =Putative zinc finger protein
  Pfam annotation: Domain name=zf-C2H2; Domain location=97-119; Score =27.7; E_value=4.1e-05; Accession=PF00096.16; Description=Zinc finger, C2H2 type
MGEDTFQYLRCCNATPYLPCNMFPTAISYSTSLSEDASVSSGTKVQDLGGLNHGVSSISPQQQPQKIKKKRSLPGNPDPDAEVIALSPKTLMATNRFVCEICHKGFPRDQNLQLHKRGHNLPWKLKQRSSKEESRNTSAESMERRSGNVKSAQRYTRFSQIGKLTQKPVVLENIDVIVEHFFP

SEQ ID NO: 204588 - protein, 444 aa, Glycine max
  Coding DNA Sequence Number=SeqID_87810
  Gene Ontology: Mol. function=sequence-specific DNA binding; Cellular component=nucleus; Biological process=regulation of transcription, DNA-dependent
  Homolog annotation: Hit_ID=Q8H7Y6; Match level="QueryCoverage=91%, HitCoverage=93%, E-value=2e-68, Identity=40%"; Hit description =Putative heat shock protein
  Pfam annotation: Domain name=HSF_DNA-bind; Domain location=48-289; Score=188.6; E_value=1.5e-53; Accession=PF00447.8; Description=HSF -type DNA-binding
MNYLYPVKEEYLEWPPPSSSPPTTGGVDESAMVPPPRPMGGLHEIGPPPFLTKTYDAVEDPTTSHMVSWNRGGASFVVWDPHAFSRDLLPRYFKHNNFSSFVRQLNTYWNTYSFTVLWFYIFFTPSHGLLDFSFSPIPSVPAVAGGTVWLHAQPLCPFPIIIIAIMGFRKIDPDRWEFANEGFLRGHRHLLANIRRRKQPSSQPSSSSSSSSYYYYSSSSQQAQQGHCVEVGRFGLDEEIDRLRRDKHVLMMELVKLRQQQQNTRSYLQAMEERLRGTEIKQQQMMAFLARALKNPTFIQQLLQQKEKRKELEEAMSKKRRRPIERGPNHGVVGEESSSVKVESLVFGDEYGFGVSELEVLAMEMQGYGKGRREQEEEPDEALDQSQERLEKELDEGFWEELFSEGFEGELDTNPTNSQDQDEEEEDHVNVLANRFGYLGSSPK

SEQ ID NO: 204589 - protein, 149 aa, Glycine max
  Coding DNA Sequence Number=SeqID_87811
  Subcellular localization annotation: CTP_CleavageSite=10; ConfidenceScore=5.22e-01
MNSTMIKLPSSSVGPKHLRRPRRLTLMCKSRLSIDPNSKDKGSTVRSIFGREGNYSTLVEEKNGEFHAVNEKQETKPEPSSGHSRVLCSEKSWKLLKKQGIDLESEHMNEQRNAMQHVSDVTKREDENSNGSGFECDGALLQFLEPEQK

SEQ ID NO: 204590 - protein, 375 aa, Glycine max
  Coding DNA Sequence Number=SeqID_87812
  Homolog annotation: Hit_ID=Q75GL2; Match level="QueryCoverage=98%, HitCoverage=75%, E-value=8e-77, Identity=45%"; Hit description =Expressed protein
  Pfam annotation: Domain name=DUF828; Domain location=4-216; Score =93.3; E_value=7.4e-25; Accession=PF05703.2; Description=Plant protein of unknown function (DUF828)
  Pfam annotation: Domain name=PH_2; Domain location=260-370; Score =233.0; E_value=6.4e-67; Accession=PF08458.1; Description=Plant pleckstrin homology-like region
  Pfam module annotation: Pfam domain module=DUF828::PH_2; Domain location=4-216::260-370
EVSPLTSGRLSHSSEPLNGGGSLTGTDSPPISPSDEFDDVVKFFRANNSIHPLFNGGRTSATIGNGTACSGPKTVGRWLKERREKKKEENRTHNAQLHATISVAAVAAAVAAIAAATAAGSSAPSKDEKMAKTDMAVASAATLVAAQCVEAAEAMGAERDHLASVVSSAVNVRSPDDITTLTAAAATALRGAATLKARALKEVWNIATVTPLERGIGGIGLCGKSINSNTSNTSTSDSGEIFNGENFLGSCSQELLAKGSELLKRTRKGDLHWKIVSVYIHRTGQVMLKMKSRHVAGTITKKKKNVVLDICTDLPAWPGRHLLGDGEKRRYFGLKTDARGIVEFECRNQREYDLWTQGVSRLLSVVAQRQNRYGN

SEQ ID NO: 204591 - protein, 36 aa, Glycine max
  Coding DNA Sequence Number=SeqID_87813
AERLEGERVGYDSSGHAQGGDEGWEAESRGVGLGHL

SEQ ID NO: 204592 - protein, 53 aa, Glycine max
  Coding DNA Sequence Number=SeqID_87814
  Subcellular localization annotation: CTP_CleavageSite=39; ConfidenceScore=5.10e-01
MGIHLIPSLSLASLCCGFRSTFPTATYLVVRRYMSGKVSLAKNSTPAKWCGGL

SEQ ID NO: 204593 - protein, 118 aa, Glycine max
  Coding DNA Sequence Number=SeqID_87815
KFHWKLDDRNSSSNCESRRHPNHPSITSPKHQFARFIDLEVQQHWSIHTKKIRGMCFLVVNKFNDSGLPQISQDINNATTLTDTVFKLLQNLSTELASSLLCYFGVSGDVETTRSGII

SEQ ID NO: 204594 - protein, 84 aa, Glycine max
  Coding DNA Sequence Number=SeqID_87816
  Subcellular localization annotation: CTP_CleavageSite=54; ConfidenceScore=5.17e-01
MFDTLHLSNVGNAFQWKWPRRSLPQRDPGRIKRLKEPVPLLNMTATVIGALSTSSALRPSRDGHFSGSDASSSGTTSIPTSRRR

SEQ ID NO: 204595 - protein, 147 aa, Glycine max
  Coding DNA Sequence Number=SeqID_87817
MKLASTALCIPDRGARGVVSDNLTFERLSPIINLAYIKKNCWNPEDLTVSIRGARRARARPIEAPSTSAAPPPAHTLVAPSTLSSTDFQHLEAMLQSIHQGQIVLLQSLQLVAPPDSIPSVEQFNEWVAWPETQPPLHREDEGLTAQ

SEQ ID NO: 204596 - protein, 86 aa, Glycine max
  Coding DNA Sequence Number=SeqID_87818
MTSSQATYRSSLSTSDSWLSLSPNKSIELQLRVQEEERGMRQEGVGVGVDFAAKVSGGVMVIGVSESGVRGVRWGLLEMNVWFGMG

SEQ ID NO: 204597 - protein, 425 aa, Glycine max
  Coding DNA Sequence Number=SeqID_87819
  Gene Ontology: Mol. function=RNA-directed DNA polymerase activity; Biological process=RNA-dependent DNA replication
MVVIQANPELDTGNQYGVMRESGVTGMKGFAGLVNDIIREYDLKALLGASGVYGTHLCGRLAANMDIPWCSLGDFNAVLRDFERNGGSSTTSMRGDHAFQNCVLDCNLLDIGYQGAPFSWRRGNTFERLDRALAFFHCPILIRFQPGIRPISFCNVSYKVIPEVLAQRLKVVMETLVIRTQCSFVSHRHSSDNIIVTKEVIHSMRHKKENKGWMAIKIDLEKAYDRLSWEFVREILQDIGFPESFVSLVQVYISTTTMRMIWNRDCLEEFKPSGGLLTFSKSVLEVLSSNTMQTTFLPKYICEEIDIKCREFSIFYAHWLDEGPIYEEIPYVHIYDTQLHVKDVLVNEDTLVWGPSNSGTYTTKSAYEWLLPEPINHLTFTGSWTWVWKQKLPEKIKCGLEEENITYLLRDCFRNTSPTLTAYTS

SEQ ID NO: 204598 - protein, 62 aa, Glycine max
  Coding DNA Sequence Number=SeqID_87820
MRGVCFLEDLCGREGGGEEDLLASVGGVRGKGISASWDRCVGVTRLSDQGKGKSHKERKFHT

SEQ ID NO: 204599 - protein, 335 aa, Glycine max
  Coding DNA Sequence Number=SeqID_87821
  Gene Ontology: Mol. function=transcription factor activity; Cellular component=nucleus; Biological process=regulation of transcription, DNA-dependent
  Homolog annotation: Hit_ID=Q9FK12; Match level="QueryCoverage=95%, HitCoverage=88%, E-value=5e-46, Identity=40%"; Hit description =Similarity to pathogenesis-related genes transcriptional activator
  Pfam annotation: Domain name=AP2; Domain location=105-169; Score =132.6; E_value=1.1e-36; Accession=PF00847.10; Description=AP2 domain
MEPQNRSNSILCKYTEHETVTKKHMKSKNNTSLSPKVISILMTDQYATDSSSDEERVTSRRRIKRYVNRIELQPAIKSVATRKRHVGDATKLRPPQVKVKNSGSVKKFRGVRQRPWGKWAAEIRDPVQRVRIWLGTFETAEEAALCYDNAAIMLRGPDALTNFGIRSKETLEKEERKELDEKEEIRTEKPEMKVVVKPEIETALVSCFYDSADEFCLNLSSPTSVLRFNESAELEKQYEPFPGRTEAHTVLEECQGQTVSFHESSEFMLQDMPWDDVFNFPVMFDEPVSHLFDETTRFSSSEVFSEEKFLPSATLCQVDDYFQDILLGSDPLVAL

SEQ ID NO: 204600 - protein, 175 aa, Glycine max
  Coding DNA Sequence Number=SeqID_87822
  Gene Ontology: Mol. function=RNA-directed DNA polymerase activity; Cellular component=cell wall; Biological process=RNA-dependent DNA replication
  Homolog annotation: Hit_ID=Q7X970; Match level="QueryCoverage=69%, HitCoverage=5%, E-value=2e-20, Identity=39%"; Hit description=BZIP -like protein
MLLKIKVARYHGQYLGLSALIGRSKSQVFQFFWERPKSLGGLGFRRMKKFNKSLLAKQMWRLITNEESLATQVLRARYFPWGSPLDAQKAHRPSYTWSNIFSSKDLIDNGVVWRIGNGDSALALPTMSQPLPSEACNLRWKKPQMYCIKENFDASVVQDKGLGIGVVYRDHQGEF

SEQ ID NO: 204601 - protein, 58 aa, Glycine max
  Coding DNA Sequence Number=SeqID_87823
MEAVKSKKEELQKDIDGRLYLALKEGEEGVANVAMKEKANVATKQKENALLTLVDISI

SEQ ID NO: 204602 - protein, 123 aa, Glycine max
  Coding DNA Sequence Number=SeqID_87824
  Homolog annotation: Hit_ID=Q1T199; Match level="QueryCoverage=100%, HitCoverage=8%, E-value=3e-56, Identity=86%"; Hit description =Homeobox
MELRPYIEEPISNDAASLNFISLDLRPRVRHDFILSNRGAVDEYWRTLENCYATADRKAASYAFPGSVVHELFRFRSWASTRLMTAEQRAELLKHVTKDNLSENISYRDCEKIAKDLNLTTEQ

SEQ ID NO: 204603 - protein, 76 aa, Glycine max
  Coding DNA Sequence Number=SeqID_87825
MATILAVKSTVPATTARWDMMTLGGGVYGIGFRVRFRVRVMIGVWDMGHGGRGLGSGFGSWGLGFGLRVWGLGFGF

SEQ ID NO: 204604 - protein, 112 aa, Glycine max
  Coding DNA Sequence Number=SeqID_87826
RPQSILGPPADLGRGPAVQIQPKEEETGADHAHQHDHLYPDMDDVAAQQHPTQDGTYKTPYGPGEVQQGPRVPSSDHGPLPILQSACRPQQGHLASHYQSLHQEVLHPRAPQ

SEQ ID NO: 204605 - protein, 176 aa, Glycine max
  Coding DNA Sequence Number=SeqID_87827
MLKGRRITSLAIWSSLSFSEEEIQHVCHVLIVLGFVPTSKGPRRPCQRLKLGLVHRLGHRGLELLGSGPRERTEVLTLLVQVVTIEHLVQPPLPSVISCLLSNHVTHIPIHPELYPIQVIREGPQRWCLLSWRQWRICPWLLILLELLRCPGMQYFLMKALVMGGQMTLLGATGTL

SEQ ID NO: 204606 - protein, 233 aa, Glycine max
  Coding DNA Sequence Number=SeqID_87828
  Gene Ontology: Mol. function=protein serine/threonine kinase activity; Cellular component=nucleus; Biological process=protein amino acid phosphorylation
  Homolog annotation: Hit_ID=Q8SA64; Match level="QueryCoverage=88%, HitCoverage=33%, E-value=1e-102, Identity=86%"; Hit description=NIMA- related protein kinase
  Pfam annotation: Domain name=Pkinase; Domain location=4-232; Score =159.9; E_value=6.6e-45; Accession=PF00069.15; Description=Protein kinase domain
  Pfam annotation: Domain name=Pkinase_Tyr; Domain location=4-212; Score=-15.1; E_value=1.5e-11; Accession=PF07714.7; Description =Protein tyrosine kinase
  Pfam module annotation: Pfam domain module=Pkinase::Pkinase_Tyr; Domain location=4-232::4-212
MEQYEILEQIGKGAFGSALLVRHKHEKKKYVLKKIRLARQTDRTRRSAHQEMELISKVRNPFIVEYKDSWVEKGCFVCIIIGYCEGGDMAEAIKKANGINFPEEKLCKWLVQLLMALDYLHGNHILHRDVKCSNIFLTKDQDIRLGDFGLAKMLSSDDLASSVVGTPSYMCPELLADIPYGSKSDIWSLGCCIYEMAAYKPAFKAFILIKIVIGKSHQQQEEGGRLFGCMHGY

SEQ ID NO: 204607 - protein, 177 aa, Glycine max
  Coding DNA Sequence Number=SeqID_87829
MTLLLSNILPNNHNSDLPLPKWITSPRHPLDLVLWSASHPHQAYPAPHQQGFHREIFHAQAGPAAVGGRPTTTNHRCTVPPSTGDTIPRVHLRSSVKVRAPDAQVQLNETFYRYTMHQQSQDPSPFPWPTPEQFGATVAWPGDERDFEIGAGPAGAPGDDEGAHEDDNMADVLDFFT

SEQ ID NO: 204608 - protein, 52 aa, Glycine max
  Coding DNA Sequence Number=SeqID_87830
MGKYELIYENIMSEEINMNEDTGKELVVVENINCSDAFNTSQVFATSEDVLQ

SEQ ID NO: 204609 - protein, 76 aa, Glycine max
  Coding DNA Sequence Number=SeqID_87831
MQSQGLALPPKIEVGPSAAYVNTKESCVDPSGNDPDTGQRNAGCTSKKVLPAWHMTETNMRAGNADCTLANGRHFA

SEQ ID NO: 204610 - protein, 143 aa, Glycine max
  Coding DNA Sequence Number=SeqID_87832
MKAEPIPSTLSCLFIGNEGTWLISSSPRRAGYFTLMSFGGPGEPEAGLGEPGVRKSLQMTLLPSLLGTVCSSLCIGTSVFFFHLHSRSFHSKCKIQSHFFSRFHFVQDDELRYFFSPTSTETTIRHLTTPISGLNSAKSGFDW

SEQ ID NO: 204611 - protein, 66 aa, Glycine max
  Coding DNA Sequence Number=SeqID_87833
  Subcellular localization annotation: CTP_CleavageSite=57; ConfidenceScore=5.04e-01
MTPQTIQTDNSRLNTTINANCPQESLYSISNGNLSEQVIKTLVTNNNIKSLRKTFVPVMMSSTVEK

SEQ ID NO: 204612 - protein, 322 aa, Glycine max
  Coding DNA Sequence Number=SeqID_87834
  Homolog annotation: Hit_ID=Q9ZUH9; Match level="QueryCoverage=53%, HitCoverage=59%, E-value=2e-15, Identity=34%"; Hit description =Expressed protein
  Pfam annotation: Domain name=DUF593; Domain location=1-91; Score =118.7; E_value=1.6e-32; Accession=PF04576.6; Description=Protein of unknown function, DUF593
MKDMLCVQQQLLEKLYAELDEEREASATATSEALDMILRLQGEIALVKMEASHYKRVAEEKIGHAEVSLEAFEEIMYQKEVQIASLEFQVHAYRHKLMSLGCELEEDLLLLNRSDQRNGENGGQSSTVRRLQSMPAIQFLSSLRAAAKRGRSPSPVLDVIPKIMEESTTDKEVAQPGSGTLDSYLNQIKELNEQVRVISDCAEGEKSANLRSRRGRSCSILPHASAKMACDQTHRLISTNLDEVSQGESTPNRGVANDSPRILNVHDVYEVPQTSENHEVSEHGGKRFEKWNSDAENRLTKPDSVSEGMVESPLKHDAEKKK

SEQ ID NO: 204613 - protein, 70 aa, Glycine max
  Coding DNA Sequence Number=SeqID_87835
MATIGHMRKALNIEEMEIRELFEDGIQMMRMNYYPHLLNQKRWSIPNDIYFQFFSLDVLHDRLLVVDISK

SEQ ID NO: 204614 - protein, 232 aa, Glycine max
  Coding DNA Sequence Number=SeqID_87836
  Gene Ontology: Mol. function=sulfate porter activity; Cellular component=integral to membrane; Biological process=sulfate transport
  Homolog annotation: Hit_ID=Q1SMI4; Match level="QueryCoverage=78%, HitCoverage=28%, E-value=3e-74, Identity=79%"; Hit description =Sulphate transporter
MESMILVSRVSEAEIGSEVISHKKMRELPGFYFHHRLYVLRKRAGPEAYMGNADYAYPSGMNVESVHRVAIPPPQPFFKSLKYSMKETFFPDDPFRKFKNQPASKRFMLGLQYFFPIFEWAPKYTLHFLKSDLISGITIASLAIPQGISYAKLANLPPILGLYSSFTPPLIYAMMGSSRDLAVGTVAVGSLLMASMLGRVVNFNENPKLFLHLAFTATFFAGVLQASLGLFR

SEQ ID NO: 204615 - protein, 88 aa, Glycine max
  Coding DNA Sequence Number=SeqID_87837
MQREQSRDQGIEAMKSVGMIGTCLRKFLLKNGIILFFLFAWGQAKCEKGRYNKQKGAEIKKKRRKLEEAQVQQGAKRETRPARKKTRR

SEQ ID NO: 204616 - protein, 36 aa, Glycine max
  Coding DNA Sequence Number=SeqID_87838
MKGVIMFIKIDMIALRVAKRLEDQRVILGMHLGLMI

SEQ ID NO: 204617 - protein, 77 aa, Glycine max
  Coding DNA Sequence Number=SeqID_87839
  Gene Ontology: Mol. function=sulfate porter activity; Cellular component=integral to membrane; Biological process=sulfate transport
  Homolog annotation: Hit_ID=Q1SMI4; Match level="QueryCoverage=79%, HitCoverage=9%, E-value=2e-23, Identity=85%"; Hit description =Sulphate transporter
MMPSKCTSCVWEKTERITDTRSASWVKCSRPRIDFNCCRQTTVAAPPMNPTMVACDTKSTINPNLHSSITCFLIKHI

SEQ ID NO: 204618 - protein, 371 aa, Glycine max
  Coding DNA Sequence Number=SeqID_87840
  Gene Ontology: Mol. function=sulfate porter activity; Cellular component=integral to membrane; Biological process=sulfate transport
  Homolog annotation: Hit_ID=Q1SMI4; Match level="QueryCoverage=99%, HitCoverage=53%, E-value=1e-152, Identity=75%"; Hit description =Sulphate transporter
  Pfam annotation: Domain name=STAS; Domain location=227-345; Score =149.9; E_value=6.7e-42; Accession=PF01740.11; Description=STAS domain
  Pfam annotation: Domain name=Sulfate_transp; Domain location=1-204; Score=139.2; E_value=1.1e-38; Accession=PF00916.10; Description =Sulfate transporter family
  Pfam module annotation: Pfam domain module=STAS::Sulfate_transp; Domain location=227-345::1-204
IGNLKKGLNPPSATDLVFVSPYMGTAIKTGFVTGIIALAVKYLSISFPLVEGNLEGIAVGRSFAMFKNYHIDGNKEMIAIGTMNIFGSFTSCYLTTGPFSRSAVNYNAGCKTAASNIVMAIAVMLTLLFLTPLFHFTPLVVLSAIIVSAMLGLIDYQAAIHLWKIDKFDFLVCFTAYVGVVFGSVEIGLVIAVAVSLLRVLLFIARPRTFLLGNIPNSAVYRNVEQYPNANHIPGILILEIDAPIYFANASYLRERITRWIDEEEDRIKATEQTSLQYVIMDMTAVANIDTSGISMLEECKKTVDRRGLQLALVNPGSEVMKKLNKSKFLDELGQKWIYLTVEEAVGACNFMLHSYKPNPMKDESEGWNNA

SEQ ID NO: 204619 - protein, 151 aa, Glycine max
  Coding DNA Sequence Number=SeqID_87841
  Gene Ontology: Mol. function=translation initiation factor activity
  Homolog annotation: Hit_ID=Q2HSQ9; Match level="QueryCoverage=95%, HitCoverage=12%, E-value=6e-43, Identity=62%"; Hit description =Initiation factor eIF-4 gamma, middle; Up-frameshift suppressor 2
  Pfam annotation: Domain name=Upf2; Domain location=1-89; Score=-12.6; E_value=0.00039; Accession=PF04050.5; Description=Up-frameshift suppressor 2
MSGCISDIFKGSAKDHHGRGVGGESGDEALDEDTGGNKEVQVRVLVKRGNKQQTKQMFIPRNSSLVQSTKQKEAAELQEKEDIKRLVLEYNDREEEEHNGLGTQPTNWMQSVGYKGGGRGSTLEGNSGRGSGSRHRHHNYSGSGIYYSRRK

SEQ ID NO: 204620 - protein, 613 aa, Glycine max
  Coding DNA Sequence Number=SeqID_87842
  Gene Ontology: Mol. function=translation initiation factor activity; Cellular component=cytoplasm; Biological process=mRNA catabolic process, nonsense-mediated decay
  Homolog annotation: Hit_ID=Q2HSQ9; Match level="QueryCoverage=97%, HitCoverage=49%, E-value=0.0, Identity=80%"; Hit description =Initiation factor eIF-4 gamma, middle; Up-frameshift suppressor 2
  Pfam annotation: Domain name=MIF4G; Domain location=480-613; Score =13.4; E_value=0.0034; Accession=PF02854.9; Description=MIF4G domain
  Pfam annotation: Domain name=MIF4G; Domain location=68-290; Score =17.2; E_value=0.0021; Accession=PF02854.9; Description=MIF4G domain
  Pfam module annotation: Pfam domain module=MIF4G::MIF4G; Domain location=480-613::68-290
MDHHEDESNSKQDDETCLRLNFSNLTQEAVARLEEIKKSIEAKLALRQSNLNPERPDSGFLRTLDSSIKRNTAVIKKLKQINEEQREALMDELRSVNLSKFVSEAVAAICDAKLRSSDIQAAVQICSLLHQRYKDFAPSLVQGLLKVFSPGKPGDESDTDRNLKAMKKRSSLKLLLELFFVGVIEDGGIFINIIKDLSSGEQLKDRDAAQTSLTLLSSFARQGRIFLGLSVSGPEIHEEFFKGLNITADQKKVFRKACYSFYDAAAELLQSEHSSLRLMEHENSKILNAKGELSDENIASYEKLRKSYDHLYRNVASLAEALDMQPPVMPEDGHTTRVTSGEDGVSSASGKDSSVVEPIWDDEDTRTFYECLPDLRAFVPAVLLGETEPKSSEQSAKNQDLTTEILPESDKGQQTTHESGEVSTESNALPEAESTERVKDKEEKDKSNELDREKEKEKDNDKKGENEKDKLRSLEGTNLDALLQRLPGCVSRDLIDQLTVEFCYLNSKSNRKKLVRALFNVPRTSLELLPYYSRMVATLSTSMKDVSSILLQMLEEEFNFLINKKDQMNIESKIRNIRFIGELCKFKIAPPGLVFSCLKGEKLKKRSEVQARA

SEQ ID NO: 204621 - protein, 259 aa, Glycine max
  Coding DNA Sequence Number=SeqID_87843
MSNSNTQPKPLLPNPFNLSDTEIVEKVYVLSHTYDDQVFDNEPLFNVVSNVIKLSTQIVGALHKLQFRVTSYIYSNLIKIFGVLQIDEPNGFIGNPISTTSFKPEFSTLKLMSCQMMTLPWGPENAHQTTLGILQQLRDYSWDAKVLIAIAALALEYGNFWNLQQVSEPQGNSLRLLNQIQHRQILVTNINTTVKLVMADGGEPCILLKPRRLRMFPLSQMPCSSSPSLFTVCRLQHQHPACFELCIIGLPCQTFSRSG

SEQ ID NO: 204622 - protein, 273 aa, Glycine max
  Coding DNA Sequence Number=SeqID_87844
MGTKGESGGRGGDGDVMAGGGCTVVGAMSMGDGVDLSGGGDGGGNGGGDGGVCDRGSNGVEHGGRVDMESGDGDADYAREDNGRRPQDGPQQPWKFRLATSSVGGGSGRWKLRTASGSHESFIWSAPPEEEDEEKEKNAKGRDYAISHSFMPMLLLHIPIYIEFYTTNFGILCSSRIFSMPAYITPASNEIPEVAGLTILLMFVVVYIRVFAAPVPPSTYQHSTTTYHFMSLFKVLKSSLLASPHLFSIGIHKILNSSFLKPLLSFGSSTSLS

SEQ ID NO: 204623 - protein, 698 aa, Glycine max
  Coding DNA Sequence Number=SeqID_87845
MALVTSLSPATPSSVQTNTLNPLGWTDDQILEKVYITHVHTAERYDVESLFNVTTNIIKRATALADSVAVKTGTPVGLIEDKVPLSTFDPPFLKLKHIASQMMNTPHGEHHAHNTAMSILDQLRTYTWDGKAIMGLAALALEYGNFWHLVQTPTGDHLGRSLAQMSRVHIVERNRQAVADYNSLVKNLLIAVECITELERLSTKGYDLKDVPALAEAMQETPVAVYWAIVTTVVCANHFDFLLGESDSRYEIANFDDKLAAVISKLKANLTRSRKKIGDLEDYWRRKKLLQTPTEIVEVLKVLIYHNEVHDPHVYDGITRQMVSIEVFRKKHVLLFISGLDSIRDEVRLLQSIYEGLQEDPREVKGYRKEDFRILWVPVVDEWNLLHRAEYDNLKLEMPWYVAEYFYPLAGIRLIREDLNYKNKPIIPVLNPQGRVVNYNAMHMIFVWGIDAFPFRPSDDDVLTQKWNWFWAEMKKVNPKLQDLIKADSFIFIYGGSDKKWLQDFTQTVEKIKRHEIIKRADAVIEHYPFGREDHRIVPRFWIGIESLFANMIQKTQKDPTIEEIKSLLCLKQQQPGWVLLSKGSNVKLLGGGDPMLATAADFEIWKEKVLEKAGFDVAFKEYYEQKRRNYPQECSHMQLANYPADILHPINCPDAACGRSMEIASVSYKCCHGQTAHHKAEVPESGDVMIEKKLYAS

SEQ ID NO: 204624 - protein, 232 aa, Glycine max
  Coding DNA Sequence Number=SeqID_87846
  Gene Ontology: Mol. function=transcription regulator activity; Cellular component=nucleus; Biological process=regulation of transcription
  Homolog annotation: Hit_ID=Q0KK48; Match level="QueryCoverage=69%, HitCoverage=63%, E-value=4e-19, Identity=35%"; Hit description=Basic helix-loop-helix protein
  Pfam annotation: Domain name=HLH; Domain location=97-146; Score=17.7; E_value=0.0019; Accession=PF00010.16; Description=Helix-loop-helix DNA-binding domain
MDRFFPEKILGEIFWDEPFLATDQSDLVQYSQINKAEASPPAATPSAFVQYRDLPRRINSLNGSNSQIMSKKMLAFLRKSWPWPVERNNVQENERNRSFRHMINERMRRQRQRQCCLALHSILPQGTKTDNNSVIQMAAKEIVRLQGCREELQRKNVELEANLEGVESSKGSGSKVQYLRVPHPKSGIDSMVEILKCLKDKGVDTRSIKSTFSPQELFAVLETETDEVAPSE

SEQ ID NO: 204625 - protein, 144 aa, Glycine max
  Coding DNA Sequence Number=SeqID_87847
MLNDDALDIIFEWGSTHSLSGNPKLTYLLRNGNAYLLAQKWKWFWHEAKKTNLHGIQVKGDRYIFSGAENSLRQWIKIKGTIYTIRRADAIIDYYHLGKEDPKIVPRFWIGIEGKRQKKHSENLDCDCSASSKVERKSAPERRL

SEQ ID NO: 204626 - protein, 43 aa, Glycine max
  Coding DNA Sequence Number=SeqID_87848
MTEQKTMKQTCAEEVLPEEELENACWRLNYKNENVSAKKMQER

SEQ ID NO: 204627 - protein, 68 aa, Glycine max
  Coding DNA Sequence Number=SeqID_87849
MENSDTKLTTSSLPPPPPVSAEEPEPKKLKMSTTTSDDEECAAGTGTKKRYKRRKVAIFFAYCGVGYQ

SEQ ID NO: 204628 - protein, 878 aa, Glycine max
  Coding DNA Sequence Number=SeqID_87850
  Gene Ontology: Mol. function=nucleic acid binding; Cellular component= nucleus; Biological process=fatty acid biosynthetic process
  Homolog annotation: Hit_ID=Q1SL15; Match level="QueryCoverage=96%, HitCoverage=89%, E-value=1e-144, Identity=35%"; Hit description =Ovarian tumour, otubain
  Pfam annotation: Domain name=FAR1; Domain location=44-257; Score= -45.8; E_value=0.0026; Accession=PF03101.5; Description=FAR1 family
MEDHVSEMSKEVTIPIDGAIDKSVDCSDAFNTTEVFPSREAMLNWARDVAKENGFVLIILRSETSTRSTKYTRSTRCNQRKTFVIMGCDRSGKYRGPYKNALSRKVSGTRKCECPFKLKGKALKKAEGWIVKVMCGCHNHDLEETLVGHPYAGRLSAEEKSLVDALTKSMMKPKDILLTLKDHNMGNVTTIKQIYNARQAYRSSKKGSEMQHLLKLLEHDRYVYWHRKVDDSDAIRDIFWTHPDAIKLLGAFNTVLIIDSTYKTTRYQLPLLEIVGVTSTELTFSVAFAFVESERADNFTWALQKLRGLIVKEDDMPQVIVTVGDIALMSAVQVVFPSSSNLLCRFHINQNVKAKCKSIVHSKEKQDMVMDAWDVIVNSPNEGEYMQRLAFFENVCLDFPIFGDYVKNTWLIPHKEKFVTAWTNRVMHLGNTATNRVEATHWRLKTLLQDSKEDMCSYWDAMKNMITLQHTEIEASFEKSKNVVEHRHNTPFYVKLVGFVSRSALSHITEEYDRVKTAGIDSSICGCIVRTTHGLPCACELARYSTMCHPIPLEAIHAHWRKLKFSDHGTNDNGSELSLQPEVDALYKRFQELDYAGKIILMAKLHEMAFPDTALKCLPPEEVGTKGAPEGLRWKSDGSTKFDPSYLELALRPARDSTSSLSSSQKTVHESKRRRVLPMMDQFPVEIHPFIEDIIDVKGDSNCGYRAVAAQLGMGEESWALVRQDLIRELQQWQDNYAKLFGSNDRVAELRKSLYVGKQASVASWMTIPDMGYVIASRYNVVLVTLSLQECMTFFPLRGRPPLSQSSHRLISIGFVHKCHFVQVVLKADSAIPPTALQWSRYCNAESRSWETSYVSRMQQFRSLFPQKEIGYVDIIED

SEQ ID NO: 204629 - protein, 142 aa, Glycine max
  Coding DNA Sequence Number=SeqID_87851
  Gene Ontology: Mol. function=pseudouridylate synthase activity; Biological process=tRNA processing
  Homolog annotation: Hit_ID=Q6ESS0; Match level="QueryCoverage=58%, HitCoverage=14%, E-value=5e-31, Identity=71%"; Hit description =Putative pseudouridine synthase 1
MQCDSHWMDVNINVPTAPEVGLYLDECFFTSYNQKWKDHEELSMKAYEKDAEEFKMKYIYSHIASTEQKEGTVALWLHSLNHRNYPDLHVINEEAIPDNKSADPKEAITDNKSADPKDAITDNKGADLEEHITDNNPVVVTQ

SEQ ID NO: 204630 - protein, 160 aa, Glycine max
  Coding DNA Sequence Number=SeqID_87852
  Subcellular localization annotation: CTP_CleavageSite=30; ConfidenceScore=5.14e-01
MHVQPSVLRRINVDGSQPQTSQGTYPNQVGASASVNPVDPNQGAATASVNPADPNHGVATATVNPFDPNQGASNANVNHVEQNQAASSSSVDPAQAKKVASSSIVILNQAKEVVANSSVITPPRRKVAKQNAKSTRGNNKSTPKTKGNMPKVLPHLIISH

SEQ ID NO: 204631 - protein, 223 aa, Glycine max
  Coding DNA Sequence Number=SeqID_87853
  Gene Ontology: Mol. function=helicase activity; Cellular component =membrane; Biological process=regulation of transcription, DNA -dependent
  Homolog annotation: Hit_ID=Q9FGC2; Match level="QueryCoverage=97%, HitCoverage=29%, E-value=1e-103, Identity=83%"; Hit description=DNA helicase-like
SLASGIRQLLKQLGRSLKKKEKQTVVEVLSSAQVVLATNTGAADPLIRRLDTFDLVVIDEAGQAIEPSCWIPILQGKRCILAGDQCQLAPVILSRKALEGGLGISLLERAATLHEGILTTRLTTQYRMNDAIASWASKEMYGGLLKSSETVFSHLLVNSPFVKPTWITQCPLLLLDTRMPYGSLSVGCEEHLDPAGTGSLYNEGEAEIVLQHVFSLIYAGNHI

SEQ ID NO: 204632 - protein, 345 aa, Glycine max
  Coding DNA Sequence Number=SeqID_87854
  Gene Ontology: Mol. function=DNA binding; Cellular component=nucleus; Biological process=regulation of transcription
  Homolog annotation: Hit_ID=Q1S505; Match level="QueryCoverage=99%, HitCoverage=99%, E-value=1e-109, Identity=58%"; Hit description =Homeodomain-related
  Pfam annotation: Domain name=Myb_DNA-binding; Domain location=14-61; Score=50.8; E_value=4.7e-12; Accession=PF00249.21; Description=Myb -like DNA-binding domain
  Pfam annotation: Domain name=Myb_DNA-binding; Domain location=67-112; Score=39.7; E_value=1e-08; Accession=PF00249.21; Description=Myb-like DNA-binding domain
  Pfam module annotation: Pfam domain module=Myb_DNA-binding::Myb_DNA -binding; Domain location=14-61::67-112
MGRPPCCDKSNVKRGLWTPEEDAKILAYVVNHGTGNWTLVPKKAGLNRCGKSCRLRWTNYLRPDLKHDGFTPQEEELIINLHGAIGSRWSIIAKRLPGRTDNDVKNYWNTKLRKKLMKMGIDPVTHKPVSQVLSDLGSISGLPNTTTYQIAFINKDLMMSNMLPITKTEPSGSNKSTVEHTQEGQVPSWEHHIPYQVIINSENIQSHVLSEAASSTSSSSSSNITQLGSPQSYSCQTPQAQIAPPCSSFDWSEFLQSDSFNWSLNPSSGIIQSEAELSNNAKSNGNDMQGGASEGSGSGAVACGASMEYQINKQCEAHSFVDGILDRDSEIRAAFPELLDASFDC

SEQ ID NO: 204633 - protein, 336 aa, Glycine max
  Coding DNA Sequence Number=SeqID_87855
  Gene Ontology: Mol. function=methyltransferase activity
  Homolog annotation: Hit_ID=Q10D93; Match level="QueryCoverage=81%, HitCoverage=83%, E-value=4e-81, Identity=56%"; Hit description =Expressed protein
  Pfam annotation: Domain name=Cons_hypoth95; Domain location=126-328; Score=187.2; E_value=3.9e-53; Accession=PF03602.5; Description =Conserved hypothetical protein 95
  Subcellular localization annotation: CTP_CleavageSite=55; ConfidenceScore=5.44e-01
MAVLSPPTLSLLLQKTKIINFRVTTTSSSHLLLLLTPPNPSSSLTPIIALQSRIFAESGNGLASEDKKILLDKYGCDVDADEYFSQSSSKSKRRKDSKEQPRRRGGKQVQDPPEDPKPPRTTHKLLQVLGGTARRVKLLSPKGMDVRPMMEVVKGAAFDILQAAGGCPAALRPGHWLDLYSGTGSVGIEALSRGCSEVHLVEMDPWVVSDVLRPNLEETGFLDASVIHTVRVEKFFERAEQFMFSTLSSNHIAMNGNRGPFDYISVTPPYTQVDYGVLMRQISESSLIGENTFIVVEYALKTDMLDSCGSLVKITDRRFGRTLLAIYGPTWSQNKR

SEQ ID NO: 204634 - protein, 51 aa, Glycine max
  Coding DNA Sequence Number=SeqID_87856
MAEASQWHQLKMENNDEGEQSTRDTRVKVSDECITEEDECGSKVEKDSQSR

SEQ ID NO: 204635 - protein, 330 aa, Glycine max
  Coding DNA Sequence Number=SeqID_87857
  Gene Ontology: Mol. function=nucleoside-triphosphatase activity
  Homolog annotation: Hit_ID=Q6YVI6; Match level="QueryCoverage=40%, HitCoverage=17%, E-value=3e-42, Identity=60%"; Hit description =Putative DNA helicase
  Subcellular localization annotation: CTP_CleavageSite=46; ConfidenceScore=5.72e-01
METALTCFFCGRLPPATASSQHFRCSNASASGLVRFSLPPSFRLIRNATNTSETNVKSRRRRRRTCPPLEVEEGILHQNGDPFGKKDLGKSVMSWIRDSMRAMASDLAAAELEGGEGEFELWERMGPGLTFIMLAQPYLNAVPMPIGLEGLCLKVCTHYPTLFDHFQRELRQVLRDSFIQDWRDTKSWKLLKDLANSAQHRAVVRKITQPKSVQGVLGMDFEKVKTIQHRIDEFTSHMSELLRIERDAELEFTQEELDAVPKPDDTSDSSKPIDFLVWGPSCSASTLESKYFVDCINPYSYVSAFDSNKAMDNCRPRRTIRKPVHYRDFV

SEQ ID NO: 204636 - protein, 247 aa, Glycine max
  Coding DNA Sequence Number=SeqID_87858
  Gene Ontology: Mol. function=helicase activity; Cellular component =membrane; Biological process=regulation of transcription, DNA -dependent
  Homolog annotation: Hit_ID=Q9FGC2; Match level="QueryCoverage=99%, HitCoverage=34%, E-value=1e-102, Identity=73%"; Hit description=DNA helicase-like
  Pfam annotation: Domain name=DEAD; Domain location=141-247; Score= -47.8; E_value=0.062; Accession=PF00270.19; Description=DEADDEAH box helicase
MHLVLFKVEGNHRLPPTALSPGDMVCVRTYDSTGAITTSCIQGFVNSFGDDGYSITVALESRHGDPTFSKLFGKSVRIDRIQGLADTLTYEKNGLRKKNPSISVVATLFGDGEDVAWLEKNQLVDWAEENLDARLGNETFDDSQQRAIAMGLNKKRPVLVIQGPPGTGKTGLLKQLIVCAVQQGERVLVTAPTNAAVDNMVEKLSNVGLNIVRVGNPARISKTVGSKSLEEIVNAKLASFREEYERT

SEQ ID NO: 204637 - protein, 86 aa, Glycine max
  Coding DNA Sequence Number=SeqID_87859
  Subcellular localization annotation: CTP_CleavageSite=54; ConfidenceScore=5.06e-01
MGVGGVISCKKLLLGALVSLGVIWFMFLAISVNRQTKRTVLVPMNVISKHLKLVSMQRHALHSNSGLFIVSKRRVPNGPDPIHNRT

SEQ ID NO: 204638 - protein, 42 aa, Glycine max
  Coding DNA Sequence Number=SeqID_87860
MAGDSAAHGGDGGEVADIKVVEDDIAGLGPQSRRQYFHCRGK

SEQ ID NO: 204639 - protein, 85 aa, Glycine max
  Coding DNA Sequence Number=SeqID_87861
MTEGNRVRQDDILNLLRKEWHLVGGELQISRNCARQQTALLVLPPVERHVKNFWNNILLISVPELKHTDSYAHNIQPQLKLPYNS

SEQ ID NO: 204640 - protein, 520 aa, Glycine max
  Coding DNA Sequence Number=SeqID_87862
  Gene Ontology: Mol. function=ubiquitin-protein ligase activity; Cellular component=ubiquitin ligase complex; Biological process =protein ubiquitination
  Homolog annotation: Hit_ID=Q1SHI6; Match level="QueryCoverage=95%, HitCoverage=48%, E-value=2e-66, Identity=32%"; Hit description=U box
  Pfam annotation: Domain name=U-box; Domain location=265-334; Score =42.1; E_value=1.9e-09; Accession=PF04564.6; Description=U-box domain
MVGLELIPIGTILTVLNSQIVKTANAAIDVVIDKESFKVLSKHLLDIAPVLKELQLQELNESEAARVALESLESDIKKANNLVEKYRNRGRFYLLLRCRYIVKEVEQVTRDIGRSLAALSIANTEVLSRISDQVNRLQSEMQTVEFEASQSQLQIVDKLNHGIREQKLDQAFANDVLEEIGRAVGVPVEPSEVSKELASIRKEMEEAATRKERAEFIFLEQIIELLSRADAARDYEEVKKQYFRRVQVIERYDSREKYIRPLNSFLCPITGAVMVDPVSLCTGTTCERSAIEAWFDDGNRIDPETKEVLEDTTLRSNVRLRESIEEWREVNYCFGIRSIKESLLSNSDLLVKESLSQIQALIRENSINKDWISIGELTDIIISILGESDSTDAKMKILITLKDSVQGHARNKEKVVESQGWYHIISCLGSDSRISKEAIDLLYELLQNRSGWNKSFCKKLSDHPSAVSYLVTLLKGPVSNSAGVSEKILMELSEIDEENISAAAKFGWYKPLTDRMIQVQ

SEQ ID NO: 204641 - protein, 267 aa, Glycine max
  Coding DNA Sequence Number=SeqID_87863
  Gene Ontology: Mol. function=glucose-6-phosphate isomerase activity; Cellular component=cytosol; Biological process=gluconeogenesis
  Homolog annotation: Hit_ID=Q1S513; Match level="QueryCoverage=88%, HitCoverage=94%, E-value=1e-116, Identity=88%"; Hit description =Phosphoglucose isomerase
  Pfam annotation: Domain name=PGI; Domain location=51-266; Score= -29.7; E_value=1.3e-09; Accession=PF00342.9; Description =Phosphoglucose isomerase
MASSTLICDTQQWKELKAHAEDVEKTHLRDLLSDDERSQSMVVEFDGILLDYSRQQATLETREKLFKLAEVASLKQKINQMYNGEYINSTENRSVLHVALRAPRDAVIQSDGNNVVPDVWNVLDKIQEFSERVRSGSWVGATGKELKDVVAVGIGGSFLGPLFVHTALQTDPEAIESARGRQLRFLANVDPIDVARNITGLNPETTLVVIVSKTFTTAETMLNARTLREWISNALGGLLNRIWGLYLLDFSIMNIMPPSPDFFKIYS

SEQ ID NO: 204642 - protein, 62 aa, Glycine max
  Coding DNA Sequence Number=SeqID_87864
MRTRTKVLVVEGYVDFNILEKVQMQGVVVGHAFDLTTLSGYDDLIDGLKKLLETRGELRSQD

SEQ ID NO: 204643 - protein, 378 aa, Glycine max
  Coding DNA Sequence Number=SeqID_87865
  Gene Ontology: Mol. function=protein-tyrosine kinase activity; Cellular component=integral to membrane; Biological process=protein amino acid phosphorylation
  Homolog annotation: Hit_ID=Q1S510; Match level="QueryCoverage=92%, HitCoverage=67%, E-value=2e-93, Identity=59%"; Hit description =Protein kinase
  Pfam annotation: Domain name=LRRNT_2; Domain location=28-71; Score =31.1; E_value=3.9e-06; Accession=PF08263.3; Description=Leucine rich repeat N-terminal domain
  Pfam annotation: Domain name=LRR_1; Domain location=102-124; Score =8.7; E_value=6.7; Accession=PF00560.23; Description=Leucine Rich Repeat
  Pfam annotation: Domain name=LRR_1; Domain location=127-149; Score =13.6; E_value=0.71; Accession=PF00560.23; Description=Leucine Rich Repeat
  Pfam annotation: Domain name=LRR_1; Domain location=151-173; Score =18.2; E_value=0.031; Accession=PF00560.23; Description=Leucine Rich Repeat
  Pfam annotation: Domain name=LRR_1; Domain location=175-197; Score =11.2; E_value=2.2; Accession=PF00560.23; Description=Leucine Rich Repeat
  Pfam module annotation: Pfam domain module=LRRNT_2::LRR_1::LRR_1::LRR_ 1::LRR_1; Domain location=28-71::102-124::127-149::151-173::175-197
MDRSNTFSSSLLLLSLLGFHLFFVSSQVEDDVTCLKGIKETLSDPLNRLSNWRFDNTTVGFICDFVGVSCWNQRENRVIGLDLQDFKLSGKIPEALKYCGNSIQRLDLASNSFSSEIPHEICTWMPFLVSIDLSSNQLSGVIPPTIDNCSYLNELVLSNNQLSGSIPFEFGNLGRLKKFSVANNRLTGTIPAFFNGFDREGFEGNSGLCGGPLGGKCGGISKKNLAIIIAAGVFGAAASLLLAFGLWWWYHLSGKNKKKGYGVGSGGVGGGGGGDWAMRLRGYKLVQVSLFQKPIVKLKLGDLMAATRREQRIRADLPDGVCTRGEAVECVQDRGEAVWDGDESVGAGLGLGWVRRGGLRGCTMAATLRSYSRTFAPV

SEQ ID NO: 204644 - protein, 492 aa, Glycine max
  Coding DNA Sequence Number=SeqID_87866
  Gene Ontology: Mol. function=binding; Cellular component=ubiquitin ligase complex; Biological process=protein ubiquitination
  Homolog annotation: Hit_ID=Q93XC9; Match level="QueryCoverage=72%, HitCoverage=70%, E-value=4e-32, Identity=29%"; Hit description =Armadillo repeat-containing protein
  Pfam annotation: Domain name=Arm; Domain location=11-50; Score=3.9; E_ value=3.9; Accession=PF00514.13; Description=Armadillobeta-catenin -like repeat
  Pfam annotation: Domain name=Arm; Domain location=146-186; Score=5.3; E_value=2.6; Accession=PF00514.13; Description=Armadillobeta-catenin -like repeat
  Pfam annotation: Domain name=Arm; Domain location=189-230; Score=9.2; E_value=0.85; Accession=PF00514.13; Description=Armadillobeta-catenin- like repeat
  Pfam annotation: Domain name=Arm; Domain location=232-272; Score =19.1; E_value=0.016; Accession=PF00514.13; Description=Armadillobeta- catenin-like repeat
  Pfam annotation: Domain name=Arm; Domain location=275-315; Score=5.5; E_value=2.5; Accession=PF00514.13; Description=Armadillobeta-catenin -like repeat
  Pfam annotation: Domain name=Arm; Domain location=351-391; Score =13.2; E_value=0.28; Accession=PF00514.13; Description=Armadillobeta -catenin-like repeat
  Pfam module annotation: Pfam domain module=Arm::Arm::Arm::Arm::Arm::Ar m; Domain location=11-50::146-186::189-230::232-272::275-315::351-391
MARAIVNLELKDLNLKLLGEQGVILPLLEMLSGSIESKELSLSSLVKLAKLHANKGIIAASGGVPLVLDLMFFCRMRPFITIKCCEILEKLASDDDGIDFLVDGKGNQLELENIITNLLALTQGPNSAHYRKPALRALLGICKFETGLVKKAVLAANGISLILPILDDSDSEIRETAINILFLFSQHEPQGLVEYLFSPRRLQALVGFLENDDNDDVQMAAAGLLANLPKSERELTMELIDLGGLDAILSILKNGTMEAKENALSALFRFTDPTNIESQHDLVKRGLYPLLVNFLNTGSVTAKARAAAFIGDLSMSTPKLTAVSKSTGCTRWWCFRPSKVPLCSAHGSVCSVSSTFCLLEANALPGLIRLLHGEVHATAYEAIQTLSTLVLEDFPQRGARVLHESNAMRPLLEILNWGTDSLKSEAIGLLEKVFVSKEMVEYYGTRARLSLLGLTGITVYGDGHLRRKAARVLSLLERYSKSSSSAFSGVQE

SEQ ID NO: 204645 - protein, 678 aa, Glycine max
  Coding DNA Sequence Number=SeqID_87867
  Homolog annotation: Hit_ID=Q8H4R8; Match level="QueryCoverage=86%, HitCoverage=79%, E-value=1e-51, Identity=26%"; Hit description =Pentatricopeptide repeat-containing protein-like protein
  Pfam annotation: Domain name=PPR; Domain location=191-225; Score =16.5; E_value=0.084; Accession=PF01535.11; Description=PPR repeat
  Pfam annotation: Domain name=PPR; Domain location=264-298; Score=8.3; E_value=0.79; Accession=PF01535.11; Description=PPR repeat
  Pfam annotation: Domain name=PPR; Domain location=399-433; Score =15.9; E_value=0.098; Accession=PF01535.11; Description=PPR repeat
  Pfam annotation: Domain name=PPR; Domain location=434-468; Score =22.8; E_value=0.0012; Accession=PF01535.11; Description=PPR repeat
  Pfam annotation: Domain name=PPR; Domain location=541-575; Score =29.8; E_value=9.6e-06; Accession=PF01535.11; Description=PPR repeat
  Pfam annotation: Domain name=PPR; Domain location=616-650; Score=0.3; E_value=6.8; Accession=PF01535.11; Description=PPR repeat
  Pfam module annotation: Pfam domain module=PPR::PPR::PPR::PPR::PPR::PP R; Domain location=191-225::264-298::399-433::434-468::541-575::616 -650
  Subcellular localization annotation: CTP_CleavageSite=53; ConfidenceScore=5.47e-01
MAANCNYGTARVSSNKSVQSIVKSVGSYLANSSWQAFPLGSENKFALQGLYVSSVAERSRLKTQQNKLVTSYVDSLDIQYLEKAYELVECAIEEGKQVLLEKEVLIYVSFGLAKARLPVPSSTVLRKMIAIEHFTPVTAWSAVLAHMSQTAEGSYLAAELILEIGYLFQNNRVDLRKKSNAPLIAMKPNAAAFNIALAGCLLFETSRKAEELLDMMPRIGVKADANLLIIMARVYERNGQREELKKLQRHMEEAPNLNDLEFRQFYNCLLTCHLKFRDLDSASNMVLEMLRKAKEARNSLAAAKFMTNAAEIDHSHSPGLASVHSLNNSKDLYSLQNNRPITNAVLSYEEFSKDRNFLKLESESKAILSSLLAKLQMQDLAVFLLNAEREDSPFSNDNSALVHVINACISLGWLDQAHDLLEEMRLAGVRTGSSVYSSLLKAYCRANRAADVTSLLRDAKIAGIQLDSSSYEAMIQSRVLQQDTQGALQLFKERKEARIPKVTQQNSGLMAKSGTETDEAGLVTKLLQEIKEGQSVDCGVHDWNNVIHFFCKKRLMQDAEKALKKMRSLGHLPNAQTFHSMVTGYAAIGGNYQEVTELSGEMKALASSISMKFDQELLDSVLYTFVRGGFFTRANEVVTMMEKGKMFVDKYKAQQYSINCFAFVACTGMHLKKWAMEK

SEQ ID NO: 204646 - protein, 399 aa, Glycine max
  Coding DNA Sequence Number=SeqID_87868
  Gene Ontology: Mol. function=inositol or phosphatidylinositol phosphatase activity; Biological process=abscisic acid mediated signaling
  Homolog annotation: Hit_ID=Q1RYG3; Match level="QueryCoverage=93%, HitCoverage=84%, E-value=1e-137, Identity=73%"; Hit description =Inositol polyphosphate related phosphatase
MPAILQNSFAFDFLGLALLTLFFLFKLSWPKSLVKKWFNIKSKAEDFHADDVLSQGVDEECSSNYSEREACTIRKSKSERSSRWYSDRMRRGKNDLDEAQVTDVYNYRIFAATWNVAGKSPPSYLNLEDWLHTSPPADIYVLGFQEIVPLNAGNVLGTEDNGPARKWLALIRRTLNSLPGTSGGCHTPSPLPNPIVELDADFEGSMRQKATSFFQRRSFQSLSRSMRIDNDMIKPQACLERRLSVCDRVMFGHRTSDYDPNYRWGSSDEENGTGGSPITTQYSPMSYGGCFTTEDSDRQTGHSRYSLVASKQMVGVFLTVWVKSDIRDDVHNMKVSCVGRGLMGYLGNKLCIEQRQGRVFEGWNEGKIYFPPTYKYSNNSDRYAGDDRRSKQKRRTPAW

SEQ ID NO: 204647 - protein, 83 aa, Glycine max
  Coding DNA Sequence Number=SeqID_87869
  Gene Ontology: Mol. function=peptidase activity
  Homolog annotation: Hit_ID=Q1RYG6; Match level="QueryCoverage=88%, HitCoverage=34%, E-value=3e-12, Identity=50%"; Hit description=Plant lipid transfer/seed storage/trypsin-alpha amylase inhibitor
  Subcellular localization annotation: CTP_CleavageSite=44; ConfidenceScore=5.01e-01
MDCACLVISANAPFFQQPISQALALSLSQACSINGVPLQCKGYIAASGSPLPVPDTFRPDPAVLGPDSPTLPSIANITIKPKV

SEQ ID NO: 204648 - protein, 806 aa, Glycine max
  Coding DNA Sequence Number=SeqID_87870
  Gene Ontology: Mol. function=actin filament binding; Cellular component=intercellular junction; Biological process=actin cytoskeleton organization and biogenesis
  Homolog annotation: Hit_ID=UPI0000162EB3; Match level="QueryCoverage =57%, HitCoverage=58%, E-value=3e-99, Identity=43%"; Hit description =actin binding
  Pfam annotation: Domain name=Extensin_2; Domain location=3-387; Score= -132.8; E_value=0.04; Accession=PF04554.4; Description=Extensin-like region
  Pfam annotation: Domain name=FH2; Domain location=362-787; Score =421.5; E_value=1.2e-123; Accession=PF02181.13; Description=Formin Homology 2 Domain
  Pfam module annotation: Pfam domain module=Extensin_2::FH2; Domain location=3-387::362-787
MMLLLLVILFVLQGFPIPTCYCQTNTPQNIETFYPIQTPKPPLLIQPPEAQPKPQASPPSPRPVAASKTSSSSSKIGTAVAATAAGTLVVSGLIFFLVQRCFRARKRKEAKNNTASAVDRRVVPQVDVFKRMEGNVKGLIVDDDGLDVVYWRKLEGKKLPDKDFQREVLDSTEDKIEDDHEGNNGKRSESIQETLLLRDRSSASHMNIFLPEQSYTIMRIPPPAPPPSVPSSIGGSSTQLSSPPFTPSSPKPLNTFFSSIPNTSSPAPPIPPPTIPDRNNQAPAPPPPPPPIPGIKSSALPLPPPPPIPVKKSSTPPPPPPPIPPRKSPAPPPPPPKAHGLKSSSKPPPTPIERTPSTTSKEGNTSPEVKLKPLHWDKVTTNLDHSMVWDKMDRALADDFLNIRVDDDLMEALFGLVAANRNDSTPKVNNSMSPSRDALAPSVNTFILDPRKSQNIAIVLKSLAVSRKEIIEALIDGQGLNADTIEKLGRVAPTEEEQTLIVAYEGNPSKLAAAESFLHHILRAVPSAFKRLNALLFRLNYDSEIVEIKEFLQTLALGCKELRNQGMFVKLLEAVLKAGNRMNAGTQRGNAQAFNLVSLRKLSDVKSTDGKTTLLRFVVEEVVRAEGKRAVLNRNHSLSRSSSRNSNSSVDSQNSAVSNEQRQREYITLGLPVVGGISSEFSNLRKAAVTDYKSFVGSISSLSARIVEIRELVSQCGNDKGGNFVREMNNFLENAEEELRLVREEQTRVMQLVKRTTDYYQGGSSKESAENPLYLFVIVKDFLGMVDQACIEIARNMQKRKTKTSL

SEQ ID NO: 204649 - protein, 277 aa, Glycine max
  Coding DNA Sequence Number=SeqID_87871
MNNLTSWKEVYSGPTKILINPSTRVRSKKYNEALNGLIQEIGTNNMVIEQDNPKLLFLSCLTSSRSLQDICVGIFVLGWKLASIEVEGLWIFLKELPLNLYKLTILCRLDVEAKLHDESRLIQICFDDYKDNDKGDDKKLKDRIKNTSRFKRKVEEHFKTQKEKLKNTSRFKRKVEFKNQESRFKDQASRSRFKIQDSRIKRRLNQDKYEKRVHLLGLLTKNKRGYISCGSVLVEGTSSRFKENKGGYIPCGSLLVKGFLQGWKRNLKDRRSLGDWM

SEQ ID NO: 204650 - protein, 100 aa, Glycine max
  Coding DNA Sequence Number=SeqID_87872
MPYKIGVENLENIKLNLKTLMHEVGTRPSKEEVGPRKHRKRHASLDGPTLSLWIIEVRYVGQEYKEEYRTGTVQESMDKIPSISEERIEIFKKDKNQPVY

SEQ ID NO: 204651 - protein, 283 aa, Glycine max
  Coding DNA Sequence Number=SeqID_87873
  Homolog annotation: Hit_ID=Q8LGS1; Match level="QueryCoverage=97%, HitCoverage=99%, E-value=4e-34, Identity=38%"; Hit description =Senescence-associated protein SAG102
  Pfam annotation: Domain name=DUF581; Domain location=220-278; Score =93.2; E_value=7.7e-25; Accession=PF04570.5; Description=Protein of unknown function (DUF581)
  Subcellular localization annotation: CTP_CleavageSite=8; ConfidenceScore=5.35e-01
MLLRNRSRAVTKPGLMADHSTQNSSPNQNYAKTIIPSLFGSPKFRDFTNKCLSSGTEALRSPTSILDARALSPFAFGSPFSTLPNKSSSQNRTWDKPDSKGGIGLALVGALKDEDTSISHNSEPNKGNVLLRVKIPFESQFQTCVDDFGTTKTNNGSKNSSGSGICAKDCCDSPRSGGVLSWSEMELSEEYTCVISHGPNPKATHIFNNCIVVETYCSLPQKHNSHHSAATSGNFLSFCYTCKKHLDQTKDIFIYRGEKAFCSRECRHREMMLDGIENLEFEN

SEQ ID NO: 204652 - protein, 53 aa, Glycine max
  Coding DNA Sequence Number=SeqID_87874
MATIRHVKFLTSLAKPQHRGVKCVLETFDFVQVSIFVFWGDLVDPIHLGLVTA

SEQ ID NO: 204653 - protein, 256 aa, Glycine max
  Coding DNA Sequence Number=SeqID_87875
  Gene Ontology: Mol. function=metalloendopeptidase activity; Cellular component=proteinaceous extracellular matrix; Biological process =peptidoglycan metabolic process
  Homolog annotation: Hit_ID=P29136; Match level="QueryCoverage=95%, HitCoverage=88%, E-value=8e-70, Identity=60%"; Hit description =Metalloendoproteinase 1 precursor
  Pfam annotation: Domain name=PG_binding_1; Domain location=22-79; Score=30.2; E_value=7.2e-06; Accession=PF01471.9; Description =Putative peptidoglycan binding domain
  Pfam annotation: Domain name=Peptidase_M10; Domain location=113-247; Score=159.7; E_value=7.6e-45; Accession=PF00413.14; Description =Matrixin
  Pfam module annotation: Pfam domain module=PG_binding_1::Peptidase _M10; Domain location=22-79::113-247
MAHGMNSLLTPVATTTKAYPTSKTTSTILATSLTLMHHLLDDKFDDTLVSAIKTFQKNYNLDITGKLDNNTLRQLTTPRCGVPDIINTNTTTQHTQLHIHTVSHYSFFNGAPRWPAGTRQLTYAFSPELNLNCAAKSLFARAFNSGDHNDGLPFDGPLGEWAHAFAPTNGWCHFDADEYWVASGDVTQSPVARAVDLESIAVHEIGHLLGLHHSSDQRAIMYAYLPPRTRKVNLAQDDINGIRHLYCLWMLLNEHE

SEQ ID NO: 204654 - protein, 558 aa, Glycine max
  Coding DNA Sequence Number=SeqID_87876
  Gene Ontology: Mol. function=nucleic acid binding
  Homolog annotation: Hit_ID=Q9FFU3; Match level="QueryCoverage=99%, HitCoverage=98%, E-value=0.0, Identity=59%"; Hit description=Genomic DNA, chromosome 5, P1 clone:MBG8
MSPSSLHALLIILFLGSAHALKVPFRVNDVLPVLPHGISWPLLNNLHSAVDLLPSFVAAVPPDNDSVQWRAACFYDNQASLEFTAPGHDDADGLGGAVLRLKRLTLIRTQSLVKLSYVNYHTDQEFRFLVKGFSISKMSKTEAAHSWTCMDLYVFATPYRITWDYYFSAREHTLKFDSWEDPAELEYVKRHGVSVFLMPSGMLGTLLSLVDVLPLFSNTAWGQNANLDFLKKHMGATFEKRIQPWRATVDPADVHSGDFLAVSKIRGRWGGFETLEKWVTGAFAGHTAVCLKDEMGNLWVGESGHENEKGEEIIVVIPWHEWWTLALKDNSNPQIALLPLHPELRARFNSTAAWEYARSMSGKPYGYHNMIFSWIDTVADNYPPPLDAHLVISVMSMWTRMQPAYAANMWNEALNKRLGTEDLDLHDILIETEKRGIAFDQLLTIPEQDEWVYSDGKSTTCVAFILSMYKAAGIFGPISSSIQVTEFTIRDAYMLRIFEDNQTRLPRWCNNENDRHPFCQILGEYRMELPGYNTLDPYANMNEHCPSLPPTYDRPLKC

SEQ ID NO: 204655 - protein, 187 aa, Glycine max
  Coding DNA Sequence Number=SeqID_87877
  Gene Ontology: Mol. function=zinc ion binding
  Pfam annotation: Domain name=zf-MYND; Domain location=6-39; Score =34.4; E_value=4e-07; Accession=PF01753.9; Description=MYND finger
GSGGRCGGAATRLCARCEAVAYCSLSHQIAHWNRHKHECDSLQQQLKSVEVLNDFPFTFSREATFQPLTIYHAARLVGVTALNPEIIGPEKELLQLAVFGELLALFPGVRIHIELVGPAIPPQRDGEKIHISKYPCCNEDECECKIGSTDTFLETQSGITSALTLQLWQGFYHDRYRDIVKVLCNNI

SEQ ID NO: 204656 - protein, 98 aa, Glycine max
  Coding DNA Sequence Number=SeqID_87878
MSGTPHRSLDGCYCFLVKRNVEWRRGLKGKLLFDIVHVILPYSLLERLAPFCPSHFGSGRRMETEIRQKGLVDKEKECIRYGFMLTAISFSLSELEST

SEQ ID NO: 204657 - protein, 562 aa, Glycine max
  Coding DNA Sequence Number=SeqID_87879
  Gene Ontology: Mol. function=oxidoreductase activity; Cellular component=endoplasmic reticulum; Biological process=electron transport
  Homolog annotation: Hit_ID=O81117; Match level="QueryCoverage=84%, HitCoverage=93%, E-value=0.0, Identity=68%"; Hit description =Cytochrome P450 94A1
  Pfam annotation: Domain name=p450; Domain location=92-553; Score =157.4; E_value=3.8e-44; Accession=PF00067.12; Description=Cytochrome P450
GVATILVMGLEFGLWDQYGTFLGCLKLGDSGYARNAVLCSVLLSICTCNWESVAVLVPLFFFFILPVLFFFFLGHSSAGLKKKKETDSRRTITLPKTYPLIGSYLAIQAVGNRRIQWLSDMVKISSGATFTFHRPLGRSHVFTGNPATVEYILKTRFSNYQKGRTAINILSDFLGTGIFNADGNTWKFQRQVASHEFNTKSLRKFVEHVVDAELSNRLVPILALAAAQGKTLDFQDILQRFAFDNICKIAFGFDPEYLKPSAERSKFAKAFEEATEISSKRFREPLPLIWKVKRALNIGSEKKLRIAVKEVLEFAKHIVREKKKELKEKESLESVDMLSRFLSSGHSDEDFVTDIVISFILAGKDTTSAALTWFFWLLSKNPRVEKEVLKEIMEKSEAPVYDEVKDMVYTHAALCESMRLYPPVPLDTKETMNDDVLPSGTVVKKGMFVTYHVYAMGRMESIWGEDWAEFKPERWLEKLQTGKWNFVGRDSFTYPVFQAGPRICLGKEMAFMQMKRLVAGILRRFTVVPTVAKGVEPHYFAFLTSQMEGGFPVKILERVHSD

SEQ ID NO: 204658 - protein, 186 aa, Glycine max
  Coding DNA Sequence Number=SeqID_87880
  Gene Ontology: Mol. function=protein serine/threonine phosphatase activity; Cellular component=protein serine/threonine phosphatase complex; Biological process=protein amino acid dephosphorylation
  Homolog annotation: Hit_ID=Q9M3V1; Match level="QueryCoverage=63%, HitCoverage=33%, E-value=2e-22, Identity=46%"; Hit description =Protein phpsphatase 2C
MAADGTGVAVVGDDEFVQHGDDDDDGGSGGIAVGSLELAPVGEGLVALAPTINLVVHASESILHRQLSLQILNMNMRATLTVENAKVVEALGEGRPHQNGIFHVSSPPQTDVTPNLGESSTFDLCCNLQVLVSNLCRSLQAHGSDLVVRVRKPETVLAKLVKTSYPKFAREREEEETVANDGGARD

SEQ ID NO: 204659 - protein, 486 aa, Glycine max
  Coding DNA Sequence Number=SeqID_87881
  Gene Ontology: Mol. function=DNA binding; Cellular component=nucleus; Biological process=regulation of transcription, DNA-dependent
  Homolog annotation: Hit_ID=Q1T199; Match level="QueryCoverage=89%, HitCoverage=30%, E-value=1e-163, Identity=66%"; Hit description =Homeobox
MMSNLNVGGTGNERFELSQQFLQSVSKSPFPFNTGKQAVKFSAWLEERGKDLTEVGANLAEDLQCGDIFHLFALVSSGELSISPFLPDNGVGEAEDLRSAKRKSDTTESSYSDKAKKSKSFFGVEGEIISRREKGFPGIIISAHRTTISRADILNLFKDNDNYGQPFEGDFQLNIGQSSNYSLPDHILEITKSSDPVPLEENRSESPWEAMAGYARHLLSEYSNKKHAYAICAEVFRVVYAAIQKAGDQGLSMGEISQVINLPGAEIDVLIVDALQAFGQALKVNAYDTVRVVDVLYRHKYFLTPMSDFHLHVVQPSSTKTIEKSDHTCELYESEERDTTSVDTSRERNTAIDSVHTLTILNLPHGDVDPENQACDRNEGCKQNRLGLSRVNHKKETLEFSSGESCVPILPWVNGDGTINNIVYRGLRRRVLGIVMQNPGILEISNRIIKEDKKDILRERELGKQEVKNDIKPLNFVLQFGIYRLE

SEQ ID NO: 204660 - protein, 91 aa, Glycine max
  Coding DNA Sequence Number=SeqID_87882
MEVVASLNGRVVFLEEVILCGRPKIYWRVGTMGIHGGNGEVVEEDDDGMEVLIRKGDIGDLRLGSMEPFLDFNLLVFDCLLEEKDVLVLSM

SEQ ID NO: 204661 - protein, 267 aa, Glycine max
  Coding DNA Sequence Number=SeqID_87883
  Gene Ontology: Mol. function=binding
  Homolog annotation: Hit_ID=Q9LS90; Match level="QueryCoverage=86%, HitCoverage=50%, E-value=6e-79, Identity=64%"; Hit description =Arabidopsis thaliana genomic DNA, chromosome 3, P1 clone: MXC7
  Subcellular localization annotation: CTP_CleavageSite=50; ConfidenceScore=5.10e-01
MVVRIAISGNENSHGQHHESKAKSGGAAGGVAVTPAKRGRPFGSGNNSASAAASAADSAAPSNLLGPSLHVHNSFADQNNKRIVLALQSGLKSELTWALNILTLLSFKEKDDMRKDATPLAKIPGLLDALLQVIDDWRDIALPKELAKTTRVRTLGASSVVTGFGCEYQALGSTGTHHRPGVGSGSAGIESTQQNGVTKSRFSELWLDEDSLFNLDDEGRTEKQQCAVATSNIIRNFSFMPDNEVIMVQHRHCLETAFQCIEDHLVG

SEQ ID NO: 204662 - protein, 134 aa, Glycine max
  Coding DNA Sequence Number=SeqID_87884
MAEEMDLQLQHLTWHLTKVFEKEREEFCKMLDRHRRSHERGSINGTYPRRPHKQGTLLKNASLRRVKHLVALVPSALLYCIIPWNRNVIHLEEETYKVDMLGIRGLNSRTNFPKEGGDDDRDQGRPLDLRGRIP

SEQ ID NO: 204663 - protein, 61 aa, Glycine max
  Coding DNA Sequence Number=SeqID_87885
  Subcellular localization annotation: CTP_CleavageSite=14; ConfidenceScore=5.02e-01
MAMQDFGSVQHNPQAMWVWTTWLARRVRTNVLSLCKSADTIVGLCRARRPAYPHLILTVDG

SEQ ID NO: 204664 - protein, 90 aa, Glycine max
  Coding DNA Sequence Number=SeqID_87886
MRYETLINLVIGGVKDEKFKGLINDGIKGDHKLRFLMLARRRSSFLKLWTLRVAFVMLLWTIVVQFKGLGDMVTPSMFKTRSSASSLPPQ

SEQ ID NO: 204665 - protein, 259 aa, Glycine max
  Coding DNA Sequence Number=SeqID_87887
  Homolog annotation: Hit_ID=Q9LIJ8; Match level="QueryCoverage=98%, HitCoverage=71%, E-value=1e-73, Identity=56%"; Hit description =Arabidopsis thaliana genomic DNA, chromosome 3, BAC clone:F5N5
  Pfam annotation: Domain name=DUF506; Domain location=65-259; Score =275.6; E_value=1e-79; Accession=PF04720.3; Description=Protein of unknown function (DUF506)
MAPMKVQPIAIDIDSEKVKATTAAVVVRNESVLKSRLRRLFVFDRQLPKNNNKDAAEFEPSSLCLAKMVQNFMEEQPPAPPKCGRNRCNCFNANSSDEDDFDLFGAAPAPESSNADATESLKSLIPCASVGERNLLAEVARIVEKNGKSIKRKDDLRKVVAEALSSLGYDSSICKSKWEKTSSCPAGEYEFIDAIVEGERLIVDVDFRSEFEIARSTGTYKAMLQSLPFIFVGNSERLTQILAIVSDAAKQSLKKKGMH

SEQ ID NO: 204666 - protein, 1105 aa, Glycine max
  Coding DNA Sequence Number=SeqID_87888
  Gene Ontology: Mol. function=DNA binding; Cellular component=beta -galactosidase complex; Biological process=DNA integration
  Homolog annotation: Hit_ID=Q1SS72; Match level="QueryCoverage=99%, HitCoverage=80%, E-value=0.0, Identity=42%"; Hit description =Integrase, catalytic region
  Pfam annotation: Domain name=rve; Domain location=524-684; Score =156.2; E_value=8.4e-44; Accession=PF00665.16; Description=Integrase core domain
  Pfam annotation: Domain name=zf-CCHC; Domain location=246-263; Score =11.6; E_value=0.012; Accession=PF00098.13; Description=Zinc knuckle
  Pfam annotation: Domain name=zf-CCHC; Domain location=282-299; Score =13.4; E_value=0.0062; Accession=PF00098.13; Description=Zinc knuckle
  Pfam module annotation: Pfam domain module=RVT_2::Retrotrans _gag::rve::zf-CCHC::zf-CCHC; Domain location=886-1103::77-192::524 -684::246-263::282-299
MNETTFNNVESYLYLHPSENPATALVSPVLDSTNYHSWSRSMVTALSAKNKLEFVDGTAPEPLKTDRLYGAWRRCNNMVVSWIVHSVATSIRQSVLWMDKAEDIWRDLKSRYSQGDLLRISDLQQEASTLKQGALSITEYFTRLRVIWDEIESFRPDPICTCNVRCSCSVSTIIGQRKLEDRAMQFLRGLNEQYTNIRSHVLLMDPIPPISKIFSYVAQQERQLLGNCSPNLNFEAKEISINTARSACEYCGRSGHTESVCYKKHGMPSSHETRYKSNGGRKTCTHCGKMGHTVDVCYRKHGYPPGYKPYNGRTTVNNMVTMNDKFQEDQTQHHEAQDLVRFSPEQHKALLALIQRPSTGSTAPEQTKQVASISSCTTDKPSIPGISSSIISSWILDSGATNHVTCSLNYLHAYKPINPVAVKLPNGHHDTNKRTKIGIVEERHGLYHLIPDQHNKTVCSTIVHPKSNVIPIDLWHFRMGHLSTERLQCMKPHYPILNHDKNFVCNTCHYAKHKKLSFSSSTSHALHNFDLLHMDIWGPCSKTSMHGHKYFLTIVDDHSRFTWIHLMHSKAETRDIIIGFITFIETQHNKRVKTIRSDNGPEFLMPGYYKSKGIVHQTSCIETPEQNGIAERKHQHLLNVTRALLFQANMPPKFWNYALIHAAYLINCIPTPFLHNTSPYERLHGHIPDISHLRVFGCLCYASTIKANRKKLEPRAHPCIFIGFKPNTKGYMLYDLHSHNIITSRNVIFYEDHFPQIVDTQHSCIEPSSTLPEPFSNIHYEPIIETTSTQHSVQEPISQTHTMEPTSPQPRRSNRRTQAPTYLRDYHHALSSLDTNTSTKARYPLSSVLSYSRLSPTHKHFIMTITSTIEPSSYAEASQHDCWIKAMRAELDALQSNKTWRLTPLPPHKTAIGCRWIYKIKHRSDGSIERYKARLVAKGYTQMEGLDYLDTFSPVAKLTTVRFLLAVAVMNKWHLRQLDVNNAFLHGELDEEVYMQVPPGLTTPNPNLVCRLQCSLYGLKQASRQWFLKLSSLLTAHGFHKSQSDHSLFLRFTELTTTIILVYVDDIILTGNSSSEIQTMITILDHTFKIKDLGDLKYFLGLEVA

SEQ ID NO: 204667 - protein, 211 aa, Glycine max
  Coding DNA Sequence Number=SeqID_87889
  Homolog annotation: Hit_ID=Q1RV25; Match level="QueryCoverage=33%, HitCoverage=20%, E-value=5e-21, Identity=69%"; Hit description=C2; Arf GTPase activating protein
  Pfam annotation: Domain name=XH; Domain location=1-109; Score=-46.6; E_value=0.065; Accession=PF03469.5; Description=XH domain
FPLEEAGTKGVKLCSLWQENVKNSAWHPFKVVTVDDKASFLPAKWGAAFVNEKAVSLTLEDDIVQTRNDACKDSDQTFIILYLAANSNFHERKKMNFYIKADRTNSKTQVLAVISEKISFNESTIGKGAERRAKATEACVVHYSLQTLFSYFQVLSVTLDEWSSDEIDAMIEVRGNSSANSIYETYFPKGYTKPGPDVSHEQHAKFIRPLS

SEQ ID NO: 204668 - protein, 144 aa, Glycine max
  Coding DNA Sequence Number=SeqID_87890
MDIMLYGILCPITYDKKVMINFLITANLTYMYRLIHSFLFNMVMPRLGSQDYVSDRDKFCMYKVMVGEKAFKDKFNPKLKGMTFVKTGIAKNFLEYAQKYIKKKVKKEPKEEPQFVVGQAMDTQDQPVDLESKIVSLQIHGEQA

SEQ ID NO: 204669 - protein, 204 aa, Glycine max
  Coding DNA Sequence Number=SeqID_87891
  Gene Ontology: Mol. function=DNA binding; Cellular component=beta -galactosidase complex; Biological process=DNA integration
  Homolog annotation: Hit_ID=Q1S3I6; Match level="QueryCoverage=97%, HitCoverage=13%, E-value=2e-65, Identity=57%"; Hit description =Integrase, catalytic region
MSSPTNMHLQAAYRVLRYLKGTPGSGIYLSAVGNPQLRAFSDSDWAGCQDSRRSITGFIVYLGSSPVSWQSKKQTTVSRSSSEAEYRALASTTCELQWLTYLLQDFRIKFVEPATIYCDNHSAIQIATNPVFHERTKHIEIDCHIVRQRVTSGHLKLLPVQSSSQLADIFTKALPPTVFQTLCNKLGMLNIHSQLEGGILTASS

SEQ ID NO: 204670 - protein, 189 aa, Glycine max
  Coding DNA Sequence Number=SeqID_87892
MAESDGSDNNCKGSTDDEMTLMSRKFKQMMKNKVKFQHSSRPKDIRHFGDKKKKSLMVTWDDSNNGKSNNSDNKQAKICLMADKQKDVSIRRYKCLRGTNAHGPKKIWVPKSHIVLVANILGRKMPGFKLVPEQWMLTTHDNFKDMQIGLSVASKIDKIKSSNEILPQFGESSSQHPHTKDWKFVNYHP

SEQ ID NO: 204671 - protein, 81 aa, Glycine max
  Coding DNA Sequence Number=SeqID_87893
MTNEEHRMKNDVEVDYGHNSIALRPHGIKGHGNSPMRAGYFTPKLFGGPGEPEASLGKPGFRKRLKMTLLGIFCILDQNIE

SEQ ID NO: 204672 - protein, 160 aa, Glycine max
  Coding DNA Sequence Number=SeqID_87894
  Gene Ontology: Mol. function=protein binding; Cellular component =Golgi apparatus; Biological process=endocytosis
  Homolog annotation: Hit_ID=Q9LYF9; Match level="QueryCoverage=96%, HitCoverage=25%, E-value=2e-47, Identity=63%"; Hit description =Clathrin binding protein-like
  Pfam annotation: Domain name=ENTH; Domain location=15-148; Score =141.5; E_value=2.3e-39; Accession=PF01417.11; Description=ENTH domain
MGLEKREVNLKVLKVSEIESKVLDATDNEPWGPHGTVLAEISKATKKFTECQMVMNVLWTRLGETGKDWRYVYKISVRTILLYLVNLFLQLTTVLISRIREYFLIIYSGLVKALSSFEYVEPSGKDVGLNVRKKVENIVSLLNDKDKIHEVRNKAANCDK

SEQ ID NO: 204673 - protein, 222 aa, Glycine max
  Coding DNA Sequence Number=SeqID_87895
  Gene Ontology: Mol. function=methyltransferase activity; Cellular component=chloroplast; Biological process=metabolic process
  Homolog annotation: Hit_ID=P23525; Match level="QueryCoverage=99%, HitCoverage=70%, E-value=1e-110, Identity=80%"; Hit description=37 kDa inner envelope membrane protein, chloroplast precursor
  Pfam annotation: Domain name=Methyltransf_11; Domain location=19-95; Score=54.4; E_value=3.8e-13; Accession=PF08241.2; Description =Methyltransferase domain
  Pfam annotation: Domain name=Methyltransf_12; Domain location=19-93; Score=11.0; E_value=0.046; Accession=PF08242.2; Description =Methyltransferase domain
  Pfam annotation: Domain name=Ubie_methyltran; Domain location=2-142; Score=-118.0; E_value=0.00078; Accession=PF01209.9; Description =ubiECOQ5 methyltransferase family
  Pfam module annotation: Pfam domain module=Methyltransf _11::Methyltransf_12::Ubie_methyltran; Domain location=19-95::19 -93::2-142
MRDEALEPADLCDRNMRVVDVGGGTSFATLGIVKHVDAKNLAKAKQKEPLKEDLPFPTDYADRYVSAGSIEYWPDPQRGITEAYRVLRIGGIACVIGPVHPTFWLSRFFADVWMLFPKEEEYIEWFKKAGFKDVKLKRIGPKWYRGVRRHGLIMGCSVTGVKPLSGDSPLQLGPKVEDVKKPVNPFVFLYRFILGTIASTYFVLVPIYMWIKDKIVPRGMPI

SEQ ID NO: 204674 - protein, 1251 aa, Glycine max
  Coding DNA Sequence Number=SeqID_87896
  Gene Ontology: Mol. function=RNA-directed DNA polymerase activity; Cellular component=chromatin; Biological process=chromatin assembly or disassembly
  Pfam annotation: Domain name=RVP_2; Domain location=369-477; Score= -52.0; E_value=0.011; Accession=PF08284.2; Description=Retroviral aspartyl protease
  Pfam annotation: Domain name=RnaseH; Domain location=864-982; Score= -25.2; E_value=0.013; Accession=PF00075.14; Description=RNase H
  Pfam annotation: Domain name=rve; Domain location=1115-1245; Score =51.2; E_value=3.5e-12; Accession=PF00665.16; Description=Integrase core domain
  Pfam annotation: Domain name=zf-H2C2; Domain location=1056-1097; Score=11.5; E_value=0.011; Accession=PF09337.1; Description=His(2) -Cys(2) zinc finger
  Pfam module annotation: Pfam domain module=RVP_2::RVT_1::Retrotrans _gag::RnaseH::rve::zf-H2C2; Domain location=369-477::604-773::122 -212::864-982::1115-1245::1056-1097
MPDHHTRLTTTDKLEEAIHRLSENHTSLSQGHQSLNSKIDSIHSSLTSQIESLFDRLTAITLQPNNTPSPNPTAHIPPSPASRYHHLKLDVPRFDDHDPLGWIFKISQFFDYQGIPELERLTIASFYMDGPALSWYQWMHRNGFFSSWPAMLQALESRFAPSFYDDPQGNLFKLQQTGSVTDYLTAFERLANRTIGIAPSSLLSCFISGLVPELRREVQALRPISLPQAIELARLQEDKLLDRRRGPRPPPHPPSPNPISAFSPSPPPGALTPKTPSPPSLPSPKLPIKRLSAEELAVRRDQGLCYHCDDKWSPGHRCKSRLHLFIADEDILSPDPFPEPDPDPTLISQISLNAMEGSPTPQTFRLYGSIGHHRVIILVDGGSSHNFIQTRLARFLHLPTASTTPLRVMVGNGHTLDCDTVSPQITLTIKTHPFTLDLLHLPICGADIVLGVQWLKLLGPVTTDFATLTMSFTYLGRPLTLFADVPPSPSPASAHQLKRLANTHSISALFHITPLPAHSPPLPSDQHPQPLPEPITAVLTRYSSIFSEPTQLPPPRTIQHHIPLLPTASPVNVRPYRYPHYQKAEIESQITAMLNSGLIQPSQSPFSSPILLVKKKDGSWRCCIDYRALNSITVKDKFPMPTVDELLDDLGKASWFTKLDLRQGFHQIRMATSDIPKTAFRTHQGHYEFRVMPFGLCNAPSTFQSAMNDTLRPYLRKFVAVFFDDILVYSSDLPSHVSHLDTVLSTLTTHHFYLKESKCVFAQSKLNYLGHIISSAGIAPDPDKIQAMVDWPTPTSTTSLRGFLGLTGFYRKFIKGYAHIAAPLTTLLRKDQFIWSPAATSAFLQLKAHMTCAPVLATPDFTIPFIVETDASAVAIGAILVQQDHPIAYYSKVLCPRLQRASAYVRELHAITSAVRKWRHYLLGASFTILTDHKSLKELMSQVIQTPEQQTYLVKLLGYDYTIRYKPGHTNTVADALSRIPTGELLSLTVPHCDFLNTLRQALAADDHYRDLLQAIGTNPEDHPALSVRNGFIFKDGRIWIPFPTPLTATLLEEFHTSPLGGHTGVAKTLHRLRQSFDWPTIKSDVQQFVSHCLVCQQTKYETKKPSGLLQPLPIPARIWEDMSIDFIAGLPPSQGHTVIMVVVDRYSKGAHFGALPTHHTAHQVAVHFLNLVCKLHGFPRSLVSDRDALFLSHFWKELFRLSGTQLRMTTAYHPQSDGQTEVVNRTLEQYLRAYVHHKPSQCIAICTSQS

SEQ ID NO: 204675 - protein, 59 aa, Glycine max
  Coding DNA Sequence Number=SeqID_87897
MAVQNSLQITRSGTGGYDDDGRAKMTVIVAISLQSLMSGKLQTNVADVAAIVVTESPKP

SEQ ID NO: 204676 - protein, 617 aa, Glycine max
  Coding DNA Sequence Number=SeqID_87898
EAEGGHSASLPSSSLEGTEEYEKQEESCFRDHLLQTYDNHLNNEPSIQQGNETTEVRQPEKSPNDGLVEVEGGNSESLSSSSLEGTEEYEKQEETYEEETTVLTVNPVNVSNNIEIQESLSGHSDHEEPDKFISEKSFQGTKSHLEVNFLDTNSHSELIKDDGLEKEMESHKKLCADKSDGKDRNEFGSSVIDTCGTPPSIDNTNGNSLTKVNCTTEDSLTSLLDSSIVDNPLKFDHEENYEVLYGESILSKSGSTMENSHDYKPDQCMKDSLKEYKSGMVYTCDMAIGSNGDTNGERKMLPDSNACKLATSDQVEEPKVTENGVPFDVDAYVNNYNKASEESGTVSDQKHFVVPEAKRVSLIAGLTVVDCRHEEGESYKNKIEESEASRVMDNVKQDQSFTATSMPNSDWKLANETKNFAIDNHVSSKLTVPSVDLVDDEAFEKREEHLQHVKAASSAGAELTTSTATMSIEPSSIYSIFANGGYETRDSVTRLSTESNPDNSISCQMQKSPSFNLNLRKEARAEESDKIPLLHQDMSADKSLSKKTSQNLIKKSKAPFIGLLKEEEEAHLLNMPQIQHNHVGTKNAVSSTSHKRKEKRKPRSSFFSSCICCATVP

SEQ ID NO: 204677 - protein, 105 aa, Glycine max
  Coding DNA Sequence Number=SeqID_87899
LVGNPYKTFGGPSVSSPATPLVATTSKNPHAMAEIGKLDHLEERLRAIEEGEDYAFANLEELFLVPNIITPPKFKVLDFDKYKGTTCPKNHLKMYCRKMGAYVKR

SEQ ID NO: 204678 - protein, 215 aa, Glycine max
  Coding DNA Sequence Number=SeqID_87900
  Gene Ontology: Mol. function=binding; Cellular component=nuclear pore; Biological process=protein import into nucleus, docking
  Homolog annotation: Hit_ID=Q2HVN9; Match level="QueryCoverage=68%, HitCoverage=13%, E-value=4e-58, Identity=76%"; Hit description =Armadillo-like helical
MAAFQTCLQVWVTSFLLADGLVVVVQAILACSFVEKDYESGLWKFLCPFKYLKWRQMIQQQVTCYIMETIALRDKRIGIKASVVEEKATACSMLCCYVDELKEGFFPWIDQVGGTLVPLLKFYFHEEVRKIVLSAMPELLRYAKLAIEKGQSHGRDVTSLKFLTDSLIPALVEALHKEPDIEIWASMLDSLNECLQIFGMLFDESQVRSIVDEIK

SEQ ID NO: 204679 - protein, 151 aa, Glycine max
  Coding DNA Sequence Number=SeqID_87901
  Subcellular localization annotation: CTP_CleavageSite=62; ConfidenceScore=5.08e-01
MYKLFVLCQTCAAIAPLSNSRHKAVVLECCSLSHGSRMLFTLCNYRPKKLQSFVVVATLVLRCFAISTITNDEHFIIPDTHNTTFKVALSRVLTGVPCIVAHSLFCEECDFNDGEVHRDGGNVEEGEGFGNRNDELVLGCSLLVEELFDDR

SEQ ID NO: 204680 - protein, 53 aa, Glycine max
  Coding DNA Sequence Number=SeqID_87902
  Gene Ontology: Mol. function=structural constituent of ribosome; Cellular component=ribonucleoprotein complex; Biological process =translation
  Homolog annotation: Hit_ID=O22795; Match level="QueryCoverage=53%, HitCoverage=20%, E-value=1e-08, Identity=89%"; Hit description=50S ribosomal protein L28, chloroplast precursor
MVGRVCEEIAMATVSFRKSFLAVTRECVPSPERNQTGPTNYHFQTIRQRNCSL

SEQ ID NO: 204681 - protein, 633 aa, Glycine max
  Coding DNA Sequence Number=SeqID_87903
  Gene Ontology: Mol. function=heat shock protein binding; Cellular component=integral to membrane; Biological process=protein folding
  Homolog annotation: Hit_ID=UPI0000547EC4; Match level="QueryCoverage =87%, HitCoverage=18%, E-value=4e-15, Identity=21%"; Hit description =PREDICTED: similar to Retinitis pigmentosa 1-like 1 protein
MENQPVLKCLKLGACEHHHQHHYHGFGKLSMGNEMGNNNTSATKEEDNISEAEKKTFREDTSEVADGMSQDIHEDNAKEEIQNVPTSKANDVMEKASEASNDITNELGKGTWQEEGHAEDQKEKTQTISTVEAKDEDTQEKAIGIASNHTASMLENDSMEGDTHASDVNMENQMPPTAEAEGVQEKAEGLVSEDATTELGKVSLQEYSHEDYEKEKMQMNPTEEAKDVQEEATGLNSSSTASMPENDLLGEDSCKSDMNMENKMHPTAEVEDVQEKATGMASDYATSSLENDLLKGDAPEDDVHADHQKHQIIESKVDHQQIAARSDFNDKTSEFDDKPQEDQQDGNVVNPAANGIYVQEKTIIVASDAPLNFTNSFEGSAQGGNSEILSSSSLEGTQEYEKQEETRLREHLSVTYNNHLNNEPSIQQGDETTEVSIPEKSSNDGSVEAEGGNFGSLSSCSLEGTEEYDKQEETCLREQLLVTYNNHVNDEPSIQQGDETTEATQPEKSPNDGSVEAEGGHSESLSSSSLEGTKEYEKQEEPCFRDHLLVTYNIHLNNEPSIQQGDEITEVIQPEKSPNDGSVEAEGGHSESLSSSSLEGTEEYEKQEESCFRDHLLVTYNNHLNNEPSIQQG

SEQ ID NO: 204682 - protein, 985 aa, Glycine max
  Coding DNA Sequence Number=SeqID_87904
  Gene Ontology: Mol. function=translation initiation factor activity; Cellular component=cytoplasm; Biological process=multicellular organismal development
  Homolog annotation: Hit_ID=Q9XGW1; Match level="QueryCoverage=99%, HitCoverage=100%, E-value=0.0, Identity=79%"; Hit description =Protein PINHEAD
  Pfam annotation: Domain name=DUF1785; Domain location=267-319; Score =100.9; E_value=3.8e-27; Accession=PF08699.1; Description=Domain of unknown function (DUF1785)
  Pfam annotation: Domain name=PAZ; Domain location=320-457; Score =171.0; E_value=3e-48; Accession=PF02170.12; Description=PAZ domain
  Pfam annotation: Domain name=Piwi; Domain location=621-942; Score =559.4; E_value=3.5e-165; Accession=PF02171.8; Description=Piwi domain
  Pfam module annotation: Pfam domain module=DUF1785::PAZ::Piwi; Domain location=267-319::320-457::621-942
MPVRQMRESSEQHLVIKPHLQNPMNGAKKVPRAVQNGKGPPPPPLPQQELPHNQTSPHVRNKGRRRSRGGGRKCDQGDVLMRPIVASGVENGSTMCGEIEMSCPTSSKSLSFAPRPGYGQVGTKCIVKANHFFAELPDKDLNQYDVSITPEVSSKAVNRSIIAELVRLYKESDLGMRLPAYDGRKSLYTAGPLPFSWREFKIKVVDDEDRVNGPKRERDYRVVIKFVARANLHHLGQFLAGKCAEAPQEALQILDIVLRELSSKRFCPIGRSFFSPDIRTPQRLGEGLESWCGFYQSIRPTQMGLSLNIDMASAAFIEPLPVVEYVGQLLGKDILSRQLSDADRIKIKKALRGVKVEVTHRGSVRRKYRVSGLTCQPTRELVFPVDENSTMKSVVEYFQEMYGFTIKYTHLPCLQVGNQKKANYLPMEACKIVEGQRYTKRLNEKQITALLKVTCQRPRDRENDILQTIQHNAYGQDPYAKEFGIKISEKLASVEARILPAPWVMCISTKRCKILKLKYHESGKEKNCLPQVGQWNMMNKKMINGMTVSQWACINFSRSVQDSVARTFCTELAQMCQVSGMEFNPEPVIPIYNAKPEHVEKALKHVYHASTNKTKGKELELLLAILPDNNGSLYGDLKRICETDLGLISQCCLTKHVFKITKQYLANVSLKINVKMGGRNTVLVDAVSCRIPLVSDIPTIIFGADVTHPENGEDSSPSIAAVVASQDWPEVTKYAGLVCAQAHRQELIQDLYKMWHDPVRGLVSGGMIRDLLISFRKATGQKPLRIIFYRDGVSEGQFYQVLLYELDAIRKACASLEPNYQPPVTFIVVQKRHHTRLFANNHRDRNSTDKSGNILPGTVVDSKICHPTEFDFYLCSHAGIQGTSRPAHYHVLWDENNFTADGIQSLTNNLCYTYARCTRSVSVVPPAYYAHLAAFRARFYMEPDLQQENGSSGGGSKATRAGGVCGGVKPLPALKENVKRVMFYC

SEQ ID NO: 204683 - protein, 661 aa, Glycine max
  Coding DNA Sequence Number=SeqID_87905
  Gene Ontology: Mol. function=zinc ion binding; Cellular component =cellulose and pectin-containing cell wall; Biological process =metabolic process
  Homolog annotation: Hit_ID=Q9LW67; Match level="QueryCoverage=99%, HitCoverage=99%, E-value=0.0, Identity=69%"; Hit description=Ankyrin- like protein
  Pfam annotation: Domain name=DUF248; Domain location=101-648; Score =1141.9; E_value=0; Accession=PF03141.7; Description=Putative methyltransferase
  Pfam annotation: Domain name=Methyltransf_11; Domain location=264 -359; Score=34.4; E_value=3.9e-07; Accession=PF08241.2; Description =Methyltransferase domain
  Pfam annotation: Domain name=Methyltransf_12; Domain location=264 -357; Score=12.1; E_value=0.037; Accession=PF08242.2; Description =Methyltransferase domain
  Pfam module annotation: Pfam domain module=DUF248::Methyltransf _11::Methyltransf_12; Domain location=101-648::264-359::264-357
MTRGRSDGLQKKHLVASVCGVAIFLGFLYVYHGSIIGSQNSGSSALEYGSKSLKRLGASYLGADDDADSKQDESSSSIMQGDGEADIVPKSFPVCDDRHSELIPCLDRHLIYQMRLKLDLSLMEHYERHCPPSERRFNCLIPPPAGYKIPIKWPQSRDEVWKVNIPHTHLAHEKSDQNWMIVKGEKIVFPGGGTHFHYGADKYIASIANLIGLFKTMFDSVSCLVHSDYLNSLSSHRPHSEFVLQMLNFSHHNLNNEGRLRTVLDVGCGVASFGAYLLSSDIIAMSLAPNDVHQNQIQFALERGIPAYLGVLGTKRLPYPSRSFELAHCSRCRIDWLQRDGILLLELDRLLRPGGYFAYSSPEAYAQDEEDRRIWREMSALVGRMCWRIAAKKDQTVIWQKPLTNECYMEREPGTRPPLCQSDDDPDAVFGVNMEACITPYSDHDNRAKGSGLAPWPARLTTPPPRLADFGYSNEMFEKDTELWQGRVENYWNLLGPKISSNTVRNVMDMKANMGSFAAALKGKDVWVMNVVPRDGPNTLKLVYDRGLIGSIHDWCEAYSTYPRTYDLLHAWTVFSDIETRGCSKEDLLIEMDRLLRPTGFIIIRDKQHVIDFVKKYLTAMHWEAVATADASADSDQDGNEVIFVIQKKLWLATESLRNTE

SEQ ID NO: 204684 - protein, 73 aa, Glycine max
  Coding DNA Sequence Number=SeqID_87906
MANLILKNIIGSKSNANISMSTEKAKPNEPRWQSDPDPAKKCKPDAKSAENVKGEKKKLTGMGSNLRKLRTQI

SEQ ID NO: 204685 - protein, 185 aa, Glycine max
  Coding DNA Sequence Number=SeqID_87907
  Gene Ontology: Mol. function=structural constituent of ribosome; Cellular component=ribonucleoprotein complex; Biological process =ribosome biogenesis and assembly
  Homolog annotation: Hit_ID=P35685; Match level="QueryCoverage=98%, HitCoverage=64%, E-value=2e-74, Identity=78%"; Hit description=60S ribosomal protein L7a
  Pfam annotation: Domain name=Ribosomal_L7Ae; Domain location=23-135; Score=83.6; E_value=6.1e-22; Accession=PF01248.16; Description =Ribosomal protein L7AeL30eS12eGadd45 family
MLLKYRPEDKAEKKERLLKRAQAEADGKPVEAKKPIVVKYGLNHVTYLIEQYCQGFKLRLWLPLSLIINKAQLVVIAHDVDPIELVVWLPALCRKMEIPYCIVKGKARLGTIVHKKTASVLCLTTVKNEDKMEFSRILEAIKANFNDKYDEYRKKWGGGIMGSKSQAKTRAKEKLLAKEAAQRMN

SEQ ID NO: 204686 - protein, 479 aa, Glycine max
  Coding DNA Sequence Number=SeqID_87908
  Gene Ontology: Mol. function=calcium ion binding; Cellular component =mitochondrion; Biological process=protein amino acid phosphorylation
  Homolog annotation: Hit_ID=Q1SMD1; Match level="QueryCoverage=74%, HitCoverage=92%, E-value=1e-57, Identity=30%"; Hit description =Tetratricopeptide-like helical
  Pfam annotation: Domain name=PPR; Domain location=170-204; Score =41.4; E_value=3.1e-09; Accession=PF01535.11; Description=PPR repeat
  Pfam annotation: Domain name=PPR; Domain location=220-254; Score =15.0; E_value=0.13; Accession=PF01535.11; Description=PPR repeat
  Pfam annotation: Domain name=PPR; Domain location=255-289; Score =34.0; E_value=5.2e-07; Accession=PF01535.11; Description=PPR repeat
  Pfam annotation: Domain name=PPR; Domain location=290-324; Score =24.7; E_value=0.00032; Accession=PF01535.11; Description=PPR repeat
  Pfam annotation: Domain name=PPR; Domain location=326-360; Score=5.6; E_value=1.6; Accession=PF01535.11; Description=PPR repeat
  Pfam annotation: Domain name=PPR; Domain location=362-396; Score =42.2; E_value=1.7e-09; Accession=PF01535.11; Description=PPR repeat
  Pfam annotation: Domain name=PPR; Domain location=397-431; Score =26.4; E_value=0.0001; Accession=PF01535.11; Description=PPR repeat
  Pfam annotation: Domain name=PPR; Domain location=432-466; Score =13.0; E_value=0.22; Accession=PF01535.11; Description=PPR repeat
  Pfam module annotation: Pfam domain module=PPR::PPR::PPR::PPR::PPR::PP R::PPR::PPR; Domain location=170-204::220-254::255-289::290-324::326 -360::362-396::397-431::432-466
MRVDYNMIIHLHLAKILLQGPPPKRQRIAQLATRFIESFNDKMDALMTHFGKIADKCQIIHSWILQKGIWLESTYGIQQVMQFLKLARLLMPYVRRLHLHSEPLPSQSTYKFNSIDDAVALFHHMVGIHPLPSIVEFTKILGTIGKMRYYATAIDLYTLMEYKGVVPFIVTFNIVINCFCHVGRMDFAFSVMSMILKWGCRPNVVTFTTLVKGFCVIKCWMHYTFTMKWLHEGFVNEARNLFHGMIERGLVPDVWSYNILIKGYCKFERVGEAMYLLEDIFLMNLVPNIITYNSVVDGLCKSVGILDAWKLVDEMHYCGQPPPDVTSYNNLLESSCRIERVEKTIAFFKHLIFERSFAPNVWSYNILISGCCKNRRLDEAINLFNHMCFKILVPDIVTYNMFLDALFNGQQLDKAIALLVQIVDQGISPNLQTYNLLLNGLHKGGKSKTAQKISLYLSMRGYHPDVQTYIINELCKGGL

SEQ ID NO: 204687 - protein, 65 aa, Glycine max
  Coding DNA Sequence Number=SeqID_87909
MVDFICEYPRVDRPHATKIYSEEARWSRGKMEGKLELELNESPEQEETCPSKYKEARIGAKINPC

SEQ ID NO: 204688 - protein, 588 aa, Glycine max
  Coding DNA Sequence Number=SeqID_87910
  Homolog annotation: Hit_ID=Q1SI78; Match level="QueryCoverage=99%, HitCoverage=65%, E-value=1e-178, Identity=56%"; Hit description =Nop14-like protein
  Subcellular localization annotation: CTP_CleavageSite=29; ConfidenceScore=5.55e-01
MAKSSKRSVGTSTTDKKKKKSKKFGPEGVAMKVKANNNATASNPFESIWSRRKFEVLGQKRKGEARRMGLARSLAIQKRNNTLLKEYHQSAKSSLFVDKRIGEKDEALDEFGKAILRSQRERQLNMKLSKKSKYHLSDGEENDFEGIDSLGRDDFEDEMLPDDIDAETDEKLDLVQWSMQIPGETSADDGEENRHKSKKEVMEEIISKSKFYKAQKAKDKEENENLVEELDKDFTSLIHSEALLSLTEPNKMNALKALVNKSISNDQSNKDHMSATRTMDNSVQEKPDDYDKLVKQMGLEMRARPSDRTKTPEEIAQEEKERLEQLEEERQKRMVAAEDSSDEDNEDSEKPSEQKPRSISGDDLGDSFSVNEQIMTKKGWVDEILERRDEEDSSSEDDDGEDPDNLGSSEDADEGSNEDLDEHKKDLSLKDWEQSDDDDIGADLEDEDDSDENIETAAEDLDEVKGLDAAVHIRAKRNASVESVKKDKDSSDAKIDVVGKQSKELDIPYIIQAPKTFEELCSLVFYGVLLQYFAVLANKEPLNVELLNMLVKPLIEMSKEIPYFAAICARRRIEATRKQFIESIKQSG

SEQ ID NO: 204689 - protein, 160 aa, Glycine max
  Coding DNA Sequence Number=SeqID_87911
MKVTDILLQLEKKQKWSCCLNNTHNTQQESDKIMRIKKDIEHKVLQISNVVGPRLHSRGTISNDAAKKEEKLVETSKRKPHEGHQPHARGLKLRGTSDNDAAKMEEKLETSKRKLHEGYQAHERDRRSTRYFEGYECDLPKGKHSRRSSRPKLSNRRKYS

SEQ ID NO: 204690 - protein, 104 aa, Glycine max
  Coding DNA Sequence Number=SeqID_87912
MASIKHIAGKQLKDVMLECLLALYEGEPWNNGKVTALWPRGHRFKSRKQPLQFPLVGVKLCTSTFPKPHLVGAPCTWSPFIVCFWICAYILTFLECGPYLYDWI

SEQ ID NO: 204691 - protein, 103 aa, Glycine max
  Coding DNA Sequence Number=SeqID_87913
MVGGPFNGSRISSNTILECGFGLNQFQKLAHRVRVASTYILYLDTISSQCETWVFLNTPPHAQHFWAWCMDNMVDNPFDGSRIGSNTILECGFRPNSIPKVSS

SEQ ID NO: 204692 - protein, 177 aa, Glycine max
  Coding DNA Sequence Number=SeqID_87914
  Gene Ontology: Mol. function=protein serine/threonine kinase activity; Cellular component=phragmoplast; Biological process =protein amino acid phosphorylation
  Homolog annotation: Hit_ID=Q53VE2; Match level="QueryCoverage=93%, HitCoverage=30%, E-value=6e-85, Identity=88%"; Hit description =Ser/Thr protein kinase
  Pfam annotation: Domain name=Pkinase; Domain location=1-106; Score= -113.1; E_value=0.08; Accession=PF00069.15; Description=Protein kinase domain
  Pfam annotation: Domain name=Pkinase_C; Domain location=124-171; Score=10.2; E_value=0.038; Accession=PF00433.14; Description=Protein kinase C terminal domain
  Pfam module annotation: Pfam domain module=Pkinase::Pkinase_C; Domain location=1-106::124-171
MQAYSTVGTPDYIAPEVLLKKGYGVECDWWSLGAIMYEMLVGYPPFYSDEPMLTCRKIVTWRTTLKFPEEAKLSAEAKDLICRLLCNVEQRLGTKGADEIKAHPWFKGVEWDKLYQMQAAFIPEVNDELDTQNFEKFEEGDKQTVPSSKAGPWRKPMGDLGFTQYTPSCPTLFGLCA

SEQ ID NO: 204693 - protein, 147 aa, Glycine max
  Coding DNA Sequence Number=SeqID_87915
MTSEGPTGDSGSLTLPNAQVPIKLSPNSYGAFMSWLGLFLSEISILDFSFISILDTKGLMSNALPAIKNGCQVYDESATAANQPVRGSFLNLLPPQMEMGVDGFGSQVPEISGFGWLNFLADWDIFRVEKSIKVYILQSTFYQTAMC

SEQ ID NO: 204694 - protein, 73 aa, Glycine max
  Coding DNA Sequence Number=SeqID_87916
  Homolog annotation: Hit_ID=O65576; Match level="QueryCoverage=56%, HitCoverage=6%, E-value=1e-12, Identity=78%"; Hit description=ABC1 protein
MGTSERLIMNQALESLQTELKTDPNWGENLFDEATKTIILIDFGAARDYPKTFVDDYLRMLGSLPFKFISLYQ

SEQ ID NO: 204695 - protein, 358 aa, Glycine max
  Coding DNA Sequence Number=SeqID_87917
  Gene Ontology: Mol. function=nucleic acid binding; Cellular component= nucleus; Biological process=chromatin modification
  Homolog annotation: Hit_ID=Q9FF61; Match level="QueryCoverage=94%, HitCoverage=38%, E-value=1e-106, Identity=57%"; Hit description =Putative SWI/SNF-related matrix-associated actin-dependent regulator of chromatin subfamily A member 3-like 1
  Pfam annotation: Domain name=Helicase_C; Domain location=225-305; Score=68.5; E_value=2.1e-17; Accession=PF00271.21; Description =Helicase conserved C-terminal domain
  Pfam annotation: Domain name=zf-C3HC4; Domain location=116-154; Score= 32.2; E_value=1.9e-06; Accession=PF00097.15; Description=Zinc finger, C3HC4 type (RING finger)
  Pfam module annotation: Pfam domain module=Helicase_C::zf-C3HC4; Domain location=225-305::116-154
MEAIALRRTKDMTLVGLPPKTIEICYVELSFDERQMYDQLKQDTKIFLSRYAHDDSLVPHYSAVLSRILRLRQICTDSKLWNVQSLLLTNIEDASNNPELLQALLGQVQDGEDFDCPICLSPPIEIVITRCAHIFCRICILRALQNKNPCCPLCRRRLKESDLFSAPPESSKVDSAGECSSSQTVLPSKVSTLIKLLTESRDQHPAAKSVVFSQFRKLLLLMEEPLNAAGFKTLRLDGTMNAKHRANVIEQFQSQGIDGPTVLLASLRASSAGINLTSASRLYFMEPWWNHAVEEQAMDRVHRIGQKEAVKIVRLIAQNSIEEQILVLQEKKKQLPREPSGTGLKGMGINDIHFLLDH

SEQ ID NO: 204696 - protein, 153 aa, Glycine max
  Coding DNA Sequence Number=SeqID_87918
MKQEAGHSGSAPSPSRLSTLNEKLEMVLATLPKLTNEEHEQCCKMAKIMLKFAVPLDTILNTVNIYGEVSRSFVVRWKDVLDRLWHFIDKDGNFHTVVYNQDLDKSAIIARWTTLRDFYHLTGDHQVSLTHYGKSVFFLIIFKSSSLPKSFSR

SEQ ID NO: 204697 - protein, 194 aa, Glycine max
  Coding DNA Sequence Number=SeqID_87919
MAIIGLYVVCDHRTCPMALGKGYDSATIIHNVPYADGVVRVTVAKAYDDDAQVPFSDVRDSNLDNHVPKPVGVVGKSNKVVAVDPLGELIRKVYDFLRPQSIHNVKERHHECQHYIETRFKESQREVYLGAYMNHAMKTLNTSLEGKLDQPTPRWIEVKWFYDGTMLDTKVITTLRKKWATYYLQVKSNAFRQL

SEQ ID NO: 204698 - protein, 463 aa, Glycine max
  Coding DNA Sequence Number=SeqID_87920
  Gene Ontology: Mol. function=nucleic acid binding; Cellular component= nucleus; Biological process=chromatin modification
  Homolog annotation: Hit_ID=Q9FF61; Match level="QueryCoverage=96%, HitCoverage=51%, E-value=1e-131, Identity=54%"; Hit description =Putative SWI/SNF-related matrix-associated actin-dependent regulator of chromatin subfamily A member 3-like 1
  Pfam annotation: Domain name=HIRAN; Domain location=21-116; Score =81.3; E_value=3e-21; Accession=PF08797.1; Description=HIRAN domain
  Pfam annotation: Domain name=ResIII; Domain location=189-419; Score= -32.2; E_value=0.023; Accession=PF04851.6; Description=Type III restriction enzyme, res subunit
  Pfam annotation: Domain name=SNF2_N; Domain location=195-460; Score =12.7; E_value=8.4e-09; Accession=PF00176.13; Description=SNF2 family N-terminal domain
  Pfam module annotation: Pfam domain module=HIRAN::ResIII::SNF2_N; Domain location=21-116::189-419::195-460
MDWQEDDRSFESSESSDKYLLGFIMSNIVGLQHHSGTLHGERPLVGLAREPHNPHDPHAIVVLNTHSLSVGYIERSVAAALSPLIDQNLVKVEAIVPTARNAHRIPCQIHVFARVSDFSAVENAVEDAGLKIITGSDASFTLSDSVAVKETRAQKKSSSVDAIFKKVNRSYTGKNPAIQILEPPRTIIRTELLQHQKEGLAWLVHRENSDDLPPFWEENEGKFVNILTDYQSDNRPDPLRGGIFADEMGLGKTLTLLSLIAFDKKSQMGVSKKWRTDRKVVTLEKRRMRESENESESSSPEKGFRTNATLVVCPPSVMSTWITQLEEHTVPGALKTYMYYGERRTDDPFDLNRYDLVLTTYGILAGEHCMPKMPAKNMYWRRIVLDEAHTIKNFNALQSLAVSKLNAQCRWAVTGTPIQSGCIDLFSIMVFLRFQPFSVRQQWRELVQRSLNKGKDKGLVRLQ

SEQ ID NO: 204699 - protein, 282 aa, Glycine max
  Coding DNA Sequence Number=SeqID_87921
  Gene Ontology: Mol. function=protein binding; Biological process =lipid metabolic process
  Pfam annotation: Domain name=Transposase_21; Domain location=99-218; Score=-52.6; E_value=4.1e-10; Accession=PF02992.5; Description =Transposase family tnp2
MNTIPDLLKDAFEQAKFLTSGYEDKKIINKLGLNYMKIDVCPKDCKLYLGDEKHLEAYNTCGTSRWKPKKKKKIATKILHYFPLEPRLQRLFPCFKITLDIRCHALENNKDWWLRYPRDGEACKKSLGNNIDVYLRPVVEELCELWNDGIEIFDSSLNQNFRLHATLIWTNSDFPGLGMFFGWNTHMLFPTSFFTVMIHLTSQLIEEAELGGLVLYLYMYPIERYIEDIKTSFNRPKRVCDEPNNNETSFVSFIFPPVGKHSMNPHTMDTMSVDLKFLAQAP

SEQ ID NO: 204700 - protein, 38 aa, Glycine max
  Coding DNA Sequence Number=SeqID_87922
MRILGCLAAALSVCPELGKGRRSIGRDPSLYLRPSLST

SEQ ID NO: 204701 - protein, 93 aa, Glycine max
  Coding DNA Sequence Number=SeqID_87923
  Subcellular localization annotation: CTP_CleavageSite=52; ConfidenceScore=5.14e-01
MSISPCGTLVTSLYQSYRVLVPPGKVMPSRHRDHTRRTPSGPKEVQQGPGVSSSDYGPLSATGKKCIAATSRAPQLIHKRRPSPKPKDAPSCS

SEQ ID NO: 204702 - protein, 228 aa, Glycine max
  Coding DNA Sequence Number=SeqID_87924
  Gene Ontology: Mol. function=ribonuclease H activity; Cellular component=nucleus; Biological process=RNA-dependent DNA replication
  Pfam annotation: Domain name=RnaseH; Domain location=54-183; Score =5.8; E_value=1.7e-05; Accession=PF00075.14; Description=RNase H
MVSVEKTKVYVPKDVQPALICSYVEEIEKCNMLYYPHRNNNYIWKDIGWSACLEGCVKINVDGSVIAGGHRATCGGVFQDFMGIWLAGFSINPGSSSVLRAEMSAILAALELAWDKKLTKVCIESDSAVAVHLINIQKVTNHPFATYVRKISVWLNRDWQVSISHIHREANVVVDSLTTHGHNLSLGSRYLETTLDVCMIPLWADFVVLWFFLTVSKKSMSCLKPSLI

SEQ ID NO: 204703 - protein, 127 aa, Glycine max
  Coding DNA Sequence Number=SeqID_87925
MKAMVNQEGSINEGHDKFLRVVVNQDGHSQSVMVQGFNFTSDHSHGGFTTIISSKTTSNSDNGRGQLMRVMVNQEGSINEGHGKFLRVVVNQEGHSQSVMVQGFSFTSDHSLGGFTMIIVRLFVRYL

SEQ ID NO: 204704 - protein, 120 aa, Glycine max
  Coding DNA Sequence Number=SeqID_87926
MNIEGEILQRKILSRDRRHLSQLNHIVEPLTNAPYVHDQRVLQDDGGLCMPSSSKPKEGDVQILEGPLCQENQHVDGSMEVVPTTSCIYVVPKDEEPKWALTIVCGSPRVATRQSLWEGI

SEQ ID NO: 204705 - protein, 60 aa, Glycine max
  Coding DNA Sequence Number=SeqID_87927
MDKIDIFVPHPLTNTSSLIQLPPEYECKPLVVKTKMDTLEPYTGAMRGIVHEPQVNLGED

SEQ ID NO: 204706 - protein, 274 aa, Glycine max
  Coding DNA Sequence Number=SeqID_87928
  Gene Ontology: Mol. function=oxidoreductase activity
  Homolog annotation: Hit_ID=Q3R1Y1; Match level="QueryCoverage=49%, HitCoverage=81%, E-value=3e-28, Identity=49%"; Hit description =Ribonucleotide reductase-associated flavodoxin, putative
GTKAGTGPPLEVDGIDKLDLVEVHQYARVFGQQLLELLRRGGVDDLHRCCSSNGPGPHRSKPRWPRHGARHAASVRSPAADSRCGSSGSAGAQHRSSTPAPTVSRRYRTPPAAAAARRPRRCQPPMPSSPKACGRRCRSSSPAAPGRPRRSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 204707 - protein, 75 aa, Glycine max
  Coding DNA Sequence Number=SeqID_87929
MANRKNSAMRKQNFHRGEFLCCTRYGKERRFHLKSKLDIKNYHDALNNKCCTCSLWPYQNWYLVLQNTLYVGKRY

SEQ ID NO: 204708 - protein, 100 aa, Glycine max
  Coding DNA Sequence Number=SeqID_87930
MATIELSSRYGSKLAYDTGIWGESYRLFAAKSLPGWCFDLCSRWCFALVVWKVGFVVDLGMAFVDNWVVAEDKGKEVRGGAIHWGISHGRRSFTTKMSLG

SEQ ID NO: 204709 - protein, 347 aa, Glycine max
  Coding DNA Sequence Number=SeqID_87931
  Gene Ontology: Mol. function=DNA helicase activity; Cellular component=alpha DNA polymerase:primase complex; Biological process =DNA replication, synthesis of RNA primer
  Homolog annotation: Hit_ID=Q6ABX1; Match level="QueryCoverage=86%, HitCoverage=66%, E-value=3e-57, Identity=40%"; Hit description =Replicative DNA helicase
  Pfam annotation: Domain name=DnaB; Domain location=68-170; Score =129.5; E_value=9.1e-36; Accession=PF00772.11; Description=DnaB-like helicase N terminal domain
  Pfam annotation: Domain name=DnaB_C; Domain location=236-347; Score= -53.2; E_value=2.4e-09; Accession=PF03796.5; Description=DnaB-like helicase C terminal domain
  Pfam module annotation: Pfam domain module=DnaB::DnaB_C; Domain location=68-170::236-347
MPIVATHAGECEKCEEGIRAGQRIERVDRGGVGAVWAHVACPMPRAVCEAWLMDDDTYGPDQAPVAETPPHDLVAEQSALGGMLLSKEAVADVLETTRAKDFYVPKHEIIFSAITSLYAAGEPTDVVAVTDQLIKTGDLQKAGGADYVHMLTSIVPTAANAGYYAGIIHRNALRRHLREVAASAAQISGDGRMDPVDAIEDVRQMLDQIGVAGQISLHAIGHAPFDQFVEVLEGGKPNHVATPWWDINRIIGGFREGSLNVIAARPAQGKSVIALQAAIRLAMEGPVAFISLEMGQEEIVARMIAQLGEVGLKGLVNQEIASAEWQKIAMVRQQIASLPLYVATSDE

SEQ ID NO: 204710 - protein, 211 aa, Glycine max
  Coding DNA Sequence Number=SeqID_87932
  Gene Ontology: Mol. function=helicase activity
  Homolog annotation: Hit_ID=Q1SRJ5; Match level="QueryCoverage=89%, HitCoverage=27%, E-value=5e-43, Identity=40%"; Hit description =Probable helicase [imported]-Arabidopsis thaliana-related
MVHGPCGTLNLGSPCMEEGKCSRFYPKMFQPHTILDADGFPVYRRRNNGHAIEKNGVIIDNRVTVILIHEDNDETHNGGTHNDEIKEYLDCRYICPCESTWRIFGFPIHGRKHVVERLHFHLPGQHSVLYEDHGDIDDVLSKLSISDSKFISWMNTNQNSVEGRNLTYAEFVSKFVYNQKKRCWHLRKKGYTTWQNTMGSTNYRGIILFRE

SEQ ID NO: 204711 - protein, 75 aa, Glycine max
  Coding DNA Sequence Number=SeqID_87933
MDISDDTDIPVILGRPFMLATSYIVDMGKRKLELGFEDQKIDFDLFVEDKPVPEHNVCLQVMERGQEVLKLGTNT

SEQ ID NO: 204712 - protein, 248 aa, Glycine max
  Coding DNA Sequence Number=SeqID_87934
  Gene Ontology: Mol. function=protein serine/threonine kinase activity; Cellular component=membrane; Biological process=protein amino acid phosphorylation
  Homolog annotation: Hit_ID=Q1S7H1; Match level="QueryCoverage=89%, HitCoverage=25%, E-value=1e-71, Identity=58%"; Hit description =Protein kinase; EGF-like, subtype 2; S-locus glycoprotein; Curculin- like ...
  Homolog annotation: Hit description=(Mannose-binding) lectin; N/apple PAN; Type I EGF
  Pfam annotation: Domain name=B_lectin; Domain location=71-184; Score =165.1; E_value=1.8e-46; Accession=PF01453.15; Description=D-mannose binding lectin
MAMLTILLLSKLLSLFSKFAVATDTITQSEFLEDNTTLVSNNGTFELGFFTPGSSSSPNRYVGIWYKNIPIRTVVWVANRDNPIKDNSSKLSINTQGNLVLVNQNNTVIWSTNTTAKASLVVAQLLDSGNLVLRDEKDTNPENYLWQSFDYPSDTFLPGMKLGWDLKKGLNWFLTAWKNWDDPSPGDFTRSTLHTNNPEEVMWKGTTQYYRSGPWDGIGFSGIPSVSSDSNTNYTIVSNKDEFYIHIA

SEQ ID NO: 204713 - protein, 83 aa, Glycine max
  Coding DNA Sequence Number=SeqID_87935
QNPQEFKILEIGPGHPESGPPPYLSDGKIGESERATTSLDKESERSTASLVGDSGGAVASPDGESEMIIKGGDGGTTSSSGEE

SEQ ID NO: 204714 - protein, 38 aa, Glycine max
  Coding DNA Sequence Number=SeqID_87936
MVSRASVASVVLPYNFRKSWSSTGKFPKSNLSIHSMHP

SEQ ID NO: 204715 - protein, 508 aa, Glycine max
  Coding DNA Sequence Number=SeqID_87937
  Gene Ontology: Mol. function=calcium ion binding; Cellular component =extracellular region; Biological process=pathogenesis
  Homolog annotation: Hit_ID=Q2KC97; Match level="QueryCoverage=95%, HitCoverage=98%, E-value=1e-72, Identity=38%"; Hit description =Rhizobiocin/RTX toxin and hemolysin-type calcium binding protein
  Pfam annotation: Domain name=HemolysinCabind; Domain location=183 -200; Score=15.2; E_value=0.24; Accession=PF00353.9; Description =Hemolysin-type calcium-binding repeat
  Pfam annotation: Domain name=HemolysinCabind; Domain location=201 -218; Score=20.5; E_value=0.0062; Accession=PF00353.9; Description =Hemolysin-type calcium-binding repeat
  Pfam annotation: Domain name=HemolysinCabind; Domain location=264 -281; Score=14.1; E_value=0.52; Accession=PF00353.9; Description =Hemolysin-type calcium-binding repeat
  Pfam annotation: Domain name=HemolysinCabind; Domain location=282 -299; Score=21.9; E_value=0.0023; Accession=PF00353.9; Description =Hemolysin-type calcium-binding repeat
  Pfam annotation: Domain name=HemolysinCabind; Domain location=347 -364; Score=13.8; E_value=0.65; Accession=PF00353.9; Description =Hemolysin-type calcium-binding repeat
  Pfam annotation: Domain name=HemolysinCabind; Domain location=365 -382; Score=16.3; E_value=0.11; Accession=PF00353.9; Description =Hemolysin-type calcium-binding repeat
  Pfam annotation: Domain name=HemolysinCabind; Domain location=456 -473; Score=3.7; E_value=19; Accession=PF00353.9; Description =Hemolysin-type calcium-binding repeat
  Pfam annotation: Domain name=HemolysinCabind; Domain location=474 -491; Score=23.6; E_value=0.00069; Accession=PF00353.9; Description =Hemolysin-type calcium-binding repeat
  Pfam annotation: Domain name=HemolysinCabind; Domain location=66-83; Score=9.2; E_value=4.1; Accession=PF00353.9; Description=Hemolysin -type calcium-binding repeat
  Pfam annotation: Domain name=HemolysinCabind; Domain location=84-101; Score=23.6; E_value=0.00069; Accession=PF00353.9; Description =Hemolysin-type calcium-binding repeat
  Pfam module annotation: Pfam domain module=HemolysinCabind::HemolysinC abind::HemolysinCabind::HemolysinCabind::HemolysinCabind::HemolysinCab ind::HemolysinCabind::HemolysinCabind::HemolysinCabind::HemolysinCabin d; Domain ...
  Pfam module annotation: Pfam domain module=location=183-200::201 -218::264-281::282-299::347-364::365-382::456-473::474-491::66-83::84- 101
TTAANYKVTLQDTITEAANAGNDTVQLRLLGSTDYSAMASATTLILGANLENLDASDTGSTKLNLTGNALANTLTGNDADNILDGGAGVDTLVGGSGNDTYMLDLKLQGTGAGATVVIEDSVTELNGTTEGIDTVKLRGTANLTTATTLTLDNDWANIEILDASATGSTKLNLTGNNLGNTLIGNAAANILIGGTGDDTLNGGAGADIMTGGDGDDIYIVDNVGDQVIENDGEGTDEVRASISYTLSDNLENLTLTGTAAINGTGNELDNTITGNAGNNILNGGTGADTLIGGKGNDTYIVDDVNDVVVESLNEGTDQINASISYSLALAANVENLLLTGTDHINGTGNALANTITGNSGNNTLDGGDGVDKLAGGLGNDTYIVDLVRTGTTTANYKVALQDTITEAANAGNDTVQLRLLGSTDYSAMASATTLILGANLENLDASDTGSTKLNLTGNALANTLTGNDADHILDGGAGVDTLVGGSGNDTYMLDLKLQGTGAGAYCSD

SEQ ID NO: 204716 - protein, 279 aa, Glycine max
  Coding DNA Sequence Number=SeqID_87938
  Gene Ontology: Mol. function=calcium ion binding; Cellular component =extracellular region; Biological process=pathogenesis
  Homolog annotation: Hit_ID=UPI00003CC8F1; Match level="QueryCoverage =57%, HitCoverage=10%, E-value=2e-25, Identity=38%"; Hit description =COG2931: RTX toxins and related Ca2+-binding proteins
  Pfam annotation: Domain name=HemolysinCabind; Domain location=131 -148; Score=15.3; E_value=0.22; Accession=PF00353.9; Description =Hemolysin-type calcium-binding repeat
  Pfam annotation: Domain name=HemolysinCabind; Domain location=149 -166; Score=21.6; E_value=0.0029; Accession=PF00353.9; Description =Hemolysin-type calcium-binding repeat
  Pfam annotation: Domain name=HemolysinCabind; Domain location=38-55; Score=29.8; E_value=9.5e-06; Accession=PF00353.9; Description =Hemolysin-type calcium-binding repeat
  Pfam annotation: Domain name=HemolysinCabind; Domain location=56-73; Score=14.4; E_value=0.42; Accession=PF00353.9; Description=Hemolysin- type calcium-binding repeat
  Pfam module annotation: Pfam domain module=HemolysinCabind::HemolysinC abind::HemolysinCabind::HemolysinCabind; Domain location=131-148::149- 166::38-55::56-73
MDAQSVIRVDGPSSAGINLYGNALDNYIWGNNYGNWISGGAGNDTLYGGDGEDTLDGGEGINILAGGKGSDTYIIHSNSDIIYELPNDYAIDQIITYVSIDLDLYPGIEYARIAYGAQNVVISSSTGNIYGGSDNNDQLIGSAGNDTFLSSAGNDILTGGLGADTFIWSIADKGPNGKPALDKITDYNSEEDKLDFRDLLIGESSENILNYLNITTSIAEGVTNTEIRISNTGGFTGGNYSAAVENQHITLAGVNLLAGTNEADLVANLISQNKLVIDA

SEQ ID NO: 204717 - protein, 257 aa, Glycine max
  Coding DNA Sequence Number=SeqID_87939
  Gene Ontology: Mol. function=ATP-dependent helicase activity; Cellular component=phycobilisome; Biological process=regulation of transcription, DNA-dependent
  Homolog annotation: Hit_ID=Q1H0H1; Match level="QueryCoverage=99%, HitCoverage=22%, E-value=1e-103, Identity=68%"; Hit description =Transcription-repair coupling factor
MAVSLPVIGHPQRFSFHSQGLDSQALAELACGLKATQTPLVVLTASAFEAQRLMDEIPYFGKDIQVHLLPDWETLPYDVFSPHPDLTSERLATLYQLSQNQSNVVIVPMATALLRLPPVSYLAAHTFMLKKGQKLDVDALRNQCAQAGYHHVSQVMGPGEFSVRGGLVDLYPMGSAFPYRIDLFDDEIETIRTFDIDTQRSVYPVPEIRMLPAREFPMDEAAITRFRSQFREYFEGDPQRAKIYKDVSKGTPSGGVE

SEQ ID NO: 204718 - protein, 41 aa, Glycine max
  Coding DNA Sequence Number=SeqID_87940
MLEVHEQPQEPVPDDERTELKLASHGRKVEKFGRPTPEMKA

SEQ ID NO: 204719 - protein, 779 aa, Glycine max
  Coding DNA Sequence Number=SeqID_87941
  Homolog annotation: Hit_ID=Q1SJW0; Match level="QueryCoverage=96%, HitCoverage=97%, E-value=2e-35, Identity=24%"; Hit description =Ubiquitin-associated
  Pfam annotation: Domain name=DUF1296; Domain location=22-65; Score =25.5; E_value=0.00019; Accession=PF06972.2; Description=Protein of unknown function (DUF1296)
  Pfam annotation: Domain name=UBA; Domain location=25-65; Score=22.4; E_value=0.0017; Accession=PF00627.21; Description=UBATS-N domain
  Pfam module annotation: Pfam domain module=DUF1296::UBA; Domain location=22-65::25-65
MGSESRNRYGNGCGGEGGSGELVAAEKEMVQCVKEIVNCTECEIYAALEECDMDVNRAVEMLLSQGFALTLLCVPSVAFVVVAVERKTGTGSDDKVVQSGLTRETYNENGKANDKGEGGSVGASVMAPTTHVVRKCTKRIDNGRQSLITRHSVLDSAQASLGPEPSMTGMSKGCLSMADIVRMGTTSSQDTVSHNCNTSGGVSACGNSESSLPLPSQNHSEQQVFHDEWPATEQPIARNAQELNMSASSNANGPFEHPSLHVNAIGLHRNCELDTAPVSWGDVACDNDAFEKNESASISREHTVLSSNTGLRSHSNSNLRNTISSDHCSSYGHGEDVSSAASIFQRLSIGESKQKVPTFEDDPAVVIPIHLQALGADCSHLSFGTYNGSSTASSVLLNSNHLSKSDLEEKSAARDKQHGFDVLKGAAGDKNSDILSSDKQWFVKHIVPEETFENEHIIKASVSDPRLQKSHWENTSLPLKQPGVQSGNHLNFPRGLYADSNSIPGDVLALLMSQSQTARHSNTVSSISNPAFSMSKVMEPGAFPLPMRSALPRDPTVHSSSHFHQLPDTKGYFSLPQNRSYNTTINSQLPFSGNTVYNQSPADMKYNLLQNRNEFLTNRLPPATARDAFGYGNLGSSIYSSGSFLSNPSPGHMMPSSNFNEILPSQYNGGRNINSIQQHGSFSHWDYGAEPRSLFIPKRTQSQYATPGYADLHHSETRVLEKYQQPGDFQDLPSKQLHPFWQRDNLHHSETRVLEEHQQPGDFQDLPSKQLHPFWQHDN

SEQ ID NO: 204720 - protein, 192 aa, Glycine max
  Coding DNA Sequence Number=SeqID_87942
  Gene Ontology: Mol. function=hydrolase activity, hydrolyzing O -glycosyl compounds; Cellular component=membrane; Biological process =carbohydrate metabolic process
  Homolog annotation: Hit_ID=Q8RZK0; Match level="QueryCoverage=54%, HitCoverage=43%, E-value=4e-31, Identity=55%"; Hit description=Beta 1,3-glucanase-like
  Pfam annotation: Domain name=X8; Domain location=89-170; Score=138.1; E_value=2.4e-38; Accession=PF07983.3; Description=X8 domain
MVTHQSEDLKRRYTTGDAHTYGHKIILKVHHSKGHHHTNHYNSQLSSHHSTNPILNPNSNPDTVSPASTLPITTPTMPNNSPVSSSGASWCTASPTSSQRALQVGLDYACGYGGTDCSAIQPGGSCYFPNSVRDHASYAFNKYYQKNPVPNSCNFGGAAVITSTNPSRASTVMILNVMTLLLRRLLELFCLI

SEQ ID NO: 204721 - protein, 484 aa, Glycine max
  Coding DNA Sequence Number=SeqID_87943
  Gene Ontology: Mol. function=protein serine/threonine kinase activity; Cellular component=membrane; Biological process=protein amino acid phosphorylation
  Homolog annotation: Hit_ID=Q0WPA7; Match level="QueryCoverage=96%, HitCoverage=91%, E-value=0.0, Identity=69%"; Hit description =Receptor-like protein kinase
  Pfam annotation: Domain name=Pkinase; Domain location=188-459; Score =145.7; E_value=1.2e-40; Accession=PF00069.15; Description=Protein kinase domain
  Pfam annotation: Domain name=Pkinase_Tyr; Domain location=188-459; Score=108.8; E_value=1.6e-29; Accession=PF07714.7; Description =Protein tyrosine kinase
  Pfam module annotation: Pfam domain module=Pkinase::Pkinase_Tyr; Domain location=188-459::188-459
MSGNSSLHVGLSRKTSFLGLRLWVLIGIGVGVFIVVILCVLSAWVMFRRKSRGSLDKYSLSQIPHISKDIRVDKVGVQTSHDQPDSVAIPVYDKPSENNSDKFLAHLSKNKSGDADNISQCSSVYHHERGFSSMSGEEGSSGTVKKQSASSFGGMVTASPLVGLPEFSHLGWGHWFTLRDLEIATNRFSPENVIGEGGYGVVYRGSLINGSEVAVKKILNNLGQAEKEFRVVVEAIGHVRHKNLVRLLGYCVEGVHRLLVYEYVNNGNLEQWLHGAMSQQGTLTWEARMKVITGTAKALAYLHEAIEPKVVHRDIKSSNILIDTDFNAKVSDFGLAKLLDSGESHITTRVMGTFGYVAPEYANTGLLNERSDIYSFGVLLLEAVTGRDPVDYSRPSNEVNLVEWLKMMVGTRRTEEVVDSRLEVKPSIRALKCALLVALRCVDPEAEKRPKMSQVVRMLEADEYPFRELVMLNHEANDSITVME

SEQ ID NO: 204722 - protein, 32 aa, Glycine max
  Coding DNA Sequence Number=SeqID_87944
MEYDSLSRCLGGEMVDTRDSKSRAKERGDRKF

SEQ ID NO: 204723 - protein, 192 aa, Glycine max
  Coding DNA Sequence Number=SeqID_87945
  Gene Ontology: Mol. function=chitin binding; Cellular component =extracellular region; Biological process=chitin metabolic process
  Homolog annotation: Hit_ID=UPI00006A17C9; Match level="QueryCoverage =71%, HitCoverage=69%, E-value=2e-10, Identity=33%"; Hit description =UPI00006A17C9 related cluster
MPISLYESIDWSVPSRHRGRAHKTHNGPGGAQQGPGVSSSGYGPLSVLHVLTFRGLHVLTFRGLHVLTFRGLHVLTFRELRVLTFRGLHVLTFRGLHVLTFGGLHVLTFRGLHVLTFRGLHVLTFQRTTRPQLQRVSRPRLQRTRRPRRQRTRRPRLQRTTRPPLQRTTCPRLQRATRSRLQWAPHSHLKRI

SEQ ID NO: 204724 - protein, 92 aa, Glycine max
  Coding DNA Sequence Number=SeqID_87946
MAHETGKAEKSEIPHGSSLLKAVRKSAVEEGREALKLGVFRGYGVNKLGKREKTLLHQIFGSSLPRFKSILCLGFLKLEGGADEMKLVSQTG

SEQ ID NO: 204725 - protein, 831 aa, Glycine max
  Coding DNA Sequence Number=SeqID_87947
  Gene Ontology: Mol. function=1,3-beta-glucan synthase activity; Cellular component=1,3-beta-glucan synthase complex; Biological process=1,3-beta-glucan biosynthetic process
  Homolog annotation: Hit_ID=UPI000034F02F; Match level="QueryCoverage =99%, HitCoverage=45%, E-value=0.0, Identity=64%"; Hit description =ATGSL11 (GLUCAN SYNTHASE-LIKE 11); 1,3-beta-glucan synthase/ transferase, transferring glycosyl groups
  Pfam annotation: Domain name=Glucan_synthase; Domain location=153 -830; Score=688.4; E_value=5.2e-204; Accession=PF02364.6; Description= 1,3-beta-glucan synthase component
MYSAVVECYETLRDIILNLLLDEDDRRVVMRICGRVEECIHEEKFVKEFNMSGLPSLSEKLEKFLTLLRSEDGKLESQIVNVLQDIVEIIIQDVMFDGHLLLQTPQQTPHEYHVERGQKFVNIDTSFTHNTSVMEKVIRLHLLLTVKESAINVPQNIEARRRITFFANSLFMNMPKAPKVRDMLSFSVLTPYFKEDVLYSDEELNKENEDGISILFYLKKIYPDEWANFNERVKSDYLEEDKELIRQWASYRGQTLYRTALSEGYRTMDSYEKNKKLLEEAQAMADLKFTYVVSCQVYGSQKKSKNTRDRSCYTNILSLMLTHSALRVAYIDETEDTKDGKSQKVYYSVLVKGGDKYDEEIYRIKLPGPPTEIGEGKPENQNHAIVFTRGEALQTIDMNQDNYYEEAFKMRNVLEEFRRGRSGQRTPSILGIREHIFTGSVSSLAWFMSNQETSFVTIGQRILANPLRVRFHYGHPDIFDRLFHITRGGISKASKVINLSEDIFAGKGRDVGMNQISLFEAKVANGNGEQTLSRDVYRLGRRFDFYRMLSFYFTTVGFYFSSMITVLTVYVFLYGRLYMVLSGVEREILQSPNMHQSKALEEALATQSVVQLGLLLVLPMVMEIGLEKGFRTALGDFIIMQLQLASVFFTFQLGTKAHYYGRTLLHGGSKYRPTGRGFVVFHAKFADNYRMYSRSHFVKGLEILILLIVYEVYGSSYRSSHLYLFITISMWFLATSWLFAPFLFNPSGFDWQKTVDDWTDWKRWMGNRGGIGISSDKSWESWWDEENEHLKYSNLRGKIIEIILAFRFFMYQYGIVYHMDITHHNKDLLVE

SEQ ID NO: 204726 - protein, 144 aa, Glycine max
  Coding DNA Sequence Number=SeqID_87948
  Gene Ontology: Mol. function=1,3-beta-glucan synthase activity; Cellular component=1,3-beta-glucan synthase complex; Biological process=1,3-beta-glucan biosynthetic process
  Homolog annotation: Hit_ID=UPI000034F02F; Match level="QueryCoverage =94%, HitCoverage=9%, E-value=8e-27, Identity=39%"; Hit description =ATGSL11 (GLUCAN SYNTHASE-LIKE 11); 1,3-beta-glucan synthase/ transferase, transferring glycosyl groups
MCHEVYNILDKNLARVTGSTDLVEGRDDEHFLREVITPIYQVLMKEAKRNNKGKASHSNWRNYDDLNEYFWAWMAFIELERYVMSFDRMWIFFILALQAMIIIAWSSLGPVGFFFDGDVFRNVMTIFITYAFLNFLQGTGFVYV

SEQ ID NO: 204727 - protein, 79 aa, Glycine max
  Coding DNA Sequence Number=SeqID_87949
MYPKAHENPRVFSCIFGLIFLESSIQCPWGLGLHQRLLAETRKMSHLLSLAVTNIVICTFPGDANIFRSRLRRSLICYP

SEQ ID NO: 204728 - protein, 461 aa, Glycine max
  Coding DNA Sequence Number=SeqID_87950
  Gene Ontology: Mol. function=zinc ion binding; Cellular component =endoplasmic reticulum
  Homolog annotation: Hit_ID=Q6KA74; Match level="QueryCoverage=97%, HitCoverage=79%, E-value=1e-103, Identity=42%"; Hit description =Ankyrin repeat protein-like
  Pfam annotation: Domain name=Ank; Domain location=69-101; Score=30.1; E_value=8e-06; Accession=PF00023.20; Description=Ankyrin repeat
MAGINVSEYAHSSVHKAIILKDHAGLKEILGVLPKLGNPLEIKTEAASIAEDEKAAAISVVVDRRDVPHGDTPLHMAAKLGDIVATEMLMDAGANGRLKNKEGWTAVRQAIINKQDKIAMVMIKYSWNDPDNKYFRRLPRYIGTMRRMKDFYMEISFHFESSVIPFISRIAPSDTYKIWKKGGNMRADMTLAGFDGLKIKRSNQSVLFLGDGTSDDESKFPGSLFKVLHKEKKVYVVSPSLDAPTDRDVKDTLAKKSRSESVRRVGLDVSQALLVPQLTWRRKERKEMVGPWKAKVYDMQNVVFSVKSRRIPGAPPPEAKPAPKKTKKKDNGKIEDILTDEERKQFEAAMNSSDDNGHSHNRAKKEKKGRSGGHRDHKERKTNSAQPAEHFVNQKGESQFKRGMMPALWLSQNFPLKIDELLPMLDILAEKLKAVRRLRELLTTKLPKESFPVKVCPLSVL

SEQ ID NO: 204729 - protein, 75 aa, Glycine max
  Coding DNA Sequence Number=SeqID_87951
MTWTEGKKNSGGTNEGKRRRLTVAQMEAHCAGVRRRKMVLGAPKSFKLRPGGSLSTQTMMMMRNVPLLGSLGHQK

SEQ ID NO: 204730 - protein, 146 aa, Glycine max
  Coding DNA Sequence Number=SeqID_87952
MKPLERDKYIDRHGLKDDFFLRDIFWTRSDAMKLSNAYNLFKNIFMRCGVIPQVIVTGRDSTLMSAVKIVFLEATNLLCRFRIDRYEQLKISLFVDRLSMVTMDKSMNITDMSYGIASSISKRWLSHAANSFAMVTTLSLSSKKLT

SEQ ID NO: 204731 - protein, 326 aa, Glycine max
  Coding DNA Sequence Number=SeqID_87953
  Gene Ontology: Mol. function=protein kinase activity; Cellular component=plastoglobule; Biological process=protein amino acid phosphorylation
  Homolog annotation: Hit_ID=Q9LRN0; Match level="QueryCoverage=99%, HitCoverage=43%, E-value=1e-139, Identity=74%"; Hit description =Arabidopsis thaliana genomic DNA, chromosome 3, P1 clone:MUJ8
  Pfam annotation: Domain name=ABC1; Domain location=6-107; Score=15.6; E_value=1.1e-06; Accession=PF03109.7; Description=ABC1 family
MALIEEELGQPWQNIYSELSSSPIAAASLGQEPGFGSSKVSSGKLNSCEQRLKVSIDVVGLVDEWAARFFEELDYVNEGENGNRFAEMMRKDLPQASLLIVVIPRTYHKYTSRRVLTTEWIDGEKLSQSTESDVGELVNVGVICYLKQLLDTGFFHADPHPGNLIRTPDGKLAILDFGLVTKLTDDQKYGMIEAIAHLIHRDYPAIVKDFVKLGFIPDGVNLEPILPVLAKVFDQALEGGGAKNINFQELASDLAQITFDYPFRIPPYFALIIRAIGVLEGIALVGNSEFAIVDEAYPYIAQLKLYHSMEKRMKTMAYGLDGKVSV

SEQ ID NO: 204732 - protein, 584 aa, Glycine max
  Coding DNA Sequence Number=SeqID_87954
MGPWGSYWRLNSESSTDHATILPTSLRAYSKVTLLGPSRMILALLPFTLDAPSTLSQNLFDGRVCLDYHLVTLKVWPETSGQASSDTQRYRSKGTPGPGRLKTDGVAIVFLKAKKASRELAFTDLESAFFLVEAHAIFAYFSEYLFLVYRVLGYAMGFKDHVIDAKRHDHVAEVGIFIDAHLPFVIGLFDHDDVGEPDKELMAYNAGVDARHDINYASMFIAGGVPIELCTLLGFGSKLQFGKPFVHDHDLSTTTHCEVRPSRLPGGRIGCHFQAFSELLLKMQCGDDDSELVDIASGLYYFSYKANKWTKVRLDQIRRDFKTLECLPVYDVNGASLVDEDLEHHEVGDYDKDNHGVDLVDVNVPDSVKVAFVRHTGLPSIGKSAHNGVDYTFDLLGRLIFLCLQRLSLASLLVLSLSSSIFCSVSSSIGIVVSVAIVLVSFRYLRVEGLLKDLVCLAIRGEESVQMFIWIRGSIILFLVEWFPTYGYVNFHDVVDKGVSTSSLPFRIVYEGEIRRILGVDLSVSDIVVGGRLEPLKGVLPLRPDRVLIMGERERGREGIHGQGGLLDLAHRTESPNRGRTRIK

SEQ ID NO: 204733 - protein, 194 aa, Glycine max
  Coding DNA Sequence Number=SeqID_87955
MRGTMHEPQAILGVDQKFSPGLPPEKHGDPGIEWAKATRSAKQGGVLRGQVAFAEAVKSNHQLSSKVGSVLDKLLCTRLDGEELLEHYKELQRASKERETNKELEEELLMYKKEAVQQHEKGFHKAVWQVGFFAKDLDLGLFDPFKDVKDGVLLDEKDIVAEEKEAAEWRRKRERRRHFKEKMSLEEAHHHRRP

SEQ ID NO: 204734 - protein, 272 aa, Glycine max
  Coding DNA Sequence Number=SeqID_87956
  Gene Ontology: Mol. function=protein binding
  Homolog annotation: Hit_ID=Q4FX63; Match level="QueryCoverage=92%, HitCoverage=83%, E-value=3e-11, Identity=27%"; Hit description =Proteophosphoglycan ppg4
MKGFVAFTTGDAPLQPNWCMSATISRHSGKMPSTSQRGADNALGYLWHKVMILIKVGEPSTRRTGASLVAAPKARQTQGLSLVSLTVPKARQTQCLSLVSLASPKDRQTQGPSLVSLVAPKACQNQCSSLVSLTALKARQTQGPSLVSLLAPEACQTQGPSLVSLTSPKAHQTQGPSLVSLTSPMAHQTKAHQIHGLSLVSLTAPKAGQTQGPSLVSLSSPKTCQTQGLSLVSLNPSSRACQTQGPPLVSLAKTQDERVPGPKFVKPKVCPW

SEQ ID NO: 204735 - protein, 244 aa, Glycine max
  Coding DNA Sequence Number=SeqID_87957
  Gene Ontology: Cellular component=integral to membrane; Biological process=vesicle-mediated transport
  Homolog annotation: Hit_ID=Q69WS1; Match level="QueryCoverage=80%, HitCoverage=95%, E-value=2e-90, Identity=76%"; Hit description =Synaptobrevin-like protein
  Pfam annotation: Domain name=Synaptobrevin; Domain location=164-238; Score=75.9; E_value=1.3e-19; Accession=PF00957.11; Description =Synaptobrevin
  Subcellular localization annotation: CTP_CleavageSite=54; ConfidenceScore=5.38e-01
MVTTLTSTVDGDEAPSTVDGSVALHGNLLNAPRNLFTTNSSSRQQCFVARGTMVLAEYSEFSGNFNTIASQCLQKLPSSNNRFTYNCDGHTFNYLVENGFTYCVVAIESAGRQLPIAFLERVKDEFSKKYGGGKAATASANSLNREFGPKLKQQMQYCVDHPEEINKLAKVKAQVLDRGEKIEMLVDKTDNLRSQAQDFRTQGTKVKRKMWVQNMKMKLIVFGIAVALILIMFMSICRGFSCLH

SEQ ID NO: 204736 - protein, 185 aa, Glycine max
  Coding DNA Sequence Number=SeqID_87958
MAMRQGGDEYCLPSPRSRLPNIYTYLSLISDGLKFVTPSPYPSGIEYPRLRPVSELNRGCIGLPSHCHQYALVPYTVMLHLLAIGNVAYPPCMDSPTKKTFDIRDTHIHGSTANSILLIKASHQVEPLALIPNIKNLRGLNTGERLEGSFVNVAAIIKVVLGWKCECKERTLANELMRKDRKEHQ

SEQ ID NO: 204737 - protein, 60 aa, Glycine max
  Coding DNA Sequence Number=SeqID_87959
MENRSNESDCAPHMQDLSSILTPERLNSTSYHECHEIGKKVKSPRKTPSLLLDLLVQQAI

SEQ ID NO: 204738 - protein, 211 aa, Glycine max
  Coding DNA Sequence Number=SeqID_87960
  Gene Ontology: Mol. function=1,3-beta-glucan synthase activity; Cellular component=1,3-beta-glucan synthase complex; Biological process=1,3-beta-glucan biosynthetic process
  Homolog annotation: Hit_ID=UPI000034F02F; Match level="QueryCoverage =90%, HitCoverage=9%, E-value=2e-59, Identity=61%"; Hit description =ATGSL11 (GLUCAN SYNTHASE-LIKE 11); 1,3-beta-glucan synthase/ transferase, transferring glycosyl groups
MKQQNGTDAFLQHVIGRFHAFEKAHTMDPTSSGRGVRQFKTYLLHKLEKEGELTEKSVQRSDARELQTYYQHFYEKKIRDGEFSQRPEEMAKNVQIATVLYEVLKTMVAPQNTEDKTRRYAEDVEHKRGQYEHYNILPLYAVGVKPAIMELPEIKAAIAALCRVDNLPMPIIRARPDASQDDSTMPTDRLKKVNDILDWIASVFGFQVKEN

SEQ ID NO: 204739 - protein, 40 aa, Glycine max
  Coding DNA Sequence Number=SeqID_87961
MVKLERFEAKPRSVRKALVWYPPKVGHEKVKVGRGSANMA

SEQ ID NO: 204740 - protein, 97 aa, Glycine max
  Coding DNA Sequence Number=SeqID_87962
MRPRCDSELQSANLGRVADQVRRQATTSTSSSVKNEDEEKGFLVAVVIFKVDVFYLPPAGHIHLDKAKGERQLTVLIEKERIREISHTCRKKKIFLQ

SEQ ID NO: 204741 - protein, 163 aa, Glycine max
  Coding DNA Sequence Number=SeqID_87963
  Homolog annotation: Hit_ID=Q1SMF0; Match level="QueryCoverage=83%, HitCoverage=25%, E-value=3e-11, Identity=30%"; Hit description =Tetratricopeptide-like helical
MYDNIISEEVDMNEQNQDEAGVNKEYVDCCDAFNTSQVFATRDDVLHWAQSVAYKIGFVAVIMRSDTNSDIRGRTSSVLIDCEISDQYRVKKKDLVRTVIGSRKYGCPFKLCAETVVGGERWMVKLMCGSHNHELIKSLVGHPYVYLVTKDEKIIVVNMIMSM

SEQ ID NO: 204742 - protein, 873 aa, Glycine max
  Coding DNA Sequence Number=SeqID_87964
  Gene Ontology: Mol. function=sucrose-phosphate synthase activity; Biological process=sucrose metabolic process
  Homolog annotation: Hit_ID=Q1RTA0; Match level="QueryCoverage=99%, HitCoverage=79%, E-value=0.0, Identity=85%"; Hit description =Glycosyl transferase, group 1
  Pfam annotation: Domain name=Glycos_transf_1; Domain location=287 -470; Score=77.5; E_value=4.1e-20; Accession=PF00534.10; Description =Glycosyl transferases group 1
  Pfam annotation: Domain name=S6PP; Domain location=583-838; Score= -69.7; E_value=1e-05; Accession=PF05116.4; Description=Sucrose-6F -phosphate phosphohydrolase
  Pfam module annotation: Pfam domain module=Glycos_transf_1::S6PP; Domain location=287-470::583-838
MELGRDSDTGGQIKYVVELARALAKMPGVYRVDLFTRQISSPEIDWSYGEPTEMLTPGDDDDDNLGESSGAYIIRIPFGPRNKYLRKELLWPYIQEFVDGALAHILNMSKVLSEQVGGGQPVWPYVIHGHYADAGDSAAILSGALNVPMVLTGHSLGRNKLEQLIKQGRQSKEDINSTYKMMRRIEAEELSLDAAELVITSTRQEIDEQWGLYDGFDVKLEKVLRARARRGVNCHGRYMPRMAVIPPGMDFSNVVRQEDGPEIDGELAQLTASVEGFSPKAMPSIWLDVMRFFRNPHKPVILALSRPDPKKNLTTLLKAFGESRPLRELANLTLIMGNRDDIDEMSSGNASVLTTVLKMIDKYDLYGQVAYPKHHKQSDVPEIYRYAARTKGVFINPALVEPFGLTLIEAAAHGLPMVATKNGGPVDIHRALNNGLLVDPHDQKAITDALIKLLSEKNLWHDCRKNGWKNIHLFSWPEHCRTYLTRVAACRMRHPQWQTNTPGNDIADEESFNDSLKDVQDMSLRLSIDADLAGLSSGPDMQDQVKRLLSRMKKPDSGGSNDTDGGNKMPDNVTGKYPLLWRRRRLIVIALDLYDNNGAPDKKMIQIVQRIIKASQLDPQNARVSGFALSTAMPIRETIEFLKSGNIQVNDFDVLICSSGSEVYYPGTYTEDGKLLPDPDYEAHIDYRWGCEGLKKTIWNLMNTAEGEDKKSSSPIVEDSKSSNAHCISYKIKDLSKAKRVDDLRQKLRMRGLRCHPMYCRGSSSMQVIPLLASRAQALRYLFVRWGLNVANMFVFLGETGDTDYEELISGTHKTIILKDVVSNGSEGILRGPGSYHREDVVPNESPLVASISETTEDKIANTLKELSKSGAM

SEQ ID NO: 204743 - protein, 73 aa, Glycine max
  Coding DNA Sequence Number=SeqID_87965
MKKNMETALCVMICDDEFGLLCVIDLDEKIVCVCRTRKRSGVGIDEEGFKIKEKIALFGRITRRDGNVCEGER

SEQ ID NO: 204744 - protein, 136 aa, Glycine max
  Coding DNA Sequence Number=SeqID_87966
  Gene Ontology: Mol. function=sucrose-phosphate synthase activity; Biological process=sucrose metabolic process
  Homolog annotation: Hit_ID=Q1RTA0; Match level="QueryCoverage=100%, HitCoverage=15%, E-value=7e-54, Identity=63%"; Hit description =Glycosyl transferase, group 1
MAGNEWINGYLEAILSTGASTIEEQKPAPVTLKDGGHFNPTKYFVEEVVASVDESDLYRTWIKVVATRNTRERSSRLENMCWRIWHLTRKKKQLEWEEVQRVTSRRLEREQGRREATEDMSEDLSEGEQGDSVVEM

SEQ ID NO: 204745 - protein, 182 aa, Glycine max
  Coding DNA Sequence Number=SeqID_87967
  Pfam annotation: Domain name=VQ; Domain location=27-57; Score=26.8; E_ value=3.2e-05; Accession=PF05678.4; Description=VQ motif
MGRKVSQESLKISKVDHQKHQFNTLIKVLRPKVYITDSSSFKKLVQELTGNGSSNNTLSPPPLEPNMVENFPLNIGTEPHESDLQTSPDDVSISPEATSNSPELCCDALMNEEFNLVCNQLCLDDLAFQQDSVTNQSIDHFLAYQNLESLLLDVESNPLYNCYEQMMQPDVSIYDYELSGLL

SEQ ID NO: 204746 - protein, 85 aa, Glycine max
  Coding DNA Sequence Number=SeqID_87968
MTLIVKKWSILSRRPRRLQVLQETAEPLPTYVHSSTTIDTTYEKTAAAAEGRGRWCSGSKKEGVQEVKARPVLPNRLWAGVGLAQ

SEQ ID NO: 204747 - protein, 216 aa, Glycine max
  Coding DNA Sequence Number=SeqID_87969
  Gene Ontology: Mol. function=triacylglycerol lipase activity; Biological process=lipid metabolic process
  Homolog annotation: Hit_ID=Q943F9; Match level="QueryCoverage=87%, HitCoverage=45%, E-value=1e-77, Identity=71%"; Hit description =Lipase (Class 3)-like protein
MKEKHPCFTGTEYILSMCIDNYFVVCRKDANYKRTVIACFIQAVYLLELDRQENRTQENALAPNWWIPFKYKLTQTLIDERDGSIFGAILEWDRSAAMADLVLLRPSGAPKAVLALRGTLLKSPTMRRDIEDDLRFLAWESLKGSVRFKVALEVLKSVSDTYGSSNVCIAGHSLGAGFALQVGKALAKEGIYVETHLFNPPSVSLAMSLRNIGEKA

SEQ ID NO: 204748 - protein, 77 aa, Glycine max
  Coding DNA Sequence Number=SeqID_87970
  Gene Ontology: Mol. function=nucleic acid binding
  Homolog annotation: Hit_ID=Q1RZN4; Match level="QueryCoverage=94%, HitCoverage=33%, E-value=2e-19, Identity=59%"; Hit description=Zinc finger, SWIM-type
YFYNIWGHFFRCMDKAEQHKEKLLLVMNGVVNIENQLAEYERDSKQTKTDDLETFVGSSIPKEVGILPPQFSKTKGS

SEQ ID NO: 204749 - protein, 105 aa, Glycine max
  Coding DNA Sequence Number=SeqID_87971
MVSKGWSFDGASMVEEKGRKSNVRERKKLLHFWLITRREKYDLFEMLKSYLGLRAVSLVPVPRVSLHPSGPVFEGKQYIYQNAQNETPSVVQRLVLLNFKLYAKR

SEQ ID NO: 204750 - protein, 111 aa, Glycine max
  Coding DNA Sequence Number=SeqID_87972
  Subcellular localization annotation: CTP_CleavageSite=64; ConfidenceScore=5.31e-01
MAGFDKLASFDVATMTQHNRSGRTLTKQESNVSQPTLLRASEARLMGASSKGGKCAESPPTFICGKRRKNRRKPVMKNIPDSGVVFTFEEGRQKRGSCSYVPSIEEEIRPM

SEQ ID NO: 204751 - protein, 674 aa, Glycine max
  Coding DNA Sequence Number=SeqID_87973
  Homolog annotation: Hit_ID=Q6KA74; Match level="QueryCoverage=99%, HitCoverage=94%, E-value=1e-167, Identity=48%"; Hit description =Ankyrin repeat protein-like
  Pfam annotation: Domain name=Ank; Domain location=69-101; Score=24.5; E_value=0.00039; Accession=PF00023.20; Description=Ankyrin repeat
MAGIDATKYGHSPVHKALVLKDHGELRRILAGLPRLRSTAEIRTEAVSILEEEKADAIAAVIDRRDVPNRDTPLHLAVKFGDEVATELLMVAGADWSLQNEQGWSALQEAICSREEGIAKIIIKHYQPLAWAKWCRRLPRLVGTMRRMRDFYMEITFHFESSVIPFISRIAPSDTYKIWKRGANLRADMTLAGFDGFRIQRSDQSILFLGDGSEDGKVPPGSLCMISHKEKEVLNALDDAGFPANDEEVQQEVVAMSKTNIFRPGIDVTQAVLLPQLTWRRQEKTEMVGPWKAKVYDMHNVVVSIKSRGVPGAMTDDELFSSCNENETESEELNDILTEDERRQLEDALRLDSTDLNNESDEVIIGHRHSCYEHREIPIEEGNYNKSGENKLEKKGWFGGWRKKDSKPEAPKKIAPPRSSLCIEEKVSDLLGDSPSRNQSKPGRHSVEIAVKGDESRRRKDAKASSANSDSRSRHKDGNRENEYKKGLRPILWLSPNFPLKTEELLPLLDIVANKVKAIRRLRELLTTKLPMGTFPVKAALAMTSLGAASIAARLNKMRIAQLSIFSWFCELVAIPVVPTIRVLVTFTKFEELEPVDEFATPPSSPSAAEQESPAVPHFSASSWFQWIKAPYRSSTSAPGSSSRIENIEDPFAIPSDYTWVTAEAKKKKMQEKN

SEQ ID NO: 204752 - protein, 117 aa, Glycine max
  Coding DNA Sequence Number=SeqID_87974
  Pfam annotation: Domain name=zf-CCHC; Domain location=76-93; Score =21.7; E_value=0.00026; Accession=PF00098.13; Description=Zinc knuckle
MYADGLANYGIDDRLEISGETCSLCLLGIGGSKRQLLLDLDFFYVERKRKTISEKGQKKTHTNINKGDNKIQKRKGECYVCGKTGHKAYECNLRKGQQSNNSKPAAPHAPQAHLAEK

SEQ ID NO: 204753 - protein, 122 aa, Glycine max
  Coding DNA Sequence Number=SeqID_87975
MVSYLTNPGKGPSYWDPPKNSAVQLAAAITAGSRIYCPCYTTEESDGNKKVYKYKGPGRNVITPEWYKEQYADPSRSLIKKVTYQFRPNWKELSVKNKESTTTLRTLSNSKRIPFFNEKGKY

SEQ ID NO: 204754 - protein, 53 aa, Glycine max
  Coding DNA Sequence Number=SeqID_87976
MVKDYFLKNLDNKLLRYSQMQTRLDPLVIENQHPVTAHLFGVTWLLGGAKSKM

SEQ ID NO: 204755 - protein, 130 aa, Glycine max
  Coding DNA Sequence Number=SeqID_87977
MEKATAIEGNSSTMSPMNSGGIETPSPVVSDSLSMDTNLQLLNQKLNVQGCRILKVQPWLQGDKNQKEKRRSDLVVIIVESHGTQRKIAGDLIPTGKRNQLERDKLSKPQIKKMWSRRATPSHPCSLKNN

SEQ ID NO: 204756 - protein, 144 aa, Glycine max
  Coding DNA Sequence Number=SeqID_87978
MPPISLLSMPLPEKASNEVEEKWVQSYVAWLGFGYGMAEYVVEATGFRREMVAGGGKMKECGMGRVVVVGGGGGGRIRTLPMWHVCCIIYCEKYKKGFIQRLNEATRDTWHDRVVDEVLGMPVMELCGRLYGNNNASWVGSISM

SEQ ID NO: 204757 - protein, 533 aa, Glycine max
  Coding DNA Sequence Number=SeqID_87979
  Gene Ontology: Mol. function=1-acylglycerol-3-phosphate O -acyltransferase activity; Cellular component=integral to membrane; Biological process=phospholipid biosynthetic process
  Homolog annotation: Hit_ID=Q9SHJ5; Match level="QueryCoverage=96%, HitCoverage=98%, E-value=1e-164, Identity=55%"; Hit description =Glycerol-3-phosphate acyltransferase 1
  Pfam annotation: Domain name=Acyltransferase; Domain location=322 -436; Score=44.5; E_value=3.6e-10; Accession=PF01553.11; Description =Acyltransferase
MVSYLVPLRLANWVMNQVLVKSCYGFSRKLKSLGFRWGDLSSKPLHQPSPFPNITKCDLEGRGSQTLACDFHKVLLRTHSFFPYFMLVAFEGGSIFRAFLLLCSCPILWILNYEMKLRVMIFISFCGLRMKDMDNTSRAVLPKFYLENLNLEAYEVVASVGSRVFFTTMPRVMVEGFLKEYLNADAVIATELHTAGCYFTGFLSKSGLLVKHSALMDYFGDTKPDLGIGNASLHDQLFVSLCKEAYVVITEEGKVMPRNKYPKPLIFHDGRLAFLPTPSATLFMFTWLPLGFLMAIYRIFLGVFLCCKFTLALGIWSGLILNFNDKNQQRSESNKGVLYVCSHRTLMDPIFLSIMLGRRLTAVTYSLSKVSELIAPIRTMRLTRDRKQDGETMKRLLCEGDLVVFPEGTTCREPYLLRFSSLFAELADEIVPVAMNAHVTMFYGTTASGLKVLDPIFFFMNPWPRYDIQVLEKVPRELTCAGGRSSHEVANYIQRELADALGFECTNLKRRDKYMMLAGNEGVVQEKKGRRFC

SEQ ID NO: 204758 - protein, 154 aa, Glycine max
  Coding DNA Sequence Number=SeqID_87980
  Gene Ontology: Mol. function=protein binding; Biological process =protein stabilization
  Homolog annotation: Hit_ID=Q1H3V8; Match level="QueryCoverage=99%, HitCoverage=100%, E-value=5e-50, Identity=64%"; Hit description=Heat shock protein Hsp20
  Pfam annotation: Domain name=HSP20; Domain location=40-138; Score =69.9; E_value=7.9e-18; Accession=PF00011.11; Description=Hsp20alpha crystallin family
MRTYDLTPFYRTAIGFDRLAKLLNESQRNENDISYPPYNIELVDENAYKIVMAVAGFQQDELEIETEHQALRVTGRKAKKEQETTFLHRGIATRDFEHKFQLADHVKVTGANLENGLLTIALLREVPEALKPRKIQIGTQAGANTTLIEQKAAA

SEQ ID NO: 204759 - protein, 185 aa, Glycine max
  Coding DNA Sequence Number=SeqID_87981
  Gene Ontology: Mol. function=oxidoreductase activity; Cellular component=membrane; Biological process=metabolic process
  Homolog annotation: Hit_ID=Q8PPZ3; Match level="QueryCoverage=94%, HitCoverage=63%, E-value=4e-78, Identity=77%"; Hit description =Oxidoreductase
TGRRDRYDEARYQFEVNVYGAARLTQLLIPAMRARRSGYIINITSMGGKIYTLLGAWYHATKHALEGWSDCLRLEVAEFGIKVVIVEPGLIETGFGDVVSGNIVKRSANGPYARLVEKVAKSVKNAYGNGRGSDPKVIADVVARAVKSPHPRTRYAAGKYAKMLIRMRLWLGDRLFDRVILGQTL

SEQ ID NO: 204760 - protein, 94 aa, Glycine max
  Coding DNA Sequence Number=SeqID_87982
  Gene Ontology: Mol. function=oxidoreductase activity; Cellular component=endoplasmic reticulum; Biological process=electron transport
  Homolog annotation: Hit_ID=Q8W2N1; Match level="QueryCoverage=92%, HitCoverage=20%, E-value=2e-30, Identity=61%"; Hit description =Cytochrome P450-dependent fatty acid hydroxylase
MGRMESIWGEDWAEFKPERDSFTYPVFQAGPRICLGKEMAFMQMQRLVAGILRRFTVVPVLTPGAEPHLISFLSSLMEGGFPVKIVDREASSSN

SEQ ID NO: 204761 - protein, 143 aa, Glycine max
  Coding DNA Sequence Number=SeqID_87983
MSGCVNVSSHTYVKSSLIGTNGVRCVGLIKEHGGLGIKKVTYFNEALASRQMEMTLDENTHVIGLLLHLVGRLVVGEEPAFGMHDNWLEEQSLAMVYPKLFILSNNHHRTVYKKWEVGEMGGGHGTWHGDDLALYGRRTLLMI

SEQ ID NO: 204762 - protein, 101 aa, Glycine max
  Coding DNA Sequence Number=SeqID_87984
MVLKLAVVEKVLFVGLVCLSEMTTIYLMQNFMAEAASATQDPMGGSVSQGYSAYPTTAPVYAPPTSAGGGGHTGHAPSADYGPLYGYHTVGTLALAFIISH

SEQ ID NO: 204763 - protein, 509 aa, Glycine max
  Coding DNA Sequence Number=SeqID_87985
  Gene Ontology: Mol. function=oxidoreductase activity; Cellular component=endoplasmic reticulum; Biological process=electron transport
  Homolog annotation: Hit_ID=O81117; Match level="QueryCoverage=93%, HitCoverage=93%, E-value=0.0, Identity=68%"; Hit description =Cytochrome P450 94A1
  Pfam annotation: Domain name=p450; Domain location=38-502; Score =170.4; E_value=4.4e-48; Accession=PF00067.12; Description=Cytochrome P450
MIDILLNLQLLAPFFLFLILPVFFFFCFTSSGPTKGTIPIPKPYPIIGHYFALKSVGNRRIQWLSDIVKISPAGTFTLHRPLGRRGVITGNPATVEYILKTRFSNYQKGRTTTSILSDFLGTGIFNADGNTWKFQRQVASHEFNTKSLRKFVEHVVDAELSNRLVPILTSAAAAQDKTLDFQDILQRFAFDNICKIAFGFDPEYLTLSAERSKFAQAFEEATEISSKRFREPLPLVWKIKRLLNIGSERRLRRAVKEVHEFARNIVREKKKELKEKQSLESVDMLSRFLSSGHSDEDFVTDIVISFILAGKDTTSAALTWFFWLLSKNPRIEKEVLKEIMEKSEAPVYDEVKDMVYTHAALCESMRLYPPVPLDTKETVDDDVLPDGTVVKKGMMVTYHVYAMGRMESIWGEDWSEFKPERWLEKVESGKWKFVGRNSFTYPVFQAGPRICLGKEMAFMQMQRLVAGILRRFTVVPAVAEGVEPHYFAFLTSQMEGGFPVKIIKRETST

SEQ ID NO: 204764 - protein, 95 aa, Glycine max
  Coding DNA Sequence Number=SeqID_87986
  Gene Ontology: Cellular component=chloroplast
MPLKDSTETKTGCQERRGEDQAGPCEQLDALSPFNPLSEMWQKEKESMDRPHRLHPVGTTRSPQGRLSASRGRGPTIEPLFKKRNALAIRSQVGQ

SEQ ID NO: 204765 - protein, 99 aa, Glycine max
  Coding DNA Sequence Number=SeqID_87987
MASKKRKAPSTPSQAIYDRSKFTSQEAWERYTNITVPRKFLLERNVVVYYTEFDEFKEEPERRHWDKELTDFANNNINVAIVKEFYTNLYDTEDKSPKQ

SEQ ID NO: 204766 - protein, 318 aa, Glycine max
  Coding DNA Sequence Number=SeqID_87988
  Gene Ontology: Mol. function=sequence-specific DNA binding; Cellular component=intracellular; Biological process=regulation of transcription, DNA-dependent
  Homolog annotation: Hit_ID=Q2K5Z5; Match level="QueryCoverage=61%, HitCoverage=95%, E-value=2e-71, Identity=71%"; Hit description =Leucine-responsive transcriptional regulator protein, AsnC family
  Pfam annotation: Domain name=AsnC_trans_reg; Domain location=233-309; Score=68.1; E_value=2.9e-17; Accession=PF01037.11; Description=AsnC family
  Pfam annotation: Domain name=HTH_5; Domain location=170-217; Score =9.9; E_value=0.037; Accession=PF01022.11; Description=Bacterial regulatory protein, arsR family
  Pfam module annotation: Pfam domain module=AsnC_trans_reg::HTH_5; Domain location=233-309::170-217
MLLALDAEPLGLGAGGDDQRVGGPYLARIGLHDERANAGFNFGHQVTDDFRADMRRLLQHLVHQPRALDRVCKARVILDIGGDHQLTALFHAGDQHRLQHCACRVDRRRVACGTGADDQYLALRYQQGSCGCTRNFVTGWRHIVANPAPNSTRKFSSLTRYSSVTSVELDAIDLKILRELQRDGRMTNVELAERVGISAPPCLRRVRKLEEAGVIEGYHAMLNAPKLGFDLVAFCMIGLKRQSDSNLKAFAAATAGWSLVRQAWMVSGESDFLLHCVAKNLTEFQDFVIEVLTADENVDTVRTMLTIFQVKRVGLVEI

SEQ ID NO: 204767 - protein, 112 aa, Glycine max
  Coding DNA Sequence Number=SeqID_87989
MHENEWHGACLLFAPIWEPIGQYLGVSNNYSPTILNSHGCSLEVSSLKIMILWRPNSQKYSPVESPTVATCPSRASEGEADGWTFQRRKDARSHHQRLFVENVGKTEGNRSK

SEQ ID NO: 204768 - protein, 167 aa, Glycine max
  Coding DNA Sequence Number=SeqID_87990
HPGLVRAARAGVTIKQYFRPTPRTSHTSSFIAPEELEQLTQKIRDQLEESITEKMQSQGLALPPEPEVGPSSARVSTKESYVDPSGNDPETGDSEKYGLLYEGSTIVHKIHLLHDQVKVGVEEVRDADFPIPVPTEEVKLVGQALNTFLAWPTHLIKRLSEHVFQCH

SEQ ID NO: 204769 - protein, 100 aa, Glycine max
  Coding DNA Sequence Number=SeqID_87991
  Subcellular localization annotation: CTP_CleavageSite=66; ConfidenceScore=5.82e-01
MLFFFLQRFCFLSFLLLQFSSSSRAASSFFFFFAAIAAIVSVFRRKVWVFALVVWVFTFVLLLRVSSSSRKVCRSGFGFCRQWQKTLSGSCWVVYGSSDP

SEQ ID NO: 204770 - protein, 47 aa, Glycine max
  Coding DNA Sequence Number=SeqID_87992
MSYDAAIEVRNHVSPEPEVEDAGVASLANPKRLVTNSECEMILKVQR

SEQ ID NO: 204771 - protein, 65 aa, Glycine max
  Coding DNA Sequence Number=SeqID_87993
MKNDEERIKEGGGCRPARPGELGCFHQKAPPSVGTPWKAQNFTDYLTMSVKYLEAVKRRLHATKQ

SEQ ID NO: 204772 - protein, 90 aa, Glycine max
  Coding DNA Sequence Number=SeqID_87994
MTQSNNRVKSYCRLILLRASVLNFERLDIQRDTIGHPSKRASILNFEGLDILRDTIGHPSKKLLSFDFAQSLYSEFQASRYTTGHNRTTE

SEQ ID NO: 204773 - protein, 98 aa, Glycine max
  Coding DNA Sequence Number=SeqID_87995
MSLAHFVFNFSTDSEMLSSGSQDGKIKDFRIRIPSSIQITQPPHPVFVPPYSSLIFSGYQVPPSNPSVFWPLAKPVLFFGSQNFCTLVFALSPLFCIA

SEQ ID NO: 204774 - protein, 60 aa, Glycine max
  Coding DNA Sequence Number=SeqID_87996
MDKNLKVGEDERRERETRSTKFCASKESTNPRSNPRFSTKCALGVMRYVKHERHAQSVTI

SEQ ID NO: 204775 - protein, 545 aa, Glycine max
  Coding DNA Sequence Number=SeqID_87997
  Gene Ontology: Mol. function=transporter activity; Cellular component= membrane; Biological process=oligopeptide transport
  Homolog annotation: Hit_ID=Q9FRU4; Match level="QueryCoverage=90%, HitCoverage=86%, E-value=0.0, Identity=69%"; Hit description =Putative nitrate transporter NRT1-3
  Pfam annotation: Domain name=MFS_1; Domain location=5-471; Score= -1.8; E_value=0.00038; Accession=PF07690.6; Description=Major Facilitator Superfamily
  Pfam annotation: Domain name=PTR2; Domain location=54-455; Score =444.4; E_value=1.5e-130; Accession=PF00854.12; Description=POT family
  Pfam module annotation: Pfam domain module=MFS_1::PTR2; Domain location=5-471::54-455
MAYYGISSNLILYLTRKLHQGTVTSSNNVTNWVGTIWITPILGAYVADAHLGRYWTFVIASVIYLMGMSLLTLSVSLPSLKPPECHELDVTKCEKASILHLAVFYGALYTLALGTGGTKPNISTIGADQFDDFDSKEKKLKLSFFNWWMFSIFIGTLFANSVLVYIQDNVGWTLGYALPTLGLAISIIIFLAGTPFYRHKLPTGSPFTKMAKVIVAAIRKWKVHIPSDTKELYELDLEEYAKKGRVRIDSTPTLRLLNKACVNTDSTTSGWMLSPVTHVEETKQMLRMIPILAATLIPSAMVAQIGTLFVKQGITLDRGIGSFNIPPASLATFVTLSMLVCVVLYDRFFVKIMQRFTKNPRGITLLQRIGIGLIIHIVIMVVASLTERYRLRVAKEHGLVENGGQVPLSIFILLPQYVLMGAADAFVEVAKIEFFYDQAPESMKSLGTSYSMTTLGIGNFLSTFLLTTISHVTKKHGHRGWVLNNLNASHLDYYYALLAILNFLNFIFFMVVTKFYVYRAEISDSIKVLEEELKEKTSNQVIPRD

SEQ ID NO: 204776 - protein, 204 aa, Glycine max
  Coding DNA Sequence Number=SeqID_87998
MRNFMGFTRQTGRGQGLLNTLKRVKKGDKGGVSLSQLKTEKEVGRKVLVSLRPIRSRVSTNGSSGHHHRHGGSTSGLGGYSPRKRKSEAAVKTPSPSKHSVEKKRAGLDLPPAGTNNPSAVVSSSFLVSNCAVLSNNHDVILTSSLDLALAKPLPNLPASASEKAVMDCFNKLLLSARLQKDKGQALVEFLTVYDASAALSLEG

SEQ ID NO: 204777 - protein, 51 aa, Glycine max
  Coding DNA Sequence Number=SeqID_87999
  Homolog annotation: Hit_ID=Q9FRU4; Match level="QueryCoverage=66%, HitCoverage=6%, E-value=9e-09, Identity=82%"; Hit description =Putative nitrate transporter NRT1-3
MAAKHVVIIMGPARALRRVVNEYTQDGTVDLKGKPILKSKSGGWNACSFVV

SEQ ID NO: 204778 - protein, 222 aa, Glycine max
  Coding DNA Sequence Number=SeqID_88000
  Gene Ontology: Mol. function=nucleic acid binding; Biological process= protein amino acid phosphorylation
  Homolog annotation: Hit_ID=Q10S20; Match level="QueryCoverage=85%, HitCoverage=20%, E-value=5e-22, Identity=34%"; Hit description=RNA recognition motif family protein, expressed
MKLGGEVLTVLQAMPDASPSENAGEPPSYGIPEHAEPLLRKPTQVLEINNVFADSIWSLSDVTIEEILDDVRLECARFGTIKSINVVKHSSDENLATKLEECEVINKVDAKDVSQDTNCITNNTEYSFSDKANYSKFKGTNGMEIHDNKEMEEDKVDEGSSVNVDKSAEVFDDKSCREHLVDDTAVEDAEDKNIPCSIIQECLGQQDTLDDGPEFLDMMVAN

SEQ ID NO: 204779 - protein, 78 aa, Glycine max
  Coding DNA Sequence Number=SeqID_88001
MTNPEGTHFRPIFGTNFRILIRDVVCVSDSLHVISLIQAPMVVSQRYASIIMRIKDLLNFNWKVVLRHSLRMLQEFTF

SEQ ID NO: 204780 - protein, 276 aa, Glycine max
  Coding DNA Sequence Number=SeqID_88002
  Gene Ontology: Mol. function=protein serine/threonine kinase activity; Cellular component=extracellular region; Biological process=protein amino acid phosphorylation
  Homolog annotation: Hit_ID=Q6EPM5; Match level="QueryCoverage=88%, HitCoverage=95%, E-value=1e-77, Identity=58%"; Hit description =Putative serine/threonine-specific protein kinase
  Pfam annotation: Domain name=Pkinase; Domain location=1-229; Score =69.4; E_value=1.2e-17; Accession=PF00069.15; Description=Protein kinase domain
  Pfam annotation: Domain name=Pkinase_Tyr; Domain location=1-229; Score=16.8; E_value=1.7e-13; Accession=PF07714.7; Description =Protein tyrosine kinase
  Pfam module annotation: Pfam domain module=Pkinase::Pkinase_Tyr; Domain location=1-229::1-229
MSFSVLKVNHGNLVKLEGFCIDPEEANCYLVYEYVENGSLYSWLHEGKKEKLSWKIRLRIAIDIANGLQYIHEHTRPRVVHKDIKSSNILLDSNMRAKIANFGLAKSGMNAITMHIVGTQGYIAPEYLADGVVSTKMDVFAFGVVLLELISGKEVINEEGNLLWASAIKTFEVDNEQEKTRRLKEWLDKDILRETFSMESLMGALTVAIACLHRDPSKRPSIMDIVYALSKSEDMGFDISDDGIGSPRVIARFSCCYGYADHEKGYRRPPPISSTS

SEQ ID NO: 204781 - protein, 192 aa, Glycine max
  Coding DNA Sequence Number=SeqID_88003
  Gene Ontology: Mol. function=protein dimerization activity; Cellular component=nucleus; Biological process=regulation of transcription, DNA-dependent
  Homolog annotation: Hit_ID=P32294; Match level="QueryCoverage=99%, HitCoverage=100%, E-value=4e-87, Identity=83%"; Hit description =Auxin-induced protein 22B
  Pfam annotation: Domain name=AUX_IAA; Domain location=11-192; Score =395.5; E_value=8e-116; Accession=PF02309.7; Description=AUXIAA family
MESRVVFENDLNLKATELRLGLPGTEDKTVHAISIRNNKRQVPETSQESVSISKASPDQHVESDPAPPAKAKIVGWPPIRSYRKQSLQEGDQGDGIYVKVIMDGAPYLRKIDLKVYRGYPELLKALETMFKLTIGEYSEREGYKGSEYAPTYEDKDGDWMLVGDVPWDMFMTSCKRLRVMKGSEARGLGCGV

SEQ ID NO: 204782 - protein, 129 aa, Glycine max
  Coding DNA Sequence Number=SeqID_88004
MEDLFKRWTQYLDSTQSRVNHPPPDIHVGTSYSMENYQWEQELQPYNQYEEERSSNMDNFLMQFKETIESTQRAFKSLEIEVGKLVEEVAKFVATREENFVEVEAHEESLAEEHDSRENDEEKSEEKTQ

SEQ ID NO: 204783 - protein, 109 aa, Glycine max
  Coding DNA Sequence Number=SeqID_88005
  Gene Ontology: Mol. function=transferase activity; Biological process= RNA-dependent DNA replication
  Homolog annotation: Hit_ID=Q1RZQ1; Match level="QueryCoverage=94%, HitCoverage=22%, E-value=7e-12, Identity=36%"; Hit description=IMP dehydrogenase/GMP reductase
MEGKSEVFHAPLRAFSVIKHYYLITCPGSIATWEMPGMWNWIEPLITEVDSFRGLVFKLSDTLNADNTNKFAMLLWSLGKRRNEKLWNSMDETKATVCYRANSMLQDWT

SEQ ID NO: 204784 - protein, 227 aa, Glycine max
  Coding DNA Sequence Number=SeqID_88006
  Gene Ontology: Mol. function=chitin binding; Cellular component =extracellular region; Biological process=chitin metabolic process
  Homolog annotation: Hit_ID=UPI000044A8F0; Match level="QueryCoverage =87%, HitCoverage=99%, E-value=3e-26, Identity=28%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
MPSPWVLVTLTVERTTRPRLERTTRPHHQRAARPHLQRTTCPRLERAARPHLGGLHALTSRGLHVLAFRGLHVLTRLHALTFRGLHVLALRGLHVLTIRGLHILTFRGLHALAIRGLHVLTFRGLHVLTFRGLHALVIRELHVLTFVGLHALTFRGPHVLTFGGLHTLALRGLHVLTIRGLHALTSRGLHVLTFRGLHVLTFRRLHALAFRGLRVLTFGGLHIHTLR

SEQ ID NO: 204785 - protein, 177 aa, Glycine max
  Coding DNA Sequence Number=SeqID_88007
IDVFLAYHNHKESPVVAILAMYDTFDRGCEGAAQELFVVHQLLASMEGRLLIGSLARRKEESGLYLHAKDVQMFPGWEHGDRELRGSSNGIIGGYHKWLRVRTQGLDWLPNLKTVGDNEVKASEESDEVQALKAKLERARVVKEKFKAAIVSSNSEEVKGIIMGQRHDLEGRVKGLP

SEQ ID NO: 204786 - protein, 247 aa, Glycine max
  Coding DNA Sequence Number=SeqID_88008
  Homolog annotation: Hit_ID=Q1RUD8; Match level="QueryCoverage=66%, HitCoverage=40%, E-value=3e-15, Identity=29%"; Hit description=IMP dehydrogenase/GMP reductase
MGQLQRQAFRKAYGKIWDLARVEVSMEPIASLSQYYDQPLRCFTFEDFQLVPTVKEFEEILGCPLGGRKPYLFSGFYPSTTRVARPWQIKANGLSFIDILALLIFGVVLFPNMEGLVDLAAIDAFLAFHHGKESPVVAILAMILSSCEGCPMRGVPSDESITPFIARGFSDHNARDRELRGSSNGIIDGYHKWLRVRTQGLDWLPNLKTVRDDEVKALEEIDEVQALKAELERAWVVEEKFKSIAIK

SEQ ID NO: 204787 - protein, 102 aa, Glycine max
  Coding DNA Sequence Number=SeqID_88009
  Homolog annotation: Hit_ID=Q6K832; Match level="QueryCoverage=34%, HitCoverage=5%, E-value=5e-08, Identity=75%"; Hit description=Lipase class 3 protein-like
VLSAAKVAKKMKLKFTKEWIAYLRLPLPIDVYKEVIHKCLKVVMRSNVGLEGGKKHKWWNCKILKPAFTIIADHEMKCLLLLIRGTHSTKDTLTAVTGNLLQ

SEQ ID NO: 204788 - protein, 40 aa, Glycine max
  Coding DNA Sequence Number=SeqID_88010
MKNDVEVDYDRNSVAPRPSCPGELLLQPEVTLLARASSVD

SEQ ID NO: 204789 - protein, 275 aa, Glycine max
  Coding DNA Sequence Number=SeqID_88011
  Gene Ontology: Mol. function=amino acid transporter activity; Cellular component=membrane; Biological process=amino acid transport
  Homolog annotation: Hit_ID=Q48KP6; Match level="QueryCoverage=100%, HitCoverage=60%, E-value=2e-98, Identity=67%"; Hit description =Ethanolamine permease family protein
MALNILGVKLAAMFELVVTVLAVLELLVFMGVVSPGFSVANFAANGWAGSDHFGMPALSGIFAAIPFAIWFFLAIEGAAMAAEEAKDPKRTIPKAYISGILTLVVLAIGVMLLAGGAGDWRKLSDINAPLPQAMKMIVGEHSNWMHMLVWIGLFGLVASFHGIILGYSRQFFALARAGYLPHSLAKLSRFQTPHRAIIAGGVIGIAAIYSDGLINLQGMTLTAAMITMAVFGAIVMYLMSMLSLFKLRRSAPDLERSFRAPGYPLVPGIALVLSL

SEQ ID NO: 204790 - protein, 75 aa, Glycine max
  Coding DNA Sequence Number=SeqID_88012
MITRILGREFLIELAKISEATCLTRWWRLRAFSFLGRHTREPCVAFPPKDLDARRTVTRCAFMTGNSLDSWKETL

SEQ ID NO: 204791 - protein, 36 aa, Glycine max
  Coding DNA Sequence Number=SeqID_88013
  Homolog annotation: Hit_ID=Q6ZKZ6; Match level="QueryCoverage=100%, HitCoverage=5%, E-value=6e-08, Identity=66%"; Hit description =Galactosyltransferase family-like protein
EWVEEEYPIYANGPGYIVSADIAQFIVSEFEKRKLK

SEQ ID NO: 204792 - protein, 67 aa, Glycine max
  Coding DNA Sequence Number=SeqID_88014
WAKRASTAKRSFSALSEKEESGKALASRPHAKCEISALSAADLKQMIGTDSRAYHSAYFGKRALEAA

SEQ ID NO: 204793 - protein, 73 aa, Glycine max
  Coding DNA Sequence Number=SeqID_88015
MKKILGLQAPMELTSPLTPQLFALIWVISYRRDNIRKGFTESTVNTRQLRDEVQHKEKDDIIGQKKIKSSTMM

SEQ ID NO: 204794 - protein, 336 aa, Glycine max
  Coding DNA Sequence Number=SeqID_88016
MEDVVPMDGVKDSGVLDEVDIPLAKHISGQCLEQEGPWMVADHYLILQRWRPFFLMNGKITKKVALWIRIQRLSIELYSNIFLDMIGISLGKFLKVDKLTSIQSKGKFVRICVKLDLEKPLETHIYVHGLSMKEENIPGSIGREIFFDTICNILDFRLLDGSHTMTLQEVVVYSTSLLVKTLVKCHHMKCHSVRAVEKSKIRVVTNGIRANLSPSTVWFEEKPDYTIDDDLKELIGSTYTNKMHLLLSSSSLKNSTVGCSNKQGCGVKCECVKCRSVRVTKKLKIGDVTRIEEEMKWSTMFGTIVDHIWSRRNEFISTPNDDNGNHDASRRWKKPL

SEQ ID NO: 204795 - protein, 206 aa, Glycine max
  Coding DNA Sequence Number=SeqID_88017
MAQYLSEFEDLANRVIVLPAPFLLSCFVSGLAPDIHREVQAHQPLTIVQAAGLARLQEEKLQDPRPPPRFRPIPPLTPPSLTLPSPCIPPSPPLLPSPSRPPPSPTVRRLTPKELASHREKRLCFLCDEKFHRGHRCTPRVHLLITEEDDPGDPSLIDSGDPAPYPADGPDLLAAQISLHSLTSLMAPETLRLIGYHRRLCDSCPD

SEQ ID NO: 204796 - protein, 62 aa, Glycine max
  Coding DNA Sequence Number=SeqID_88018
LRIANDTFSQSRSEDADISKEGADDDMMMLVTECSRALSLTDSKCVCSGYRIGRLRVPMDSQ

SEQ ID NO: 204797 - protein, 346 aa, Glycine max
  Coding DNA Sequence Number=SeqID_88019
  Gene Ontology: Cellular component=fimbrium; Biological process=cell adhesion
  Homolog annotation: Hit_ID=Q6D8N2; Match level="QueryCoverage=90%, HitCoverage=99%, E-value=3e-60, Identity=39%"; Hit description =Putative exported protein
MSSSRAAIRCGSALNRNQSVRSSKQHNSKEWCMSSWSIYKRRALLGCLATPFGAQALECHLNTENGITEESEDIGRLTIPATLPVGSRLWTSKPMSRDVMCWAHASKPKGEWVYFYPNPDNRQFAAGIAMGVIYNGRDLGLINSRVQTDMFRTPKQRELGHVNYQVYLQKTGEITEGGASQIAVFQLDGVGGINVHPGKNYRFTLTGLDKIKVIQCAASVELSTPEGVDFGEIPTWKPNAGTVASKDFSILIRKNGCSDSFALEANFMVKNGTLTDATGLNMDNGSTLRIHDNSNPKWIKYNQFDSFADMSGRDQVQKSYSASLQASGEGQEGNFRKTVILLINYI

SEQ ID NO: 204798 - protein, 62 aa, Glycine max
  Coding DNA Sequence Number=SeqID_88020
MEGALTLLDVPGFIRCMLCMYMEGCSDLVGCPWGAVTLSDAPGGGNIVVKKFKHLRRGMADR

SEQ ID NO: 204799 - protein, 59 aa, Glycine max
  Coding DNA Sequence Number=SeqID_88021
TYRLKTEERRRTVKNDEEFPQNRLRKCYGSISTRFFITKTEVLAAQRLLEEDFEAYPNY

SEQ ID NO: 204800 - protein, 490 aa, Glycine max
  Coding DNA Sequence Number=SeqID_88022
  Homolog annotation: Hit_ID=Q1SS74; Match level="QueryCoverage=84%, HitCoverage=82%, E-value=4e-57, Identity=34%"; Hit description=C2
  Pfam annotation: Domain name=C2; Domain location=54-149; Score=5.2; E_ value=0.074; Accession=PF00168.20; Description=C2 domain
MLVPNSWIDLTNVFNYKILTPTYVESQVIIDDPNFNTNSFSLVFPNFGNLLAGCKAKFQGITKVETWNGFIQSECSEFQLQDVYAKFSLTYNPDETLSTRIINGGGKNPTFNEKLRMKITQIDAVLKCEVWMFSRSRIHMEDQLLGFALVPIAQVVGKGKVTEDYSLSSTDLFHSPAGTVQLTLSLDPSLAINSSVNLIPESAKNSSISSEVILLDRKISEVMLDPVEYARIEFPDISVVKENQQMVSEYFNLASQGTTSAPSRSNIGGSLPFLHLGASPQLDDYEMTISSQDENHVGSISPNESIQNSCFLGSTITTLSDDRNSADSVEKKNHLSTGDSSNSVTVSITVEGTQNCCAGPDTPTSKKEEGEARNDKDANFSSKEKESKKTNNNNTEAAKFGQVFSGPLGNINLEAEQAAMQKQIVDMYMRSMQQFTESLAKMKLPMDLDKPEKVDHGDGDVIQNHDSSKLEMDKKKKDGSRVFYGSRAFF

SEQ ID NO: 204801 - protein, 219 aa, Glycine max
  Coding DNA Sequence Number=SeqID_88023
MNVHGCSVMVAKWRGGDGIGWWHNAEVVNDDDGEGKRGRVKNGLFRGEVEANNKDIAFMRRSQSEIVSSGILKGPYIQAMRGRNQMNKCNHKYGVVAFAESSKGKATWLRDPDQDVDIISVHHASGLICEINLSNPLSTSDDLRFLGTFHVFSVTGFYNNNLSASSSPNNNSIPYSSSAIQFTRGSPPKLFEGLIGGKLIGVEPVQVMASIVKKRTCST

SEQ ID NO: 204802 - protein, 184 aa, Glycine max
  Coding DNA Sequence Number=SeqID_88024
  Gene Ontology: Mol. function=chitin binding; Cellular component =extracellular region; Biological process=chitin metabolic process
  Homolog annotation: Hit_ID=UPI00006A17C9; Match level="QueryCoverage =95%, HitCoverage=100%, E-value=6e-19, Identity=28%"; Hit description= UPI00006A17C9 related cluster
GLHVLTFRKLHALAFEGLHVLPFRGLHVLPFRGLHILTFRELHALTFRGLHVLTIREPHVLTLRVLHALAFRGLHALTFRGLHVLAFRGPHVFTIIGLHALGFRGLHVLTFKGLHVLPLRGLHILAIRGLDVLTFRGLPALILRVLHVLIIRGLHALAFRGLHATPLEDYTSSPSEDHTSSPSE

SEQ ID NO: 204803 - protein, 88 aa, Glycine max
  Coding DNA Sequence Number=SeqID_88025
MSQNFADYLTMDVKYLEAVERRLHAIKQWSPDKIRARMTIRYLRLQPNSLSLDDKRCRRRCRSLRINRLACPWLTKGAGNHKVTLHVT

SEQ ID NO: 204804 - protein, 58 aa, Glycine max
  Coding DNA Sequence Number=SeqID_88026
MSSFRDLEQKWAPKVEALLGNNGGWEKRRRRLRERERASEIFLGLSEERERAMPHVSI

SEQ ID NO: 204805 - protein, 159 aa, Glycine max
  Coding DNA Sequence Number=SeqID_88027
MSISPCISISWDRPHKTHSGPGGALQGPGVSSSGYGPLSVLQGACPPQQGIAPARHPVDPDKSNRVLGFPVLITSLCQFYGVPFTPSKVIRPPTNRAFNKKYCTPRQAQGETPQQPGDGRQRAINAPSPPPKRFSSSTKAGALPMTRGRPTGDQVQSQR

SEQ ID NO: 204806 - protein, 121 aa, Glycine max
  Coding DNA Sequence Number=SeqID_88028
MTKSNGKDPLEGHGGPMTRARARKAKEALQQVLSILFEYKPKFQGEKSKVVSGSLLKSAVKLLYKLDHFINKHKLSFIQKIRVYLFYLIESDSPKFLSDSRTPWLYQRTFTTFVCCPHWKE

SEQ ID NO: 204807 - protein, 421 aa, Glycine max
  Coding DNA Sequence Number=SeqID_88029
  Homolog annotation: Hit_ID=Q38848; Match level="QueryCoverage=61%, HitCoverage=78%, E-value=2e-57, Identity=49%"; Hit description=LRP1
  Pfam annotation: Domain name=DUF702; Domain location=201-366; Score =317.8; E_value=1.9e-92; Accession=PF05142.3; Description=Domain of unknown function (DUF702)
MDDTLDYRLHNQGFSVVATTRRLPSDSGAFADWAATASSGAGGGGGRAVPVDDLSLGFNAGPAAAATGPTAGMWSTQARSINYPEMGMFVVAPASSFHHHHHHQPPQHDPSVMADSLNPATALGVGVGVIPLLAATPCLESDNNILGSRTRGGGGIQLWQDQQQHHQSHYMKKQLQQGLLDHNSNTSSGNLIQNSGEVTASGTSSGGTTCQDCGNQAKKDCTNRRCRTCCKSRGFDCPTHVKSTWVPAARRRERQLMTSATAAVAGSSGSTSGTKKPRLIASQTTTTSHTSTSNTTPPRSFDTSSSHQDAGFKESLPGQVRAPAVFKCVRVTAVEDGQDEYAYQAVVKIGGHVFKGFLYDQGVENRDVYPNLSELHLGGGSGGAGRNGVSSSSPMMDPNDVYAASGGGLLGGSSAYGNPMN

SEQ ID NO: 204808 - protein, 275 aa, Glycine max
  Coding DNA Sequence Number=SeqID_88030
  Pfam annotation: Domain name=NifT; Domain location=115-180; Score =1.0; E_value=0.045; Accession=PF06988.2; Description=NifTFixU protein
MKLCGPFYLRWMYPIERYMKIFKGYTKNLHRPETSIVERYIVEEAIELCSKYIEKAKPIELPESWHDERVNEVVTYIVRHKALVKESNPKMTKNKILVVKGGQWFYTKNSLVLILKMMIQPYHTPFSTHVPNVNGEEEVDDVNANRNDHDEGELINIAYGYTTELPPLESVPSLTTSKRARKVTQLISLSVKLVGVERSLVHVDLTATKVDEGKEDDDDKVYEKYKFSKEKWNQFFQSRSDLLWEDVGKKAQSMQKQNVAPLVLEQKLMEENQKK

SEQ ID NO: 204809 - protein, 191 aa, Glycine max
  Coding DNA Sequence Number=SeqID_88031
  Gene Ontology: Cellular component=cytoskeleton
  Homolog annotation: Hit_ID=Q9M3A3; Match level="QueryCoverage=78%, HitCoverage=46%, E-value=3e-31, Identity=47%"; Hit description =Protein ABIL2
MTTFLKIMSPAGETLRGAKLTKSIYMGCSLDDEDDWHHFRNAVRATIRETPTSTESKGRSPSPSLQPQRAGAFSFTSTMPKKDLEKRTVSPYRFPLLRTGSMSGRPTTPKNSRPTTPNSSRRPTTSSPSDARLMYPSEPRKSASMRLPAERDSNKDVEHQHHSKSKRLLKSLLSRRKSKKDDLLYTYLDEY

SEQ ID NO: 204810 - protein, 150 aa, Glycine max
  Coding DNA Sequence Number=SeqID_88032
  Homolog annotation: Hit_ID=Q8H6Q8; Match level="QueryCoverage=97%, HitCoverage=44%, E-value=3e-07, Identity=27%"; Hit description=CTV.20
ESRIPADLKYFSSFALSWIFSWQYRYSKTEKTNQYPSLQRHAFVKWWTQFDSSKADAEQVKLWFQSHPEFLKAADPETSVFLNQKSHLAAFLAGSTSKEVLAKNLKEVLQMLQQEEEASSSKKEETSSAEEDEEDPFYQNEDDCFGICLD

SEQ ID NO: 204811 - protein, 207 aa, Glycine max
  Coding DNA Sequence Number=SeqID_88033
  Homolog annotation: Hit_ID=Q1S735; Match level="QueryCoverage=43%, HitCoverage=32%, E-value=1e-09, Identity=51%"; Hit description =Probable transposase [imported]-Arabidopsis thaliana-related
MTSSETPSSQEASTQNSRPNIRAKTDIASRHCKMIKEGEVELIGSRVTWLVLAEVRYQMKQNLDENKSKMRKIEEECDDSYSPSEEGGEVPIEVEQPTPRAFATKKHESRIQGSKYAQPLGLLEKEFPKLVWSPCASHYINLMLQDMGKLEELTEPLVCVLRIVDSEDKYAMGFLNQAMYKAREEMVRRFQRNKTEVKPYLKILDHR

SEQ ID NO: 204812 - protein, 98 aa, Glycine max
  Coding DNA Sequence Number=SeqID_88034
MVGILYYKKLVEAINCNEKPSNDYYNFTRVDFIKGRKCMIMVRVPALSGCLIKPGVNYISGEEHNKLYQRLLRSTFGSIVGSFEDTIKRNHCSGYGWL

SEQ ID NO: 204813 - protein, 146 aa, Glycine max
  Coding DNA Sequence Number=SeqID_88035
MVTTKELETLLESFEQTFTEAQESTKKTLDSLHKMLESLVSSLASLNGEKKILTDEDENIDTLDSGRSIVEHAQIQFLAFDGTNFWDWRGKAEQFFELEVTPIAQHGREVNLVNRRVWVDKDIASQRSFLRKLLKEATGKLLEEAS

SEQ ID NO: 204814 - protein, 207 aa, Glycine max
  Coding DNA Sequence Number=SeqID_88036
MRYNWLYAGDVGVMHEDGYLEIKDRSKVSRVEGEVGVVRAPDDGGSGGVVSICEAERRTSGVAVGEEGGGVLQGEVAALWCLKWWLKEGLVEPPLKKEVVEFLQGEVVALHGAQIGRCSMIFMVVKLEEMATIGESIGMTELYEGKVAGKHIDAVSSPEISAKSNFQIYSAVRHENDNTKIMKELGNMVSKDGEYCDLGSHWWLKLL

SEQ ID NO: 204815 - protein, 97 aa, Glycine max
  Coding DNA Sequence Number=SeqID_88037
MAELNQDDTFMPLFGHGIWIKGQTDKGFTMDTVIARLKLDHWFSHWLASCRAFRPWIFFINGVLCFLKINGSGMKKKERLLERPLQGEDESRTSSPP

SEQ ID NO: 204816 - protein, 196 aa, Glycine max
  Coding DNA Sequence Number=SeqID_88038
  Gene Ontology: Cellular component=chloroplast envelope
  Homolog annotation: Hit_ID=O80503; Match level="QueryCoverage=99%, HitCoverage=46%, E-value=5e-51, Identity=50%"; Hit description =Expressed protein
MTGQFRPRKLIADVKNEISNAEEFDLSTVKDVVKHFINKSLYSFGLTSQFAFPPSTSLLLAIEGHGEKERLRRKMMLHDHDLTLEAAWPQLFVDHKGKYWDVPESLSVDLSSLVSESGLRYHFGIHKNGGNPQAMNATDGNPPLSLLPGLCAKVAVSYEKIKYFWRDKGAAEQENEEALPYDVRLKEPHAAVSGII

SEQ ID NO: 204817 - protein, 47 aa, Glycine max
  Coding DNA Sequence Number=SeqID_88039
MTKLGLCVPLDTTVSEWQRGADNRKNDQTWSLLAIGHNCVCLAKGCG

SEQ ID NO: 204818 - protein, 155 aa, Glycine max
  Coding DNA Sequence Number=SeqID_88040
  Gene Ontology: Mol. function=RNA-directed DNA polymerase activity; Biological process=RNA-dependent DNA replication
MGGRTKGLRRRGGPPMRLYEVQFRHLNKQDNTMVISSFSKEEVKGTIWECVGSKCLGPDWFNFHFIKKCWGMIKDDIMKVMHDFYSREVPPKDFEKAYDFVRCNFLYRMLQRLGFFECWIHWIKACLETSSMSILINGSPTQELKNQRGLRRGTP

SEQ ID NO: 204819 - protein, 185 aa, Glycine max
  Coding DNA Sequence Number=SeqID_88041
  Subcellular localization annotation: CTP_CleavageSite=26; ConfidenceScore=5.03e-01
KWPRGSLPQRGPGKDKAAEGTSFRPRSTTVTALGALYTSSASKAIKGWAPAVGTTGYSYGQWIPFDADAISQLLGYPMVLEEGQECEYGQRRNRSDGFDEEAIAQLLCIPGQDFARTAAGRRVRIMRTNMTTLTQIWMTLLLSNILPTDHNSDLPMPKCQLVYAILTRMSIHVAQLIADAIYIFA

SEQ ID NO: 204820 - protein, 110 aa, Glycine max
  Coding DNA Sequence Number=SeqID_88042
  Gene Ontology: Mol. function=RNA-directed DNA polymerase activity; Biological process=RNA-dependent DNA replication
MKDFRLISLYNGINKIISKVLANRLKPILPKCISQKQSGFIENQTILDNVRLSSKVIHHMRCKNKGVSPFLKNNEVKGDIHGVKLSDNEITIIKEILDKYGEVSGQTINY

SEQ ID NO: 204821 - protein, 93 aa, Glycine max
  Coding DNA Sequence Number=SeqID_88043
MSFISLILSGHPMMRSWILTKKCSRSSILELAYKACKSTKKSGVFSFYDGANNNELGYIAKQLRNLKKKFLEKFSTPRPYIEERIHEEYHGSE

SEQ ID NO: 204822 - protein, 152 aa, Glycine max
  Coding DNA Sequence Number=SeqID_88044
  Gene Ontology: Mol. function=oxidoreductase activity, acting on single donors with incorporation of molecular oxygen, incorporation of two atoms of oxygen; Cellular component=proton-transporting two -sector ATPase ...
  Gene Ontology: Cellular component=complex; Biological process=ATP synthesis coupled proton transport
  Homolog annotation: Hit_ID=Q1S835; Match level="QueryCoverage=77%, HitCoverage=42%, E-value=2e-37, Identity=51%"; Hit description=2OG -Fe(II) oxygenase
  Pfam annotation: Domain name=2OG-FeII_Oxy; Domain location=33-95; Score=31.2; E_value=3.7e-06; Accession=PF03171.10; Description=2OG -Fe(II) oxygenase superfamily
MGNTVKLGTLLFELLSEALGLNSNYLKDMECAEGLFAVCHYYPSCPEPELTIGTAMHTDNDFFTLITSDRCKSVEHRVLANHVGPRISIASFFRPRGKAALKVYEPIKELLSEDNPPKYRETTFADYEAYYVAKGRLDGTSAHITRFWKKKD

SEQ ID NO: 204823 - protein, 71 aa, Glycine max
  Coding DNA Sequence Number=SeqID_88045
  Gene Ontology: Mol. function=long-chain-fatty-acid-CoA ligase activity; Cellular component=membrane; Biological process=metabolic process
  Homolog annotation: Hit_ID=Q6FFF5; Match level="QueryCoverage=87%, HitCoverage=14%, E-value=4e-24, Identity=69%"; Hit description=Acyl -CoA synthetase
MKGYWNRPDETEKVMTKDGFFRTGDVGIMDTRGFNVYPSEIEEVIAKHPKVLEVAAIGVPDDRIPAARGIH

SEQ ID NO: 204824 - protein, 122 aa, Glycine max
  Coding DNA Sequence Number=SeqID_88046
  Gene Ontology: Mol. function=oxidoreductase activity, acting on NADH or NADPH, quinone or similar compound as acceptor; Cellular component=integral to membrane; Biological process=ATP synthesis coupled electron transport
  Homolog annotation: Hit_ID=A0A380; Match level="QueryCoverage=99%, HitCoverage=26%, E-value=1e-58, Identity=82%"; Hit description=NADH -plastoquinone oxidoreductase subunit 2
  Pfam annotation: Domain name=Oxidored_q1; Domain location=6-121; Score=-119.1; E_value=0.08; Accession=PF00361.10; Description=NADH -Ubiquinoneplastoquinone (comple
MAITEFLLFILTATLGGILCSYLLSGYTKKDVRSNEATTKYLLMGGASSSILVHGFSWLYGSSGGEIELQEIVNGLINTQMYNSPGILIALLFITVGIGFKLSPAPSHQWTPDVYEGVRFVR

SEQ ID NO: 204825 - protein, 495 aa, Glycine max
  Coding DNA Sequence Number=SeqID_88047
  Homolog annotation: Hit_ID=Q669J9; Match level="QueryCoverage=33%, HitCoverage=45%, E-value=4e-72, Identity=77%"; Hit description=N -methyl-L-tryptophan oxidase
  Pfam annotation: Domain name=GerE; Domain location=332-389; Score =46.0; E_value=1.3e-10; Accession=PF00196.10; Description=Bacterial regulatory proteins, luxR family
RFTARKAVVTAGTWVKALLPQLPVAPLRKVFSWHQADGRYSVNNRFPAFTVEAQDGTHYYGFPADNDGLKVGKHDGGQPMDAPEQRKPFGSYASDGTEVFTFLRQFLPGVGVCLHGEACSYDMSPDEDFIIDTLPECDRLMVISGLSGHGFKFASALGEIAALFAQDKAPPAVAVLVPVEPWAAKSDVLFYRRYAPSAFNKDVTMKLLVVDECCFTRVGIASYFADSGITTIKCCHSIEYATPLLASFQPSHILVNLSNQCRYNEADAQLLAFMEASQSALLFIYLDTPYPYSETPMRIADNAFLFNKSILPLTLRTLRENPLALADDGEERSLFSPQELTVMKYWMAEMPNYRIAKKLQISSHTVYVHKRHITEKINARNRLEFYSLYNVLRYFYPPNTPTNSTPLALLARSYARRAIKDAEKRTIIKGLFLLAAEMLNRILAAIVNNVREHLAAAAPRPAAAADALCPDQSFRPDLDSWPIRAPYRPAAGAGL

SEQ ID NO: 204826 - protein, 355 aa, Glycine max
  Coding DNA Sequence Number=SeqID_88048
  Gene Ontology: Cellular component=integral to membrane
  Homolog annotation: Hit_ID=Q8D0R2; Match level="QueryCoverage=67%, HitCoverage=81%, E-value=8e-63, Identity=46%"; Hit description =Putative transport protein
  Pfam annotation: Domain name=UPF0118; Domain location=2-223; Score =27.8; E_value=1.4e-05; Accession=PF01594.7; Description=Domain of unknown function DUF20
MLERRRVPRILGVTLLVTAVIVVVMLFIGMLGASLNEFARSLPQYRGMMIEKLRELQHYADRFNISLSSEAMLQYVDPSAAMNLVTRMLGHLSGAMTNVFLLLMTVVFMLFEVQLLPYKLQQALDKPNEGLAAMRRALDGVTRYLALLFNGLGDALVVAGGFIAVNMVIGNILEPRVMGRGLGLSTLVVFLSLIFWGWLLGPVGMLLSVPLTIVARIALETTEGGYRLAVILGDGRPPRQPPAAPEWNSEARSFNSSTTRRQSTWHPPKRPSATKSPPERTARASCNPSSPPMQSMAARAPKWVIFASCGASITRQAPAASSAWRWAALRTTTARRIPRSAVSCANSRLTAEPPP

SEQ ID NO: 204827 - protein, 317 aa, Glycine max
  Coding DNA Sequence Number=SeqID_88049
  Gene Ontology: Mol. function=chitin binding; Cellular component =extracellular region; Biological process=chitin metabolic process
  Homolog annotation: Hit_ID=UPI00006A17C9; Match level="QueryCoverage =98%, HitCoverage=100%, E-value=5e-40, Identity=32%"; Hit description= UPI00006A17C9 related cluster
AARPRLQRTHASPSEDYTSSPSEDCTCSPSEDYTSSPSEDYPSSPSEGYTLSPSEDYTSSPLEGCTHSPSEDCTSSPSEGYAPSPSEDYTSSPSEGYTPSPVLTFIGLHVLTFRGLHVLTFRGLHALTFRGLRVLAFRGLHALTIRGIHALAIRGLYVLAFKGQHALALRRLHILAFRGLHALAFTGLHVLAFRGMHALGFGGLHVLTFRGLHVLTFRGLHVLVFRGLHVLAFKGLHVLAFRGLHVLTFKGLHVLTFRGLHALAFRGLDVLSFRGLHALALRGQLILAFSGLHTLAFRGLLVLAFRVLHALAFGGLH

SEQ ID NO: 204828 - protein, 106 aa, Glycine max
  Coding DNA Sequence Number=SeqID_88050
  Homolog annotation: Hit_ID=Q1SQK6; Match level="QueryCoverage=78%, HitCoverage=4%, E-value=2e-20, Identity=56%"; Hit description =Helicase, C-terminal; Argonaute and Dicer protein, PAZ; Type III restriction enzyme, res ...
  Homolog annotation: Hit description=subunit; Ribonuclease III, bacterial
MAESKNSPKLIVKAPKALGDMVESIAGVMLVDTELDIENVWRIFEPLLSPIVTPVNLELPSLCKLNKLCDCLVCFIKETSTKEGEIHHVELQLQLEDFFFFGRKRD

SEQ ID NO: 204829 - protein, 77 aa, Glycine max
  Coding DNA Sequence Number=SeqID_88051
MRGGDCTVARPGYDTLHQQRQDPSPYSWPTLEQFKATIAWPGDRPNFQKGAGPTGAPGDEDGAQEDDDMADVMDFFL

SEQ ID NO: 204830 - protein, 158 aa, Glycine max
  Coding DNA Sequence Number=SeqID_88052
  Gene Ontology: Mol. function=receptor activity
  Homolog annotation: Hit_ID=UPI00005A2256; Match level="QueryCoverage =90%, HitCoverage=16%, E-value=2e-11, Identity=30%"; Hit description =PREDICTED: similar to TGF beta receptor associated protein -1
MLAPRKLEDSEAAEQYCAEIGRADAYMQLLEMYLDPQDDKDPMFTAAVRLLHNHGESLDPLQVLEKLSPDMPLQLASDTLLRMFRARVHHHRQGQIVHNLSRAVDIDARLSRLEERSRNVQINDESLCDSCDARLGTKLFAMYPDDTVVCYKFHVFGH

SEQ ID NO: 204831 - protein, 136 aa, Glycine max
  Coding DNA Sequence Number=SeqID_88053
MFLTSDKREIELSPDEVVTTIDPQKAEILQRYLQWLIEDQDCNDTQLHTLYALSLAKSAIEAFESENISENLDSGNIETRSLAMLKNSIFQIPVRESLQIFLQSSDLYDPEEVLDLIEGSELWLEKVTLRLLTVLS

SEQ ID NO: 204832 - protein, 377 aa, Glycine max
  Coding DNA Sequence Number=SeqID_88054
MVQVESNSSMSRVVLEPHAQFDLTAHSRASSIRSLSISHSKRHRTTLLYVGTHSGTLFSLSGEDSNDSDDAVLRKLSFLRSVSVSDAAVESISVIEEFRKLLLLSDGTLFLVDSELSNRATKLSFPKGVSLVTRRRLRNNGGESEGFGSGLGSGSGSGSGLGLFQKLRMNSMKEGEVQSETGGGCVFAIVVGNRLILAELVLGNRNGKSERDDGGALVVLKEIQCVDGVVSAMVWLNDSIVVGTVNGYSLISCVTGQSSVIFSLPDVSWPPRLKLLHKEWRVLLLVDNVGVIVDPHGQPVGGSLVFRHGLDSMGEIDSYVVVVSDGKIGLYHKRHGGCVQVLPFGGEGVGRCVVASEEDKGGRLVAVATATKNIAVD

SEQ ID NO: 204833 - protein, 271 aa, Glycine max
  Coding DNA Sequence Number=SeqID_88055
  Gene Ontology: Mol. function=RNA-directed DNA polymerase activity; Cellular component=intracellular; Biological process=RNA-dependent DNA replication
MAQPQGPQVKGNPLCHINENFVSADWMFDGRVAMIHDEVPREQSNWGLPPELQRMVEQEDREMKSHQEEMEIVNLGVGEEKKEVKVGTSMTMPIQDALVALLRDYQDIFTWSYQDMPIARYPKWVANIVSVPKNDGKVRMCMDYQDLNQASYNQIKMALEDMGKMTFVTLWGMFYYKVMSFGLKHARATYQRAMVAFFHDMMHKEIEVYVDDMIAKFKTEEEHLVNLQKLFERLRKYQLRLNHAKCTFGVKSGKLFDFIISQKGIELDLDK

SEQ ID NO: 204834 - protein, 171 aa, Glycine max
  Coding DNA Sequence Number=SeqID_88056
MGAALLRSAAIAAVTPTIDNIGGNLPEIELLKCEEMVPRNRYWGLHPPPAPLEDVIDDGLMTIQRASFLRKAGVETIVDNDLFLNPANRADLLESAIKNISRYLEACREKDLTESVREGVDTLLMYLYRALNSVEDMEKLASSINWCVVAPSRLSGDYFPRQIVDANSYEN

SEQ ID NO: 204835 - protein, 225 aa, Glycine max
  Coding DNA Sequence Number=SeqID_88057
  Homolog annotation: Hit_ID=Q6EP30; Match level="QueryCoverage=57%, HitCoverage=59%, E-value=2e-28, Identity=48%"; Hit description =Ferredoxin-like
MWIAQVSISSTLVISIVDMGSQQGMVNYGVGICPGIQVGNPANDIVDIINKNRTDEKLPRLNDSPGLGCMALQYVELCKGNCTENNVVNCRPPEDDFTEVFAPNCGVELPTFGTITGHIVGCQRKYIEPLLVFSEVLIKDKKSLSLLRNKSHTEVGVGLVGLHKGPFFCFVAIFDNVRNCDLCGYNCGRRQLLKAMGGRELHCGRFDRDESVTEVRWQVMIVNED

SEQ ID NO: 204836 - protein, 122 aa, Glycine max
  Coding DNA Sequence Number=SeqID_88058
MAKEADDHNLSLHANGLDCLWMAKEVDDHNLSLRAIGLDCLWMAKEEANDHNLSPHTIGLDCLWMAKEADDHNLSPNAIGLDCLWMAKEADDHNLSLHTIGLDCLWMAKEADDHNLSPCAFH

SEQ ID NO: 204837 - protein, 162 aa, Glycine max
  Coding DNA Sequence Number=SeqID_88059
  Gene Ontology: Mol. function=oxidoreductase activity; Cellular component=proton-transporting two-sector ATPase complex; Biological process=ATP synthesis coupled proton transport
  Homolog annotation: Hit_ID=Q1S835; Match level="QueryCoverage=99%, HitCoverage=51%, E-value=1e-44, Identity=48%"; Hit description=2OG -Fe(II) oxygenase
  Pfam annotation: Domain name=2OG-FeII_Oxy; Domain location=39-112; Score=69.5; E_value=1.1e-17; Accession=PF03171.10; Description=2OG -Fe(II) oxygenase superfamily
DILLKYRKHIMKLGILLLELFSEALGLSPNYLKDIGCAEGLFALCHYYPSCPEPDLTTGTTMHSDNDFFTVLLQDHIDGLQFITNDRLKSAEHRVIVNHVGPRISVACFFSPSAKASLKFCGPVKELLSEENPPKFRNTGDYEAYYFAKGLDGTSALTHYRI

SEQ ID NO: 204838 - protein, 93 aa, Glycine max
  Coding DNA Sequence Number=SeqID_88060
  Gene Ontology: Mol. function=nucleic acid binding
MAEEQPRRLIQGNLFHGLSNEDPYAHLATYIEICNTVRIVGVLEDAIRLHLFSFSLSGEANRWLHSFKGNSLRTWDEVVEKFLKKYFPKSKIA

SEQ ID NO: 204839 - protein, 74 aa, Glycine max
  Coding DNA Sequence Number=SeqID_88061
KAAFKERMKRWLVVALETKEEEEEQEGSKKGLRSTQLTKHDGERGGEHNQSATTNMGSYMMPVTALAADTGSES

SEQ ID NO: 204840 - protein, 155 aa, Glycine max
  Coding DNA Sequence Number=SeqID_88062
  Gene Ontology: Mol. function=oxidoreductase activity, acting on single donors with incorporation of molecular oxygen, incorporation of two atoms of oxygen; Cellular component=proton-transporting two -sector ATPase ...
  Gene Ontology: Cellular component=complex; Biological process=ATP synthesis coupled proton transport
  Homolog annotation: Hit_ID=Q1S835; Match level="QueryCoverage=95%, HitCoverage=40%, E-value=1e-42, Identity=52%"; Hit description=2OG -Fe(II) oxygenase
MWDQYNLKGALRPGVKDVPSLFHHQPEKFEKASNIGNTSHIIPIIDLAIINKDPSNRLGLVDIVKKTSETWGFFPVVNHDIPLSVLVEMKNGVKWFHEMDTEAKKQFYSRDRSKSFLYKSNFDLYGSQPSINWRDSFWYLYYPDAPKPEEIPVVC

SEQ ID NO: 204841 - protein, 889 aa, Glycine max
  Coding DNA Sequence Number=SeqID_88063
  Gene Ontology: Mol. function=transferase activity, transferring pentosyl groups; Cellular component=imidazoleglycerol-phosphate synthase complex; Biological process=histidine biosynthetic process
  Homolog annotation: Hit_ID=Q7VSY7; Match level="QueryCoverage=26%, HitCoverage=94%, E-value=1e-123, Identity=94%"; Hit description=1-(5- phosphoribosyl)-5-[(5- phosphoribosylamino)methylideneamino] imidazole-4-carboxamide isomerase
LAHAAAHRQGDEDLRGDLLDDGQDQVAAIAGGGDVQEGEFVGALLVVAAGDLDGIAGIGEVDEVDALDDPAGGDVKAGDDAAGQRALGGRAGLGGPAGVERAFVDAAAQDGAFDALFLDGAQGLDVLDAGDAARGEHGNAHVLRQAHGGLDVHARQHAIAADVGVDDGFAAVVLELLGQVEHVVAGQLAPAVGGDLAVAGVQADDDLAGEGAAGVLQEARVLDRGGADDDVGDASVEIAFDGVEIADAAADLDRDIVADGVQDGLDGCFVLRFAGDGAVQVDQMQAAGALVEPLRGHGGGVFGEHRCIVQVALAQTHAASVFEIDGGDQQHGRCARGLRLPVYKIAIQAQTVLGALLGVELHRENVSCRHRAGKGNAIIGFTNGQARIGRVGVITMDEIEMRVARNAVPDRVRARLAHFVPSHVRDFQPLRADIDRAGRAGVGLAGRVVGRDRVGEARAGKAPHHAGEQPQARDAQQRLGAGGLDDRFAQAGFIQGAHAVRHGALAGKHHAVGRVDFMGLVADADVRVGGGVLERARDGMEVAHSVVDDGDSGHFGLPGHDVAHARVDFDGHAQRAATGLEDRLALVVGVGAAQVVDVQGDQRVVDQALEEFACQVDVEGADVRAGEGDVVFQAGTAREIDHHARQRLVQRHVGVTVAAQPGLGADRLGDGHAQRDAHVFHRVMRIDVQVALGLDVEVDQAVARDLVQHVVQEGHARVDRLLAGAIQVDGHADAGFVGVAGDLCGTHQSGVLGRRAHRDAEAAGQERMGVGEVTNQYFALFQGKMHGVAIQLAGKAREYEVGRGREYPDAGQRRQRRGQRFAVGAQAGGLLVQHRLVAQHRQQRCLGQHVQVVGRAHLVELGDPVGVAGQIAKTQACQADLGHGAHHHH

SEQ ID NO: 204842 - protein, 45 aa, Glycine max
  Coding DNA Sequence Number=SeqID_88064
MKNERRTMKKGGKPSRNRPRKRLRSIMEAPRLRFSSWVKREVVAA

SEQ ID NO: 204843 - protein, 836 aa, Glycine max
  Coding DNA Sequence Number=SeqID_88065
  Gene Ontology: Mol. function=zinc ion binding; Cellular component =actin filament; Biological process=protein transport
  Homolog annotation: Hit_ID=Q1RYE4; Match level="QueryCoverage=100%, HitCoverage=86%, E-value=0.0, Identity=85%"; Hit description =Cytochrome cd1-nitrite reductase-like, C-terminal haem d1
  Pfam annotation: Domain name=Clathrin; Domain location=401-552; Score= -15.2; E_value=0.066; Accession=PF00637.10; Description=Region in Clathrin and VPS
MYQWRKFEFFEEKYGAKCAVPENDEDDGVVAAERKIECCSSGRGKLVTGFDDGVVCFFDRGLKFNYSFQPHSSSVLFLQQLKQRNFLVTIGEDEQLTPQQSALCLKVFDLDKMQPESSSTTSPDCVGILRIFTNQFPEAKITSFLVLEEVPPILLIAIGLDSGSIYCIKGDIARERITRSKLQVENNHLDKTLSAVTGLGFKVDGQSLQLFAVTPCSVSLFSLHDQPPRRQTLDQIGSGVNSVAMSDRSELVIGRPEAVYFYEVDGRGPCWAFEGEKKLLGWFRGYLLCVIADQRTGKHTFNIYDLKNRLIAHSALVKEVSYMLYEWGNIILVMNDKSALCIGEKDMESKLDMLFKKNLYTVAINLVQTQQADAAATAEVLRKYGDHLYSKQDYDEAMAQYIHTIGHLEPSYVIQKFLDAQRIYNLTNYLEKLHEKGLASKDHTTLLLNCYTKLKDVKKLNLFIKSDDSIGELKFDVETAIRVCRAANYHEHAMYVARKAGRHEWYLKILLEDLGSYEEALEYISSLESSQAGMTIKEYGKILIEHKPVETIQILIRLCTEDGNKRGRSNGVYMSMLPSPVDFLSIFIHHPQSLMDFLEKYTNKVKDSPAQVEIHNTLLELYISNELNFPSMSQVNDGGNYLNGASAKTMILSAQSNGNIGDHKSSEQGKDHLERREKGLRLLKSAWPQETEHPQYDVDLSIILCEMNAFKDGLLYLYEKMKLYKEVIACYMQAHDHEGLIACCKRLGDSVKGGDSSLWADVLKYFGELGEDCSKEVKEVLTYIERDDILPPMIVLQTLSRNPCLTLSVLKDYIARKLERESKMIEEDRQAIEKYQ

SEQ ID NO: 204844 - protein, 80 aa, Glycine max
  Coding DNA Sequence Number=SeqID_88066
MSFLNNILRKYSYSSTTCFHYLIVNSITLITKTIIFPTPKSQAKGTLLRRDITSGVHNIPRQSKGRARVEGIGLFPIVKG

SEQ ID NO: 204845 - protein, 178 aa, Glycine max
  Coding DNA Sequence Number=SeqID_88067
MEKAAATKPECLNESASYHKIFKMLKLRKRNLCNCNKDLGSAQQSPLLLALPKDLGPSRHYCWRFHRQLSKSENAADNGVSVATCLVQLEGAIRTGAMHGQLREKGHPLGNNFRRALVWEFVSKSTLNRENCLHVKMGGVPPMRMATCMCMCFANDDGEIYGGLASRNDDMYGHVFRN

SEQ ID NO: 204846 - protein, 87 aa, Glycine max
  Coding DNA Sequence Number=SeqID_88068
MTSGSRVEGAKTTPCMSSKALELDKEACEFVLKEKHFFKFSHLEQLEVLGKVFNKVAEDDMHIKNPNRATGGGALESTRNATIANGE

SEQ ID NO: 204847 - protein, 39 aa, Glycine max
  Coding DNA Sequence Number=SeqID_88069
LERQNTGKSKGYDFVTFKEAEAAKKAYEDSTTLIINGRR

SEQ ID NO: 204848 - protein, 80 aa, Glycine max
  Coding DNA Sequence Number=SeqID_88070
  Subcellular localization annotation: CTP_CleavageSite=31; ConfidenceScore=5.01e-01
MNINVKGEWILMHIMSCPNFVSLSSYYSITSSNYGTSHVLVLADFSPSTRTTELEKLFENFKDHGFVIRWVNDTVALAVF

SEQ ID NO: 204849 - protein, 103 aa, Glycine max
  Coding DNA Sequence Number=SeqID_88071
MARIMVSERKATCFQQELISTKEEALRKLLRLKQMFDSKSLLPYLCFQMAPMHVNHAREVPEYEINPKELDLTNSVEIMKIMAAIIAIEKAVEEHWNWLCDSK

SEQ ID NO: 204850 - protein, 71 aa, Glycine max
  Coding DNA Sequence Number=SeqID_88072
  Subcellular localization annotation: CTP_CleavageSite=40; ConfidenceScore=5.10e-01
MSALAQEHRHPTLSSRAPQPTGLPSCPPNKGHSQSTCDVQESTLMCVSFEFWLKIDIIKLTTICILLDKLH

SEQ ID NO: 204851 - protein, 520 aa, Glycine max
  Coding DNA Sequence Number=SeqID_88073
TYGLWLNLYLPKFEADTHQGGLLDIARRLRVTFVRRTRGKTCKTKDFDAQGSMELGIYMSGVELRVLVWLDVCAPVPGLTWRVNMQKRSSSVEDCLMSGAIALTSRGLSSLSSSRAWTSGIRAASVKLSGVDMLLILSARFDPATSEDTFRGAFDSESSSPERVRASHCTSGVSPINCDPPPFCFYGSEENYVGSSSSPPTVAGYEWVRDDVLKYKSALTSALSVVALQCQVKLASHEDSCKIVVQACGSDDFPFLKADHFFKVLNMDVVVDGWPLMLNKDGDPLPILLGGQGHLGVAASLVGHTSIMGDFSWRPLIKQVEPASGVVSSSVVAPIVGEESQPVVEANFVAVEIAPSAPSFVLAKRKQDDSAGPLGHKKLKAPSSLRALRQAAGMQDVPPAPSVVEALDVDVVIVVTPAPPPPPVVFVQEVAHVAAKVIAPAALASSAVEPSSTVVAYIYLGCNTENKRGYISCGSVQVEGTFTWLFKENTGGYVPCGSLLVKDFTRLKEISRTGGCLGIG

SEQ ID NO: 204852 - protein, 188 aa, Glycine max
  Coding DNA Sequence Number=SeqID_88074
  Subcellular localization annotation: CTP_CleavageSite=36; ConfidenceScore=5.65e-01
MKNLACLTALLKPFLCYSTTSFLKMSNSSPSSLLASLSLAAHNLDSFSMESDSFSQASRSATFLASSSFSAIMSFTLPAKLFFSSCKALQQLNNSSSSNLVRINLANTANFRRQLVVRPHSLNKSKNRTSYLRALHSPNSVEVKANAVEGGTIRAEEEGGSATGALVVATSTLSKGAMTCWIKWSQNN

SEQ ID NO: 204853 - protein, 98 aa, Glycine max
  Coding DNA Sequence Number=SeqID_88075
  Subcellular localization annotation: CTP_CleavageSite=70; ConfidenceScore=5.45e-01
MVTLAEQVVHLWHMASRHFTAFPISHSPSRGTLRVPIAPLSPLPSKHGSASIQMRSSFSMEWNVGQRNKRGDMEKRKRREEKEERGTDARRNECEGKE

SEQ ID NO: 204854 - protein, 87 aa, Glycine max
  Coding DNA Sequence Number=SeqID_88076
MVMGKCCLVVVGVWSRWMKGGRRWFWLEMMKRDDGGATVLFGGDQRPRRRGERRVSPFALATHLHVGSAIRTGDTASSKPAIRAGEI

SEQ ID NO: 204855 - protein, 410 aa, Glycine max
  Coding DNA Sequence Number=SeqID_88077
  Gene Ontology: Mol. function=RNA-directed DNA polymerase activity; Biological process=RNA-dependent DNA replication
  Subcellular localization annotation: CTP_CleavageSite=57; ConfidenceScore=5.15e-01
MVGLVSSLGGKGANMKKGVFQPLNGVKGGVPPQRVACLLGAIGPPSCPPNKGHFQPTCKVQKPILATSTLTMDELCKRTKGYIQMEEVFEFKNEVRQAGQNRDKHEGGTKTDSYSEASNYLHNYRKLHNKLEDINAPSQQSLPPITFMDRDFKGINPINQDDPMVVFIIITNFMVSPDTVHLHDGPLLGFAGERVETKGYMDLMTTFDQGQLSRSFTGLRALTVYQPSLDDEFDIDPCDDTFDKSPSKSSSSYSSDPNSSSPSDMPGIHPSIICHKLAIYPQAKSVSQKKRKIREERCKVVKEEVEKLLNANFIKEVRYPTWLANIIMVKKDNGKWRTCTDYTDQNKAFPKDAYPLPNVNRLVNEASGFQVMPFILKNAGAKYQRLMDQIFKQQIGHNIKLYVDDMVIKS

SEQ ID NO: 204856 - protein, 177 aa, Glycine max
  Coding DNA Sequence Number=SeqID_88078
  Homolog annotation: Hit_ID=Q3BPW6; Match level="QueryCoverage=80%, HitCoverage=33%, E-value=1e-18, Identity=39%"; Hit description =Putative membrane protein precursor
MKTWSRALLPAMFGMLAAVTAQAADYRTQYAKQWPLTLSSAQSGAYRVVLEPAIYRRAGCADLGDVQVFNAAGQSLPSALLAPDQPLAQPPVQRELPWFALPPLAEAHRNDLQLLTERDTDGRVRRVEARWTAVAGSRAAGRQLRPAALACDWPRLSAGGSAARRQAPAAAPPAGGW

SEQ ID NO: 204857 - protein, 81 aa, Glycine max
  Coding DNA Sequence Number=SeqID_88079
GFPVYCISQRNERGFEALVLTLGMDHLELPSGVGTKHEQQKPVKERMQLGMESRPTDRCPFSALSRQRTSLQGSPISFVFA

SEQ ID NO: 204858 - protein, 130 aa, Glycine max
  Coding DNA Sequence Number=SeqID_88080
  Subcellular localization annotation: CTP_CleavageSite=103; ConfidenceScore=5.16e-01
MVASHITWRGFKNSCGMVNVISLPRATKREGFSSMYSPHLSESPIPGSFPEGATQLSFVLTQGPKGPNSGSGGSASPFDCICSRSSGGMEEELRDVREADPKYCFMVTPAPTAQTRPGCSGRPMAAVRIS

SEQ ID NO: 204859 - protein, 86 aa, Glycine max
  Coding DNA Sequence Number=SeqID_88081
MDFKLYQMDVKSAFLNGFIQEEVRFGMENAKQMATPMSTACYLDKDEVGQSVHIKKYRGIDVNLTRSRSLDTGYGDLDDATFSEGR

SEQ ID NO: 204860 - protein, 65 aa, Glycine max
  Coding DNA Sequence Number=SeqID_88082
MVCPSRCHEEMHDVIKEQTRRKTLEEASLSSSESETQHDHRSTSTPYGSHRPRYSDAILPPKGIG

SEQ ID NO: 204861 - protein, 141 aa, Glycine max
  Coding DNA Sequence Number=SeqID_88083
MAGTQSSNGVGTVDAEQLGFLRNNGAPNRETTGFRRQAKNRKYPHLPSLSEAARKTALHPAPLRRDSGHSSRDLNPRRYTRVRRGWLPLRRYIGRYDHYRQLCFLAYIWLIDGEAVCGVGREGEREVDETVLLCTGVLELA

SEQ ID NO: 204862 - protein, 141 aa, Glycine max
  Coding DNA Sequence Number=SeqID_88084
MARFCSVVLSRFLSSKINPSSLLQIPVILPNPQSPNRKSIIQRYLSIEDESECRQKRDMKRKRTHPSLARNSAMPDHQINGGIRESLGHKNIYQTTKSIKANILRRKSFRWKTCGDVVGQLHKAQRRVQLSGEILLYPRDH

SEQ ID NO: 204863 - protein, 82 aa, Glycine max
  Coding DNA Sequence Number=SeqID_88085
MAHQNPPYLAFCTPGQNETKNKIHEYQRETNENIHIFLNEHQGMKLISSRMKSDKASQDIHSISQVSRLLFTLKAPMKTNTT

SEQ ID NO: 204864 - protein, 113 aa, Glycine max
  Coding DNA Sequence Number=SeqID_88086
MGTSKLKVSSRIIVRLAIRDTSQGGQGQAVRPAGGILCTESFDEGVKAIYGPRWESTTPGQEGIQMLVWIYCPNVPLEERLKSSIVLIVRRGMVLLGCTQAKYERSVRRPGDI

SEQ ID NO: 204865 - protein, 472 aa, Glycine max
  Coding DNA Sequence Number=SeqID_88087
  Gene Ontology: Mol. function=transferase activity, transferring glycosyl groups; Cellular component=integral to membrane; Biological process=metabolic process
  Homolog annotation: Hit_ID=Q8S996; Match level="QueryCoverage=99%, HitCoverage=83%, E-value=1e-177, Identity=67%"; Hit description =Glucosyltransferase-13
  Pfam annotation: Domain name=UDPGT; Domain location=5-472; Score= -55.4; E_value=7.8e-08; Accession=PF00201.9; Description=UDP -glucoronosyl and UDP-glucosyl transferase
MEKTRYIAVIPGVGFSHLAPILQFSKQLVELHPHFHVTCIVPSLGSLPSASKAILETLPPNYINTILLPPVNPNDQLSQEDIPVLVKIHLTMSHSMPSIHKALKSLTSKATLVAMVVDSFAFEALDFAQEFNMLSYVYFPAAATTLSTLLHLPKLDEEISCEYRDFSDPIKVPGCVPFRGGDFYGPAQDRTSPVYKFLLQRVNRIRHVDGIFINSFLEMETSPIRALKDEDKGYPPVYPVGPIVQSGDDDAKGLDLECLTWLDKQQVGSVLYVSFGSGGTLSQEQITELAFGLELSNHKFLWVLRAPNNATSDAAYLGAQNDVDPLKFLPSGFLERTKEKGMVVPSWAPQIQVLSHSSVGGFLTHCGWNSILESVLKGVPFITWPLFAEQKMNAVLLSEGLKVGVRPRVSENGLVERVEIVDVIKCLMEGEEGAKMRERMNELKEDATNALKEDGSSTKALSQLPLYWKILA

SEQ ID NO: 204866 - protein, 182 aa, Glycine max
  Coding DNA Sequence Number=SeqID_88088
MTQILFLTSLPSIQQITINNTKKKPTDNNTNIEKEKECVKSLKAFEQSGTTLNTDKSEARDPRHINPSKAARKTREEIGSKGLPAQGRKRTRHFAAMETLAGTARRRRRRVVHLACWAVSRVSTWWAASNHACPIVQPCPVTAEATDTMSHRSHTRMCVWCESGAGHAGDTNSKFNLETPTY

SEQ ID NO: 204867 - protein, 470 aa, Glycine max
  Coding DNA Sequence Number=SeqID_88089
  Gene Ontology: Mol. function=transferase activity, transferring glycosyl groups; Cellular component=cytoplasm; Biological process =metabolic process
  Homolog annotation: Hit_ID=Q8S996; Match level="QueryCoverage=99%, HitCoverage=83%, E-value=1e-177, Identity=64%"; Hit description =Glucosyltransferase-13
  Pfam annotation: Domain name=UDPGT; Domain location=6-470; Score= -42.6; E_value=1.8e-08; Accession=PF00201.9; Description=UDP -glucoronosyl and UDP-glucosyl transferase
MEKTTTHIVVIPSAGFSHFVPIIHFSKQLVELHPEIHVACIIPILGSLPSAAKPILQTLPQNINTIFLPPVNPNELPQGIPVVLQILLAMAHSMPSIHHTLKSITSKTPHVAMVVDTFAYEALDFAQEFNMLSYVYFPSAATTLSTHFYFRTLDEETSCEYRDLPHPIKVPGCVPFHGRDLYAQAQDRTSELYKISLKRYERYRFVDGIFINSFLELETGPITALQDEEREYPPLYPVGPLVQTGTASSANGLDLECLAWLDKQQVASVLYVSFGSGGTLSQEQITELAFGLELSNHKFLWAVRAPSNVANATYIGEQKHVDPLEFMPCGFLERTKEKGMVFPSWAPQIQILSHSSVGGFLTHCGWNSILESVLKGVPFITWPLFAEQKMNAILLCECLKVGVRPRVGENGLVERAEIVTVIKCLMEEEEGKKMRERMNELKEAATNGLKQDGASTKNFSRVAFKWKNLA

SEQ ID NO: 204868 - protein, 471 aa, Glycine max
  Coding DNA Sequence Number=SeqID_88090
  Gene Ontology: Mol. function=nucleic acid binding; Cellular component= beta-galactosidase complex; Biological process=DNA integration
  Homolog annotation: Hit_ID=Q1S1G2; Match level="QueryCoverage=98%, HitCoverage=40%, E-value=1e-100, Identity=46%"; Hit description =Integrase, catalytic region; Zinc finger, CCHC-type; Peptidase aspartic, catalytic
  Pfam annotation: Domain name=rve; Domain location=165-325; Score =133.8; E_value=4.7e-37; Accession=PF00665.16; Description=Integrase core domain
MLNPPTIVRLPNGHHVTATHSGDICISDSIILSAVLYVPSFSFNLISISKLVYTNSCKLIFSSNSCLMQDEITQAKIGTVEVRNGLYYLTPNYTAISNIETNIVHPYCTITPIDLWHFRMGHLSSERLRNMQSTYPFLKLDKNFVCNTCHYAKHKRLPFPTSNSHASNSFELLHIDIWGPCSKVSMLGHRYFLTIVDDYSRFTWIFLIHVKAETREHIKAFIALVETQFDNKVKKIRTDNGLEFLMSDFCSLKGIIHQTTCVEMLGKNGIVERKHQHLLNVTRALLFQANLPNNFWCFALSHAAYLINCILTPFLKNASPYEKLFGSPCDISNLKVFGCLCYISTLSAHRQKLDPRAHPCIFLGFKPNTKASVSHPLGYSASVCHPFNFVLSYSRLSSSHRHFVLSISTSTEPKTYAEASQHGCWLKAMQAESQALQTNNTWTLTDLPANKKAIGCRWVYKIKYHADGSVE

SEQ ID NO: 204869 - protein, 207 aa, Glycine max
  Coding DNA Sequence Number=SeqID_88091
  Gene Ontology: Mol. function=nucleic acid binding; Biological process= DNA integration
  Homolog annotation: Hit_ID=Q1T2A4; Match level="QueryCoverage=41%, HitCoverage=23%, E-value=4e-17, Identity=51%"; Hit description=Zinc finger, CCHC-type
  Pfam annotation: Domain name=zf-CCHC; Domain location=136-153; Score =14.7; E_value=0.0036; Accession=PF00098.13; Description=Zinc knuckle
  Pfam annotation: Domain name=zf-CCHC; Domain location=98-115; Score =15.7; E_value=0.0025; Accession=PF00098.13; Description=Zinc knuckle
  Pfam module annotation: Pfam domain module=zf-CCHC::zf-CCHC; Domain location=136-153::98-115
MSERDSQTPGVDSFLYLHPSENPAVSLVSPVLDSSNNHSWSISMMTALSAKNKLEFIDGGALEPLKADRTYGGWRRCNNMVVSWIIHSVSMTIRQMKLACNYCGKTGHTENVCYKKHGVPSNNSERNKSSSHRSGKVCTYCGKMGHTIDVCYKKHGFPPGYRFSNPRSSANSLVAGDNAVTNDQTQLLESKEIRFSPEQYKALLALI

SEQ ID NO: 204870 - protein, 532 aa, Glycine max
  Coding DNA Sequence Number=SeqID_88092
  Gene Ontology: Mol. function=transporter activity; Cellular component= membrane; Biological process=transport
  Homolog annotation: Hit_ID=Q9FGR5; Match level="QueryCoverage=91%, HitCoverage=82%, E-value=1e-142, Identity=55%"; Hit description =Transmembrane transport protein-like
  Pfam annotation: Domain name=Sulfate_transp; Domain location=152-491; Score=-148.5; E_value=0.034; Accession=PF00916.10; Description =Sulfate transporter family
  Pfam annotation: Domain name=Xan_ur_permease; Domain location=41-478; Score=-12.3; E_value=1.2e-07; Accession=PF00860.11; Description =Permease family
  Pfam module annotation: Pfam domain module=Sulfate_transp::Xan_ur _permease; Domain location=152-491::41-478
  Subcellular localization annotation: CTP_CleavageSite=57; ConfidenceScore=5.16e-01
LVLPRSSLWPTSLPSTPPSSLIRAGHAASPIASLYAPTPKRQLSECPTHLLTRPGLSCKYPPVNPGYAACVERTRRDLIVATVASSLIGSGIMGLFANLPLALAPGMGANAYFAYSVVGFHGSGPVPYRTALTAIFLEGLIFLIISAVGFRAKLAKLVPKPVRVSSAAGIGLFLAFIGLQSNEGIGLIGFSPSTLITLGGCPRNKLTALAPVITINGTVSLIPGATVSDKILCSGNRMESPTLWLGLVGFLIIAYCLMKNIKGAMIYGIVFVTVISWFRNTPVTVFPNTQLGDAGYDYFKKVVDVHVIKTTAGALSFDSMWKGAFWEALFTFLYVDILDTTGTLYSMARFAGFVDDNGDFEGQNFAFMADASSTVVGSLLGTSPVTAFIDSSTGIREGGRTGLTAVTVAGYFLMAFFFTPLLASIPAWAVGPPLIMVGVMMVRCVVEIDWEDMREAIPAFVTIVLMPLTYSIAYGLIGGIGTYLVLHAWEWGEEVVRNFFTNNNFKDNNNISNVNANSRVVDDHEQGDDNKV

SEQ ID NO: 204871 - protein, 109 aa, Glycine max
  Coding DNA Sequence Number=SeqID_88093
MALLVGLGSSFFKHVGYVIDGVVAIGAIFLEAFVVRKGGGLLVVVSLWRVIRVVESVFELSDEAIEAQIAGIVCQFEALKEENMRLVGVIYEKDKMIEMLKEDLDKCRE

SEQ ID NO: 204872 - protein, 256 aa, Glycine max
  Coding DNA Sequence Number=SeqID_88094
MSPNLLLRSAKGPKISTKKQCMETGIRRQGRTHRRRTGGCVDQRAEQATRLEDLNASDIIDVKATECDDLVANIDRDAEDAGVVEGGDTEREVIMEEEGEEEDLGGPKAHGLDHRVRFSTRRWGPEQTIATTVASLFFYDNPFQRKPTPFFESTNHTQNPNDGDHPMNIDFGKEKKWKRNKDKTNKTPTPTINTLVFVTEAIEKSEKKRKRDSDEGKNLNVDTKAIGKRKRKRDEVEKDWEEECFSELKSVLEDEG

SEQ ID NO: 204873 - protein, 240 aa, Glycine max
  Coding DNA Sequence Number=SeqID_88095
  Homolog annotation: Hit_ID=Q1SXD2; Match level="QueryCoverage=49%, HitCoverage=30%, E-value=3e-38, Identity=69%"; Hit description =Protein kinase-like
MKVRLVLDAAPLAVFPVIDDLEIELSSGTYLKQSQVRIMGVTADSQNQGRTTIDIHLVSHGKKFDNTTAVLLSKRFWHNEVPLNRSLFGDYYLGSCFISPNDILVYSCHMLLPETKAVGIRFFSHQYILTGGYTYCPEAILWWAFACSSEYFWELEQNQRSWEGYVNWRNKSAPRDCHGGMLAASFALVVEILESLAFLANACNLSQRSKECPLCWQSLALKDPASQELLAAVEDEKCMR

SEQ ID NO: 204874 - protein, 185 aa, Glycine max
  Coding DNA Sequence Number=SeqID_88096
  Gene Ontology: Mol. function=protein serine/threonine kinase activity; Cellular component=nucleus; Biological process=protein amino acid phosphorylation
  Homolog annotation: Hit_ID=O22932; Match level="QueryCoverage=92%, HitCoverage=39%, E-value=3e-23, Identity=40%"; Hit description=CBL -interacting serine/threonine-protein kinase 11
  Pfam annotation: Domain name=NAF; Domain location=59-119; Score=70.0; E_value=7.5e-18; Accession=PF03822.5; Description=NAF domain
MSYDLRFLLSRLLDTNPSTRITVDEIYKNTWFNAGGGEYRFNRVSVTESECEKQLGRTGFESLNAFDLISFSTGLDMSGLFEDPNGSDSAERIVSSVAPEEIMERVEAVAEEGRVVVRREKNGGGAKLEGQDGNLIGIVVVYRLTDELVVVEMKRGEKGGKCGVQFWKDKLCPLLLELTSDLEEP

SEQ ID NO: 204875 - protein, 72 aa, Glycine max
  Coding DNA Sequence Number=SeqID_88097
  Subcellular localization annotation: CTP_CleavageSite=29; ConfidenceScore=5.11e-01
MRKPRWQSLIRKFQLAGKGSRRSKRSCVRATRVQEEARGPACARLGLEKGRFSAKGEKLGRARVAAVFSLFS

SEQ ID NO: 204876 - protein, 87 aa, Glycine max
  Coding DNA Sequence Number=SeqID_88098
MGEDNNSNGQSHTNSLDRDKLLTGIDLEPPDFSFHQSDHHHHHTYTMSYNHHHSNNNDFPTTSTMGSSSLSYDEDASFDERHGKMLK

SEQ ID NO: 204877 - protein, 149 aa, Glycine max
  Coding DNA Sequence Number=SeqID_88099
  Gene Ontology: Mol. function=transcription regulator activity; Cellular component=nucleus; Biological process=regulation of transcription
  Homolog annotation: Hit_ID=Q1SYF1; Match level="QueryCoverage=93%, HitCoverage=42%, E-value=2e-23, Identity=42%"; Hit description=Basic helix-loop-helix dimerisation region bHLH
MSMKKLGSMKNEDISQSYIKYVQTDKAYILQEAITYMKQLQERVKVLENENKRKTTYSKIFIKKSQVCSREEATSSCETNSNYRSTPPPLPQVEARMLEKEVLIGIHCQKQKDIVLKIMALLQNLHLSLASSSVLPFGTSTVKVTIIAQ

SEQ ID NO: 204878 - protein, 71 aa, Glycine max
  Coding DNA Sequence Number=SeqID_88100
MNAKRIEDMIGVLPKRKILMWHGESQGNQNTMVSTITPDHNMLSTTQGMIQALHVGEHIRSVMGSDSCSPD

SEQ ID NO: 204879 - protein, 445 aa, Glycine max
  Coding DNA Sequence Number=SeqID_88101
  Gene Ontology: Mol. function=binding
  Homolog annotation: Hit_ID=UPI000065F51C; Match level="QueryCoverage =78%, HitCoverage=95%, E-value=6e-21, Identity=23%"; Hit description =Homolog of Homo sapiens "Ataxin-10
MGGGTAFLEHPISDDILQLLFEVSNSSNLEKSLEILIQNAKSDSGRLELASKKILPAVLNIVHSLTHASHHHQRNHILSLSFKLLRNLCAGEAANQDSFLELNGVAVVCSVLRSEAASSGPDHGLVRWGLQVLANVSLAGKQHQCAVWEELCLDGFVSLARLGTKETCDPLCMVIYTCCDGNPEWFKRLSSEDGRLVMAEIVRTASSAFLLRILSEILNERLKDVTVSKDVALFVFGIFKKSIGVLEHATRGKSGLPSGFVGVDVLGYSLTILRDVCAQDGVRGNTEDSNDVVDVLLSYGLIVLLLCLLGALEPPAIIRKGLKRCEKEDGASCSIKPCPYKGFRRDIVALIGNCVYRRKHAQDEIRHRNGILLLLQQCVTDEDNPFLREWGIWSVRNMLEGNNENQKVVAELEIQGSADVPEITSLGLRVEVDQRTRRAKLVNIP

SEQ ID NO: 204880 - protein, 82 aa, Glycine max
  Coding DNA Sequence Number=SeqID_88102
MGEFGELRLTAIIFQYFCCKGLVYETRGHCKVRLGCSLYSSFRQLSGSHSKVLCVVDRSGTRRVPMGLHSVDNGDVKHYVSL

SEQ ID NO: 204881 - protein, 131 aa, Glycine max
  Coding DNA Sequence Number=SeqID_88103
MKYLIATNCPGPFLLSYSPNLKTPKAEPHRFIAFSILNPSCQGQISNKDENKTYFRSRDENLQKEDLRFSASTEDLRYWEAMENTVLVNCDGGSSIELTTIENCSNAVEDVLNFFNFRLEFKVFLEEDEDG

SEQ ID NO: 204882 - protein, 435 aa, Glycine max
  Coding DNA Sequence Number=SeqID_88104
  Gene Ontology: Mol. function=hydrolase activity, hydrolyzing O -glycosyl compounds; Cellular component=anchored to membrane; Biological process=carbohydrate metabolic process
  Homolog annotation: Hit_ID=Q8L837; Match level="QueryCoverage=80%, HitCoverage=88%, E-value=1e-135, Identity=66%"; Hit description=Beta- 1,3-glucanase-like protein
  Pfam annotation: Domain name=Glyco_hydro_17; Domain location=32-350; Score=347.2; E_value=2.6e-101; Accession=PF00332.9; Description =Glycosyl hydrolases family 17
MATFIRRMAISYILLTLFFSADIGFFGRVASFGINYGQVANNLPPPDKVLELLTNLKVTRTRIYDTNPQILTAFANSNIEVIVTVENNMLGQLNDPQQALQWVSGHIKPYLPDTKITGIQVGNELFTNGDTTLIQYLVPAVVNIHNALVQLGLDSNIHVSTPSSLEVLQESYPPSAGSFKSEISGIMSQFLNFLATTKAPFWINAYPYFAYKDDPNRIPLDYVLFNPNEGMVDSNTNLHYDNMLYAQVDAVSFAIAKLGFSGIEVRVSETGWPSKGDPNEVGATVQNAQTYNRNLLRRQMANEGTPLSPRMRLEAYFFALFNEDMKTGATSERNYGFFQPDATMAYNVGLAAFADSSTSSTSISLTSSATKTKKSGPTHFLNDGGNNKICNTAKRQGNSIGKSTFSEWLHFHSLTLPLVTFQHQACGGDVRLSLF

SEQ ID NO: 204883 - protein, 100 aa, Glycine max
  Coding DNA Sequence Number=SeqID_88105
MGGCGRPRRRRRGGGQWRPFSGAFSMAKGGNGVVGGAKGGNGVSSDGDRLHLRRLGVTELELEWRCGRGRSVAAMLKALLHGHSYSAHGKGCVATVKSIQ

SEQ ID NO: 204884 - protein, 72 aa, Glycine max
  Coding DNA Sequence Number=SeqID_88106
MVVILPKENVVIWLCSLHNRPDNYLKGIINSALKELDDTPQSKSKAAARWIVVKYFNDARPLEPERLKALRI

SEQ ID NO: 204885 - protein, 277 aa, Glycine max
  Coding DNA Sequence Number=SeqID_88107
  Subcellular localization annotation: CTP_CleavageSite=56; ConfidenceScore=5.62e-01
MATPPNSSSPPPLPPTDATSHSLSNLKRTRKATCLRSLVTTPVGAERPLVHVDPASGKADGPHRKKLRTYLGIVARDKVDVTYENWKQVHAAQKDLIWEDIQFKSDLTSKWTLAADKDSVDDTDVRKKAQAIQRQNTTSHVLSRGGYEYLKNKFMDEKRKRKMEEATQSRSIDIVIDSLSPIRRHVKWKMARTKKTGQMTSETAKKIAKKIDSLEEQASQGSFVVHGRQDVLTATIRQLEHPGSVHATGAGVTIKQYFGATPRTSRTSSSMAPEDLE

SEQ ID NO: 204886 - protein, 224 aa, Glycine max
  Coding DNA Sequence Number=SeqID_88108
  Homolog annotation: Hit_ID=Q2QN32; Match level="QueryCoverage=74%, HitCoverage=30%, E-value=1e-19, Identity=36%"; Hit description =Lipase, putative, expressed
  Subcellular localization annotation: CTP_CleavageSite=50; ConfidenceScore=5.24e-01
MTSAYNRLSESKILGHSPLPLPPILPARRSHPLLRRASSSAPPCCFFIVRSGSLKPAEALLPLKEGPDGTDGGNHDSTCGDGRWGQWMKGPLVRAFSISSSSSLSSCKNKKSDLRLLLGVLGAPLAPVHVCTTDPFPYLSIKDIPVGVRKMLRTTNDSVLGDYEFSCAFALVLGFQETFSAQYILEKYIAASGGQRLQNSINNAYAMGKVRMIASEFETANKVL

SEQ ID NO: 204887 - protein, 87 aa, Glycine max
  Coding DNA Sequence Number=SeqID_88109
  Gene Ontology: Mol. function=protein serine/threonine kinase activity; Cellular component=membrane; Biological process=protein amino acid phosphorylation
  Homolog annotation: Hit_ID=Q1S6S4; Match level="QueryCoverage=84%, HitCoverage=7%, E-value=5e-24, Identity=71%"; Hit description =Protein kinase; Adipokinetic hormone
MVVTTNNFSDYAQIEQARYGRFFKGFLPDGTVAAIKRAQEGSLQGEREFLTEIQLLSRLHHRNLVSLVGSCDEKGEQLAPHLQAYPR

SEQ ID NO: 204888 - protein, 183 aa, Glycine max
  Coding DNA Sequence Number=SeqID_88110
  Homolog annotation: Hit_ID=Q1T0R3; Match level="QueryCoverage=58%, HitCoverage=52%, E-value=2e-07, Identity=31%"; Hit description =Hypothetical mitochondrial protein atmg00310
MEGDVSFENQCVLKAIKINFHKRKVLCVTLACFPSNSWVYPRRVATCGPVIENFQTRLVVWKGFEKGDTKTNKHPERRFLWGGKSADQKISWVNWDQVCLPKSEGGLWVKNIIVVTGAYGEECYMVEPNIFPQLKIWVPPLPIHYGGGIFLNLNHRDMCPAPWLSYNIVRKLRTGSSIKFWKE

SEQ ID NO: 204889 - protein, 175 aa, Glycine max
  Coding DNA Sequence Number=SeqID_88111
  Gene Ontology: Mol. function=DNA binding; Cellular component =mitochondrion; Biological process=DNA integration
MESMKISKVWTLVEASKDIKLNGCKWVYKKKIEEDGKVETYKACLVSKGYHQKEGCVFTLNGGTVSWKYFKQATVADSVTEAKYIMVSEADKDIVWMKKFIYELGVVPSIGGLVPLLCNNTGTITQAKEPKSHQKSKHFLQRYHSIREIIGHGDVKIEKVVGRRMQQIHSPRHLA

SEQ ID NO: 204890 - protein, 118 aa, Glycine max
  Coding DNA Sequence Number=SeqID_88112
MYKDNWTQPWPMGSEIYPKVHENPRAFFSSSSLILLEPLAHGSSDWSLPREDCITHQWAKRASTAKRRFSMLSVTKESSRASSSRSRAKRDINALSAAVIFSQAQCTTDAKLKSTYSR

SEQ ID NO: 204891 - protein, 119 aa, Glycine max
  Coding DNA Sequence Number=SeqID_88113
  Gene Ontology: Mol. function=RNA-directed DNA polymerase activity; Biological process=RNA-dependent DNA replication
  Homolog annotation: Hit_ID=Q1RTD3; Match level="QueryCoverage=53%, HitCoverage=9%, E-value=5e-12, Identity=51%"; Hit description=IMP dehydrogenase/GMP reductase
MQEMNGKCKRKELMMMGMEKGNVRERCVQQFHQNAYLPKVMASSFIALIPKKINPQELSKYRPISMIGSLHKILSKLLARRMKMVLWSLRLRGACPSPLLNSGEGIFGAFQECNADRAL

SEQ ID NO: 204892 - protein, 91 aa, Glycine max
  Coding DNA Sequence Number=SeqID_88114
MLNLFPQPLMPFYSKNEGGGCRPAHPGKLGSLTPYILFKIKWWQRSQCFTSKLSVHGSLGTQCDLRHRSLFEVSMIYNNVYRQPQGATLPF

SEQ ID NO: 204893 - protein, 390 aa, Glycine max
  Coding DNA Sequence Number=SeqID_88115
  Gene Ontology: Mol. function=zinc ion binding; Biological process =defense response to fungus
  Homolog annotation: Hit_ID=Q9FJ71; Match level="QueryCoverage=91%, HitCoverage=19%, E-value=6e-32, Identity=37%"; Hit description =Arabidopsis thaliana genomic DNA, chromosome 5, P1 clone:MTE17
MASSDEEGEIIPDLVDSYWFENEKEEFVSLSSLTLLWSISETVCGLKAQVFLRGTTDDDGLQTIHKQIIGWRFELPSGKPEISVLSKDKSWITLQRPRKCFESTIKAILVTVYCLHFVKWNPEESQICIWVKMLKAFSSFDIVPSENDLLSNVTLIREAVERDKDLTKSKNVLPTKKSKFIVDSEDEENDQSDVLTTKKSKFIVDFEDGENDQSDVLPTKKSKFIVDSKDEENDQSDVHPTKKSKFIVDSEDEENDQSDVLPTKKSKFIGDFEDEKNGQSDVFPTKESKFIVDSEDEENDQSDGELDPDGEQNIGYDTVCAICDNGGEILPCEGRCLRSFHATKEAGIDAVCESLGYTSAQVKVSTVFPVFCYYVWTIWEKKGKKTVGWK

SEQ ID NO: 204894 - protein, 715 aa, Glycine max
  Coding DNA Sequence Number=SeqID_88116
MEESQHGTSLFPMLEKWNSTMRPGHRLVWAQCWGVPLEKWDIANIRKIVATVRDLIEVDDDVDERRRLDRARILIRTPRKPLVHHTVAVHIGGEVHNVHIVEEGCTAVGMRSTLCRSTTNSSEQIDSDGSDIGTLFAAPETTPDFQTQTSSLDGMQNDVAENHQISLLPGGHQATENSLGIAQSSQTHPPSTDKRTQTDTGKGKQQNSVVQTTVNTMPYIGEDRTCEAAKKKGLGSRVMSSVTEERTGYTGKEIVVVPTQGQRDIDHQITNGPIMFSKMTCISNPRDNGPVSELGLTTHTTSFTSHNPYVSPPHLETLSVHPSTSTAACDKLITEAGSKTDVSLTKHNTVTNPEHNKASSSYQTEENGSELKVYARSRGRRQKTAHQSGKQHTLGDITPLTHLEPISGTATPTAATKHNIVTNPKLNKASSSYQTAEIGSELEVYDRSGGCREKEAHLSGNQYNVGDITPLTHLESISGMATPIATTKGSNRGQYEEAASLWELAKIWGQPHLTMNIVSYNIRGLGRGVKWAAIRRMIRKHKDYFAFGMNEPSKWNEGQNKWELWDSLKQLRQQNTQGLWCFLGDFNSIRHHSERVGVSQRGAEASNIIDFNEWIADLNFVETPNVGRSFTWFKPNGVAKSKLDRILVSQEWLHKWPDSTSFTLDRNFSGHCPILLRAKIIDWGPKPFRVFDCWLKDKSFEQIVKECWSNTQPTG

SEQ ID NO: 204895 - protein, 174 aa, Glycine max
  Coding DNA Sequence Number=SeqID_88117
  Gene Ontology: Mol. function=zinc ion binding; Biological process =defense response to fungus
  Homolog annotation: Hit_ID=Q9FJ71; Match level="QueryCoverage=63%, HitCoverage=10%, E-value=1e-35, Identity=52%"; Hit description =Arabidopsis thaliana genomic DNA, chromosome 5, P1 clone:MTE17
  Pfam annotation: Domain name=Eco57I; Domain location=1-78; Score= -23.8; E_value=0.045; Accession=PF07669.2; Description=Eco57I restriction endonuclease
MKIIGLNPPFGVKGSLANKFINKALTFKPKLLILIVPKVTKRLDRKKEGYDLIWEDDEMLSGKSFYLPGSVDTRDKQLEDWNLKPPPLYLWSRPDWTTKHREIAQKHCHIKEEYDVHVNGKEVKNYLMEENHECYQNCRGLHVPGNVLSIFDGIPNDNGANAPEEGATSNASVW

SEQ ID NO: 204896 - protein, 279 aa, Glycine max
  Coding DNA Sequence Number=SeqID_88118
MDPQELTSKLCILGHRFVLNAEGAPWKLLRKDLTTLAQTWSMLSYSNLAPTSHTSDLNMDRASFPALIFALYVAQGVVSDSLTFESLSRAINLAYIKKNCWNLDDPMIEFPRTRKAQSRGSQGPSSAAPSAPASSAPAPSPTPAPSTSAPPLPPAHSHSPAPSASSSSCQCRCSKVTIPMLQSIHRGLCLVMQSMHDSAQHRPFISMDEFMAQMAWPGVQPSPLRGGEASTAQEPQPELEVAHEATPEATPQVSHAISPVVEVSEGEEGADDIDYAVDL

SEQ ID NO: 204897 - protein, 44 aa, Glycine max
  Coding DNA Sequence Number=SeqID_88119
MWNFNFRKGGHVELHPQVRGAVVVTHHATEVLAGAEGLGHALRR

SEQ ID NO: 204898 - protein, 55 aa, Glycine max
  Coding DNA Sequence Number=SeqID_88120
MEVELEPRVKALPFKVKAMSRESPSQKALHVLDTDLRTHWSTATNTKEWILLELD

SEQ ID NO: 204899 - protein, 135 aa, Glycine max
  Coding DNA Sequence Number=SeqID_88121
  Pfam annotation: Domain name=Transposase_23; Domain location=77-135; Score=-17.5; E_value=0.093; Accession=PF03017.5; Description =TNP1ENSPM transposase
MKKIQGLQAPHGAISAAEDLKQLTQKIRGQLEDSITQKSQMQLQGLALPPEVEVGPSATRVSTKERCVNPSGQDPEMGDSDKCDLDVDDNPPRLVVVGRVYEGSTTVHNIPLGNNQVKVGVKQVRDADACVPVPT

SEQ ID NO: 204900 - protein, 46 aa, Glycine max
  Coding DNA Sequence Number=SeqID_88122
MDTSEPYTGAMRGIMPEPQVPCYKVMMKDNDWYLKALHWGNEGHRA

SEQ ID NO: 204901 - protein, 56 aa, Glycine max
  Coding DNA Sequence Number=SeqID_88123
MKIKDMRARKIISSYLHSGAQCPMCAVKNVIWTSRLPVTKDETNIQCMRDDMMHDI

SEQ ID NO: 204902 - protein, 116 aa, Glycine max
  Coding DNA Sequence Number=SeqID_88124
  Subcellular localization annotation: CTP_CleavageSite=58; ConfidenceScore=5.70e-01
MAKPRRGRRSPSGSISGSSSRSSSPPTLVPPLARAPFLGPVLTRAPNPLPLHPPLPPEAAAFPCRGAEGTANLFDQSAEDATLEGFECGVIGRHVEIESYHACNIDCSFCVVSEDD

SEQ ID NO: 204903 - protein, 618 aa, Glycine max
  Coding DNA Sequence Number=SeqID_88125
  Homolog annotation: Hit_ID=Q6K675; Match level="QueryCoverage=82%, HitCoverage=89%, E-value=7e-39, Identity=37%"; Hit description =Putative streptococcal hemagglutinin
  Pfam annotation: Domain name=DUF566; Domain location=229-618; Score =315.4; E_value=1e-91; Accession=PF04484.3; Description=Family of unknown function (DUF566)
MDVCESGKNKAPETPRVRPPSVLAEKNNAEKTTRRSRTREISSRYKSPTPASPSAPRRCPSPNLTRTTPASSSHLFPKRSLSTERKRPSTPTSPTPQRPSTPVSVDGKLSSRRLSGTRLPDSLWPSTMRSLSVSFQSDTISIPVSKKEKPVVSASDRTLRPASNVAHKQPETPTIRKPTPERKKSPLKGKNASDQSENSKPLDSLSSRLIDQHRWPNRIGGKVSSNALNRSVDCADIRTLNTSVPGTGVSSLRRLSLSISGESSKPFQRASNDAVRLLSLVGSGRIGSEVKSVDDCLPQELRPHKSFAATPTDKAGLAFAGVRSQSLFAPGSRLPSPSRTSVLSSSSSRGVSPSRSRPSTPPSRGVSPSRIRPTNSSIQSNNSISVLSFIADFKKGKKGAAYIEDAHQLRLLYNRYLQWRFVNARAEAVLYIQNAIVEKTLYNVWITTLSLWESVIRKRINLQQLKLELKLNSVMNDQPLCICKGKAAYNIPSPYLRIAKSLWAMGYEMTYLDDWAVLERDHIDAVSKAVEDLEASTLRLPVTGGAMSDIEHLKVAICQAVDVMQAMASAICSLLSQVEGMNNLISEVAAIAVQEKTMLDECEMLLASVAAMQLYSVH

SEQ ID NO: 204904 - protein, 294 aa, Glycine max
  Coding DNA Sequence Number=SeqID_88126
  Gene Ontology: Mol. function=RNA-directed DNA polymerase activity; Biological process=RNA-dependent DNA replication
MLVATPRIFLLWKTHPWGGPFDVSPKVEVCGGRAVDHRLWGRIHSGHGYEPRMGLGRNGDGMASLVEFKENRGRASRHDPLCHISESFIIAGWRSNDESYEGTNTEDPDVDFERIANQAEDEENEDSGFPLELERMVAQEDRETTPHQEETEIVNLGVGEEKKEVKVGMGMTTPVRDELGVLLQNYQDIFPGSYQDMPGLNPDIVQHQLPLNTGCSLVKQKLRRIKPEMSLKIKEKVKKLFDVGYLAVARYPEWVAKIVLVPKKDGKARMCMDYRDLNRASPKDNFSLPHIDVL

SEQ ID NO: 204905 - protein, 364 aa, Glycine max
  Coding DNA Sequence Number=SeqID_88127
  Gene Ontology: Mol. function=helicase activity; Biological process =viral genome replication
  Homolog annotation: Hit_ID=Q9LTU4; Match level="QueryCoverage=99%, HitCoverage=25%, E-value=4e-98, Identity=50%"; Hit description =Helicase-like protein
  Pfam annotation: Domain name=DUF889; Domain location=100-352; Score =434.8; E_value=1.1e-127; Accession=PF05970.5; Description=Eukaryotic protein of unknown function (DUF889)
  Subcellular localization annotation: CTP_CleavageSite=39; ConfidenceScore=5.16e-01
SSAIRSTSGIVLTVASSGIASILLPGGRTTHSKFAIPVPATKNSTCNIHQGSDLAELFHITKLIIWDEAPMCHRYSIEALDKSLQDIMHNNNPFGGKVNVFCGDFRQILPVVPRGNRSDIVYATLNSSYIWNHCQILKLTKNMRLQSNPTDHSNLDELKQFFEWLLDIGDGKLAEPNDGYGEITIPDEFLIKDFQDPIQEIVEATYSDLLHNYNNGDFLQKRVVLASTKDVVDKINDYVLSLIPGEEKEYCSVDSVDKSDELLSPAFGVLTAEFLNSLKTSGIPNHKLIIKVGTPIILLRNLDQADGLCNGTRLIVTRLGSSVVEAEIIAGPNIGHRTYIPRMNLSPSDSPWPFKLIRRQFPFM

SEQ ID NO: 204906 - protein, 87 aa, Glycine max
  Coding DNA Sequence Number=SeqID_88128
MNCVFVHASSTHEFGAMRSDCLVQFSILYPFFRCPMNCVFVHASSTYEFGAMRSDCLGQFSILYPFSEPHEFRFRSCVLHPRVWSHA

SEQ ID NO: 204907 - protein, 225 aa, Glycine max
  Coding DNA Sequence Number=SeqID_88129
  Gene Ontology: Mol. function=hydrolase activity
  Homolog annotation: Hit_ID=UPI00006715D2; Match level="QueryCoverage =75%, HitCoverage=56%, E-value=1e-51, Identity=57%"; Hit description =Zn-dependent hydrolase
  Pfam annotation: Domain name=Lactamase_B; Domain location=36-203; Score=31.3; E_value=3.4e-06; Accession=PF00753.17; Description =Metallo-beta-lactamase superfamily
MKMKSLALLVTLAAAPAFAAPLQLDVYNPQEQGIFPVSSTLVSGPHEAILFDAQFSPKDGEKLVELIKARGKQLTHIVITSGDPDFYFGLEPLVQAFPQAKIVASPLVVEHIEATKDAKLQYWGPQMNGAAPHQLYAPQITHQTRFSVDGERIELRHAAEKSAYVWIPSSKAILGGTVVDSGIHVWTADTQTAPIWSGVYISLMFKDLITLLGTVTLHNPYNIVA

SEQ ID NO: 204908 - protein, 161 aa, Glycine max
  Coding DNA Sequence Number=SeqID_88130
  Gene Ontology: Mol. function=transcription factor activity; Biological process=regulation of transcription, DNA-dependent
  Homolog annotation: Hit_ID=UPI000066ADBD; Match level="QueryCoverage =95%, HitCoverage=52%, E-value=2e-36, Identity=51%"; Hit description =Transcriptional regulators, LysR family
  Pfam annotation: Domain name=HTH_1; Domain location=4-63; Score=65.0; E_value=2.4e-16; Accession=PF00126.17; Description=Bacterial regulatory helix-turn-helix protein, lysR family
MDRVTAARVFNRICELGSLSAAARALDISRPMVSRYLDEMEKWAGARLLHRSSRRLTITPAGEQILHKTRALARLADEIEQQGDEGKPQGTLRVACAHSTATHILGPMIPAFLARYPAVRIELEINNQPVSLVGERIDVAIRITDDPEPGAIARSWVNVPR

SEQ ID NO: 204909 - protein, 226 aa, Glycine max
  Coding DNA Sequence Number=SeqID_88131
  Homolog annotation: Hit_ID=Q1SS26; Match level="QueryCoverage=62%, HitCoverage=17%, E-value=2e-07, Identity=27%"; Hit description =Unnamed protein product; no similarity, hypothetical start
DGVPFEGTVDDEWKFDFSVFDARRMVCTNQADMTGRLLASSLAFECHIMHYLIVRILLPRSSNLAQVYEEDLIIMWVFLTGRQIDWAHLLRYHMHKTLRSNAPLPYPHLITLFLQHFNVPLDSEPFVKGKRSFSIGANVVSSFRYRKERDGSWMKKDAPVQAAEDRSPSPHSQRDDSSSLMYNILDRLDGLHTFVDEHFDSLDSRIDAMDARFARMDTCITKLEED

SEQ ID NO: 204910 - protein, 123 aa, Glycine max
  Coding DNA Sequence Number=SeqID_88132
MIVNQQVKKKTDSKALSSKAKGKEKEEKDSSKKIVKKENHFATKCDIKRALLLKQSFYLLLSRETSLSTAIPLELEVIPQVKELLDDGLVCKSLNPCAFVGAQNRYYEAPNPYDRWYDECVEW

SEQ ID NO: 204911 - protein, 110 aa, Glycine max
  Coding DNA Sequence Number=SeqID_88133
MAVQWRRKRERRRHFKEKMSLEEAQHHRTPWIRAWRKKEMNEGKGREEHEILRRQKYWQMSVREKMQAVQQFPTNRSMRLADKDSLSAHISAGNSAWQQRLVLGQSVLWA

SEQ ID NO: 204912 - protein, 67 aa, Glycine max
  Coding DNA Sequence Number=SeqID_88134
MALSVTSRFRTQRAEQGAKFSTFRAISEFFSDCEVLRGGGDNLTPFVKGVSLPWKAKTLSWGFLMSS

SEQ ID NO: 204913 - protein, 167 aa, Glycine max
  Coding DNA Sequence Number=SeqID_88135
MRVLTPLKLKDPASIEAPQASFHQYILCGTSRGYIYLGCYTENKRWYISCGSVQVEGTSTWLFKENKGEYIPCGSLACKGFYKVERNLKNRWLLGDWMRSPPLSSTVPTTALRARQRCVGQEVSCPGRAGGVQRKALMKALLEVTMDEDGDEEEEGKGVGFVKEQDQ

SEQ ID NO: 204914 - protein, 76 aa, Glycine max
  Coding DNA Sequence Number=SeqID_88136
MSSIFIFHRTQHPLSLCLHRTQHPHLYVFIGLNLLYILMTPENQELSKFQRIRSQKASRFKTRDSRIKRRLNQDKF

SEQ ID NO: 204915 - protein, 106 aa, Glycine max
  Coding DNA Sequence Number=SeqID_88137
MLLRGVYADLPRAPASWLVEIWVHGRLRRDKMVDEPRSRPITCEPVSSGPIDDPLRARTLPTRPQSGEASSVADRAQVPLEGGAREGESLRRARTPVAPRGAVGES

SEQ ID NO: 204916 - protein, 58 aa, Glycine max
  Coding DNA Sequence Number=SeqID_88138
MAILVKARRAFASSEAVPLKSWREWPRFKFSKKVECTICSSDKKGPGLIGSRSRSVFS

SEQ ID NO: 204917 - protein, 40 aa, Glycine max
  Coding DNA Sequence Number=SeqID_88139
MAQLIIPYIVEVNVDYLTKPLDVFKEMCRILKPGVLAIMR

SEQ ID NO: 204918 - protein, 88 aa, Glycine max
  Coding DNA Sequence Number=SeqID_88140
MAQILLHGTLHATVYEVDKLKIGGGNFLTKTTDVEIGYPENRCRMSDFNIGPLTVVVFQQHRVTMTRDNRCKKASITDVENLFSSSVS

SEQ ID NO: 204919 - protein, 58 aa, Glycine max
  Coding DNA Sequence Number=SeqID_88141
MKANPKELNPYLKDNGSESIFASPPLVVPYALAGTDIEQGIGVCVEATLHGECDSKVF

SEQ ID NO: 204920 - protein, 458 aa, Glycine max
  Coding DNA Sequence Number=SeqID_88142
  Homolog annotation: Hit_ID=Q9FJ58; Match level="QueryCoverage=92%, HitCoverage=80%, E-value=5e-65, Identity=37%"; Hit description =Arabidopsis thaliana genomic DNA, chromosome 5, P1 clone:MTE17
  Pfam annotation: Domain name=C2; Domain location=38-125; Score=33.0; E_value=1e-06; Accession=PF00168.20; Description=C2 domain
MDSFNQSHQTTSFRYNPNSNTVNHTDDNDDDAEFSGILDIYVHHARNIHNICIYDNQDVYAKFSLTYNPDETLSTRIINGGGKHPIFNENLKMKITQMDAVLKCEIWMFSRSRNHLEDQLLGFALVQISQVVGKGKVTEDYSLSSTDLFHCPAGTVQLTLSLDTSFSISSTVNPISQSVTNSSISSEVVLLDPKVSQDMSDPVEYSRIEFPDVSVMKENQKMVSEYFNLESYGSYASRPNYSVGLLPFLHLGASPQGDDYEMTVTAPDENHESTSPNETIRNPVFPTSTTTSLSDERNSGDSVEEKNNLRGDSSNSFNVSITVEGCQNSGGSPETPTSKKESGARDDKESKFSSSKEKEINSDRNTEATRFGQVFSASLGNINMEAEQSAMQQQIVTMYMRSMQQFTESLAKMKLPMDLDKPESEGQLGVIQNPNSSKLETDKKKDGSRVFYGSRAFF

SEQ ID NO: 204921 - protein, 92 aa, Glycine max
  Coding DNA Sequence Number=SeqID_88143
MESGIKELVVAVGGKMKDESMKMNRGDYDDVMGWLDATLFLDCFALSFTVSNFSDSLSPLRVLGLKSVMGEFTEPSYNTKNRCSNSKKPQSS

SEQ ID NO: 204922 - protein, 41 aa, Glycine max
  Coding DNA Sequence Number=SeqID_88144
MVRSRDELTAEVNQGKTMASHDWPCIVCLLLADSSRQNTNP

SEQ ID NO: 204923 - protein, 321 aa, Glycine max
  Coding DNA Sequence Number=SeqID_88145
  Gene Ontology: Mol. function=oxidoreductase activity; Cellular component=peroxisome; Biological process=electron transport
  Homolog annotation: Hit_ID=Q2SMR1; Match level="QueryCoverage=99%, HitCoverage=85%, E-value=1e-123, Identity=65%"; Hit description =NADH:flavin oxidoreductase, Old Yellow Enzyme family
  Pfam annotation: Domain name=Oxidored_FMN; Domain location=1-320; Score=276.8; E_value=4.3e-80; Accession=PF00724.10; Description =NADH:flavin oxidoreductase  NADH oxid
MAPMTRARSLQPGNIPSALMAEYYRQRASAGLIITEATQISPQGQGYSWTPGMHSPEQVSGWQLITGAVHQAGGLIFSQLWHVGRMSHASFHQDGQPVAPSALAPDAQVWVVNEKGEGQMVDCPQPRALSRKDIHSIVADYRQAALNAVQAGFDGVEVHGGNGYLIDQFLRQTSNIRTDEYGGTLANRIRFAQEVLSAIAEAIGHERTGIRLSPFITQRGMNDPQVSEAILALAAWCEQQGIAFIHLAEADWDDAPQIPEQFRQSLRETFSGTLIVAGNYDLEKAEKILAAGYADLIAFGRPFIANPDLPHRLAHRLPLAE

SEQ ID NO: 204924 - protein, 100 aa, Glycine max
  Coding DNA Sequence Number=SeqID_88146
MEKLMKNNSKAMEAKEGSAAMHSRSSCFYNGRTKIFKQRQLASHAGDPWARQTANGNGDLALTDASPLLHCHGRTSPAPSAIGTRQFDWRFPMRSAYRQF

SEQ ID NO: 204925 - protein, 83 aa, Glycine max
  Coding DNA Sequence Number=SeqID_88147
MSLRTLFLLPHQALILEISEKGYNGQIRIIKGTPETGLQIPDFHKQRNQSGGRVAQDRQRRRKEMNEKLEFIKLGRSAYKSCS

SEQ ID NO: 204926 - protein, 103 aa, Glycine max
  Coding DNA Sequence Number=SeqID_88148
MEEEISLQEKNITMKIISFVAGNRLQTYGNRLHVENSNSKSFSTAISQPCLLVIDYTSCKCLSFEAALLDSSLTSSKSCIHTFTSTRVKIEWERRDQEQASQT

SEQ ID NO: 204927 - protein, 90 aa, Glycine max
  Coding DNA Sequence Number=SeqID_88149
  Gene Ontology: Mol. function=RNA-directed DNA polymerase activity; Cellular component=chromatin; Biological process=RNA-dependent DNA replication
MRKNGLFVKSGEDVFPKEIPQGLLPLRGIEHQINLVPGIVLPNRLTYKSNPQETHEIEKQVTDLMTKGWVEKSLSPCVVPVILVPKKDES

SEQ ID NO: 204928 - protein, 111 aa, Glycine max
  Coding DNA Sequence Number=SeqID_88150
  Subcellular localization annotation: CTP_CleavageSite=47; ConfidenceScore=5.02e-01
MPSKVILMMPKNQELSKVSSKDSRIKFQVSRFKIQESSFKNQESRIKSNQDQDSRIKRRLNQDNFSVSSSLRLSKSFCSKLSRPRKVLCSKTCAIHHFIRFSLCQKEFAKD

SEQ ID NO: 204929 - protein, 215 aa, Glycine max
  Coding DNA Sequence Number=SeqID_88151
MSCLAIITLISLCQSVSWYAIVIRMSVHVPQVIADAIYLFAGMPPSRHPLDPDKSNRALGFPALITGLCQSFGVPVTPSKVIRPPITRAFIDKYCRPRQAQGDAPQAADAPPPPHQADPAGSLGMERYLQHLVRHLSQQGQGFAPFACPTPEHFGAKVAWPGDWPEAQAGEALAGSPSNAEEARMDEEMTDLLGFLGGAEPRDRGSVRPRPHDLF

SEQ ID NO: 204930 - protein, 137 aa, Glycine max
  Coding DNA Sequence Number=SeqID_88152
MATIKVVSVTHHDTERSCGLRWVNSSGDNLLMDTEGIGFEGLTSRGEGNEGVEEISLPGVGLTQVLAPMLVVSEPVPLGGFPEPWPGCELPIASHPLEPSKGMTIHVKGSNGDTLMFRGREGMVEEEEGEWLGVSGL

SEQ ID NO: 204931 - protein, 89 aa, Glycine max
  Coding DNA Sequence Number=SeqID_88153
  Subcellular localization annotation: CTP_CleavageSite=50; ConfidenceScore=5.27e-01
MSSDNDEDELLQSGNKMSTTSANPPPILESRWRTTSSHRRNPFLCQNSRRAKAESPPPPMIPKSRCSTSLAAMRIMSKIWLPPSGPKPP

SEQ ID NO: 204932 - protein, 103 aa, Glycine max
  Coding DNA Sequence Number=SeqID_88154
  Gene Ontology: Mol. function=RNA-directed DNA polymerase activity; Cellular component=chromatin; Biological process=RNA-dependent DNA replication
MGRRGNSLSPEMTKEVELCKPLRSTKFIEKFVNGWDLKMIFYHDCIQGLIIDTKSPGAIVFLTSNTGEENRLDVKEEALWEVCKCEIMHWFRSYAPDNRVGVM

SEQ ID NO: 204933 - protein, 147 aa, Glycine max
  Coding DNA Sequence Number=SeqID_88155
  Gene Ontology: Mol. function=dihydroxy-acid dehydratase activity; Cellular component=mitochondrion; Biological process=branched chain family amino acid biosynthetic process
  Homolog annotation: Hit_ID=Q9LT89; Match level="QueryCoverage=44%, HitCoverage=22%, E-value=1e-14, Identity=63%"; Hit description =Similarity to DNA binding protein PCF1
MERKEKRVRVARVPGLEVVTHATGAHGDGVADANDVEAEGNHVSSGNVVTHDLEEVGEVHASDGNAVTLSHNGFPRTKPRRRRPVAWSCRPWRDQCRRLGHKSDSETVRWLLEHAESAIVKATGTGTVPAIAVFVGGMLKIPTTSSN

SEQ ID NO: 204934 - protein, 102 aa, Glycine max
  Coding DNA Sequence Number=SeqID_88156
MAAQWYDGTIISMVRLNRPSIMVYGGTIKLNVRVLLMNQFCTRVEMTGVVFKFEKEASSEDASKEKKRLPVVEIRRHSLSISSHQVPLFLWSIHSFFVLASC

SEQ ID NO: 204935 - protein, 61 aa, Glycine max
  Coding DNA Sequence Number=SeqID_88157
  Homolog annotation: Hit_ID=Q1SA53; Match level="QueryCoverage=83%, HitCoverage=15%, E-value=4e-08, Identity=59%"; Hit description=HEAT
MANNSEIVAAREEGIEVELEVFTGEDDDGGNNLDCALGDAEVVVLEEIHTRVNKRGDLGRG

SEQ ID NO: 204936 - protein, 79 aa, Glycine max
  Coding DNA Sequence Number=SeqID_88158
MMVRWRTYSFKVDGEQREQESLDGEEDREKDKTTRRRRNIPRYGGEGEEAETCDDARVRRRRCSSATNTMLRCTQRRFR

SEQ ID NO: 204937 - protein, 271 aa, Glycine max
  Coding DNA Sequence Number=SeqID_88159
MDMNVGALISGQITSMAQCNSSRLGFPALIIALCKSKGVASGSLVFERLSLVINLAYIKKNCWNPDDMTITIREARRARTRPAEAPSTSTAPPLERTLAAPSASSPADFQHFEAMLQSIHQGQIILLQSLQMVAPPDSIPLVEQFNECVAWPGTQSSLHREDEGPIAQVPQQMEDESYETTTPKPLVIRKKADQTQEVVATSEKSLEATSEPSKPVVDTALIQQAADPSTPEDQTTPVLSPNTSPTATPVLHLIDEEDVRTQDTQDRSQDF

SEQ ID NO: 204938 - protein, 78 aa, Glycine max
  Coding DNA Sequence Number=SeqID_88160
MEAKAQKWWPRGKNLQNPWVLRFRMRERSFEWRETPPPLVFMFPGCLPAALPSCPELGMGRRSIDHGPSLYSRPSLST

SEQ ID NO: 204939 - protein, 117 aa, Glycine max
  Coding DNA Sequence Number=SeqID_88161
MGEAEEVQEKMKADMEAMKEKMATMMEAMMSVKKIMEANAVAIAATSVVAKVNLMSPSSINQMNHPTSDMVGKDLGSTDDPLENSFLQESTTSFILPCYKVVKTRRRWLPHSPTLGQ

SEQ ID NO: 204940 - protein, 110 aa, Glycine max
  Coding DNA Sequence Number=SeqID_88162
MMVSACHQTCLSLDSKKGADDHNDNHNLSLRAIGLACLWIAKEGANDHNGLCVPSDSLVSGWQRCSDDHNLSPRAIRLACLWIAKEGAVDHNGLCMPSDSLVFGWQKRLQ

SEQ ID NO: 204941 - protein, 137 aa, Glycine max
  Coding DNA Sequence Number=SeqID_88163
  Subcellular localization annotation: CTP_CleavageSite=47; ConfidenceScore=5.42e-01
MTTLAQTWSVLSFSNLIPTSHTSYVTLDRAKLIYVTFRRPRKGRGKRSEAPTTSAPPETLAPSSSTAPLPPTQTPVIPPTSTSVLPTPISIGPSDFIFTPQILHSMLQSIHRGKSIIMQSLQGLGFPSIMSMDEYEA

SEQ ID NO: 204942 - protein, 181 aa, Glycine max
  Coding DNA Sequence Number=SeqID_88164
  Gene Ontology: Mol. function=magnesium ion binding; Biological process=Mo-molybdopterin cofactor biosynthetic process
  Homolog annotation: Hit_ID=P32173; Match level="QueryCoverage=58%, HitCoverage=55%, E-value=2e-38, Identity=70%"; Hit description =Molybdopterin-guanine dinucleotide biosynthesis protein A
  Pfam annotation: Domain name=DUF1040; Domain location=94-180; Score =173.4; E_value=5.8e-49; Accession=PF06288.3; Description=Protein of unknown function (DUF1040)
MAARLAHKDHHSAFACREVLLQGRCERSVHQRNSRMVTLPVVYPNHGCCTAKPEQPLDKTGRNKGRIAGAEDKPLALRLLHNGKHTGQRSRIIFQVIRVNGIPAALPAWQKEPELNLMQFLQKLAKESGFDGELADLSDDILIYHLKMRDSAKDAVIPGIQKDYEEDFKTALLRARGVIKE

SEQ ID NO: 204943 - protein, 40 aa, Glycine max
  Coding DNA Sequence Number=SeqID_88165
MRLHCYQASQRPNMTTDRPPLLMAHIDPGIGPNISICMQR

SEQ ID NO: 204944 - protein, 153 aa, Glycine max
  Coding DNA Sequence Number=SeqID_88166
  Gene Ontology: Mol. function=chitin binding; Cellular component =extracellular region; Biological process=chitin metabolic process
  Homolog annotation: Hit_ID=UPI000044A8F0; Match level="QueryCoverage =98%, HitCoverage=99%, E-value=2e-20, Identity=30%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
GCRPLAFRGPHVLAFRGLHVLTFNGLHAFAISGLHAITFRGLYALTFRGRHVLTFRGLYALALRGLHVLHFRGLHLLPFRGLCVLAIRGLQVLAFTGLHVLTFRGLHAFPFRGPHVLAFRGLHVLAFNGLHALAFRGLHALTFRGLYALAFRG

SEQ ID NO: 204945 - protein, 125 aa, Glycine max
  Coding DNA Sequence Number=SeqID_88167
  Gene Ontology: Mol. function=chitin binding; Cellular component =extracellular region; Biological process=chitin metabolic process
  Homolog annotation: Hit_ID=UPI00006A17C9; Match level="QueryCoverage =92%, HitCoverage=100%, E-value=6e-18, Identity=33%"; Hit description= UPI00006A17C9 related cluster
MSSTSEDYSSSPSEDYESSPFEDYKSSPSEGYMSSHSEDYTSSTSEGYTSSPSEDYTSSPSEGYTPSPSENYTSSSPEGYTSSPSEDYTPLPLEGYTLSPLEDYTSSPSEDYMSSPLEDYTSLPS

SEQ ID NO: 204946 - protein, 260 aa, Glycine max
  Coding DNA Sequence Number=SeqID_88168
  Gene Ontology: Mol. function=two-component response regulator activity; Cellular component=membrane; Biological process=two -component signal transduction system (phosphorelay)
  Homolog annotation: Hit_ID=P0AFJ5; Match level="QueryCoverage=72%, HitCoverage=82%, E-value=3e-95, Identity=89%"; Hit description =Phosphate regulon transcriptional regulatory protein phoB
  Pfam annotation: Domain name=Response_reg; Domain location=3-117; Score=133.4; E_value=6.2e-37; Accession=PF00072.14; Description =Response regulator receiver domain
MAKRILVVEDEAPIREMLCFVLEQNDYQPIEAEDYDSAIGKLIEPWPDLILLDWMLPGGSGIQFIKHLKREAMTRDIPVMMLTARGEEEDRVRGLEVGADDYITKPFSPKELMARIKAVMRRISPMAVEEVIEMQGLSLDPSSHRVMSETTPLEMGPTEYKLLHFFMTHPERVYSREQLLNHVWGTNVVSFLCPLLNGVFYRAGTTLLEEITDRAGAGVSACAGAGSAGWLSAVVAVTGRVRRAVLALQKSDAAVALAVD

SEQ ID NO: 204947 - protein, 54 aa, Glycine max
  Coding DNA Sequence Number=SeqID_88169
CMHVKTEENVHDLEWRKEIQKQKNCIKLDDVGLSHNRGRENIYMCREQNSYKGA

SEQ ID NO: 204948 - protein, 67 aa, Glycine max
  Coding DNA Sequence Number=SeqID_88170
MLPWPAGMLPQHSSAQTTSPYSGSDMNDNIMEKEEREEMPLQGEDESRRSSPPYEAMNKSLEEEGDE

SEQ ID NO: 204949 - protein, 112 aa, Glycine max
  Coding DNA Sequence Number=SeqID_88171
MTLTFGVQRFRISFKLMLIRCVRVSGQGQNTLRSCWQCHLGESDSVGLPIVWQFIDYMASRATFIVVATYPSMGGRRETHRCIFQGRKMRGVATSIYSRKTSKKSERAVYEL

SEQ ID NO: 204950 - protein, 228 aa, Glycine max
  Coding DNA Sequence Number=SeqID_88172
MKDKRDEEEKLEKQKKKKDSKTLSSKAKGKEKEENDSSKKIVKKENHFATKGDIKRALLLKQTFYLLLLRETSLSTTIPLELEVIPQVKELLDKGLVRKSLNPCALLVPKIVIMRHQIPMIGVSIQTSVLVCDCRNLPFDGKARRDSKVSLPRKENVQKSPPMFIQGKRQKNQKDEGLWILKMRVRELFTHREERGSCSYVSSSAMRNSDLRSSFKVRKLRVELLLNF

SEQ ID NO: 204951 - protein, 84 aa, Glycine max
  Coding DNA Sequence Number=SeqID_88173
MEGVPLRKLQRKRVIFQQKEILRELFFLSNISTFSSQGRLHLALSQFPHLRPFPQREEEDKHKNFILVQQQLVPTSNLQATCGS

SEQ ID NO: 204952 - protein, 67 aa, Glycine max
  Coding DNA Sequence Number=SeqID_88174
MATKCILDAHLFHSFDTPSRERERERERERESESESLEESKQSDSFMAMAGAQMSEKGSAYGSGLTR

SEQ ID NO: 204953 - protein, 169 aa, Glycine max
  Coding DNA Sequence Number=SeqID_88175
  Gene Ontology: Mol. function=nucleic acid binding; Cellular component= intracellular; Biological process=transport
  Homolog annotation: Hit_ID=Q10JI3; Match level="QueryCoverage=67%, HitCoverage=40%, E-value=4e-20, Identity=42%"; Hit description =Expressed protein
  Pfam annotation: Domain name=DUF1675; Domain location=17-163; Score =3.5; E_value=1.9e-07; Accession=PF07897.2; Description=Protein of unknown function (DUF1675)
MEQNIIKAVSVLNHRFLCIALNTLRGVSCNIPYIGPTHAAKGVALNIQTSTKEENDSKASHKTIAKAISPRPADSKPENPAKKHKLGNYCSLKGDVMEILRQMPSVTTTGDGPNGKRIEGFLYKYRSGQVCIVCVCHGNFLTPAEFVMHAGGKEVANPMKHITVLSNSF

SEQ ID NO: 204954 - protein, 165 aa, Glycine max
  Coding DNA Sequence Number=SeqID_88176
  Gene Ontology: Mol. function=DNA binding; Cellular component=nucleus; Biological process=DNA integration
  Homolog annotation: Hit_ID=Q8RUQ2; Match level="QueryCoverage=76%, HitCoverage=10%, E-value=5e-31, Identity=56%"; Hit description =Putative retroelement
MFIGPCGNSGHGVEQLDIKIVFLHGMEKDILMKQSEGFEMEGKKNFVCRLKKSLYWLKQSPRQWYKRFVEFIVSHGYIKSPYDSCVYHSKVEGGSQIYLLLYMDDMLLASQNKYEIQNLKSLLNSEFEMKDIRVAEKILRSSPKKVLLMLEGMNVNQTSNLGCIK

SEQ ID NO: 204955 - protein, 196 aa, Glycine max
  Coding DNA Sequence Number=SeqID_88177
MPEKGQQQNRQLENKRQVEDSGRKTCRKRQEQNRRPNSDGAETAGIGVRGRYDTGGGGVSSTAATCSLLHARKQICDSAVWFAKNGRVRECHQSDQDAITMSCRSVDDDAGGGVTCQKCCRSSGDGLWRTAVADGKEGNRRKRGSKQKGQLGMWKTVTRRKATSGELHRNAEKGRQKSDSSWSHWRGRKGSQKVPE

SEQ ID NO: 204956 - protein, 304 aa, Glycine max
  Coding DNA Sequence Number=SeqID_88178
  Gene Ontology: Mol. function=nucleic acid binding; Cellular component= beta-galactosidase complex; Biological process=DNA integration
MRGRHRLQQSLNGDAFPNRPQSQEEEIYKEIPPGHGTTNGGNKVCRLMKALYGLKKIPCDDEVEKQILREKFTTQFEMKDLEKKASLFLKETVCWISLKKRVRRVARLLEYSEKKYKIENDEESPKVEKTQYQKLGGKYIYLSHTTTDLAYAVSMVSKFIHDPWQHFQVVNRIIQKVTPSGEAKFRVVSQGVRELLWIKIVLNDLKYVALMKLFCDTDNKFDIIIAHNLVQHERTKHIEVDRHFFKEKLDSGFTDTGVRSFKTPPPVSRRIHQKTSYRVVSRSYLQAKNDWYSFSNLRGVCCTV

SEQ ID NO: 204957 - protein, 83 aa, Glycine max
  Coding DNA Sequence Number=SeqID_88179
  Homolog annotation: Hit_ID=Q1S9M8; Match level="QueryCoverage=64%, HitCoverage=6%, E-value=1e-18, Identity=85%"; Hit description=FAR1; Zinc finger, SWIM-type
MPRWLPNSSVCGTTCMFAKRRNVTLEGQKKLQDTETTSGESEVKFQVSRDTLGAMLRSMAYIREQLSHADDAQSEPLSKKHRK

SEQ ID NO: 204958 - protein, 844 aa, Glycine max
  Coding DNA Sequence Number=SeqID_88180
  Gene Ontology: Mol. function=zinc ion binding; Cellular component =nucleus; Biological process=transcription
  Homolog annotation: Hit_ID=Q1S9M8; Match level="QueryCoverage=81%, HitCoverage=89%, E-value=0.0, Identity=75%"; Hit description=FAR1; Zinc finger, SWIM-type
  Pfam annotation: Domain name=FAR1; Domain location=60-276; Score =190.2; E_value=5.1e-54; Accession=PF03101.5; Description=FAR1 family
  Pfam annotation: Domain name=SWIM; Domain location=553-589; Score =40.4; E_value=6.1e-09; Accession=PF04434.8; Description=SWIM zinc finger
  Pfam module annotation: Pfam domain module=FAR1::SWIM; Domain location=60-276::553-589
MDVQVINVEVSGHQTKADDGDAEPSDGEVNNAENYGSHVEDEISEPHMGMEFGSEDVAKNFYNEYARHMGFSSKVGPYGRSKADGENMYREFVCGGEGLKKSPNESCNAMIRIELKGQNKWVVTKFVKEHSHYMVSSSKAHSRRPSKHFSSVGRTMPETYQGVGLVPSGVMYVSMDGNRVSNQNTRGVKNIHTAAAERSHLVKNSTLMNYSVRPCSQNKTLGRDAHNLLEYFKKMQAENPGFFYAIQLDEENRMSNVFWADARSRTAYSYYGDTVHLDTTYKVNQYRVPFAPFTGVNHHGQMVLFGCALILDDSEASFLWLLKTFLTAMNDRQPISITTDQDRAMQTAVSQVFPQARHCISKWQILREGQEKLAHVCLAHPNFQVELYNCINLTETIEEFESSWNFILNKYELRGNDWLQSLYNARAQWVPAYFRDSFFAAISPTQGFDGSFFDGYVNQQTTLPLFFRQYERALESWIEKEIEADFETVSTTPVLKTPSPMEKQAANLYTRKIFSKFQDELVETFVYTANRIEGDGPNSTFRVAKFEDDQKAYMVTLNHSELKANCSCQMFEYAGILCKHILTVFTVTNVLTLPPHYILKRWTRNAKNSAGLDEHTGESHAQESLTARYGNLCKEAIRYAEEGSVTVETYNAAISGLREGVKKVANVKKSVAKVTPPNNQASGTAYDDRKTTPTLDTTPLLWPWQDEITRRFNLNDAGGPVQSVADLNLPRMAPVSLHRDDGPSENVVVLPCLKSMTWVMENRNSTPGNKVAVINLKLQDYSRAPSAESEVKFHLSRVTLEPMLKSMAYISEQLSTPANKVAVINLKGIKLVNRISGGFGGIGQ

SEQ ID NO: 204959 - protein, 497 aa, Glycine max
  Coding DNA Sequence Number=SeqID_88181
  Gene Ontology: Mol. function=DNA binding; Cellular component=nuclear pore; Biological process=DNA integration
  Homolog annotation: Hit_ID=Q1S1B7; Match level="QueryCoverage=88%, HitCoverage=74%, E-value=4e-64, Identity=33%"; Hit description =Integrase, catalytic region
MTLLLLSYLVTHPLILIFVPLVVYAMCIFPHKNGQSSLLNQLNVHFLVILLTKKGSPSSKPFLVYQRHNHATSNPPSAPRAPQNHSLTVDLAPLRRNSRVCKPPDMHGFISPLSLTAMLSSIAIPSSYKQAMEHDHWHKAIETKLLALEENQTWNVVPYPPSIKPLSSKFVLSIKLRSDGFIDSYKTRLVVLGNKQEYGLNYGETFAPVAKMTTVRIVLALAASQSWLLYQLDVKNAFLYGDLEEEVYIKLPKAIYATQQLLHSTFHMKDLGQLTYFQGLEVRYQPASLFLNQHKYIQDLVSPIQALLIPPWKLVSNTVVMKVLFLRTRLYIAGSSLQLRAYGDANWAGCPDTRKSTTSWCMFLGDALISWKSKKQDSVSKSSTESEYRDMFVACSKIIWLHGILIELGFTQAQPTPLHVDNTIAIKIASNPVYHERTKHIEVDCHSIHEAHNRKVIILPHVSTSVQLANIFTKSLTRQRHDFLVDKLMLLDSPASI

SEQ ID NO: 204960 - protein, 124 aa, Glycine max
  Coding DNA Sequence Number=SeqID_88182
MIMRGQDIYSSQDEATTSPSSSESEEANGEESSEEIYPQEEGQPLMVKEECKETLVSTATPLGLEVIPQVKELLDEGLVRKSLNPCALLVPKIGIIGAKVQLIQASFNRPKGLEGSALRGFERI

SEQ ID NO: 204961 - protein, 86 aa, Glycine max
  Coding DNA Sequence Number=SeqID_88183
MAQYPCFMGIGEGRLAIEDCDGNSIHVWYQPWLKTIDNDYVISTCSNGNNFDLKVGDLIDHVTCTWKLNEMNDAQPIQSIPLLNIE

SEQ ID NO: 204962 - protein, 102 aa, Glycine max
  Coding DNA Sequence Number=SeqID_88184
MPGRKNKRDAKRVKDATDLGNALGKSNHKQHKLNSDPTLIKVKGLRSKPTMTVRSKSNGTHHACVLMSHRICVTRTHSLSPLSLSPSSRLCNSRWLRNPNHR

SEQ ID NO: 204963 - protein, 71 aa, Glycine max
  Coding DNA Sequence Number=SeqID_88185
  Gene Ontology: Mol. function=RNA-directed DNA polymerase activity; Biological process=RNA-dependent DNA replication
  Homolog annotation: Hit_ID=Q1SP50; Match level="QueryCoverage=66%, HitCoverage=6%, E-value=8e-10, Identity=56%"; Hit description=RNA -directed DNA polymerase
MDKSLNVGEDEWREREWEKIRASRCKGKVGEVALKIDINKAFDRVEWQYLFSVLTLTKFHEKWISWIKMCL

SEQ ID NO: 204964 - protein, 122 aa, Glycine max
  Coding DNA Sequence Number=SeqID_88186
  Gene Ontology: Mol. function=oxidoreductase activity; Cellular component=mitochondrial outer membrane translocase complex; Biological process=electron transport
  Homolog annotation: Hit_ID=Q1SZE5; Match level="QueryCoverage=95%, HitCoverage=27%, E-value=2e-52, Identity=84%"; Hit description =Pyridine nucleotide-disulphide oxidoreductase, class I; FAD -dependent pyridine ...
  Homolog annotation: Hit description=nucleotide-disulphide oxidoreductase
MLGKSTFGLSMWLLKWLPIRFVDRFLLIVSWLMLGDTARFGLDRPKLGPLQLKNLSGKTPVLDVGTLAKIKSGHIKVRPGIKRLKRYTVEFVDGRTENFDALILATGYKSNVPYWLKLIVEN

SEQ ID NO: 204965 - protein, 73 aa, Glycine max
  Coding DNA Sequence Number=SeqID_88187
  Gene Ontology: Mol. function=oxidoreductase activity; Cellular component=mitochondrial outer membrane translocase complex; Biological process=electron transport
  Homolog annotation: Hit_ID=Q1SZE5; Match level="QueryCoverage=74%, HitCoverage=12%, E-value=3e-21, Identity=83%"; Hit description =Pyridine nucleotide-disulphide oxidoreductase, class I; FAD -dependent pyridine ...
  Homolog annotation: Hit description=nucleotide-disulphide oxidoreductase
MAYVQEEDMFSKEDGFPTKPFPNGWKGENGLYAVGFTKRGLLGASMDAKRIAEDIERFDFLENKGSKVTKKRR

SEQ ID NO: 204966 - protein, 650 aa, Glycine max
  Coding DNA Sequence Number=SeqID_88188
  Homolog annotation: Hit_ID=Q86I54; Match level="QueryCoverage=61%, HitCoverage=81%, E-value=3e-07, Identity=20%"; Hit description =Similar to Leishmania major. Ppg3
MESISNSGSSVDMRTGPTTKSGEGEQFNKEKKQVPSSSPFSSELKSQDHFDLMPNATTTTTHPRPLGATSPTHDKTYSQSELHNTHLVAENGDGRPVNSHVEAHSSNPFGEANPSPLENNTAPSTSSQNPFIEMSDATTNTKHVGASESEKEHDHLHSLPSMQQEKGGMPNNSVSAFPTDGMLGPHSSLAPSTNESSQGNPFKAPPTSETNKNTFVGSADSVKVDEHHDHGNESHHRLPSPEQGHWSVPSSEARTHPANTHGETHVPSSSQQLDPLLESAQNKHQADATSKDHAGSTTIPTSVEPHHTFSVTEQGHHNKDSSNSEIDNKSDSSVSSFSPASESSTQDHMHNSANAVTKAPQKRGKDVRFASESCNDDIPISSFQKHGQQTSDGEGQNSSTGVALGTSNGSEKQNPPLQIMERPENPTTSSNYRFPSHVFDRHKSKSNTQWSTASNESLFSIQMGNTSFSNDMGWSWMSKSGEMDRPGDAISPGVFPPSNQPPLPPQSPPQPQPQPPATKFSDISQSTAKQHKGSRVTELKAAETMREVIMENSISKGDLIPAGGATPSNMRSTSNAHSHKSDGSTKSFAFNVLADGEKPLSAKHGEEKRKQQKQPEQQDIRPAPDAAPQNPKPIPNAPQNKSWFSCFSCC

SEQ ID NO: 204967 - protein, 86 aa, Glycine max
  Coding DNA Sequence Number=SeqID_88189
PDNYLKGIINSALKGLNDTPQPKSKAATRWIVIKCNRQKGNIECDYYIMHWMSTIILGTFRNWEAIIGAREMKGASHPVGTILSPT

SEQ ID NO: 204968 - protein, 79 aa, Glycine max
  Coding DNA Sequence Number=SeqID_88190
MTTTTKVMFYDPDSKAPNRVNPKTWRACAGAAVHMEHASPSHHLSPLIRGTTGKVTAEAVARASIVQTSLSSVTGVLFR

SEQ ID NO: 204969 - protein, 910 aa, Glycine max
  Coding DNA Sequence Number=SeqID_88191
  Gene Ontology: Mol. function=RNA-directed DNA polymerase activity; Cellular component=exocyst; Biological process=exocytosis
  Homolog annotation: Hit_ID=Q9FNR3; Match level="QueryCoverage=63%, HitCoverage=90%, E-value=1e-127, Identity=41%"; Hit description =Leucine zipper protein-like
  Pfam annotation: Domain name=Exo70; Domain location=339-910; Score =258.9; E_value=1e-74; Accession=PF03081.6; Description=Exo70 exocyst complex subunit
MVFKDDKKVELMKENLRGDCLRGDGDKMGSVRKNTVASGNREDMVNTYEEPPDPGDHKYALVPRAIRDMETNVNVGGQPEMVEETMEVCTIILDDQYKRVDLWNNLRDICSFSNKPWMLIGDFNDTMLPSEQRGSEFDQNRATIFAQNIDDCRLLKVGGLNAIHKKLDRVMCDNNWRMNFPEAVIEVLQRAHSNHHSLLLRCRGDRLFKFIDAWCTHEDYKHVVSNAWNRYVVDILTSLDSMKKDSIIFNKEVFGSIFRRKKELQFRITGLEKYLKTVDSQFCVDFFLLFTFFAEMEENKSVISTCEQDQHVVAAAQHILKALAASKTVSEDLRKTLLDLETQLSSISIVNERKRTGIKQFERQLKCVEDKVMKWETNPSSNESCEYLKVVGEIQTLIQSLENFSVNEKGKPKELLRRANEILQVAMPSLEKELVHILVQHKQYFEPEYMSFHSNRMDIVYDESFRLVEEEQINEASRSSSGASRQSEASTIDLVNPTVLQHLKSIASFMFGSKYHQEFCQVFVTSRRDALAEYLVILEMEKLRIEDVIKLEWHCLNNEIKKWIRAMKIIVRVYLVSEKRLCEQILGDFGSFYQCCFSEISQSFMLHLLNFGEAVAMGTHTPEKIFRLLDMYEVLEHLAVDVDILFFEEVGSFVRGEFHKLRRSFGESVKSTFVAFRNAIASNHSKTPFPQGGVHHVTKYVMNYIMTLGEYGDTLNLLLVDESSIDPAGNNNNKPDLPCLSLCPTACQFRSITATLESNLSNKSKLYKDKALQHVFMMNNIHYMVQKVKCSGLSHFFGDRWLRQHTAMYQRDARCYEMVSWGSLLSMLKEDSVSNCVSRRTLEKKCKEFCTAFGEVYRVQTEWFISDLLLREDLQISVSQKVVPAYRTYTGKNSYNIAEKYIKYSVDDLQ

SEQ ID NO: 204970 - protein, 51 aa, Glycine max
  Coding DNA Sequence Number=SeqID_88192
MYETDWSATVSIDDFYLTAEGQNKLREANPGNALLEDWMHGSERKEVEEIV

SEQ ID NO: 204971 - protein, 71 aa, Glycine max
  Coding DNA Sequence Number=SeqID_88193
  Homolog annotation: Hit_ID=Q1RVK6; Match level="QueryCoverage=98%, HitCoverage=15%, E-value=8e-07, Identity=38%"; Hit description=Zinc finger, CCHC-type
MPRREKNDMISQKLFTIEFEEGNKLGPCCFLDDRVMQTLRAPWVEFVIVKLLVSHEGATEMGVELSGGYNV

SEQ ID NO: 204972 - protein, 114 aa, Glycine max
  Coding DNA Sequence Number=SeqID_88194
  Gene Ontology: Mol. function=nucleic acid binding
  Homolog annotation: Hit_ID=Q1S4N1; Match level="QueryCoverage=61%, HitCoverage=5%, E-value=2e-26, Identity=78%"; Hit description =Peptidase S8 and S53, subtilisin, kexin, sedolisin; Integrase, catalytic region; Zinc ...
  Homolog annotation: Hit description=finger, CCHC-type; Peptidase aspartic, catalytic
MAQIKNHKERKMKNAKARSCLFAGVSQMIFTRIMTLKTPKAIWDYLKEEYVGDDRIQSIEVLNLRREFELQGTTTFNRGVALAPTYPQITCGANDQLKLTLQEENEIADDRRRR

SEQ ID NO: 204973 - protein, 678 aa, Glycine max
  Coding DNA Sequence Number=SeqID_88195
  Homolog annotation: Hit_ID=Q2QN77; Match level="QueryCoverage=72%, HitCoverage=75%, E-value=5e-51, Identity=30%"; Hit description =Expressed protein
MDLWVVAAAAGAGYLAKYWNRISKNGDGSCHIALEDSCFENPGPPSCSSPFTKQARRDEFCHDFCFDGRALKGKSSTPNPMDGLLTGEVASTRGIDGEKLRHFRNYNKHDVLSLSNLAMPLSPYDDVDDVDDGNEQSSGFVGDHGFLFPDSSAEVVPINNSSGHKTFLKMKHLSGRANRPLSSLESCFMAQLYKEHAETEEYVFSSLSSPSTATRSFLVSNGSQIINRANNNLFSVPIGSKEYKLQKEAGQVKDENVFGVSSLPKIISVNDTKETFNAVIGRSRRLSSSDNVSSGKIIRTQQFDKTFLFSLGISFGMITSIMANKREIDKLRELLKQNENLVQDLQEELEMKDSMTVKELQNENYGSLDTLDHSSYDKELNEFSPEKHVDNSPRIDSKESYHQKVEQSSESMSKIEAELEAELERLGLDMNASSLEGKLSELVELDPEFVADFSQGELRADMVSGKDSLHPKSNEDAGDATPLPANYAVLPHELSLRLHEVIQSQLEQRVKELEIALENSQRKVQLFESKQESYLQKASSFSKENDDCDLMSQPLILNLSGEALDAYNEAYEELIKINDSEENSPLGIHDSSDHQEDSHANDWHALGVQHGGANGSSKVTMMEGSIYELDGTADETCGFDDTEVEQQLIRQIVERTKKGSPVFKNAQRILYSVYEDEQ

SEQ ID NO: 204974 - protein, 656 aa, Glycine max
  Coding DNA Sequence Number=SeqID_88196
  Homolog annotation: Hit_ID=Q9FNR1; Match level="QueryCoverage=24%, HitCoverage=52%, E-value=1e-32, Identity=46%"; Hit description =Similarity to RNA binding protein
  Pfam annotation: Domain name=RRM_1; Domain location=44-115; Score =95.4; E_value=1.7e-25; Accession=PF00076.12; Description=RNA recognition motif. (a.k.a. RRM, R
  Subcellular localization annotation: CTP_CleavageSite=34; ConfidenceScore=5.02e-01
MAFFGRVGNILRQATNQKIGLEIRSLSSVFQATRCMSNAPNSRLFIGGVSYSIDAQSLGEICSQYGQVVDARIIMDRETGRHRGFGFITYSNVDEASRALQALDGQDLDGRRVEVKFAIERSHGFGGGGFGGSYGNTPYDAGAGTGHPGSYGNTPYGAASGGYDNTGGGNAAGVYGRGEDGGGGNWPSGNFGVSSFGNNYGDAGVYAGNSAGGYDNNGYGGGSGGDAGPYGSNAARDYDNGVGGSGSSFGDRSSGKNYGDAGAFRANAASEYGGGSGGSFGDSSSVNNYGAGGGYNGTGTSYRNAGSFATSNPYNDGPGAAGFGKNNNYDSSAGFGSGSRYGSAAAAGGRQSFAGSQHPGSAMANASDGTDTGNGFAGGSYGNAGSFATSKTYNDGTGAAGFGKNNKYDSSAGFGSSSRYDSAASVGSQSFAGKQHPGMVNGSDGTGTGNGFAGGSYGNAGSYATSNTDKDGTGAAGFGKNNNYDSSAGFGSGSRYGSAAAGGRQCFAGSQHPGIAMANASDGTDTGNGFAGGSYGNAGSFATCNSYNDGTGTAGFGKSNKYDSSAGFGSSSRYGSAAAVGSQSFASSQHPGSAMANASNGTGTGNDFADRYHGSGGQFGSNQSSNVGQHGRDFGGSFDEDFRIGNYENDAFAGRA

SEQ ID NO: 204975 - protein, 87 aa, Glycine max
  Coding DNA Sequence Number=SeqID_88197
MYTLIFCSLTQPVLRSQSLNLPNHMLLVRHVQYGYRKMNEGSFWEMVNATPTWVPIGARSMIRFAHNQGKELGRMRWRSLNYNHAFG

SEQ ID NO: 204976 - protein, 186 aa, Glycine max
  Coding DNA Sequence Number=SeqID_88198
  Homolog annotation: Hit_ID=Q1SKD7; Match level="QueryCoverage=70%, HitCoverage=34%, E-value=2e-08, Identity=27%"; Hit description =Ankyrin
MAPKKLFAKRARKATAGKESSVAPQAKIEFDGHRFQSEEHQHRFEVIKDWSFLKERRVQLAEGENAKFRAEVARRRHTQLTEPMAKYDLEVVMEFYANARPTEEGVMDKHSWVWGQWIPYDTDAINQFLGQPQFSGVATYPSAGGRRVTRGMRVPRKEYARSRHQRLFEENVGKTGKDAIYELLSE

SEQ ID NO: 204977 - protein, 92 aa, Glycine max
  Coding DNA Sequence Number=SeqID_88199
  Gene Ontology: Mol. function=ribonuclease H activity; Biological process=DNA integration
  Homolog annotation: Hit_ID=Q1SAS4; Match level="QueryCoverage=66%, HitCoverage=3%, E-value=2e-16, Identity=61%"; Hit description=RNase H, putative
MNGAVEAANKNIKKIVQKMITSVRTSVGATPFSLVYGMEVALLFEVEIPSLRILAKSGLDEAFSGGALLLMNMDDEELPLPMNSDIVKRYYT

SEQ ID NO: 204978 - protein, 46 aa, Glycine max
  Coding DNA Sequence Number=SeqID_88200
MEIPKRLSIQTISVNLDPGSQVAGQETASPVKYGDTQAVIRTNDFC

SEQ ID NO: 204979 - protein, 64 aa, Glycine max
  Coding DNA Sequence Number=SeqID_88201
MPEIPMPCWTSLGPLGVSEVRVMVTMKDVTEQECRPDLSQSGHASAHDLHSPPIYASCKICPRE

SEQ ID NO: 204980 - protein, 101 aa, Glycine max
  Coding DNA Sequence Number=SeqID_88202
MELKACLDNRVTGSVLLLLSMAKIKEPRANGWIYDACPKFNKKVDGEVLPIFCVGYGNENASTIPNHFVSQISQDEALISSIVAKLPTFDLQIRLTELLAI

SEQ ID NO: 204981 - protein, 327 aa, Glycine max
  Coding DNA Sequence Number=SeqID_88203
  Gene Ontology: Mol. function=nucleic acid binding
  Homolog annotation: Hit_ID=Q1T493; Match level="QueryCoverage=68%, HitCoverage=44%, E-value=2e-30, Identity=33%"; Hit description =Nucleic acid-binding, OB-fold, subgroup
  Pfam annotation: Domain name=DUF223; Domain location=129-227; Score= -8.9; E_value=0.019; Accession=PF02721.5; Description=Domain of unknown function DUF223
  Subcellular localization annotation: CTP_CleavageSite=45; ConfidenceScore=5.34e-01
MTVIFLFVFQFDFVLLFGLAMRRKVSFGVYFCSVAGFDYEKKRMSLAVVVSFSFVSFSSFRAKLFLCLLLDFKVVNFGFQWLRWLCDYKVMACVADKIKLIDGSREAFKLSVRITDLWFIRIPEKSEQVEMVVVDSDGDEIHVVCKQDQLKSRKANLKENLTYVMHNFKVMKNDGKFRVCDHEYKLCFTGVTVVRQSDMEHLLFRKFRFVDFSSVIADVIGVVDEVVFRYVSSKNTRVVLKLKDLSGQVLSCTLWENYCLQFLSYLNDIEDERLVVILLTYARIKEAQGSYLLSVSNSFKAFKLMINNLVLEIQEFRERYFGNVLLM

SEQ ID NO: 204982 - protein, 386 aa, Glycine max
  Coding DNA Sequence Number=SeqID_88204
  Gene Ontology: Mol. function=chlorophyll binding; Cellular component =integral to membrane; Biological process=photosynthetic electron transport
  Homolog annotation: Hit_ID=P56777; Match level="QueryCoverage=100%, HitCoverage=94%, E-value=0.0, Identity=71%"; Hit description =Photosystem II P680 chlorophyll A apoprotein
  Pfam annotation: Domain name=PSII; Domain location=1-380; Score =683.6; E_value=1.5e-202; Accession=PF00421.9; Description =Photosystem II protein
MHTALVAGWAGSMALYELAVFDPSDPVLDPMWRQGMFVIPFMTRLGITNSWGGWNITGGTITNPGIWSYEGVACFGFGAFHVTGLYGPGIWVSDPYGLTGRIQSVNPAWGVEGLFHLSVRPPQRLYKGLRMGNIETVLSSSIAAVFFAAFVVAGTMWDTFQQEIYRRVGAGLAENQSLSEAWSKIPEKLAFYDYIGNNPAKGGLFRAGSMDNGDGIAVGWLGHPVFRDKEGHELFVRRMPTFFETFPVVLVDGDGIVRADVPFRRAESKYSVEQVGVIVEFYGGELNGVSYSDPATVKKYARRAQLGEIFELDRATLKSDGVFRSSPRGWFTFGHASFALLFFFGHIWHGARTLFRDVFAGIDPDLDAQVEFGAFQKLGDPTTKKQ

SEQ ID NO: 204983 - protein, 55 aa, Glycine max
  Coding DNA Sequence Number=SeqID_88205
QSMSVTADHDCSMLNSSEPTELESQSVSVTGDYDPLLRIPLTPTKRVSSDELDDE

SEQ ID NO: 204984 - protein, 135 aa, Glycine max
  Coding DNA Sequence Number=SeqID_88206
MGNEDLAMLENLSWDATQKTQKDHDGIVIPISDENPWKNRLLVKVLGAWVNFRIIEAKLQRSWTKNDTIQIIDVQDGAMDGSKHYSIVQRWRPFFLMQAEETKKVAVWIRIPRLPIELYNDTLRVWHVTWRFFED

SEQ ID NO: 204985 - protein, 49 aa, Glycine max; identical to SEQ ID NO: 200508
  Coding DNA Sequence Number=SeqID_88207

SEQ ID NO: 204986 - protein, 121 aa, Glycine max
  Coding DNA Sequence Number=SeqID_88208
  Gene Ontology: Mol. function=protein binding; Biological process =defense response
  Homolog annotation: Hit_ID=Q1SWW3; Match level="QueryCoverage=94%, HitCoverage=19%, E-value=2e-15, Identity=30%"; Hit description =Disease resistance protein
LILDECAYEALGLEYQGVNCGVSHKRVLERGGVREGCQTSSFITEPQVYGREEDNDEIMDFLVGDASHSEHLLVYAIVEDFRVKKMTKAIIEAVSGCAYDVWDDEQDNWQKVENCIDLWSK

SEQ ID NO: 204987 - protein, 206 aa, Glycine max
  Coding DNA Sequence Number=SeqID_88209
  Gene Ontology: Mol. function=helicase activity; Biological process =viral genome replication
  Homolog annotation: Hit_ID=Q9ZQR0; Match level="QueryCoverage=99%, HitCoverage=16%, E-value=5e-45, Identity=45%"; Hit description =Putative helicase
MARDRLVDSQLDNVKLKLIAAREKDGRTYNLPNVSEVAALIVGDFDPDSRRDIIVETQNGELQRIHELNSSYLGLQYPLLFPYGEDGYRPDILHYSTSSSRKRKRNRLTMREWFAYRLQSRSNEAQTLLHSRKLFQQFIVEAYTMVESERLSYIRNNQKKLRVDKYCSLQTSLDVGSSKGLSKGKRVILPSNFVGSPRYMDQLYFD

SEQ ID NO: 204988 - protein, 84 aa, Glycine max
  Coding DNA Sequence Number=SeqID_88210
MGGADSKFQILIWAFQTVFRSRIASGESSPARLGELGGNLLPLFPIKRQKGAVLRVPDPAGYAFQLFWVKIIVSVKKIQAEVLP

SEQ ID NO: 204989 - protein, 632 aa, Glycine max
  Coding DNA Sequence Number=SeqID_88211
  Gene Ontology: Mol. function=lipoxygenase activity; Cellular component=chloroplast; Biological process=electron transport
  Homolog annotation: Hit_ID=Q1S9M9; Match level="QueryCoverage=99%, HitCoverage=76%, E-value=0.0, Identity=78%"; Hit description=Plant lipoxygenase; Lipase/lipooxygenase, PLAT/LH2
  Pfam annotation: Domain name=Lipoxygenase; Domain location=3-616; Score=1011.7; E_value=2.6e-301; Accession=PF00305.9; Description =Lipoxygenase
MEKENVKVLIEYMTMMYPLSEKKSSGFYVPRDEAFASIKQTQFTSSAVSLGLNAIFESVDTILTDPNLGFFSFEDIDTLFKEGLHLPPLKANGLSLLQRVIPKLIKAANDTQNILRFDAPETFKRDKFFWFSDVEFARETLAGVNPYSIQLVKEWPLTSKLDPQIYGPQESTITREVIEPQIITYGTIEEALKEKKLFMLDYHDLFLPYVSKVRKIKGTTLYGSRTLFFLTDQGILKPLAIELTRPPMDGNPQWKQVFQPSCDSTNLWLWRLAKAHVLAHDSGYHELISHWLRTHCVVEPFVIATHRQLSSMHPIYRLLHPHLRYTMQINSLAREALISANGVIEISFLTNKYSMELSSVAYDQLWQFDSQALPNDLISRGMAVADPNAPHGLKLTIEDYPFANDGLLIWDAIKQWVTDYVNHYYPTPSIIESDQELQAWWKEIKTVGHGDKSEEPWWPNLNTSKDLIDIITTIAWVASGHHAAVNFSQYAYGGYFPNRPTIARNKMPTEDPSEEEWGNFLNKPEQTLLECFPSQIQATLVMVVLNLLSDHSLDEQYIGKYMEPSWAENPTIKVAFERFNRRLKEIEGIIDSRNGNSNLKNRHGAGIMPYELLKPFSGPGVTGKGVPYSISI

SEQ ID NO: 204990 - protein, 235 aa, Glycine max
  Coding DNA Sequence Number=SeqID_88212
MNRTSLTASSEMKNPMIGPPLIIQFIAAFNNDKNTIQLPAFYHTQWAPQYPEFVHMRYNGAIYEIRVRQHKEKVYLADGLENFRKDLKIYESTTINFFACDHHFVFDIHFIPPLERQTCGRQRHSSRKHIWTLRLTQQMLDSPEPLKRPRCTEVPLKACGNHMTLLRRHGPPLQWKVETLNPAIGGKGVLQPWYDFLEEMNFDNGDEISIYYRYYEKNWDIIIRKQEDWEDSDNN

SEQ ID NO: 204991 - protein, 296 aa, Glycine max
  Coding DNA Sequence Number=SeqID_88213
  Gene Ontology: Mol. function=hydrolase activity, hydrolyzing O -glycosyl compounds; Cellular component=vacuole; Biological process =carbohydrate metabolic process
  Homolog annotation: Hit_ID=Q6XD74; Match level="QueryCoverage=92%, HitCoverage=91%, E-value=1e-128, Identity=80%"; Hit description =Class III chitinase
  Pfam annotation: Domain name=Glyco_hydro_18; Domain location=25-283; Score=186.3; E_value=7.7e-53; Accession=PF00704.18; Description =Glycosyl hydrolases family 18
MANLATSLSFIILALLALARGSNAGSIAIYWGQNGNEGTLAETCATGNYEYAILAFLPTFGNGQTPMINLAGHCDPYSNGCTKLSSDIKSCQAKGIKVLLSLGGGAGSYSLASPQDARQVATYLWNNFLGGSSPSRPLGPAVLDGIDFDIEGGSNLYWDDLARYLKGYINKGRKVYLTAAPQCPFPDSWIGNALKTGLFDNVWVQFYNNPPCQYSSEVTNLEDAWKQWTSDIPANKIFLGLPASPEAAGSGFIDVNDLTSKVLPAIKGSSKYGGVMLWSRYYDDQSGYSSSIKNHV

SEQ ID NO: 204992 - protein, 524 aa, Glycine max
  Coding DNA Sequence Number=SeqID_88214
  Homolog annotation: Hit_ID=Q10RP7; Match level="QueryCoverage=98%, HitCoverage=72%, E-value=3e-64, Identity=51%"; Hit description=Appr -1-p processing enzyme family protein, expressed
  Pfam annotation: Domain name=A1pp; Domain location=102-214; Score =151.3; E_value=2.6e-42; Accession=PF01661.11; Description=Appr-1"-p processing enzyme family
PEMYGPVATSDSATSRAGLPNDSVDSVVTLDQVPRWIDADHSLVYDNGDTSFSSPYFPDPLTFKSGLESGGGVSRFPVDHEVNSKIYLWRGNPWNLEVDAVVNSTNEVLDEAHSSPGLHAAAGPGLAEECATLGGCRTGMAKITNAYDLPARKVIHTVGPKYASKYQTAAENALSHCYRSCLELLIDHGLKSIAMGCIYTEVKNYPREPAAHVAIRTVRRFLEKQKDNITAVVFCTTSTTDTEIYKRLLPLYFPRDKQEEEMALSKLPADVGDENGETVIDERKIRIKPLPKKKVSKESKPAEAPVDLPVSDVGSVRRVRIRKQPLCICKGKAAYNIPPPYLRIAKSLWAMGASPGAAVKLCLGDLLVMGSNPETASLHMQGTSSYLDTYLDPAFMSLIKDPDERRLEQWEKTVQAQRGWNFANLLGFGDLGGPPLSAAEEYSVHSRYLSKAKSLNLSEIAEMKVVYRGGVDIEGRPVMVVVGAHFLLRCLDLERFVLYVVKEFEPIMQKPYTIVYFHSASSLQ

SEQ ID NO: 204993 - protein, 116 aa, Glycine max
  Coding DNA Sequence Number=SeqID_88215
MPISPYGSISWSVSFRHRDRAYKTPSGPGEVQQGPGVSSSSYGPMDHARKTPCGPGEVQQGPGVSSSGYGPLDRARKTPSGPEEVQQGPKVSSSDYGPLSVLRSARRPQQVHQAPY

SEQ ID NO: 204994 - protein, 48 aa, Glycine max
  Coding DNA Sequence Number=SeqID_88216
MRMRSPLKARACSPLKLRTCRPLKMRACNPLKVRTCSPLKVRTYSPLK

SEQ ID NO: 204995 - protein, 322 aa, Glycine max
  Coding DNA Sequence Number=SeqID_88217
  Gene Ontology: Mol. function=structural molecule activity; Biological process=keratinization
  Homolog annotation: Hit_ID=UPI00006A17C9; Match level="QueryCoverage =60%, HitCoverage=100%, E-value=9e-25, Identity=36%"; Hit description= UPI00006A17C9 related cluster
LHVLTIRGLHALTSRGLHVLALRGLHALTLGLHVLTIRGLHALTSRGQHVLTFVGLHALAIRGLHVLTFVGLHALTFGGLHALAIRGLHVLAFRGLQALTLRGLHVLANRGLHALTLRGLHVLAIRGLHALTSKGLHILALKGLHALTFRGLRVLIFSVLHIHTLREFKVLCPYMLNRDLHSRANCASTTREGGYYTATMHTGLTHINCVALTARFPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTGK

SEQ ID NO: 204996 - protein, 166 aa, Glycine max
  Coding DNA Sequence Number=SeqID_88218
MEIEEDAEIPLILGRLFMLAASCVEFKEKVLKMASRKRKASTSRPQPHYDTHRFTSVDAWNRYADNILGQNILLKRKVKLFVTEFDEFRTELVRRNWHRTLINLMEGSIDVALVKEFYANLYDPEDKSPKQPGETLPAYSRFYKLRPDPQELAARLCIPSGIYSEC

SEQ ID NO: 204997 - protein, 85 aa, Glycine max
  Coding DNA Sequence Number=SeqID_88219
MAENLHGITHGNVLDALRKCLGVDFLHGNDFFSLISSDPQILGGLNENEGGACHPARPGVRGCFLQKAHPGRPKWAWLLFAPPIY

SEQ ID NO: 204998 - protein, 256 aa, Glycine max
  Coding DNA Sequence Number=SeqID_88220
  Gene Ontology: Mol. function=DNA-directed DNA polymerase activity; Cellular component=intracellular; Biological process=DNA replication
  Homolog annotation: Hit_ID=Q0Z2H4; Match level="QueryCoverage=99%, HitCoverage=27%, E-value=1e-109, Identity=76%"; Hit description=DNA polymerase I
LVEEDFALLLGAGQVEGLARDVVGLLLQLHDALAQVVALLGQRGGIDEHAVALYAEQGLAGGDLQLVDAAQAVVGLQLRPQYAVHVQGLVGILAGIGGSLVHGHLGERDLVGALAAQVFIADARAVGVAQRQAGQAVRAVHFQHIALQHGVVHIAVHLDAGIGEDMAVVLDVLAQLGPGRILQPGLEALQHFVGRQLLWRVGAGMAQGDVGSGAGLHAQRDAHDLGTHLVQRGGFGIQGREFGGVDLGQPLVERFP

SEQ ID NO: 204999 - protein, 121 aa, Glycine max
  Coding DNA Sequence Number=SeqID_88221
  Subcellular localization annotation: CTP_CleavageSite=28; ConfidenceScore=5.25e-01
MVKPSSPANLASAIICFFASKKFPHRLKASPGRVGRETLHHTLPSWAMVHGIFQSGVVLAEVLLADSRFTRPDMGFHPTKLNFVPSDADEAPLDVSICLHAFGIVGCGSFSGVKSCEREGA

SEQ ID NO: 205000 - protein, 68 aa, Glycine max
  Coding DNA Sequence Number=SeqID_88222
MSLCQFYGVPVTPNKVIRPRINRAFIKKYCAPKQAQGETPQQHWDGWQQATGAPPPPLEFTSAHPQKR

SEQ ID NO: 205001 - protein, 62 aa, Glycine max
  Coding DNA Sequence Number=SeqID_88223
MVGVCHHKARISGSVMVEAQPRVGGSRSIYDAFVSFFMKGGIARVLSQMQRQKKEIFPPIKK

SEQ ID NO: 205002 - protein, 1008 aa, Glycine max
  Coding DNA Sequence Number=SeqID_88224
  Homolog annotation: Hit_ID=Q2QN61; Match level="QueryCoverage=34%, HitCoverage=36%, E-value=2e-15, Identity=26%"; Hit description =Expressed protein
  Pfam annotation: Domain name=DUF863; Domain location=78-998; Score =328.4; E_value=1.2e-95; Accession=PF05904.2; Description=Plant protein of unknown function (DUF863)
MCFKQVYELHRLYRIQRDLMNEVKRKELHRNQIPVEASFSVGHMTSQLTTEDGQKWHISGFPVGNSTCAKTSVSGVEGIHSPLDSMKAIGQQTSPFPSPNGCSSSKDVEVLESRPLKVRRKMFDLHLPADEYIDTEESEKLSDEKTSDPSFFLPDRNCKTGKEGDAKLFCGNGEKTGCQEDTSRSEQSLRRRNGLADLNEPVPVEETYNSPYVHLLNRNPCQGATECSDISADAAKQKSDFFALSREQLLNSHHGTESWTRSNEYLESNGGGKGWYQSVAESGQAKSNTHPVPQLLKSVSSQTIQDALSKVREPASDYLNGRNKADMWREKTVSDLHISERNHEYSINKQPESVIPLHRPGLFAASPSSDLSKSWSHSASSWEMANSSLSQKLMSIQTPPCLNASGALSRRSQSHQSNGVLEECWPLNINSKPNPGFRSDAPIQNGFYPGSSSGPKEPSMNISSISYDYLNHKNDCKIIPDHFINNVSSKSCKGSDSNCNDMKSGKDIDLNVLLPNGLSNNLVPRSGAGIMDGQQNNEERHAVLPWLREKTTCKNGVQNTAGESSLFHAASLSNKDETVKGPSGKFMHNVTSVLCSNDTEARRTEANESSGNKKILGIPIFDMAHISPKKEFSSITSLSVLNPTPSDLEAVGNKKKWIFDINLPCDAAVVELDKEAFTETAVSKTRSPTTADSRNQIDLNLSMSEDEGSFTTIPSDNIKMKAQIDLEAPAPPEIEEDAVPEEKKLETALASPQVPQGTVEQPKDDELITNAAEAIVVLSSLTWEVDDGVISPSESPKVDLLSWFADVVSSSCKDEGKCDVSREKDGEDNEGRSSEGMDYFEAMTLNLPETKEEDYMPKPLVPENFKVEETTTLLPTRTRKGPARRGRQRRDFQRDILPGLASLSRHEVTEDLQTFGGLMRATGYSWNSGLTRRSSSRNGGGRGRRRGQVAPSPPTPVATNETSTPLMQQLNNIEVGLEDRSLTGWGKTTRRPRRQRCPAGNPPLIQLT

SEQ ID NO: 205003 - protein, 291 aa, Glycine max
  Coding DNA Sequence Number=SeqID_88225
  Gene Ontology: Mol. function=chitin binding; Cellular component =extracellular region; Biological process=chitin metabolic process
  Homolog annotation: Hit_ID=UPI000044A8F0; Match level="QueryCoverage =95%, HitCoverage=99%, E-value=7e-32, Identity=32%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
LVPITIRGLHVLALRGLHVLTFVGLHALTFRGLHVLANRGLHTLALRGLHVLAIRGLHVLTFRGLHALAIRGLHVLALRGLHALTLGYTPSPWVLVTLTVERTTRPRLERTTRPHHQRAARPHLQRTTCPRLERATRPHLGELHVLTFRGLHALAIRGLHILTFRGLHALAIRGLHVLTFVGLHALTFGGLHVLANRGLHALTFRGLHVLAFKGSCTFTFVGHALTFRGLHVLANRGLHALTLRGLHVLANRGLQALTLKRTTRPRQQRVARPHLQRTTHPRLERAPRPHL

SEQ ID NO: 205004 - protein, 171 aa, Glycine max
  Coding DNA Sequence Number=SeqID_88226
  Gene Ontology: Mol. function=RNA-directed DNA polymerase activity; Cellular component=mitochondrion; Biological process=RNA-dependent DNA replication
  Homolog annotation: Hit_ID=Q1T608; Match level="QueryCoverage=59%, HitCoverage=52%, E-value=8e-17, Identity=45%"; Hit description =Rhodopsin-like GPCR superfamily
MSKNVIAARDVSTFILLPPKALKNQSSPLPFIWWGIDILGPFPKAAGQVKFLVVAIDYFTKGIEAQALATITAKNMEILSSDKFSTEHPQTNGQVEVTDLVILKRIQRHLEEAKVCWVEQGRKNATQGKLTDNYEDPYRVRVKIDAYMLETFFGLTIPQTWNAANLRRYYS

SEQ ID NO: 205005 - protein, 332 aa, Glycine max
  Coding DNA Sequence Number=SeqID_88227
  Gene Ontology: Mol. function=nuclease activity; Biological process =response to DNA damage stimulus
  Homolog annotation: Hit_ID=UPI0000549965; Match level="QueryCoverage =23%, HitCoverage=17%, E-value=3e-07, Identity=38%"; Hit description =PREDICTED: similar to F-box only protein 21 isoform 2
  Pfam annotation: Domain name=UVR; Domain location=147-182; Score =22.4; E_value=0.0014; Accession=PF02151.9; Description=UvrBuvrC motif
  Pfam annotation: Domain name=YccV-like; Domain location=197-296; Score=113.8; E_value=4.8e-31; Accession=PF08755.1; Description =Hemimethylated DNA-binding protein YccV lik
  Pfam module annotation: Pfam domain module=UVR::YccV-like; Domain location=147-182::197-296
  Subcellular localization annotation: CTP_CleavageSite=38; ConfidenceScore=5.24e-01
MAPFEPFKRSQITSSTGRNLVWNNSVQSLFLTRHSGFRAEAAWMFRGGEQGLDVSSEHSESANEDILMFFFFQLDLATRVQGLFQIYEEFLMLRLFGTSECQYALNMEQYDIAKQLRNKLAEVEEEVIKQQQSKRGLSSKSEAQDKAISIIRLHSDLQNAIENEHYALAAELRDEISKLEAESLAASAKALAHENAQYAFRLGQKVRHKKFGYKAVICGMDPVCSESSSWMENAQVKKLSRGSAQPFYQVLVDVHAEPNLLVAYVPEENLLTPDKPDMLNRLDLYLKDIHYAIISIIEFALLLVPREDSIIPTSLFYSMEWIQQEISSQLSN

SEQ ID NO: 205006 - protein, 60 aa, Glycine max
  Coding DNA Sequence Number=SeqID_88228
  Subcellular localization annotation: CTP_CleavageSite=46; ConfidenceScore=5.02e-01
MTPLGTILDSSSAHFPFLEDAPMSPASPSRRRVGCDNEESGCDNLVVSNKRNLRMMIDQD

SEQ ID NO: 205007 - protein, 123 aa, Glycine max
  Coding DNA Sequence Number=SeqID_88229
  Gene Ontology: Mol. function=nucleic acid binding; Biological process= RNA-dependent DNA replication
AVIQKILPPKHKDPESVTIPCSIGEVTVVKALIDLGANINLMPLSMCRRLGELEIMPTRMTLQLVDHSITRPYEVIEDVLVRVKHFIFPTDFVKLELGFEDQKIDFDLFVEDNPAPKQNVCLQ

SEQ ID NO: 205008 - protein, 45 aa, Glycine max
  Coding DNA Sequence Number=SeqID_88230
MHLRDQGGLVRARALSALMDCLAHISELWLSACLSRLADELKQCA

SEQ ID NO: 205009 - protein, 75 aa, Glycine max
  Coding DNA Sequence Number=SeqID_88231
MAEQNRTLRELATLDVAHQPLCIQYPEIDEDCEDPQRHLKEFHVFYSIVRPHIVSKDYIKMKHLLSCLLFSLQPC

SEQ ID NO: 205010 - protein, 50 aa, Glycine max
  Coding DNA Sequence Number=SeqID_88232
MEFLELKQGNMIVPEYATKFEELVKQAVNYQGVYQFPLLVNMCRIWDEDS

SEQ ID NO: 205011 - protein, 115 aa, Glycine max
  Coding DNA Sequence Number=SeqID_88233
RHVLTFEGLHAVTFIGPHALTFRELQVHAFRGLDVFALRSKGAHLKRATRPHLQRTTRPHLGYSYPYLQRTTRPHLHRATRPRHQRATRPHLGYSYPHLQRTTRPRVQRTTCPRI

SEQ ID NO: 205012 - protein, 149 aa, Glycine max
  Coding DNA Sequence Number=SeqID_88234
MEAMKDQMTIVMEANMTVVATKSAATEVDLTHPSGVNQISRPVSDMVDQGREALGSTGGPHFVQVQSKHPFPPYGLPPNYAPPNVVHVLEENVDHSTPIPLEGQQPQSGHAHVSKPMAETHEVPHDHTLVGFEPYPRYATEGQAFGGIP

SEQ ID NO: 205013 - protein, 94 aa, Glycine max
  Coding DNA Sequence Number=SeqID_88235
MEREKFDHLEERLRAIEGGGDYPFVDMAKLCLVPNVIIPPKFKVPNFDKCNETTCPKNDLKMYCRKMGAYAKDKKLLMHFFQREFDRGSNHLVH

SEQ ID NO: 205014 - protein, 100 aa, Glycine max
  Coding DNA Sequence Number=SeqID_88236
MEHFLEQVARPEVQLLLVRPNKAALPEPTPVQVDLEPTDPQSRVVNPPSFPEREVVPPSPPLIVISDASSDEAAAPPDSPAGETADPLASPVGGIANLSD

SEQ ID NO: 205015 - protein, 90 aa, Glycine max
  Coding DNA Sequence Number=SeqID_88237
MVPKSQASKDRLKLTRRRLRNHGYLEEIVKGWFSDMQWRLVTVTGGCGWWRRRFGVLGEGLGRRGETNACFTLLDVFVAYKTRSGEILLA

SEQ ID NO: 205016 - protein, 119 aa, Glycine max
  Coding DNA Sequence Number=SeqID_88238
MVSMPSRTPSKGISTGCNGLDLTLIKDESPPIITKTSIDADKSLHEAWEQSNKLTLNLMRMTMAANVKPSMPKTDNAREFMKMVKDCSQFNTTNKSIVGNLSSGLTNKKFISLNHFMIT

SEQ ID NO: 205017 - protein, 122 aa, Glycine max
  Coding DNA Sequence Number=SeqID_88239
MSSPSVPLYVAQRVFQRKCKNTLLQYPTREILRETQSSAASNDDSWWPPVVVGGGEEGVRVWVGIWKGGEGENCVFHAEERIYNLQISLSELVSLSGSPLFALSATIRAECNSFCTNSRSAY

SEQ ID NO: 205018 - protein, 221 aa, Glycine max
  Coding DNA Sequence Number=SeqID_88240
  Subcellular localization annotation: CTP_CleavageSite=13; ConfidenceScore=5.19e-01
MASNPSKAQKKAKSSKRKQGFNFPNLLEAQGLSKLVQMKGTFYLKLVNVFYTCTHAYLEGNLFSTVNGVEMVIDVGVWKAVARQDMGGVRKFKEITDGYSKMKTYRGILLDPARNLRNRLGVGGLTAKDRMPVYLITYILTPRSSNHAQITNNDMQIVYGLKFDIKMNWIVDFSKASSKITERHLKKLGMRFVEHEWIMAREPPAVGNMDKMEEDVKAEAP

SEQ ID NO: 205019 - protein, 623 aa, Glycine max
  Coding DNA Sequence Number=SeqID_88241
  Gene Ontology: Mol. function=protein kinase activity; Cellular component=integral to membrane; Biological process=protein amino acid phosphorylation
  Homolog annotation: Hit_ID=Q9SUQ3; Match level="QueryCoverage=92%, HitCoverage=92%, E-value=1e-176, Identity=53%"; Hit description =Putative receptor kinase
  Pfam annotation: Domain name=LRRNT_2; Domain location=22-60; Score =36.1; E_value=1.2e-07; Accession=PF08263.3; Description=Leucine rich repeat N-terminal domain
  Pfam annotation: Domain name=LRR_1; Domain location=114-136; Score =16.7; E_value=0.082; Accession=PF00560.23; Description=Leucine Rich Repeat
  Pfam annotation: Domain name=LRR_1; Domain location=138-160; Score =12.3; E_value=1.4; Accession=PF00560.23; Description=Leucine Rich Repeat
  Pfam annotation: Domain name=LRR_1; Domain location=162-183; Score =8.9; E_value=6.3; Accession=PF00560.23; Description=Leucine Rich Repeat
  Pfam annotation: Domain name=LRR_1; Domain location=184-206; Score =15.2; E_value=0.24; Accession=PF00560.23; Description=Leucine Rich Repeat
  Pfam annotation: Domain name=LRR_1; Domain location=65-88; Score=7.9; E_value=9.3; Accession=PF00560.23; Description=Leucine Rich Repeat
  Pfam annotation: Domain name=LRR_1; Domain location=90-112; Score =11.9; E_value=1.7; Accession=PF00560.23; Description=Leucine Rich Repeat
  Pfam annotation: Domain name=Pkinase; Domain location=321-585; Score =64.9; E_value=2.6e-16; Accession=PF00069.15; Description=Protein kinase domain
  Pfam annotation: Domain name=Pkinase_Tyr; Domain location=320-585; Score=50.1; E_value=1.5e-15; Accession=PF07714.7; Description =Protein tyrosine kinase
  Pfam module annotation: Pfam domain module=LRRNT_2::LRR_1::LRR_1::LRR_ 1::LRR_1::LRR_1::LRR_1::Pkinase::Pkinase_Tyr; Domain location=22 -60::114-136::138-160::162-183::184-206::65-88::90-112::321-585::320 -585
MAKMLGLLFMIGAMLFGVGAEPVEDKQALLDFLQSINHSHYLNWNKSTSVCKRWIGVICNNDQSQVIALHLTRTGLSGPIPPNTLSRLLALETVSLASNSITGSFPTGFSQLKNLTYLYLQSNNFSGPLPSDFSVWKNLSIANLSNNSFNGSIPFSLSNLTHLTSLVLVNNSLSGEVPDLNIPTLQELNLASNNLSGVVPKSLERFPSGAFSGNNLVSSHALPPSFAVQTPNPHPTRKKSKGLREPALLGIIIGGCVLGVAVIATFAIVCCYEKGGADGQQVKSQKIEVSRKKEGSESREKNKIVFFEGCNLAFDLEDLLRASAEVLGKGTFGTVYKAALEDATTVAVKRLKDVTVGKREFEQQMEMVGCIRHDNVASLRAYYYSKEEKLMVYDYYEQGSVSSMLHGKRGGGRISLDWDSRLKITIGVARGIAHIHAQHGGKLVHGNIKASNIFLNSQGYGCLSDIGLATLMNPALRATGYRAPEATDTRKTLPASDVYSFGVLLLELLTGRSPLHAKGGDEVVQLVRWVNSVVREEWTAEVFDVDLQRYPNIEEEMVEMLQIGMACVVRTPDQRPKIGEVVRMVEEIRRLINTENRSSTESRSEGSTPIPHAIETPSTSFAH

SEQ ID NO: 205020 - protein, 452 aa, Glycine max
  Coding DNA Sequence Number=SeqID_88242
  Gene Ontology: Mol. function=nucleic acid binding; Cellular component= nucleus; Biological process=DNA integration
  Pfam annotation: Domain name=rve; Domain location=37-181; Score=-0.6; E_value=0.0067; Accession=PF00665.16; Description=Integrase core domain
  Pfam annotation: Domain name=zf-CCHC; Domain location=42-59; Score =26.5; E_value=4.2e-05; Accession=PF00098.13; Description=Zinc knuckle
  Pfam module annotation: Pfam domain module=RVT_2::rve::zf-CCHC; Domain location=209-340::37-181::42-59
MKDNSIHLMIRDGAKTSKSKLGKKDKGKSQLKVKDGGVHKENKCYFCKQSGHLKKDCLKEILILDTGCHVDLEGCLYVPGLIIDEVERQLDIKVKVVRSDKGGEFYGKYDESGQCLGPFAKFLENIGICAQYTIPGTPQHKGVAKRQNHTLMDMDRILSKEVPKTSYELWTKRKPSLRNLHVWGCLAKVKMYNPHEKKLDEKTISGFFIGYPKKSKGYRFYCLNHCMRIVEDGNVRFIENELHQMDVKTTFLNGDLEEEVYIDQPKASNDVAMLHDVKKCPSNKFEMKDMVEASYVIGIEIFHDRSQGLLGLSQKGYTNKVLKRFKLEKCSTRIVPIQKGDKFSQMQCPRNDLERKKMESIPYPSVVGSLMFAQTCTRPNISFVVGMLGRYQSNPGIEHWKAAKKVIRSNHLEVVGYLDSDYVGCVDSRKSTLGYIFLLAGGVASSKSAKRL

SEQ ID NO: 205021 - protein, 304 aa, Glycine max
  Coding DNA Sequence Number=SeqID_88243
  Homolog annotation: Hit_ID=Q1SKA8; Match level="QueryCoverage=38%, HitCoverage=45%, E-value=5e-07, Identity=31%"; Hit description=Zinc finger, CCHC-type
  Pfam annotation: Domain name=zf-CCHC; Domain location=183-200; Score =29.2; E_value=1.5e-05; Accession=PF00098.13; Description=Zinc knuckle
MTKARQKGFDFGNLPVEDRRTTKNGGKSSRNHSWKHLGSVTEENEGGACHPTRPGELGCFLQKAVPSGELPGRPKMLRNFTDYATMLSFDFRHVTELHGLHSNGCQVPRSGQTRIASQQADGPQMKLGYDNNSSKEYYKESYSCKEEAENFNLMGKKFGKFLKKFKDIKFSKSSKKIESKNTFTCFKCGKQGHIKFECPIYLRKHIGEKKGNKDRKHKKAYIAWEDNASTTSDSFTDEEAANVCLMAKSMDESSTIEETKVNSEFEEVLEAFNEMHGEAQRLAILNKKLKSDLELHITKLAFST

SEQ ID NO: 205022 - protein, 163 aa, Glycine max
  Coding DNA Sequence Number=SeqID_88244
  Gene Ontology: Mol. function=beta-galactosidase activity; Cellular component=beta-galactosidase complex; Biological process =carbohydrate metabolic process
  Homolog annotation: Hit_ID=Q6EM00; Match level="QueryCoverage=53%, HitCoverage=12%, E-value=2e-20, Identity=63%"; Hit description=Beta -galactosidase
MALGTDDALKNGGLVFAALSGKLYIIKGGCGVGRMFENHGQHMIDNDYTPCSTLDIFVKDLMWLELIQKSKDGGLDVIETYVFWNLHEPVRGQEGLGEICEDSGCNKSICASPHWSILVSLFGYTSFREISSETDNEPFKVTFFLSLRDVLESKSTHQNCLHA

SEQ ID NO: 205023 - protein, 68 aa, Glycine max
  Coding DNA Sequence Number=SeqID_88245
MELDPLLELDCYLRGLKNKFKIEKKIIGEEEEEESNTQCLALYGTSHGDASLNILVDPNPRSVRILRR

SEQ ID NO: 205024 - protein, 73 aa, Glycine max
  Coding DNA Sequence Number=SeqID_88246
MGKGRSPLRGWGGRKVLGSKYEGLLIERVGKFEKGVEWRLGGGDCLSVGMSWGSGLMEPGVGFLGGGMSGLCG

SEQ ID NO: 205025 - protein, 167 aa, Glycine max
  Coding DNA Sequence Number=SeqID_88247
  Gene Ontology: Mol. function=helicase activity; Biological process =protein amino acid phosphorylation
  Homolog annotation: Hit_ID=Q1SN45; Match level="QueryCoverage=99%, HitCoverage=9%, E-value=6e-34, Identity=42%"; Hit description=AAA ATPase
  Pfam annotation: Domain name=DUF889; Domain location=1-167; Score =113.1; E_value=8.2e-31; Accession=PF05970.5; Description=Eukaryotic protein of unknown function (DUF889)
MRLQGNAQLIDDQETTKFAKWILDIGDGVIGNQNDGYATIEIPEYLLITEYNDPIDAIVKSTFPDLYQHHSNPKFFKSRAILASTNETVEEVNDYILSLILGEQMEYLSSDYIEKLETIDSWHFQSITTKFLNSLNTSSLPNPRIKLKIGSPIMLLRNLDQTQGLCN

SEQ ID NO: 205026 - protein, 302 aa, Glycine max
  Coding DNA Sequence Number=SeqID_88248
  Homolog annotation: Hit_ID=Q47522; Match level="QueryCoverage=14%, HitCoverage=53%, E-value=9e-19, Identity=100%"; Hit description=LacZ protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPEFDLQRLPVARQADMQADADGDGPGTGVVVGRDCAAHLGAQALGQHLGLGAGGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 205027 - protein, 245 aa, Glycine max
  Coding DNA Sequence Number=SeqID_88249
KEHTLWCPYRSRAKARVVSEIEKVQEQMKVDMEAMKEQMTTMMEAMMTMRKMTEVNTAIFVVTSTATEVDLTHPSGLNQVNHPMSDMVGQGGRTLGSTSGPHFVQSRASIPSHHMACLPTIHHPMLHTLPIRMSITPLPYPLRANNPNLAFCGVPLLNTLRRPQYHPQPQPLHFAVGRVPPAMVEREKFNHIEERLMAIERGEDYDFANMVELCLVLDMVIPLKFKVLDFDKYKGTTCPQESPED

SEQ ID NO: 205028 - protein, 110 aa, Glycine max
  Coding DNA Sequence Number=SeqID_88250
  Pfam annotation: Domain name=zf-CCHC; Domain location=69-86; Score =20.4; E_value=0.00042; Accession=PF00098.13; Description=Zinc knuckle
MELLRLNQHEENDKKKKGIALKAPSSIQEENEDLSFFVQRFNKFLRMRGTQRRQNFKPKRRIEEPSQTPRCFECNQPRHLRPDCPIFKKRMEKSEKKIIGEKKAKMAYIT

SEQ ID NO: 205029 - protein, 103 aa, Glycine max
  Coding DNA Sequence Number=SeqID_88251
MVTRSMKFCNVAETKRKYCYAIRVQIAIRPTWAFQNLPPEGGCFWRKQLAHLGELGGKLLPYFAINRGRNEEGRGSAFLVLRILLKLLRKIVSVKKIQAEALP

SEQ ID NO: 205030 - protein, 178 aa, Glycine max
  Coding DNA Sequence Number=SeqID_88252
MPGLGRDWSSLVVGNSTPPNVPKVAVGRWCKTILHIHKSRIPTIPCCPPPTELTYSHVALILVPLNVGSPSILPSFHNIQHINITSIIIKTLELNGNLAKLPIISPKTQYPRKSSEKEVYQNLKFRSPTRRDVFHDSENAFLSRFGAEMATKGWSFVGASMVEEEEENGNVKEGEKGF

SEQ ID NO: 205031 - protein, 372 aa, Glycine max
  Coding DNA Sequence Number=SeqID_88253
  Gene Ontology: Mol. function=RNA-directed DNA polymerase activity; Cellular component=chromatin; Biological process=chromatin assembly or disassembly
MAGILCLLKQQNSLEITSVIILGTPHAALHRMKLDVPRFDGSDATGWIFKITQFFEYHTTPDHESLTITSFYMEGQALAWFQWMHRNGQLSSWPAFLHALHSRFAATTYEDPTGLLCKLQQRTTVSNYLSEFEALANRIMGLLSSMTMSCFISGLTPAIRQEVQVLQPVSMSQAVAYARLHEEKQNDARKSFRPSVGASSSSRQAPLPASSTSPLFPTPTHPTPSNVPFKRLTPEELAIRREKGLCFQCDEKYSRGHKCSSSLFLLIMEVDDTVSEPHEQHPPLPEPVPEPPLAQLSFNALSGQVVPETLRMQGYIRGQPVSILIDGGSMHNFVHHRVVMTVGLTTNMTSPLRVTVSNGEELQCQQTCSDVE

SEQ ID NO: 205032 - protein, 313 aa, Glycine max
  Coding DNA Sequence Number=SeqID_88254
  Gene Ontology: Mol. function=receptor activity; Biological process =protein amino acid phosphorylation
  Homolog annotation: Hit_ID=Q84KS6; Match level="QueryCoverage=70%, HitCoverage=67%, E-value=2e-16, Identity=29%"; Hit description =Membrane located receptor-like protein
MVILSSFFRCAQSVIAFVAFIIIVLFQQTCFAKHHPSCPLSSCGKVQNITYPFRLKGHPDGCGLSRYELDCVNNATVLTLFSGKYHVQDIDYKRYQIRLTDAGIAEDTACSIPRYVLQRFNFSDDDPLFFTDVKEYQDEDYYPRNVVFLNCTKKVNDDPRYVEVNAVRRCDSGGGGHIYALLNGFGELSMMDIKVGCRLTATTFASWKRYRNVSYADIRKWLHQGFRLSWFSTVICRDQCGKGYRGCNINQTTGEIGCEEKRYCYMLGYKYYKTTKYCGILGITYLILGYIRYYSPSPHIVGKLALPYLCHFS

SEQ ID NO: 205033 - protein, 623 aa, Glycine max
  Coding DNA Sequence Number=SeqID_88255
  Gene Ontology: Mol. function=protein serine/threonine kinase activity; Cellular component=integral to membrane; Biological process=protein amino acid phosphorylation
  Homolog annotation: Hit_ID=Q1S8T0; Match level="QueryCoverage=92%, HitCoverage=93%, E-value=1e-152, Identity=48%"; Hit description =Protein kinase
  Pfam annotation: Domain name=Pkinase; Domain location=312-580; Score =128.5; E_value=1.9e-35; Accession=PF00069.15; Description=Protein kinase domain
  Pfam annotation: Domain name=Pkinase_Tyr; Domain location=312-580; Score=80.5; E_value=5.3e-21; Accession=PF07714.7; Description =Protein tyrosine kinase
  Pfam module annotation: Pfam domain module=Pkinase::Pkinase_Tyr; Domain location=312-580::312-580
MNFGACLQQTMLNFQKLSLLILLTLVFQPVNVIGKNHYCMQKCGRVHIQFPFYLRNSNKFNHTTDYPTGFGLLCTEKDDTLLELPSVPIKLFVRNIDYKSQQIEIYDPQNCLPSQLLKLGNASISPFQFSKPKGFYDYEKDLYDSRTNVSFFRCDSRSLCPIFLLDPSDDVNLFIPDILYCTKLKDILSVKWYFNMEDWDSAVLMEWSKPNCSYCEAQGQKCRWKNGTNGETECFVCPTNKIPTRTVLIIAAGGIVGLMLLLLLAKALFHVYCYHKMKGEDQARIEKFLEDYRAMKPTRFTYADIKRMTNGLSESLGEGAHGAVFKGMLSREILVAVKILNNAVGDGKDFMNEVGTIGKIHHVNVVRLLGFCAEGFHHALVYDFFPNGSLQRFLAPPDNKDVFLGWDKLQRIAMGVARGIEYLHLGCDQRILHFDINPHNVLLDEDLIPKITDFGLAKLCPKNQNTVSMSAAKGTLGYIAPEVFSRSYGNVSYKSDIYSYGMLLLEMVGGRKNTNVSLEESFQVLYPEWIYNLLEGRDTHVTIENEGDVKTAKKLAIIGLWCIQWNPVDRPSIKTVVQMLEEDGDKLIAPPNPFGTTNSSGTNVVVPTRRQNFELEIIHETNE

SEQ ID NO: 205034 - protein, 107 aa, Glycine max
  Coding DNA Sequence Number=SeqID_88256
MRASGNRLPRGCNRLPGLERGLEHCGGLWDGSLVIDYQIVMAAQLIRDRVEMECLEGAWETLEGNTRCRFQGTIRFTATSLVHPDEPARTLQCTVEWTAPWISFVYF

SEQ ID NO: 205035 - protein, 215 aa, Glycine max
  Coding DNA Sequence Number=SeqID_88257
  Gene Ontology: Mol. function=transporter activity; Cellular component= integral to membrane; Biological process=oligopeptide transport
  Homolog annotation: Hit_ID=Q7XJQ3; Match level="QueryCoverage=92%, HitCoverage=55%, E-value=2e-28, Identity=48%"; Hit description =Putative peptide/amino acid transporter
MKQEMEKRKQGKSEGNEKQKWVHDASLDYKGRVPIRASTAIEFSERITHFGISSNLIMYPTRVMHEDLKTTTNNVNCWKGATTLLPLIGGFVGDAYTATTVVVYAEDFVSWGVACLILTIFMALNIIAFYLGKPFYRYRRLQGNPFMPILQVLIAAIRKRNLLCPSNPASMSENFQGRLLSHTSRLRFLDNAAIVEENNIEQKDSQWRSATVTER

SEQ ID NO: 205036 - protein, 268 aa, Glycine max
  Coding DNA Sequence Number=SeqID_88258
  Gene Ontology: Mol. function=sugar porter activity; Cellular component=membrane; Biological process=electron transport
  Homolog annotation: Hit_ID=Q8UBF3; Match level="QueryCoverage=99%, HitCoverage=84%, E-value=1e-104, Identity=69%"; Hit description=ABC transporter, nucleotide binding/ATPase protein
  Pfam annotation: Domain name=Peripla_BP_1; Domain location=1-258; Score=-42.0; E_value=0.00072; Accession=PF00532.11; Description =Periplasmic binding proteins and sugar b
MNQGAQEAAKASGKQLVIYNANDNPVAQNDAIENYIQQGVKGILVDAIDVNGIMPAIKEAAAANIPVIAIDAVLPAGPQAAQVGVDNLEGGKILGKYFVDYVAKEMGGKARLGIVGALNSAIQNQRQKGFEETIKSNSQITVADVVDGQNIQDNAMTAAENLITGNPDLTAIYATGEPALLGAIAAVENQGRQKDIKVFGWDLTAKAISGIDGGYVTAVLQQDPKKMGEEALKALNSLTAGKTVSKTILVPATVVTKANVDSYRSLFK

SEQ ID NO: 205037 - protein, 244 aa, Glycine max
  Coding DNA Sequence Number=SeqID_88259
MTRSRTKQSEDTLQQMVSTILDKAQVEKDEGPEALPRIILLLSGFLVEPISDLSRLNPCGIYPDLSSISGSGVIQISLPIPSDPLLIRITSIPIEEAKQQASLVGCISTYNPKGGEVSISAFKPTLLIPGFRPDPDLTPSLGFSSDVAGRDNSAIGTKSNGNASFREEGCVMMVSWGHTTSERGKRNRETEKGEVAESASDPRLRSSVRSSSILILLDASSREPREEERRHWEEERGHWKEESE

SEQ ID NO: 205038 - protein, 318 aa, Glycine max
  Coding DNA Sequence Number=SeqID_88260
  Homolog annotation: Hit_ID=Q1M950; Match level="QueryCoverage=40%, HitCoverage=46%, E-value=3e-52, Identity=77%"; Hit description =Conserved hypothetical BtpA-family protein
  Pfam annotation: Domain name=BtpA; Domain location=1-138; Score= -89.1; E_value=3.9e-06; Accession=PF03437.5; Description=BtpA family
  Pfam annotation: Domain name=TENA_THI-4; Domain location=131-318; Score=-0.2; E_value=0.00027; Accession=PF03070.6; Description =TENATHI-4 family
  Pfam module annotation: Pfam domain module=BtpA::TENA_THI-4; Domain location=1-138::131-318
WANAYIANEGFIEGAAAKALRYRNQLRADHIRVFADSHVKHGSHAIVADRSIQELTRDVDFFEADAVIATGQRTGDSATLSEIDEIRAATALPLLVGSGVTPDNVCQILGRTQGVIVASTLKVDGVWWNPALWQAMQQHRFVVDIEHDRLPDSVFNRYLVFEGNFVATAIAIFALAVSKAPGIRQQRWLIGVLNALVDTQIAWFEAVLARRGIRPADYPDDLPGVSAFRDGMLKVAQQGSYAEIITLMFGAEWMYYHWCLRVSAQSQQDADVRRWVEMHAEDEFHQQAQWLKTELDQCALTLSAAQQAQLSQLYARVL

SEQ ID NO: 205039 - protein, 474 aa, Glycine max
  Coding DNA Sequence Number=SeqID_88261
MAAKKDGFAKVVVDLEARLKELESRLEESELRIVMVMEASRELEEELLLYKKEDLDLGLLDPFKDVKDVVEEEATDEGRVLRSKAMMPVLPNQCGHRSLDLLSSSSDGYEDCPHGGLALRHHAPVALGSRATLGGGSPTPMPFGKLDHLGVAICLVEHGPLIVVVVVAASQRTKGVPWVLEKYVPRANIRFWYQVRTLDFARVCTKGGPWVLEMVDLAYLEFLRGWNLVMERAHHGWTLASAKLGFDESCVLAYMALAVDLPRLDLGFCEPFGELTRELSNLGFGHRALVYMPLAIGLNREKSATLGLECRSAKVELQVGCDPKGTFLVGAKLSRSGIFSGFTSDSPNENKSLLVDGSPTSTGIMAFMPYVLRLVESSTQGLGDDFEVFVSLSFELSVVVGDNGIWEAIPTDEVLLDVYSPYGERPRGAQTMKVVRRSAWHVCKLLASSASLGKVEVVFPEHWPVVASSHCFGG

SEQ ID NO: 205040 - protein, 403 aa, Glycine max
  Coding DNA Sequence Number=SeqID_88262
MDWEVISIGESSSSKRARASRRTGGGASCPCRGVRLSAAAEEHVPITVILPRLLPGVDDVLKYKSCLTSVAIVAALHRKVKLAIQACGSDDLPFFRVAHGRPPFFFMYRCLFEVLGVIPPLTVFQCVLLEHLNSNPNRFNSYDEDLLTLVERVNKAILEQLPALLDGRAILSLFSASDHLAALDGIIGGIVPPYVAAPSIGEGGQPVGEVGLVVAAKVTPSAPSFVLATRKRDDATGPFGRKKSKALVSLCALRQVAGLIPTGGHFRVDSVVVPYSTIAARLLSVGVAATNASTVVPPSSMASMASPSVVLAESEQKTLAGFVSAFDKNLIRSVGVQNATDSAKVAKWRDNARTLWRVEHRKVANATVAFTEVIMSNRPLSTKVGDVLAKLLRTRLDGDELFR

SEQ ID NO: 205041 - protein, 107 aa, Glycine max
  Coding DNA Sequence Number=SeqID_88263
MVQAGEVCAVPGQCASDYMDWFFRISHPVKTPGHTSDPLPDDILHVSKPGAPSTFARPTVEEPKHAVEVCHGIAERLECHLSLGVVTPGSSTHEVIEECLRMARSVT

SEQ ID NO: 205042 - protein, 262 aa, Glycine max
  Coding DNA Sequence Number=SeqID_88264
MAEVKQTMKKLATSQGIDVSQSIRPPNIGDNQINFPSWAHNNLNHNQFMCEDLVASERTVEINQANPPKGMYELNPQDNLFALQQKMQVQIETMTKAIQQILQQLQGTISKKPQQAFMCEECGGGHQTSKCTKVPTEEAIISTIECDEVGEEEEDEMMRGELKFEKYIEMLQGKKEEPPIEKLTWDVLHQVRPTRHLEDKEDQQVPIIVGRSFMRTNHVTIGVRKGVYTLREGKKQMFYCYIQGIEDFPNESAHQQFHHTTP

SEQ ID NO: 205043 - protein, 422 aa, Glycine max
  Coding DNA Sequence Number=SeqID_88265
MLWGQEAYHVFNKMDEDSKHTLIAKCLIEAHLVDLDAINKRKQKRLANAITDEDQGLNSFGISKKIQKIMVEQKKRKKTRKQFQKEEEEEELLSREHRTKIRHEVITSTPVCPTVITTVPQRLKELSDADEKNKGLHDYEHTPFEAFKALPIDAIIHLPLPHWTCPIQPNVIKMPLHVLALEAWRSLQKFKDKKTSQSSISRDLFDKLKKDSSQEVEPLKSEFQIKVHMWMPITKLFLVHPADLNLSQEDRSSLGKLHEQIYLRDQATAYPSSLHILRATDIKMVVDKVSPCLPVWDDAQKKGFKLYYNEDMPSRKMKVAIVNFPRNWSLLFNGKNLIYTPNTYDARTFWNQTVLWTLKMPSLLVMMEVKMLSTTTLYKCYVLLGSIALIILVSTSQRMLTDIRLFSAYSNFLLFNKKAVII

SEQ ID NO: 205044 - protein, 206 aa, Glycine max
  Coding DNA Sequence Number=SeqID_88266
MVAWGEDLVQHKGSYSVTSLNHAFPILKGGLGGGWHLENIYNVLPSHIREDILNTRLALNSSILDILTSLLENVKFFMCRLGHEALPSKEFLSEIIAHILWDCGNTHVVWSGCKNPLPSSASIRSSFIPELMVPPYTIITRAHNLLKVALKAFHVMVAYCETHLVIGFKDLLVDIGRSGHSQGRIDGDSGRPEGVRGWHRYAAIYC

SEQ ID NO: 205045 - protein, 222 aa, Glycine max
  Coding DNA Sequence Number=SeqID_88267
MDKAIKTQISTKLQDSECDIVIALRALKNLNSMFLKELVGTFKVHEQELQQDEGPKREESLALTLKDDDSFDDESEEDLDADELAFISWKIQKMWRIKHRHFKSKFTELEKSQDKKKFFKTKEKKGLMSTKKDLNNTSSDEESNICLMVDTTSNESESNQQDEGQVDVSLDKSTKTCEACITLKDKESKLCLEIETSVKERAILLKNFQELENRLKDLQKDQ

SEQ ID NO: 205046 - protein, 168 aa, Glycine max
  Coding DNA Sequence Number=SeqID_88268
  Homolog annotation: Hit_ID=Q1SYZ5; Match level="QueryCoverage=41%, HitCoverage=41%, E-value=4e-16, Identity=60%"; Hit description =Uncharacterized plant-specific domain
  Pfam annotation: Domain name=DUF623; Domain location=92-151; Score =87.1; E_value=5.6e-23; Accession=PF04844.4; Description=Protein of unknown function, DUF623
MSSSRKKLVLNTVSVSLGCGSCRRPGLLRHIFHPKRRPKKPAYQAHGFHWDDTATSSSTTNASTAATFSPCYAEASAQFSNYGRGVAVEKDSDDPYLDFRHSMLQMILENEIYSKDDLRELLNCFLQLNSPDHHGVIVRAFTEIWNGVFSVRRSGSSTGFHLNRCLFG

SEQ ID NO: 205047 - protein, 72 aa, Glycine max
  Coding DNA Sequence Number=SeqID_88269
MKLCFHTKRLSVQMISVNPDPGSQVAGGGTLWLSAPFVNQGERVQCFYFHHPGTFKPNEARDSSLLGGDDRV

SEQ ID NO: 205048 - protein, 254 aa, Glycine max
  Coding DNA Sequence Number=SeqID_88270
MTPRINHLSRFALLRPDPQELAAKLYIPGRGFELNVDGQPLKILRKNMTTLAQTWSVFSFSNLIPTSYTSDVTIDRAKLIYDIIMNMDMNLGYLISHQISLSAQHDTSRLGFPALIIALWKARGVQSDSRSLENLSPAINLTYIKKNCWNLDDPTVTFRGPRKARGKRSGPHYFSTTRDNSSFFFHSSSTSHSDSNYSSNIYTDTTSSSFICKTFRFFIYTTNAAFHAPELTQGAVHYHAEPSGLGLAIHHEHG

SEQ ID NO: 205049 - protein, 80 aa, Glycine max
  Coding DNA Sequence Number=SeqID_88271
KVLLILRDFWNVPVIHVLIDIFESDFLIEEIVFGGDLLGLALILEVSGIGSNGQVFINKETETAAQPHRIGGGREKRDGK

SEQ ID NO: 205050 - protein, 59 aa, Glycine max
  Coding DNA Sequence Number=SeqID_88272
MSHGRLYQQRMKNVFDKKGQNHLRPWSDAGTKLKAKTNQGKTVTRPQFAAQCRFLLSGT

SEQ ID NO: 205051 - protein, 88 aa, Glycine max
  Coding DNA Sequence Number=SeqID_88273
KGSTSRVLGIFLQIPTKNGGAVQEPPVNISRRSNGVDGDPVLRGTRIRATGTWRYVAGVRRPWGRQGDRALIIDYQLGVIDYTVLPAT

SEQ ID NO: 205052 - protein, 608 aa, Glycine max
  Coding DNA Sequence Number=SeqID_88274
  Subcellular localization annotation: CTP_CleavageSite=51; ConfidenceScore=5.44e-01
MGPGQYISPQSSEPICGSLFDVRGSSLNKQRVTSLSSPQVWTSVVQCENCRSMWLVKSSSLEMCCLGYFYQVVNDGGVFGVLVKIALKIARPRVELVGVPLALTRGSGGGDVRVRDDVLKYKSCLTSAASVAVLQCKHLNEAPSQLHLNNWAMVRAFEILYPFFNIQPSVLDHFFKVLATDVVVDGMPLMFNRDGEPCFSFYWQSGPTKFKSYDEDLLIVMETVDKAILEQLPASLDARAILSLPSTSDPLAALDGIVGDFPWRPLVKWGCATVYWRGGQPVGEVVHVVVAAEVTLNASSYILVKRKRNVAIGPMGRKKSKAPMSLHTLRQATQKGPIASHLITTQDMPSAPPTVEAPASAAMTPATPAPSPLPAAVVQEVSQAVVEVVVPATQAESACGNHWCSHDVASFFIGSGGPLATILVAMALPSSPSCLCVSLDHLYTFSDVDSLWGATYKLEQKTSTGFVSAFDKNLIRSTGVQDASDYAKVFLQRSLALLEENGLWHQEAVQKVAFLEAEAVRENRHLSSKVGGALARLLRTWLDGDDLFRRCKDLQAEKIDLGGRLESMATEKDGFAKRVAELETWLKESKSRLKESELRVAKERKASK

SEQ ID NO: 205053 - protein, 149 aa, Glycine max
  Coding DNA Sequence Number=SeqID_88275
  Subcellular localization annotation: CTP_CleavageSite=7; ConfidenceScore=5.23e-01
MRAFGTMAARPGELMLSPTETGTPRRAGSFSPNQFGAPGAPGRARGMTPPMVYKTQGPFLVQGSTNPRTTFDEASHNYISIPTRTHGIKAYQKPKAHLWYQNPRSVLGTYFYQTQGTPFGSLTCSNYDDHRQGSKFHQENYHPIIWQDF

SEQ ID NO: 205054 - protein, 113 aa, Glycine max
  Coding DNA Sequence Number=SeqID_88276
MTTGGHHSCRVFPAEPPHQEEHFNWSGILRIYLKDSVEKKSLNHFFRSFSEDMIKSKGKDPLEGLGGPMTRARARKAKEALQQVLSILFEYKPKFQGEKSKVVSCIMAQMEED

SEQ ID NO: 205055 - protein, 333 aa, Glycine max
  Coding DNA Sequence Number=SeqID_88277
  Gene Ontology: Mol. function=DNA binding; Biological process=DNA integration
  Homolog annotation: Hit_ID=Q1S326; Match level="QueryCoverage=23%, HitCoverage=21%, E-value=1e-25, Identity=67%"; Hit description =Putative receptor kinase-related
  Pfam annotation: Domain name=RRM_1; Domain location=150-214; Score =50.1; E_value=7.7e-12; Accession=PF00076.12; Description=RNA recognition motif. (a.k.a. RRM, R
  Pfam module annotation: Pfam domain module=RRM_1::RVT_2; Domain location=150-214::236-333
MGVQFHTNVVNGRWRASPGAAVKLCLGDLLVMGSNPETASLHMQGHRFRLPPPAAVILSLATGSVPVGRMLPIRRSLASKNSPQHHGYGRQLIPVLFQSSDRHFVVVWIVGLVSRACTTAVWLAEFLELSFLSSSLLCITSGYSKRMYHVYVGNLDSRVTERDLKDKFSAFEVIRSVWVACSPPGYVFIDFDDRGDAHNAIRELDGKNGWRVELSHNSRGGAVQQPSSIMYNTECFNSLYFSIIGQSRAIKCVFLNYDDTFCPVAKITTIQLSFAMAAIHHWHLHQLDIKNVFLHGELDKEIYMKQSPGFVAQGKSGLVCKLHQSLYGLKQSP

SEQ ID NO: 205056 - protein, 93 aa, Glycine max
  Coding DNA Sequence Number=SeqID_88278
MRSYHLDMHGVVFALSTPKPDVVDDASQLQQWVQANKTEIHRRQLLSLDHEQRKRQQVQINEYHKLLEDLKTENISLPDEFISELLIEKLLES

SEQ ID NO: 205057 - protein, 201 aa, Glycine max
  Coding DNA Sequence Number=SeqID_88279
  Gene Ontology: Mol. function=nucleic acid binding; Cellular component= mitochondrion; Biological process=DNA integration
  Homolog annotation: Hit_ID=Q0KIN0; Match level="QueryCoverage=87%, HitCoverage=11%, E-value=5e-47, Identity=46%"; Hit description =Integrase core domain containing protein
MGACPYTPQLMDLMLNFSQADLNYLTVTKPNITFVVSVVSQFLNAPCDSHWNVITCILRYIKNAPGRGMLYEDKGIPRSFLILTLIGQGNMISWRSKKRDTIARSSVEAEYREMAIAACRITWLRQLLQQLKFGDTQATTLICDNQVALHIASNPIFHEQTKHRDRLSLCKGKDILTKSLRGHQIQFICPKLGAYNLYAPA

SEQ ID NO: 205058 - protein, 34 aa, Glycine max
  Coding DNA Sequence Number=SeqID_88280
MPSPVQSLGWLEIYQRENRLVAAPASSYTAILTQ

SEQ ID NO: 205059 - protein, 175 aa, Glycine max
  Coding DNA Sequence Number=SeqID_88281
MGDSDKYGLYIEENPPRLVALGRLYEGSTTVHNISFMHDQVKVGVEEVRDANTLIHVPTEEGAVEPMKLADRPDHDLDDPLYLMTLTIPQLFLKLLQVMWDATMFGVFNDNFPLYIKHEDLSEIAYGGQCLSISIIQLWILAHWQMVVILPKENVVIWFCSLHNRSDNYLKGIIN

SEQ ID NO: 205060 - protein, 72 aa, Glycine max
  Coding DNA Sequence Number=SeqID_88282
MLESMFFNIVMKGLVTLPPSVLGRSVIPKCHCHQQHQWLSVFCFMEAATTPRMAWSMLEKLDLTSSQATMVV

SEQ ID NO: 205061 - protein, 66 aa, Glycine max
  Coding DNA Sequence Number=SeqID_88283
MDGTFDDEVEPAVTIGEYLEEVEERELKFLNLQFKHMIRVCNNFSTVLSTSPQYNGVVNRTEEFLQ

SEQ ID NO: 205062 - protein, 60 aa, Glycine max
  Coding DNA Sequence Number=SeqID_88284
MTMEENEVTPIILGKLFLNTIGTLIDVKEGKLTWWLGDEEEVFKATNKIKVIFSSNTHKP

SEQ ID NO: 205063 - protein, 116 aa, Glycine max
  Coding DNA Sequence Number=SeqID_88285
  Homolog annotation: Hit_ID=Q5ZDK4; Match level="QueryCoverage=34%, HitCoverage=14%, E-value=9e-09, Identity=77%"; Hit description=50S ribosomal protein L22-like
  Subcellular localization annotation: CTP_CleavageSite=34; ConfidenceScore=5.13e-01
MVQSWSRQHKSWSGKRQIRKLSPKKVNLVAALVRGMLVKDASMQLESTIKRAAKTVYQVKEFHRRDGFEVASADKMAKSCMMTRDLKEECRASILSYPIPIHGLRMLQEFGILADQ

SEQ ID NO: 205064 - protein, 117 aa, Glycine max
  Coding DNA Sequence Number=SeqID_88286
  Gene Ontology: Mol. function=serine-type peptidase activity; Cellular component=membrane; Biological process=signal peptide processing
  Homolog annotation: Hit_ID=Q1T541; Match level="QueryCoverage=75%, HitCoverage=60%, E-value=2e-40, Identity=93%"; Hit description =Peptidase S24 and S26, C-terminal region
  Pfam annotation: Domain name=Peptidase_S24; Domain location=63-105; Score=5.5; E_value=0.09; Accession=PF00717.13; Description=Peptidase family S24
MGDRKEAIAITMGWIGESVDSIKSLQIRQVLTQAVSLGMIVTSALIIWKALMCITGSESPVVVVLSGSMEPGFKRGDILFLHMSKDPIRAGEIVVFNVDLIVTVDLEGGPGTSFCSL

SEQ ID NO: 205065 - protein, 35 aa, Glycine max
  Coding DNA Sequence Number=SeqID_88287
MGSNEAYAYMFVQQEFDVILKCFAKVDIAGKVTTK

SEQ ID NO: 205066 - protein, 90 aa, Glycine max
  Coding DNA Sequence Number=SeqID_88288
  Homolog annotation: Hit_ID=Q2HSN5; Match level="QueryCoverage=92%, HitCoverage=40%, E-value=4e-10, Identity=30%"; Hit description =Transposase
MEAKRKDNFVWALQKFKGIFFRVDGLPKVIITKRDLTLMNALKYIFHEASSLLCQFHIDKNVKAWDQVMKAWGSVKDFPTQSEYEEHVKM

SEQ ID NO: 205067 - protein, 132 aa, Glycine max
  Coding DNA Sequence Number=SeqID_88289
LITGLCQSFEVPVTPSKAPDAPPPPHQADPAGSFDTERYLRHLVRQQAANHRAHVQTHNCLYQLSLSLQSQGFAPFPCPTPDQFRAEVAWLGDWPEAQAGEAPAEAPGDGKEARMDEEMTDLLDFLGGSGAT

SEQ ID NO: 205068 - protein, 174 aa, Glycine max
  Coding DNA Sequence Number=SeqID_88290
MPQLVSWHPPRQDFVALNTNGNVSREECKAGTGGLIREGSSNWLLELFAIFKGLQEAWNHSYRQYILAIFLWEGDAFDGGCGDGMAAMYSKNEMNLKEVLDGYDKAVEALGNVSNIKDVYVEDQELEMELGFWEVSMDEAPYLKDINMWLYGGFTQLKPLQNMFKLVDHRREMQ

SEQ ID NO: 205069 - protein, 67 aa, Glycine max
  Coding DNA Sequence Number=SeqID_88291
HSSNLVEFVPPNEDPHIVLDGFGYMRGRDDYKESWTKFFIVGPLAFIGEPIGVGKKDEIFFRKKTVK

SEQ ID NO: 205070 - protein, 83 aa, Glycine max
  Coding DNA Sequence Number=SeqID_88292
  Gene Ontology: Mol. function=siderophore-iron transporter activity; Cellular component=membrane; Biological process=siderophore transport
  Homolog annotation: Hit_ID=Q1XX86; Match level="QueryCoverage=97%, HitCoverage=10%, E-value=2e-26, Identity=70%"; Hit description=TonB -dependent siderophore receptor precursor
MWGHRLKKIILPGAHSINDLAFFILADSPDAVLIIKTYIGNACNIFQYISQPERLPVVDEFFGNRIQRERKIFVFHRNLSGCK

SEQ ID NO: 205071 - protein, 123 aa, Glycine max
  Coding DNA Sequence Number=SeqID_88293
  Gene Ontology: Mol. function=siderophore-iron transporter activity; Cellular component=membrane; Biological process=siderophore transport
  Homolog annotation: Hit_ID=Q1XX86; Match level="QueryCoverage=99%, HitCoverage=15%, E-value=2e-41, Identity=68%"; Hit description=TonB -dependent siderophore receptor precursor
  Subcellular localization annotation: CTP_CleavageSite=38; ConfidenceScore=5.05e-01
MSSVDPGGTINMVTKKPLANSRYEVSLSGGSFDTYRLSADVTGPLNTSKTLLYRFNGAHQHARSFRDHVKNNGILIAPSISFIPNDRTSVNVEMIYNEMNGNLDRGQPIFGAVAGKTDLNSTP

SEQ ID NO: 205072 - protein, 54 aa, Glycine max
  Coding DNA Sequence Number=SeqID_88294
MDPINTAQNDACTDSTLICNVGIVLSLSRPPDYARNSPPPIGDQPGSPKVFPTR

SEQ ID NO: 205073 - protein, 294 aa, Glycine max
  Coding DNA Sequence Number=SeqID_88295
  Gene Ontology: Mol. function=nucleoside-triphosphatase activity; Cellular component=alpha DNA polymerase:primase complex; Biological process=DNA replication
  Homolog annotation: Hit_ID=Q5H2P2; Match level="QueryCoverage=99%, HitCoverage=57%, E-value=1e-144, Identity=93%"; Hit description =Replicative DNA helicase
MSASCSIAPDSRMSAITGRLSRDHRHVQFLGQALQRTRDLRDFGRAVFAVARHAHQLQVVDHHQAQVVLALEAAALGTQHFRRHARRIVDEDLGFLQHLDRTGDAAPVLVFQLAGTQALRVDAAVGGNQAHRQLRCRHFHREHRHALLRFDRRVLGDVQREGGLAHGRARSQDDQVGRLQAGGHRIEIVVAGRQAGDVAAVLEAAAQLFEGILQRTGHGHEIGTATCALFGDGEHALFRRGQQLAAVTPFGLETVVDDVGAHLDQLPQHHLVAHDFRVCHDIGGRRRGTGQFDQ

SEQ ID NO: 205074 - protein, 153 aa, Glycine max
  Coding DNA Sequence Number=SeqID_88296
  Gene Ontology: Cellular component=mitochondrion
MDVDKILPSSSTLGWHSLKVKGEVQTKKGLWWIPRHPETRKGVVSDEMLRGVENKRRSGDSRYRSTFRTAAESTGRQETTCLNRENGVVGELYKCRAARRSSRECCTLDGESPVAESITSLRSDPSSMGHVESRVNQQGPPCKAKYSWVTDSE

SEQ ID NO: 205075 - protein, 165 aa, Glycine max
  Coding DNA Sequence Number=SeqID_88297
DRARKTPSGPGEVQQGHGVSSSDYGPLSVLRGARRRQQGVGRDTTTAWRWPAAGNRCTATTSKAPQLIYKGWSVAYDSWSTSRRPSPKSKVAKIPFAIMTREFGGMRRHPTVTRTHPLPSSDPRVRKHAGVPYGYPHLWSSRDGESDDMRGVPYGYPDISVNPDP

SEQ ID NO: 205076 - protein, 81 aa, Glycine max
  Coding DNA Sequence Number=SeqID_88298
MMEREMITMIVDTLPMFYYEKMVGYMPSTFADLVFAGERIEVGLRRGKFDHPALMNRKLVKWWLDRNIEMAITEATGLQMR

SEQ ID NO: 205077 - protein, 152 aa, Glycine max
  Coding DNA Sequence Number=SeqID_88299
MILKEELATCARSKRSLAQHLEATEQSMLAIIGQYKEELNKSVTHAQKLAEDFAQVYAEKEAKGRVIDALHQEATMWMDRNFIITKKTPSVATYPSAGGRRVTRGMRVPRKEYARSRHQRLFEENVEKTGKDAIYELLSERLGSCIYARGRY

SEQ ID NO: 205078 - protein, 287 aa, Glycine max
  Coding DNA Sequence Number=SeqID_88300
MARKARSSPFRSWMKRSTGDVKRAGRLLNGSLARRKEESGFYLHAKDVPREECHQTKASRLSSHELSVTTTRGYSKEFARHGMRREERTESLGEAVMGSSAAITVRDDEVKASEESDEVQALKAELERARVVEEKFKSIAIKMKLWNEKQEGPKGRTRPKQSFEGLYRAAIVSSSSEEVKGIITGQRHDLEGRAKGNMWAIIDKCKEKLNLAATHEQRLEDEYAKISAEREARERVIDSLHQEATMWTDRFALTLNRSQELPPLLAKAKAVADTYSAPEEIHGLLSY

SEQ ID NO: 205079 - protein, 102 aa, Glycine max
  Coding DNA Sequence Number=SeqID_88301
MTIICLRMSSGPPPLDDKRRRMTITCLCAPSNMIVSEWKKVSGMTIICLRMSSGPPPLDDKRRRMTITCLVAPSDTIVSEWQKGERNDHNLSPHVIGPAASG

SEQ ID NO: 205080 - protein, 51 aa, Glycine max
  Coding DNA Sequence Number=SeqID_88302
MGVKYLEAVKRRLHATKQCSPDEIRYFMLVCFCLDHVDPCSVKVTQHWEKG

SEQ ID NO: 205081 - protein, 79 aa, Glycine max
  Coding DNA Sequence Number=SeqID_88303
MDNHQHGNHSDPAQARIKKKGIRQHKVNYQAQNIDSNIPDSSEDESSESTQGSASVSSPENQNYMSSVNEAAINREGNN

SEQ ID NO: 205082 - protein, 417 aa, Glycine max
  Coding DNA Sequence Number=SeqID_88304
  Gene Ontology: Mol. function=tRNA (guanine-N1-)-methyltransferase activity; Biological process=tRNA modification
  Homolog annotation: Hit_ID=Q0YZ15; Match level="QueryCoverage=52%, HitCoverage=85%, E-value=1e-100, Identity=81%"; Hit description=TRNA (Guanine-N1)-methyltransferase
ALVAAPALDLRVVAGQQWRRHFPPFPDFGAGVVRAIEQAIERRIEAVLLETAFVIEHAGLQPRDGIQQGHGSDLAARKHEVAQAQLVRDMGIDEALVQALVAAAQQDCALPLRPLGHHGMAQRGADRREQHHGSRLGLAGITARLPGRLQATLQRLGHHHHARTAAEGAIVHAPVVALGMVARIPQVHADLARGIGTARDAAFKKRREQLREQRDDVEAHGGRRSIVGLPVGNDGLARQIHLVHIGIDKGNHALALLAILFIGQHQHGLRTGGQQVADDAQDHALAVDHGQAQQIDPVILAIFGLREIAARHEDARATQGLGGVAVVHDRRCGDDGIGVDARLLDRQQHRTGELPRTLLGGLQIPLLCGEQGLGVGTEGGHLEPALDAPGIGDTPDLHGIGGQDAGFEFRHVAHGSR

SEQ ID NO: 205083 - protein, 183 aa, Glycine max
  Coding DNA Sequence Number=SeqID_88305
  Gene Ontology: Mol. function=DNA binding
  Homolog annotation: Hit_ID=Q1S0F5; Match level="QueryCoverage=78%, HitCoverage=27%, E-value=4e-12, Identity=32%"; Hit description=IMP dehydrogenase/GMP reductase
MARVAKVVKISAQELDRVKKNRNGEVGIPRKLLEEKAKALVDQGEWTSFIDVLALLVFGIVLFPNVDGLVDLAVIDAFLAYHHSKESLVIAVLADAYDTLDLRCEKSSTRIVHCTPPLYVWLVSHVFRHENILVCPLQGRHMCVEKGKANWEELLAGMVGASVSWFPDERKEGPKFCAHVKGS

SEQ ID NO: 205084 - protein, 48 aa, Glycine max
  Coding DNA Sequence Number=SeqID_88306
MRAFAKHDTQWLSARKKPEEDELSGSLSAPLQVIKCTAQSRSRSESLR

SEQ ID NO: 205085 - protein, 56 aa, Glycine max
  Coding DNA Sequence Number=SeqID_88307
MTKARQKGVRKNVTELYGLRLNTSFQTPDMPRNFTNCLTMGVKYLEVVKQGSHPNK

SEQ ID NO: 205086 - protein, 108 aa, Glycine max
  Coding DNA Sequence Number=SeqID_88308
  Pfam annotation: Domain name=zf-CCHC; Domain location=70-87; Score =7.3; E_value=0.062; Accession=PF00098.13; Description=Zinc knuckle
MELMRLHQHEENDIKRKGIALRVSSSFIQEESDKEDLTEIEEDDDDFRFFVKRESNIITKKKEEDSSLAPTCYESNQSGHMRFDCLVFKRRIEKSDKRNLKEKKEKKA

SEQ ID NO: 205087 - protein, 90 aa, Glycine max
  Coding DNA Sequence Number=SeqID_88309
MKTTNTAANGTNNQGTPKWIEVKSHVQSGGYECGYYMMHWMWNIVSGGLKNDWTMWFLDGTTLDKETITTIRQKWAAYFLKVQSNQCTKS

SEQ ID NO: 205088 - protein, 391 aa, Glycine max
  Coding DNA Sequence Number=SeqID_88310
  Gene Ontology: Mol. function=ATPase activity, coupled to transmembrane movement of substances; Cellular component=integral to membrane; Biological process=proteolysis
  Homolog annotation: Hit_ID=Q0BAW8; Match level="QueryCoverage=99%, HitCoverage=50%, E-value=1e-118, Identity=54%"; Hit description=ABC transporter related
  Pfam annotation: Domain name=ABC_membrane; Domain location=120-389; Score=33.8; E_value=5.9e-07; Accession=PF00664.13; Description=ABC transporter transmembrane region
MTALENAGITGGMVERRLQDLPEQLMPMILLRQNGGGSIVLSRRIHTNEENQRELRFQLIMPEVSDKAVEMSLAELNEIYAGFAVMAKPAAVLDERASEMLPEVKGHWLFSTLWRYRRYYRSAAIAAVLINVLALSSIFFTMNVYDRVVPNQAFVTLWSLAIGVTIAMIFEAITRFVRAHLLDMAGKKADLVLGSMLFRQALSIQMEHKPASSGTFANQIREYESVRDFVASATLAAISDLPFILMFVGVIFFISGPLAIIPLMMIPLIIIVSAAIQWPLARIMKENLRDASLKQGVLIESVEGMETLKAVGGEAHMQRRWENFSALQSANSMKSKRYSTLATGVVTFLQQFQTVMLVVAGVYLINAGTFTMGAMIATVMLASRATPPLVQ

SEQ ID NO: 205089 - protein, 133 aa, Glycine max
  Coding DNA Sequence Number=SeqID_88311
  Homolog annotation: Hit_ID=Q6CQE5; Match level="QueryCoverage=29%, HitCoverage=35%, E-value=8e-10, Identity=79%"; Hit description =Protein TAR1
YALTRTLHRRSGSVGGATHRGIPPISFLAPYGPTPGARRCRGTPRARAAIHNRDDDVSTSISTARAWATIAIRVGQCPESIGGPALTSFSSFPRGTCSLSVSRQYLALDGIYRPIGAAFPNNPTRRQRLVVRQ

SEQ ID NO: 205090 - protein, 165 aa, Glycine max
  Coding DNA Sequence Number=SeqID_88312
  Gene Ontology: Mol. function=chitin binding; Cellular component =extracellular region; Biological process=chitin metabolic process
  Homolog annotation: Hit_ID=Q86AI8; Match level="QueryCoverage=95%, HitCoverage=41%, E-value=8e-16, Identity=35%"; Hit description =Similar to Homo sapiens (Human). Mucin 2
MSGPLNESISCFLKRVDPWVLVPSPSEDYTSSPSEDYTSSPLEDYTSSPSEGFTPSPSEGYASSPSEGYMHALRELCVLTFRGLHALAFRGLHALTFRGLHVLTFRGLHVLAFRGLHTLSFRGLHALAFRGLHVVAIRGLHVLAFRGLHAITFRGLHVLTFRGLH

SEQ ID NO: 205091 - protein, 373 aa, Glycine max
  Coding DNA Sequence Number=SeqID_88313
  Gene Ontology: Mol. function=electron carrier activity; Cellular component=integral to membrane; Biological process=electron transport
  Homolog annotation: Hit_ID=Q6WPM6; Match level="QueryCoverage=98%, HitCoverage=67%, E-value=1e-143, Identity=65%"; Hit description =Putative hemolysin activator HlyB
  Pfam annotation: Domain name=ShlB; Domain location=1-373; Score= -105.3; E_value=6.9e-10; Accession=PF03865.4; Description=Haemolysin secretionactivation prote
GLENLQRLPTVQASMEIVPGETPGQSDIVINRRQERFWRVDASLDDSGSNATGRYQGNLTLSLDDPLALSDLFYLSGSHNLDGNGGKSSKNLTGHYSIPLGYWQLGLTASQYDYVQTVAGANGDYQYSGKSKNVDFQMSRVLHRSGSQKTTLSADVLAREQRNFINDTEIAVQRRQTAAWKLGLQHRHYLGNATLDAGASYQRGTRWFGAQPAPEEQWGEATALSKILQFNAQLNLPFALGGQNFRFTSRYQRQMSSTPLTSPDMFSIGNRWTVRGFDGERTLTASHGWYVRNDIAWSTPLPGQEFYLGADYGEVGGAGSETLVGKHLAGGVAGLRGQYQRASYDLFAGIPLAKPDGFKTDPATFGFSVSWNY

SEQ ID NO: 205092 - protein, 55 aa, Glycine max
  Coding DNA Sequence Number=SeqID_88314
LKHDIKIPNGENARNWVAKVVLKFHDDPTVNESKIVIFLRQVRWPVGKREDFERR

SEQ ID NO: 205093 - protein, 85 aa, Glycine max
  Coding DNA Sequence Number=SeqID_88315
MSGFGQRFGDKGDVPHYFHDTHATMMIRKFYAKLVMHAPMWTLKHQGRSLPPSSPRRAQLAQASKVASSRSNNLLEEESGRPKWA

SEQ ID NO: 205094 - protein, 138 aa, Glycine max
  Coding DNA Sequence Number=SeqID_88316
  Subcellular localization annotation: CTP_CleavageSite=65; ConfidenceScore=5.69e-01
MASPPSSPPPPPPSPSDTSVSPSAVKRTRKATHLRSLSTRPPGAERPVVHIDPATGKADGGRHVRELEGGPYCSEGLDLGGYSEASDDRTKKKLLHTIGERWRQFKSDLIRKWALAADQDGVDDTVCEKYGISKEKWS

SEQ ID NO: 205095 - protein, 152 aa, Glycine max
  Coding DNA Sequence Number=SeqID_88317
  Gene Ontology: Mol. function=RNA polymerase II transcription factor activity; Cellular component=nucleus; Biological process =transcription initiation
  Homolog annotation: Hit_ID=Q4WVB1; Match level="QueryCoverage=99%, HitCoverage=53%, E-value=6e-32, Identity=55%"; Hit description =Transcription initiation factor TFIID 23 kDa subunit, putative
  Pfam annotation: Domain name=TFIID_30kDa; Domain location=1-56; Score= 64.0; E_value=4.7e-16; Accession=PF03540.4; Description=Transcription initiation factor TFIID 23-
IPDAVTSLYLTLAGLPPPGNVPNQTPPHLARLLALATQKFIADIAADSYQYARIRASNSSSASNPMGSLNAASGLGMPAGASGAGAASGAAGASGGDAGKGKANTHLGIQRPGFGGGGSGGSGQGRTVLTMEDLGMAVAEYGVSVKRGEFYR

SEQ ID NO: 205096 - protein, 58 aa, Glycine max
  Coding DNA Sequence Number=SeqID_88318
  Subcellular localization annotation: CTP_CleavageSite=15; ConfidenceScore=5.06e-01
VLGGVSSSSPSTAAVGSSGSGSWAVEAPPSPEGEGWAPGHATCVSNSSMLMMDGGPML

SEQ ID NO: 205097 - protein, 190 aa, Glycine max
  Coding DNA Sequence Number=SeqID_88319
MDQLFTMILAFTSKLQTSVPIRVPNSCDFASLITRIHNTLQLSDKQFLDEIHYRKPFTDTGNQIRFQCMKLINDDDVNTMLMCNDQFSCVGPIELLCTVGRTPDEIINLLERTMPRTHDAILYYNGKWNMPPQNKFVGCAFIGKNPKKFQIPSTCTIDELKNLIKQVAPKGIPPLGIHESQTVLFDGTRE

SEQ ID NO: 205098 - protein, 64 aa, Glycine max
  Coding DNA Sequence Number=SeqID_88320
MASSFLRLSDVWEFYRSSQRSNWRNLREPLEMLLSLAEDTELYMFDESVDVPMRNCYEIDVFLC

SEQ ID NO: 205099 - protein, 234 aa, Glycine max
  Coding DNA Sequence Number=SeqID_88321
  Homolog annotation: Hit_ID=Q1XN55; Match level="QueryCoverage=98%, HitCoverage=98%, E-value=2e-42, Identity=38%"; Hit description =Hypothetical protein precursor
MKKILNIIALFVFFLGFGQIDNIADGESITFRIHYGILTAGNATLTTQKTTYKGAPHLYVKGTGQTSGAVKAFFKVDDLYESFIDIQTGLPSFYVRNVKEGSYRQHFETVFNHDNNTLILTDKKTPANGSKVIKSVKGIQDMLSCFYYLRSQSQTELKVGTENLKTKFGVINCLKIVPSVMSGRVFKDKEGVTMWVSNDANHVPMLLKAELAVGSLKASIDDFKNVKYPLRFSK

SEQ ID NO: 205100 - protein, 75 aa, Glycine max
  Coding DNA Sequence Number=SeqID_88322
MSLHSSSSVNGEGSTLMQSYPARALDRRIQVDWARDPREGPRILMSLRLSSSFFRNLLKESSQGGELSYERGMRI

SEQ ID NO: 205101 - protein, 109 aa, Glycine max
  Coding DNA Sequence Number=SeqID_88323
  Gene Ontology: Mol. function=DNA binding; Biological process=DNA integration
  Homolog annotation: Hit_ID=Q1SIT1; Match level="QueryCoverage=87%, HitCoverage=32%, E-value=3e-16, Identity=46%"; Hit description =Integrase, catalytic region
MDHAGEERKLQLSELDEIRLEAYENAKFYKEKTKKFHDSMIIKKDFMIGQKVLLYNSMLGLMSVEIKSDSTHKSFEVNGHRLNPFLTNPSLVDVVVEETSLLHPTLPPP

SEQ ID NO: 205102 - protein, 58 aa, Glycine max
  Coding DNA Sequence Number=SeqID_88324
  Homolog annotation: Hit_ID=O64438; Match level="QueryCoverage=62%, HitCoverage=15%, E-value=6e-13, Identity=89%"; Hit description=ARG10
CFYSTTVGGLRCYENPKKKITAVPAEEEQIWGAFFKVILELKKLELNIHYVTRIASCN

SEQ ID NO: 205103 - protein, 106 aa, Glycine max
  Coding DNA Sequence Number=SeqID_88325
MGKTHEIPHHNLADFEPWLGYTTEGQAVGGIPYNTLWRALSITHNCTSCIPQRLKTLMTMAGMGKLDHLKERLRAIEGSEDYAFANLGKLFLIPKHGHSQVQGAGL

SEQ ID NO: 205104 - protein, 63 aa, Glycine max
  Coding DNA Sequence Number=SeqID_88326
MFVLNSALKGFDDTPQSKSKAAARWIIVKSSKSETQHGIYKIYSHVIETPPSKSETQHGVHGT

SEQ ID NO: 205105 - protein, 98 aa, Glycine max
  Coding DNA Sequence Number=SeqID_88327
DSTSKNSNAYKSFFAYPLFSHIQLNNQHILLWVDVAHSSIDVYGAETENGVNRRMNRRSNIITIETRQRSSGGAGAGVDFVKGNKDKGEGMLNFVEAW

SEQ ID NO: 205106 - protein, 319 aa, Glycine max
  Coding DNA Sequence Number=SeqID_88328
  Gene Ontology: Mol. function=catalytic activity; Cellular component =beta-galactosidase complex; Biological process=carbohydrate metabolic process
  Homolog annotation: Hit_ID=Q0PKY2; Match level="QueryCoverage=99%, HitCoverage=83%, E-value=1e-110, Identity=56%"; Hit description=Endo- 1,4-beta-mannanase
MNIASDPFTSSKVTTTFQEASQHGLNVARTWAFNDGGYNNALQISPGSYNENVFKYKVESKNKSFMEILSTCKGLDFIISEAGKNGIRLILSLVNNWNDYGGKSQYVQWARERGQYVNNDDDFFTHPIVKEYYKNHVKDWVREKAAYVKSIDSNHLLEGFYGDSMLEKKQFNFGNQVGTDFISNNQVPEIDFATIHLYPDQWVSNSGETAQDDFVSKWVQAHIQDSNDVLGKPILLTEFKKSSRSSGYNVDKRDSYLGKLYNFIFNSASNGGPCAGGLFWQLMAQEMNGLHDGYEVIFDENPSTANVITQQSKKMSNLE

SEQ ID NO: 205107 - protein, 160 aa, Glycine max
  Coding DNA Sequence Number=SeqID_88329
MTGRLLAGSLALESCILHYLIVRILLPRSSNLAQVSEEDLIVMWAFHTGRQIDWAHLVWYRMHKALRLNALLPYPHLVTLFLQHFNISLDSERYVQIKRSFLIGAVVVTSFGYRKERDGSWSILDRFDGLQTYVGERFDALEQQVDMQFDAMDSRITKVE

SEQ ID NO: 205108 - protein, 236 aa, Glycine max
  Coding DNA Sequence Number=SeqID_88330
  Gene Ontology: Mol. function=4 iron, 4 sulfur cluster binding
  Homolog annotation: Hit_ID=Q3BTW5; Match level="QueryCoverage=49%, HitCoverage=29%, E-value=1e-52, Identity=86%"; Hit description =Radical SAM superfamily protein
TSPRCGARSAAPAEAFAGLLGTATALVDAGHQHQRIRRFGCQLQRLARLAFGRIEVADLHVAGGQCQQVLQAHLTPHVVRIADRVDRRFAGAQPGLGLGFAAADRNGQHACEQNQPEARLVELRLAAGAVHHLALELATGSVDVVATGAADHGQHVVVEQDLLEGADMRLFRALVAGTRERVERNQVDLARILGLHRVVELAHQAGQLAGMLGLVVDALHQGVFEGDRFAALVGAQ

SEQ ID NO: 205109 - protein, 135 aa, Glycine max
  Coding DNA Sequence Number=SeqID_88331
  Homolog annotation: Hit_ID=Q1SKD7; Match level="QueryCoverage=96%, HitCoverage=34%, E-value=8e-11, Identity=30%"; Hit description =Ankyrin
MAPKKLSTKRSRRDATAEGSNAAPEFDSHNFRSVGLQQRFEAIKGWSFHRERRVQLREDEYTSFWGEIARRHWTSQVTPMAKFDLEVVLEFYANAWPTEEGVRDMRSWVRGQWIPFDADAFSQFLGDPLVLEEGQ

SEQ ID NO: 205110 - protein, 177 aa, Glycine max
  Coding DNA Sequence Number=SeqID_88332
  Gene Ontology: Mol. function=protein serine/threonine kinase activity; Biological process=protein amino acid phosphorylation
  Homolog annotation: Hit_ID=Q9LFP7; Match level="QueryCoverage=83%, HitCoverage=32%, E-value=2e-26, Identity=42%"; Hit description =Serine/threonine specific protein kinase-like
METTSGAGNRIGYRSARRFKGERNKDVTYEEGSNFLKKLKIFLGCMFFSSKQEDSRSDKSRQGRNVTNDLVRHQPVTQRSLSTKRSKRSSATNLSQEIIQASSLRRFTFNDLKLATRNFESKNLLGEGGFGTVLKGWVNEHENFAARPGTGTPVAVKTLNPNGFQGHKEWLVCDVPF

SEQ ID NO: 205111 - protein, 115 aa, Glycine max
  Coding DNA Sequence Number=SeqID_88333
  Gene Ontology: Mol. function=protein serine/threonine kinase activity; Cellular component=chloroplast; Biological process=protein amino acid phosphorylation
  Homolog annotation: Hit_ID=Q9LFP7; Match level="QueryCoverage=70%, HitCoverage=16%, E-value=8e-24, Identity=60%"; Hit description =Serine/threonine specific protein kinase-like
  Subcellular localization annotation: CTP_CleavageSite=55; ConfidenceScore=5.48e-01
RNVTNDLVRHQPVTQRSLSTKRSKRSSATNLSQEIIQVSSLLRRFTFNDLRLATRNFESKNLLGEGGFGTVLKGWVNEHENVAARPGTGTPVAVKTLNPNGFQGHKEWLVCDVPF

SEQ ID NO: 205112 - protein, 292 aa, Glycine max
  Coding DNA Sequence Number=SeqID_88334
  Homolog annotation: Hit_ID=Q1S7C5; Match level="QueryCoverage=27%, HitCoverage=6%, E-value=3e-11, Identity=42%"; Hit description =Integrase, catalytic region
MKIEHVIKSHKLKRFVVHPQIPLRFLTETDRDAGIEKGVMRAKARQLQTELHEMMLEDKSMRKFFLRIKEISNLLAFVESSISLQEHINAILEGLSQDYHSVISVIDNKFQPLPVEEVEVNPNSSLSFGFDPYAASNKFSQWYDSENFRGNFGRGGSFNRGGRVVVWRRLWPCRRMLCKFSMSSVLQILAYSICLSLLYSNQGNNSGQNNYGQNNCFRSSNSWNQGTNQNRSMQSSQNQQPPSAMIATPIFSLDPLQPGFQIQGANEVLLQGSLGPDGLCLSKSSTPRLNCC

SEQ ID NO: 205113 - protein, 323 aa, Glycine max
  Coding DNA Sequence Number=SeqID_88335
  Gene Ontology: Mol. function=chromatin binding; Cellular component =chromatin; Biological process=chromatin assembly or disassembly
  Homolog annotation: Hit_ID=Q1SAV4; Match level="QueryCoverage=69%, HitCoverage=63%, E-value=5e-64, Identity=50%"; Hit description =Integrase, catalytic region
  Pfam annotation: Domain name=rve; Domain location=82-215; Score=37.7; E_value=4.1e-08; Accession=PF00665.16; Description=Integrase core domain
MASIPPWTPIHDPDRPLKFKGIDDPDHSNARTTILSIQIIGANFTWDHLGRDVKSFIKNCQTCQQIKHATRKLAGLLQPLPIPTGIWEDLSLDFITNLPSSQGYTVILVMVNQFSKGMHFGSLSSHFTTFKVAALFLDTVYKLHGFPRSLVFDRDPIFVSQFWSELFKLSGSSLQMSIAYHPQSDGQTKFLALTEWSYNMSTHSSTGLTPFKVIYSKPLSFVLGYILGSSRNEVVDSILMIRAILHNALKHCLLKAQENMKRLADAKHHDDNFKLYHDPLPPSSMPVPPLAYNHHPILEPLSILAHRMDTTTTPPTQMVLVQW

SEQ ID NO: 205114 - protein, 100 aa, Glycine max
  Coding DNA Sequence Number=SeqID_88336
  Gene Ontology: Mol. function=RNA-directed DNA polymerase activity; Cellular component=chromatin; Biological process=RNA-dependent DNA replication
MAEEDIAKMAFRTHHSHYEYRVMPFGLCNAPSTFQATMNAVLWPFLRKFTAIFFNDILVYSASLSAHLIHLEQTDASGSAIGIVLMQKGRPIAFFSKQFS

SEQ ID NO: 205115 - protein, 173 aa, Glycine max
  Coding DNA Sequence Number=SeqID_88337
  Gene Ontology: Mol. function=ribonuclease H activity; Biological process=RNA-dependent DNA replication
  Homolog annotation: Hit_ID=Q1RYI2; Match level="QueryCoverage=84%, HitCoverage=22%, E-value=1e-19, Identity=36%"; Hit description =Ribonuclease H
MVRDANHALLMEGLHDLWSKSLGPNIDVATWVFLLLIRRGLAQTSGKGIVSCWDDIGKNMCWQIGNGRIVYFWKDNWIPTLGSLCDQVSSSDITSQIELSTCMFVESSGQWDTRYRGNFLPHSIIDKICSINLPLGSKGEDTADWNLSSDGEFSTKLAYESIIGCMSNVDIGK

SEQ ID NO: 205116 - protein, 161 aa, Glycine max
  Coding DNA Sequence Number=SeqID_88338
  Gene Ontology: Mol. function=RNA-directed DNA polymerase activity; Cellular component=chromatin; Biological process=chromatin assembly or disassembly
MVIHAHPPIAILLLRQEHWGGKKVVANTNHARTKVSVGANIYEAGGRLKRYMMNNVARWGKGCWSEEDGANLVLMEQRRYGSILDHSFKLLGRAWIGPLGTSTQISTEGRECWHHPRIEPLPTMTYNDDVSSMDKVKNLATQGWIKLWVLPLFIRIVRHAW

SEQ ID NO: 205117 - protein, 178 aa, Glycine max
  Coding DNA Sequence Number=SeqID_88339
  Gene Ontology: Mol. function=RNA-directed DNA polymerase activity; Cellular component=chromatin; Biological process=chromatin assembly or disassembly
MAEHGTRKTTIDRLEDASSRLTVHHESLASKHSDLASKVDTLHNQAFKVGTLLNRLNHLHTMPTVPPISPHPSRPHVKLDAMRFNSNDPLGWIFKISQFFDYQGMPEEECITVTSLYKDGPALSRFQCSNWNNFITSWPGFLQALESHFAPTYYDDPKGALFKLSQRGFVNQYPCRKP

SEQ ID NO: 205118 - protein, 77 aa, Glycine max
  Coding DNA Sequence Number=SeqID_88340
MGRGMLKITTVQLVDDEDIKEFDAIKDQPHPYLSIPPIEPTSSTQPNELEFTIEFVLPNKELDSFSEDEDDVLHNQP

SEQ ID NO: 205119 - protein, 143 aa, Glycine max
  Coding DNA Sequence Number=SeqID_88341
MHCKAWLGKQKAIENIYTNWERLYHDLPRLLQVKQQFLPGMVAGKETLPMPPQESQAVEEFQTVYQWVSILQAHGLGRWNIIVRILKLYVYNYSTYARIKPTFNHHYNILREEVDIDQAINWLNEISREKWTFHGMVADDGST

SEQ ID NO: 205120 - protein, 113 aa, Glycine max
  Coding DNA Sequence Number=SeqID_88342
  Homolog annotation: Hit_ID=Q0WMY5; Match level="QueryCoverage=74%, HitCoverage=9%, E-value=1e-23, Identity=58%"; Hit description =Membrane-associated salt-inducible protein-like
MRAVEFDGVEFHGRVLTVKLDDGKKMRERSEERARWLQGNGGDKGEYPSTRHKERDGSRKSFQKVLETQPENWQAVVTAFERIKKVHYLVLYAILILVVASINSLLCLEGLLV

SEQ ID NO: 205121 - protein, 135 aa, Glycine max
  Coding DNA Sequence Number=SeqID_88343
  Gene Ontology: Mol. function=nucleic acid binding
  Homolog annotation: Hit_ID=Q0WMY5; Match level="QueryCoverage=77%, HitCoverage=55%, E-value=1e-34, Identity=51%"; Hit description =Membrane-associated salt-inducible protein-like
  Pfam annotation: Domain name=PPR; Domain location=39-73; Score=34.7; E_value=3.1e-07; Accession=PF01535.11; Description=PPR repeat
  Pfam annotation: Domain name=PPR; Domain location=4-38; Score=20.8; E_ value=0.005; Accession=PF01535.11; Description=PPR repeat
  Pfam module annotation: Pfam domain module=PPR::PPR; Domain location =39-73::4-38
PARKEYGLMVKYYARRGDMHHARQTFESMQARGIEPSSHVYSSLIHAYAVGRDMEEALHCVRKMKEEGIEMTIVTYSIIVGGFAKMGKAETLIPCQREKLKGVQIDFYAASVDFHFGSRLPVQCTGVNLLSLKDS

SEQ ID NO: 205122 - protein, 73 aa, Glycine max
  Coding DNA Sequence Number=SeqID_88344
RAFAKHDTVCLSARKNPEEDKLSGSLSAPLQVIKCTASAHLLSERRVLSHNPLMCAKRSRFVLSARARTNPPI

SEQ ID NO: 205123 - protein, 259 aa, Glycine max
  Coding DNA Sequence Number=SeqID_88345
  Gene Ontology: Mol. function=serine-type endopeptidase activity; Biological process=proteolysis
  Homolog annotation: Hit_ID=Q5GVL7; Match level="QueryCoverage=58%, HitCoverage=22%, E-value=1e-49, Identity=67%"; Hit description =Prolyl oligopeptidase
DEAANVVRKQAVITLPGPVVPFVLVQSIQVKHGLPLLGDLPVLGQGGVGPQAALVLLVLPEVVVVVADLLHAGNLGIGVEHLADAGLHLLEGRGLRQARLGLGVLFLDPARRSDRCLQRPRRSPPRQRSSCRPAGRRKQVETLQLQAVISRGTLAWIAAAAPVSKVRPRRSSRDGLAPPRRYGDAPVHRYDAPAAATTSAATGSAATPTRPPAACPPATSAANPARHCCRARPARPVPVPRRPGPAAARCAAGGGRGIL

SEQ ID NO: 205124 - protein, 161 aa, Glycine max
  Coding DNA Sequence Number=SeqID_88346
PRVGSRAPGHYYHGYYRPEPKEGKERTKARSSLAIHSEGGWGSTSFMTHGPIETRFSDMDFFEMVNHFFNREREVIQNPLAPVQNRWKFPTPIPQRRLSVHFPEIEEIYSSVAENIMSRDLEISAEISIEPSADGAGNNGWHRSLSHARRCISGTGQALRE

SEQ ID NO: 205125 - protein, 56 aa, Glycine max
  Coding DNA Sequence Number=SeqID_88347
  Subcellular localization annotation: CTP_CleavageSite=26; ConfidenceScore=5.06e-01
MYLHQDGFLLKLSSLPAHPSSRFFLALSRKSGALSRWIAKPTDWLSEKLKISTSQT

SEQ ID NO: 205126 - protein, 100 aa, Glycine max
  Coding DNA Sequence Number=SeqID_88348
MEQNRLRPRLEVKTSQWQKSTKDRVTADRCPFPTLDKQRTTLHGSPANANPGGGGTFSSPKTLPPHFKNPQAHGNYENSSPQASIVEFLLPFSRFNSLPT

SEQ ID NO: 205127 - protein, 89 aa, Glycine max
  Coding DNA Sequence Number=SeqID_88349
  Subcellular localization annotation: CTP_CleavageSite=29; ConfidenceScore=5.31e-01
MSPPPLGPLNHSQTQLMLSGRLPFPALVSANLHTTKSLKLSGIWTSLSRTEDMQEILKKNGQTPPLNMILGLNRWLCSCSCANGLKQCA

SEQ ID NO: 205128 - protein, 126 aa, Glycine max
  Coding DNA Sequence Number=SeqID_88350
  Gene Ontology: Mol. function=transporter activity; Cellular component= integral to membrane; Biological process=transport
  Homolog annotation: Hit_ID=Q0MRN2; Match level="QueryCoverage=99%, HitCoverage=99%, E-value=3e-45, Identity=94%"; Hit description =Plasma membrane intrinsic protein 1;3
  Pfam annotation: Domain name=MIP; Domain location=1-116; Score=-1.2; E_value=9.4e-10; Accession=PF00230.10; Description=Major intrinsic protein
MEGKEQNVSLGANKFSERQPIGTAVQSQDDGNRHGYAATDAKCNARDSHVPILAPLPIGFAVFLVHLATIPITGTGINPARSLGAAIIFNKDLGWDDHWIFWVGPFVGAALAALYHQVVIRAIPFK

SEQ ID NO: 205129 - protein, 468 aa, Glycine max
  Coding DNA Sequence Number=SeqID_88351
  Gene Ontology: Mol. function=acyltransferase activity; Cellular component=nucleus; Biological process=regulation of transcription, DNA-dependent
  Homolog annotation: Hit_ID=O04201; Match level="QueryCoverage=96%, HitCoverage=96%, E-value=1e-139, Identity=55%"; Hit description =Putative anthocyanin 5-aromatic acyltransferase
  Pfam annotation: Domain name=Transferase; Domain location=11-463; Score=337.9; E_value=1.7e-98; Accession=PF02458.6; Description =Transferase family
  Subcellular localization annotation: CTP_CleavageSite=14; ConfidenceScore=5.08e-01
MSYSSSAFPSVVSKCTVVPHRNSTMGDLKLSISDLNMLLSHYIQKGCLFTTPSLPSSALIPHLKNALSQTLSLFPPLAGRLKTDADGYVYITCNDTGVDFIHVTAADISVADLLSPSSSSSSSDVPPIFKQLFPFHHKISYTAHSSPIMAFQVTDLADGIFLGCAVCHAVTDGASFWNFFNTFAGISRGATTSPSTLPDFRRESILNSNVVLRLPEEIKVTFNVEEPFRERIFSFSRESIQELKATVNNNGLTSFPPPENGDAVELMAKMSNDTQPKTVTTTEISSFQSLCALVWRCVTKARNIEGSKTTTFRMAVNVRQRLEPKLGDCYFGNAIQSIATCAEAADVASKELRWCAEQLNKSVKAFDSATVHRNVENWERQPKCFELGNHDGATVQMGSSPRFPMYDNDFGWGRPLAVRSGGANKFDGKMSAFPGRNGGGAVDLEMVLAPDTMARLESDSEFMFYVSG

SEQ ID NO: 205130 - protein, 116 aa, Glycine max
  Coding DNA Sequence Number=SeqID_88352
  Gene Ontology: Mol. function=transferase activity; Cellular component= nucleus; Biological process=regulation of transcription, DNA-dependent
  Homolog annotation: Hit_ID=Q9LFB5; Match level="QueryCoverage=91%, HitCoverage=22%, E-value=3e-35, Identity=64%"; Hit description =Anthranilate N-benzoyltransferase-like protein
MELKLQKQLNKSVKAFDSATVNRNVENWERQPKCFELGNHDGASVQMGSSPRFPMYDNDFGWGRLLAVRSGGANKFDGKMSAFPGRNGGGTVDLELFSASNKMARLESDSEFVGTR

SEQ ID NO: 205131 - protein, 76 aa, Glycine max
  Coding DNA Sequence Number=SeqID_88353
MLQPCGIGTNLKEHSNWVTPKAYTLKSSSGPLPPDSDNVHELYNTNNLTLIFQTCLTSCATVQPFRILTRNPTIFL

SEQ ID NO: 205132 - protein, 233 aa, Glycine max
  Coding DNA Sequence Number=SeqID_88354
DSSIDLALVKEFYANLYSPEGPSLKQVRIRGHLIKIDADSLNTFLEKPVVLAEGESLPVYSRYYRKPTDIREIEAALCIPGRGFGLNDEGHHGKILKKDLTTLAQVWSVLLCSNLAPTSHTSDLTLDRARLIFGLVSQLDMNVGALISSQITSMAQSNSSRLGFPALITALCRSRGVASDSLVFERLSLVINLAYIRKSYWNHADLTVTIRGARRARARPAEAPSTSAAPPTA

SEQ ID NO: 205133 - protein, 145 aa, Glycine max
  Coding DNA Sequence Number=SeqID_88355
  Gene Ontology: Mol. function=sequence-specific DNA binding; Cellular component=nucleus; Biological process=regulation of transcription, DNA-dependent
  Homolog annotation: Hit_ID=Q8H1D2; Match level="QueryCoverage=93%, HitCoverage=72%, E-value=3e-40, Identity=61%"; Hit description =WUSCHEL-related homeobox 5
  Pfam annotation: Domain name=Homeobox; Domain location=22-83; Score =57.5; E_value=4.3e-14; Accession=PF00046.19; Description=Homeobox domain
MEEGMSEFCIRGGNSGSATGTKCGRWNPTTEQVKVLTDLFSSGLRTPSTDQIQKISNQLSFYGKIESKNVFYWFQNHKARERQKRRKVDNDVIRSENSISINSFTQTDFTQLYQVSEPERVMETLQLFPLNSFGESESKNMRVHA

SEQ ID NO: 205134 - protein, 92 aa, Glycine max
  Coding DNA Sequence Number=SeqID_88356
MRIDEFCALCHSDFANWVINAHRGILRPLSFRNNKLGGKHAETDYAPFIIQEQQAEWVNAQRQILRPLSFRFRKSSDKHAETDSAPFVIRGQ

SEQ ID NO: 205135 - protein, 161 aa, Glycine max
  Coding DNA Sequence Number=SeqID_88357
  Gene Ontology: Mol. function=protein dimerization activity
  Homolog annotation: Hit_ID=Q1SCU4; Match level="QueryCoverage=65%, HitCoverage=24%, E-value=9e-14, Identity=40%"; Hit description=Zinc finger, BED-type predicted; HAT dimerisation
  Pfam annotation: Domain name=zf-BED; Domain location=57-102; Score =23.2; E_value=0.00092; Accession=PF02892.5; Description=BED zinc finger
MIEAQSSNNPTNTKVPPTPTPHSSSSRETRGIEEKLETHDQPVKAECVSPNKRGLTSKAWIHFKSQKIDEKWKAICKYYDKKLVGETKQGTKHLHGHIRSCKLHTVRGPRQSILKTMEQSTSSTGNTPESVVVGNYSFNQDDSMKELATKVWMTPLPGEGR

SEQ ID NO: 205136 - protein, 83 aa, Glycine max
  Coding DNA Sequence Number=SeqID_88358
MEADKDVPIIFGRPFLSTCDSLVKGVFPSVGKQDPPSMKMIPNDPGWNKKKGDSNTIQALGYGVDDYTRGSVKKREITLFEVC

SEQ ID NO: 205137 - protein, 158 aa, Glycine max
  Coding DNA Sequence Number=SeqID_88359
MTNKDTLGCSGQRGTRDLGELVSSDYPIFGALIWCGELTGLALLFLTGSKTTLFELRVFEEKSTHPYNQQLSGSRDVEEWFKDINFYLGMEVPHDAQEFIVTPMRFDVRGNVLSWRFKLVRSMQVIEDRGDHTNMMPKEEEEYRELLRDLEPSSKEED

SEQ ID NO: 205138 - protein, 53 aa, Glycine max
  Coding DNA Sequence Number=SeqID_88360
MSLKPAGLLDLIMADIGVTEQMTIQLSKKAPREGRDLNRWYQVKAEWERLIQI

SEQ ID NO: 205139 - protein, 83 aa, Glycine max
  Coding DNA Sequence Number=SeqID_88361
MYGREFTYSKNRPSTGEDLSRRRNDYELQQFRLWFSIRGVSDWMAVAEQLTGWKHLRLRCDGNAMNMEMMALNRVTDLFAREK

SEQ ID NO: 205140 - protein, 194 aa, Glycine max
  Coding DNA Sequence Number=SeqID_88362
  Gene Ontology: Mol. function=DNA binding; Cellular component=beta -galactosidase complex; Biological process=DNA integration
  Homolog annotation: Hit_ID=Q1SD84; Match level="QueryCoverage=78%, HitCoverage=11%, E-value=1e-27, Identity=39%"; Hit description =Integrase, catalytic region
MADSSSVTGDDQNSQPPKHEQRESLGYLTSKRPKPDTTDPQHTVRAAENSMVMTWLVNSMEEDISNLGNKSQIYELTLQAREIRRGNNVTRYFHSLKRVWQDLDLFNNYNWMSAEDAKHYQQTVEEGRAFQFLAGLNEELDEVRGRIIGMATLPSLGEIFAEVRREETRRSVMMGKMKVDPPLETNALAVEATA

SEQ ID NO: 205141 - protein, 56 aa, Glycine max
  Coding DNA Sequence Number=SeqID_88363
MRAIARVMSEIKEVQQEMKANIESTKEQMTTMMEPMMSMRRMMEVNAATVVVAREL

SEQ ID NO: 205142 - protein, 243 aa, Glycine max
  Coding DNA Sequence Number=SeqID_88364
  Gene Ontology: Mol. function=DNA binding; Biological process=DNA integration
  Homolog annotation: Hit_ID=Q1SAZ0; Match level="QueryCoverage=52%, HitCoverage=9%, E-value=3e-17, Identity=37%"; Hit description =Integrase, catalytic region
DQTSGKMIGGAKMMDGLYYFEDAFKNKVAQGLSDPEIDKGNPVPDLGGAQTGKEIPQSKKEFHVYARKYHKKTRNQFIISASSQPEIPKDGPAEIPQELPGNTEIPTSNTDLPIKPAKPSTNHPISKYVSYQNLSQNHQAFTCKITNLFVPRNIEEALDDPNWKLAILEEQDALKKNGAWENVSLPHDKKASRVVPEVLIYKGYYSITSSPQVVNEELLMWCTLLLFYLYYPLQKQKTLSDIA

SEQ ID NO: 205143 - protein, 102 aa, Glycine max
  Coding DNA Sequence Number=SeqID_88365
MPKRNQTGPNNNQTGSPKDKGHDGEVAGEWVTGKQHHTPERRVRESHETEKKHAWEHMWQHMGDDGQRSLARKRGDSVAANWWQRGWAALLTVKPKGLKEKP

SEQ ID NO: 205144 - protein, 122 aa, Glycine max
  Coding DNA Sequence Number=SeqID_88366
MKADDHDRLRMPTDSIVSGKAKKTAKETLIVLKTMKSDDNDRLRMPTDSIVPWKAKKTEKEIVIVMKTMQADGHDCLRMPMDSIVSWKGKKTEIVMKIVKADDHDRLRMPTDLIVYGRQRRH

SEQ ID NO: 205145 - protein, 77 aa, Glycine max
  Coding DNA Sequence Number=SeqID_88367
MSMRKCSIGVVRVNENMPVSAEAQLRLSSHEKAMPTYIKNISRGYLTTDVRVNENMPVSAEAQLRLSSHEKAMPTYI

SEQ ID NO: 205146 - protein, 173 aa, Glycine max
  Coding DNA Sequence Number=SeqID_88368
  Homolog annotation: Hit_ID=Q47522; Match level="QueryCoverage=29%, HitCoverage=64%, E-value=5e-24, Identity=100%"; Hit description=LacZ protein
MYKFLEIHNIPKLNQEESVNINRPIINSEIESVIKNLPTKKNPELDGFTSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 205147 - protein, 111 aa, Glycine max
  Coding DNA Sequence Number=SeqID_88369
MLKDLEISLEVEPMVLKESTVGSGKCVNKEEDQQVPIILGIEDVCKGVYTLREGKKQMFYYIQGIEDFPNESAHQQHLNNPHVIHQAIGVKEALIGRQPSFLTLTFYITFI

SEQ ID NO: 205148 - protein, 309 aa, Glycine max
  Coding DNA Sequence Number=SeqID_88370
  Homolog annotation: Hit_ID=Q1SIB8; Match level="QueryCoverage=33%, HitCoverage=72%, E-value=2e-14, Identity=40%"; Hit description =Ankyrin
  Pfam annotation: Domain name=Ank; Domain location=197-232; Score =20.3; E_value=0.0069; Accession=PF00023.20; Description=Ankyrin repeat
MVILQEKGKKKDHQQNFFTSTSRGTASGLAAEGTEFLDQAAGCHYVGVRIPNPTIVSGGWSATLVKSPTFPTKKLIIVGFRVGSREEISLVVLGGSEEYASGLLEYQVVVVLDRISYGSNLCWGSELGLFGSSVSKFEKQNLDGFYNSILLELSAFDDYEDFRGEVDEKGLDVNEVLNYILLEKGGGVDVNRVWGSDRAIALHCAIAGGPKSSLEIVKLLLDVGANAECLDASDNKSEDLDVECDQGGYEMKFMEGFVQTIEQFKSTDKLEEGEPDVAPCGACRPWIFFINGVLCFLKINGSRMEKEKR

SEQ ID NO: 205149 - protein, 152 aa, Glycine max
  Coding DNA Sequence Number=SeqID_88371
  Subcellular localization annotation: CTP_CleavageSite=52; ConfidenceScore=5.12e-01
MDEPLSKAAPTQHHPPPTLIAPKATSVMENVTKRLALKKQQQKPSSTAQCLRAINETKSEDDRPLVFRKRKVAPPSDETSMTQWSLQSPFLLLHSTAIDLQEAKDSIDEEDPRPTSSTWSYIRLPFLLLNLVQPNGKQTGKERSLETKASRG

SEQ ID NO: 205150 - protein, 170 aa, Glycine max
  Coding DNA Sequence Number=SeqID_88372
RMQGLDWLPSLRTTKGVEVEAPEEDEKENAKLRDVNTATTKALEQETKRDRREEHGRNKFRGALWGNNSELKLQREERDQSRVNSLILKDELNVCLRSKRSLSQRLCETETNMLAIINKYQEELNLAMPEYTQKKRLGERSQELPRLLAKAKAMADTYSAPEEIHRLLSY

SEQ ID NO: 205151 - protein, 178 aa, Glycine max
  Coding DNA Sequence Number=SeqID_88373
  Homolog annotation: Hit_ID=Q5W7C9; Match level="QueryCoverage=53%, HitCoverage=33%, E-value=6e-21, Identity=61%"; Hit description =Unknow protein
  Subcellular localization annotation: CTP_CleavageSite=51; ConfidenceScore=5.19e-01
MLIPRIPSLLLLREKKFMTRRPSTFTRHCSVRLSPIAENSPLLPPTRAPPRADSSFCSSAYGVLAAVSSCCSPPKGRFLRVTHPSATGNTTSRPTCMYKADSEFSSIPRHNLYPGASYSTGVRSQKYSPPTPRVIPRASYPFSIIIRSRHTNRKTYIGFRDNQARTDNFHHVKVTLYR

SEQ ID NO: 205152 - protein, 235 aa, Glycine max
  Coding DNA Sequence Number=SeqID_88374
NTGVQTDDVGFMLVDLKKIAYQNDPFIMAEQAKQVFYVQDPSDETWKMVTPPNSPPPPTGAASQSRSTLKQTRKAIWLRSLATRPVGAERPLVHVDTMTGKADSPHRKKLRTYLGIIARDKAEFDIPEALDPRTKKKILQTMGERWRQFKSDLTSKWALAADKESVEDTVCEKYDISKKKWAPILSDLQRPPFVGDVRKKTHVIQKQNTAPHVLSRGGYEYLENKLMDEKRKKKL

SEQ ID NO: 205153 - protein, 357 aa, Glycine max
  Coding DNA Sequence Number=SeqID_88375
  Gene Ontology: Mol. function=DNA binding; Biological process =regulation of transcription, DNA-dependent
  Homolog annotation: Hit_ID=A0B3A6; Match level="QueryCoverage=58%, HitCoverage=88%, E-value=9e-77, Identity=69%"; Hit description =Transcriptional regulator, IclR family
  Pfam annotation: Domain name=HTH_11; Domain location=11-64; Score =11.8; E_value=0.0046; Accession=PF08279.2; Description=HTH domain
  Pfam annotation: Domain name=HTH_IclR; Domain location=8-95; Score =112.4; E_value=1.3e-30; Accession=PF09339.1; Description=IclR helix -turn-helix domain
  Pfam annotation: Domain name=IclR; Domain location=124-222; Score= -12.4; E_value=0.0025; Accession=PF01614.9; Description=Bacterial transcriptional regulator
  Pfam annotation: Domain name=Ribonuc_L-PSP; Domain location=237-350; Score=87.1; E_value=5.3e-23; Accession=PF01042.11; Description =Endoribonuclease L-PSP
  Pfam module annotation: Pfam domain module=HTH_11::HTH_IclR::IclR::Rib onuc_L-PSP; Domain location=11-64::8-95::124-222::237-350
MGNEGVNAVEKALSLLDCFKPGEESLSLTALSQLSGYHKTTVYRLMNSLERMGYVVRSDSGVYTLGPRLLYLGKLYEQSFHLASVVQPELQALATATNESASWYVLDNGQRLCLFRAESSDGLRHTRLPGTIFPLDNSAISKVLRFWGMNENLFDALPSLPIFSSGARDPHIAAFAVPVFAENDRLTAALALTGPVSRLTLNRKDEELGVLMREAAARLPAALLRIFQSNTSVNAVFPAALSPAVRAGNTVYVRGQIGTDFEGNLVGLGDPAAQAEQAMKNVKQLLEEAGSDLSHIVKTTTYIIDPRYREPVYQVVGKWLKGVFPISTGLVISGLGQPQWLMEIDVIAVIPDDWQPQ

SEQ ID NO: 205154 - protein, 188 aa, Glycine max
  Coding DNA Sequence Number=SeqID_88376
  Gene Ontology: Mol. function=methyltransferase activity
  Homolog annotation: Hit_ID=A0B3A5; Match level="QueryCoverage=95%, HitCoverage=77%, E-value=1e-51, Identity=60%"; Hit description =Dimethylmenaquinone methyltransferase
  Pfam annotation: Domain name=Methyltransf_6; Domain location=2-144; Score=117.3; E_value=4.3e-32; Accession=PF03737.6; Description =Demethylmenaquinone methyltransferase
MSPVVAAPLHGRVKPLSPQMKVAGPAITVEVRPGDNLAIHAALAIAQPGDVLVVDGKGDISCALLGEIMATQAEASGIAGIIIDGAVRDADALAQGSYPVFAAGLNPSGPTKSIPGRVNHPVSVAGASIEPGDLVVGDADGVVVIAKQDVERIIALAAKKLDAETRRIAGIKQAICVRAGWKVLCARR

SEQ ID NO: 205155 - protein, 67 aa, Glycine max
  Coding DNA Sequence Number=SeqID_88377
  Homolog annotation: Hit_ID=Q6JJ29; Match level="QueryCoverage=98%, HitCoverage=21%, E-value=3e-07, Identity=39%"; Hit description =Prephenate dehydratase
MEVTKLHCSHACDPCHATELSCLRTQMEDHALKEVLVDTKEHEDVMVYWELDLTDDVAVVAKEEVEI

SEQ ID NO: 205156 - protein, 93 aa, Glycine max
  Coding DNA Sequence Number=SeqID_88378
PPSLLNNEFASKSTRRTEVISDTLLVNRICPFQDLVIGPLQSSFIPGKGTTDNALIAQEVVHQMHKKQEILALMIQEKVSSGEWHYENFKQRV

SEQ ID NO: 205157 - protein, 176 aa, Glycine max
  Coding DNA Sequence Number=SeqID_88379
MATMMEAMTSMKKILEANAVIVAATSTVAKANPMPPSGLKQMYHPTSDMVGKDLGSTDDPMMCKFKTSMPSRHMACLPMWRTLPMRMSITLLPYSLRANNPKTDHAHVSQPMGEAHEIPHHNLADFEPCLGYATEGQAVGGIPMPNTLKGPQFRPQPQPLHFAVVRAPPAMPEKGK

SEQ ID NO: 205158 - protein, 171 aa, Glycine max
  Coding DNA Sequence Number=SeqID_88380
MAYMDWLGLAGLVMMQYPTTNNGFMNAFVESKLINDVLSTFDRVMMKILLMTRLGIPTEEETIEATIAGARVKLTWLAELHQWNVALGSCMWAATTYLLPLVDSMILADKSSTHIHVAYLLYLNNLDACHDYAWGVTTLATNALDDSIVSRWKSVRGYMYALLIKDKLDDL

SEQ ID NO: 205159 - protein, 190 aa, Glycine max
  Coding DNA Sequence Number=SeqID_88381
MKVDRLLVDYLEASLEARHCCDTILQAIHQTRFAYARVTNVVVKLSQTTSYDDDQSQNPIHTQLSSFFCDIYSRQIHDPLTYAIVKEKENSKNINYKACLQEGRDLSGVSIRERFNTTTNSCMKLCEQLDVAAKRVYVVINELDTMSRTIKRLDDEVEHWREIADICVKNYCKCEILKRIVKEFQDNKSN

SEQ ID NO: 205160 - protein, 126 aa, Glycine max
  Coding DNA Sequence Number=SeqID_88382
  Homolog annotation: Hit_ID=Q2HUF7; Match level="QueryCoverage=41%, HitCoverage=22%, E-value=5e-10, Identity=60%"; Hit description=Enoyl- CoA hydratase/isomerase
  Subcellular localization annotation: CTP_CleavageSite=49; ConfidenceScore=5.11e-01
MNRQKYPSFISFTHERGTPTPLSNPSAPPSLRHPHVALISLPMSIIIVVNGHASAVGFLFAINHDYVLMHNDKGVLYISQRNPLSSIATKAANSWLWFLMRSREKRDLGGYQLCENGKKGFACEDD

SEQ ID NO: 205161 - protein, 238 aa, Glycine max
  Coding DNA Sequence Number=SeqID_88383
MPKPMKRLNWEIDQSRNWSSIYSSNKILEVTHALNVSAMKGQRLWENARNPSFVLPLGCGKLGHNLRKCDLPPPVVEEQENEGTVIQPVNEGHAKGDTVVKSTVAINDNIVIVIQSQQAKNELVIKVQQPEEMIPKGGHLNKRKQVLKQLLKHNQLLKQFLNHNQLHNLLLKHNQLLKQLLDHNQGTGTRTKKVSQQTGDRRVEDNAEVISPLTRVTRSKGKTTSKGNSLSVGQQGNT

SEQ ID NO: 205162 - protein, 53 aa, Glycine max
  Coding DNA Sequence Number=SeqID_88384
MTNENLLVGKLLVADRAYREGYIAIIMPKPADWLKVKASLVSLQEYKKLREVN

SEQ ID NO: 205163 - protein, 255 aa, Glycine max
  Coding DNA Sequence Number=SeqID_88385
  Gene Ontology: Cellular component=extracellular region; Biological process=cellulose and pectin-containing cell wall organization and biogenesis
  Homolog annotation: Hit_ID=Q8GZD3; Match level="QueryCoverage=99%, HitCoverage=100%, E-value=1e-132, Identity=84%"; Hit description =Expansin
  Pfam annotation: Domain name=DPBB_1; Domain location=64-152; Score =175.6; E_value=1.2e-49; Accession=PF03330.8; Description=Rare lipoprotein A (RlpA)-like double
  Pfam annotation: Domain name=Pollen_allerg_1; Domain location=163 -240; Score=156.3; E_value=7.8e-44; Accession=PF01357.11; Description= Pollen allergen
  Pfam module annotation: Pfam domain module=DPBB_1::Pollen_allerg_1; Domain location=64-152::163-240
MAKVMFVLVSFLVLCCYTINTCAFSSSGWTNAHATFYGGSDASGTMGGACGYGNLYSTGYGTDTAALSTALFNDGASCGECYKITCDYQADPRWCLKGASVTITATNFCPPNFALPNNNGGWCNPPLKHFDMAQPAWEKIGIYRGGIVPVLFQRTPCVKKGGVKFSVNGRHYFELVLISNVGGAGSIQSVSIKGSKTGWMTMSRNWGANWQSNAYLNGQSLSFRVTITDGVTRLFQDVVPANWAFGQTFPTSVQF

SEQ ID NO: 205164 - protein, 110 aa, Glycine max
  Coding DNA Sequence Number=SeqID_88386
MSTINKDHIVDESNRSETKLVEEEEEEEDLQKLLVPDVQNLPLIPPSAVETNFATYFALDFMKPAHDHLCVIGLAPSHVAFKDEGGITAVDFNVGKSDRSGMKVTGKRKK

SEQ ID NO: 205165 - protein, 258 aa, Glycine max
  Coding DNA Sequence Number=SeqID_88387
  Gene Ontology: Cellular component=extracellular region; Biological process=cellulose and pectin-containing cell wall organization and biogenesis
  Homolog annotation: Hit_ID=Q8GZD3; Match level="QueryCoverage=91%, HitCoverage=92%, E-value=1e-112, Identity=76%"; Hit description =Expansin
  Pfam annotation: Domain name=DPBB_1; Domain location=67-155; Score =176.1; E_value=8.8e-50; Accession=PF03330.8; Description=Rare lipoprotein A (RlpA)-like double
  Pfam annotation: Domain name=Pollen_allerg_1; Domain location=166 -243; Score=154.7; E_value=2.5e-43; Accession=PF01357.11; Description= Pollen allergen
  Pfam module annotation: Pfam domain module=DPBB_1::Pollen_allerg_1; Domain location=67-155::166-243
MTTTTVMLVLVSFLVLCCFTISNCGFSPSGWNSAHATFYGGIDASGTNGGACGYGNIFSATGYGTDTTALSTALFNNGASCGECYKITCDYRTDPKWCLKGKSVIVTATNFCPPNLSLSPNKGGWCNPPLKHFDMSQPAWEKIAIYRGGIVPVFYQRVPCARQGGVRFTMNGNNYFELVLITNVGGAGSIKSVYIKGSKTGWMAMTRNWGENWQSNEYLNGQSLSFKVTTTDGVTRLFRGVVPANWAFGQTFPTRVQF

SEQ ID NO: 205166 - protein, 139 aa, Glycine max
  Coding DNA Sequence Number=SeqID_88388
  Gene Ontology: Mol. function=nucleic acid binding; Cellular component= outer membrane-bounded periplasmic space
MATCKIIVIWLKVVYIDVTGKFYGAQTRNLSRASVIEEVAESATQVVGSSYYNTIKNAFNDTKTDIQTRVSFKFNSSLFENAVCCFERGVWTPFFYVNGFLLPDTGGAVDYKTWRKVIDPLVGAKNKSIQNEESLHFFL

SEQ ID NO: 205167 - protein, 144 aa, Glycine max
  Coding DNA Sequence Number=SeqID_88389
  Gene Ontology: Mol. function=metal ion binding; Cellular component =integral to membrane; Biological process=ubiquitin cycle
  Homolog annotation: Hit_ID=Q8L9W3; Match level="QueryCoverage=57%, HitCoverage=57%, E-value=3e-21, Identity=64%"; Hit description=RING -H2 finger protein ATL5J
MASEFSGALGSEDLRVQLGPTNGANRVLREPGVSALDMKSMVATGDHSSRLLALDLVEADGAFGAQDEFFAASPTPKRIDPYQLRASPVDRQWGVGCGGSTQEIGYWRQLPSISQIHTALCLVLYGKTKIESEIPVRVNRRVES

SEQ ID NO: 205168 - protein, 40 aa, Glycine max
  Coding DNA Sequence Number=SeqID_88390
MKDGAQVVLNDNGNYGKFSHLLASQDRDYLLSPTGAQICS

SEQ ID NO: 205169 - protein, 84 aa, Glycine max
  Coding DNA Sequence Number=SeqID_88391
  Gene Ontology: Mol. function=sequence-specific DNA binding; Cellular component=nucleus; Biological process=regulation of transcription, DNA-dependent
  Homolog annotation: Hit_ID=Q8LLR1; Match level="QueryCoverage=75%, HitCoverage=26%, E-value=3e-27, Identity=95%"; Hit description=MADS -box protein 3
  Pfam annotation: Domain name=SRF-TF; Domain location=9-59; Score =121.5; E_value=2.4e-33; Accession=PF00319.9; Description=SRF-type transcription factor (DNA-binding and dimerisation domain)
MGRGRVELKRIENKINRQVTFSKRRNGLLKKAYELSVLCDAEVALIIFSSRGKLYEFGSVGSTRFIVLPPDTSLLSVKGFSFAH

SEQ ID NO: 205170 - protein, 102 aa, Glycine max
  Coding DNA Sequence Number=SeqID_88392
  Gene Ontology: Mol. function=structural constituent of ribosome; Cellular component=ribonucleoprotein complex; Biological process =translation
  Homolog annotation: Hit_ID=Q5QM99; Match level="QueryCoverage=88%, HitCoverage=98%, E-value=2e-45, Identity=95%"; Hit description=60S ribosomal protein L37a
  Pfam annotation: Domain name=Ribosomal_L37ae; Domain location=12-101; Score=209.9; E_value=5.9e-60; Accession=PF01780.9; Description =Ribosomal L37ae protein family
MVLSLSLSLSHTKRTKKAGIVGKYGTRYGASLRKQIKKMEVSQHSKFFCEFCGKYAVKRKAVGIWGCKDCGKVKAGGAYTLNTASAVTVRSTIRRLREQTES

SEQ ID NO: 205171 - protein, 192 aa, Glycine max
  Coding DNA Sequence Number=SeqID_88393
  Homolog annotation: Hit_ID=Q6ZH90; Match level="QueryCoverage=41%, HitCoverage=52%, E-value=3e-33, Identity=85%"; Hit description =Putative P18
  Pfam annotation: Domain name=SAP18; Domain location=29-154; Score =149.6; E_value=8.4e-42; Accession=PF06487.3; Description=Sin3 associated polypeptide p18 (SAP18)
MSDGGKRQGGRALPPPPRGPPPPPPSRPRLEPVDREKERDAKRKKTCPLLLRVFTKIGSHHSMEDFAVRGKEPKDEVQIYTWKDATLRELTDLVKEVAPAARRRNAKLSFAFVFPDKNGRFKVQEFEDDAYCFDCEVTTTVATHECGHIKLKCCRNAIVVQATHGFCTCDVKNSLNVQQLSNLLTMNVEGIK

SEQ ID NO: 205172 - protein, 647 aa, Glycine max
  Coding DNA Sequence Number=SeqID_88394
  Gene Ontology: Mol. function=protein disulfide oxidoreductase activity; Biological process=intracellular signaling cascade
  Homolog annotation: Hit_ID=Q67UI1; Match level="QueryCoverage=75%, HitCoverage=65%, E-value=1e-102, Identity=41%"; Hit description =Glutaredoxin-related-like protein
  Pfam annotation: Domain name=DEP; Domain location=281-352; Score =68.9; E_value=1.6e-17; Accession=PF00610.11; Description=Domain found in Dishevelled, Egl-10, and Pleckstrin
  Pfam annotation: Domain name=DUF547; Domain location=438-575; Score =200.7; E_value=3.4e-57; Accession=PF04784.5; Description=Protein of unknown function, DUF547
  Pfam annotation: Domain name=Glutaredoxin; Domain location=164-223; Score=70.3; E_value=6e-18; Accession=PF00462.14; Description =Glutaredoxin
  Pfam module annotation: Pfam domain module=DEP::DUF547::Glutaredoxin; Domain location=281-352::438-575::164-223
MGSEENGTEIQIQNPTHTQTQQHSNPNNIASPEIHANTSNNQIEITSHYGGDDAESDRHVTLVVHPHSLLPMPVPPQSFKSNENDAVSSNDSNFSVGSFLRQRSSHLSAAIVKRVSSLRQSMEEKTNDDEEENLEVTEFSLSGVKVTVTPKPEEEKETSFKGRISFFSKSNCRDCTAVRRFFKEKGIRYVEINVDVFGERERELRERTGSGSVPQIFFNEKLIGGLVALNSLRNSGEFDRRVAEIVAGKVAGGDSPAPPVYGFDYVEEERADEMVGVVRVLRLRLPIQDRLRRMKMVKNCFQGNELVEALLQNFHCARNEAVEIGKQLSKKHFIHHVFGENDFEEGNHLYRFLEHEPFIPRCFNFHGTTNDSEPKPADSIFVRLTKIMSAILESYASDDRQHVDYEAISRSEEFRRYGSTNSTVKSAMPTVHSFTVAPSLDLQRVNLLELSENEKLAFFLNLYNAMVIHAVISVGCPEGAIDRRSFFSDFQYLVGGHPYSLNMIKNGILRCNRRSPYSLVKPFSTGDKRLEVALIKLNPLLHFGLCNGTKSSPNVRFFTPHRVVDELRGAAREFFENHGIEVDLEKRTVYLTRIFKWFSGDFGQEKEILLWIINYLDPNKAGLVTHLMGDSGPVHISYQNYDWSINS

SEQ ID NO: 205173 - protein, 81 aa, Glycine max
  Coding DNA Sequence Number=SeqID_88395
  Subcellular localization annotation: CTP_CleavageSite=31; ConfidenceScore=5.05e-01
MERVASPTVHMRCSAMELASFKVQRSMLATRASNAMPASTLSSGDQMKAQLADGKSERGLHPQKWKLALMSLSTPMKAFSY

SEQ ID NO: 205174 - protein, 612 aa, Glycine max
  Coding DNA Sequence Number=SeqID_88396
  Gene Ontology: Mol. function=transferase activity, transferring hexosyl groups; Cellular component=integral to membrane; Biological process=carbohydrate biosynthetic process
  Homolog annotation: Hit_ID=Q9M3Y6; Match level="QueryCoverage=96%, HitCoverage=99%, E-value=0.0, Identity=81%"; Hit description=68 kDa protein
  Pfam annotation: Domain name=Glyco_transf_8; Domain location=270-586; Score=405.7; E_value=6.7e-119; Accession=PF01501.10; Description =Glycosyl transferase family 8
MGCADQDYISAVPSKQVLDVIVSSTNDLGPFSLDNFRKNLSASWRVGLGNSNAEHELNQQTTHVRQEKPEVKEGRSSGDNPSQWTDSSAQQTRRHLIEKRREKRAAELVKKDNEVAVRVENTAIERSKSVESAIIGKYNIWRKEFENENGDSTVRLMRDQIIMARVYISIAKLKNKVELHEELISRLKESQRALGDAVSDADLHHSTHGKIKAMGQVLSKAREQLYDCKLVTGKLRAMLQTADDQVRSLKKQSTFLSQLAAKTIPNGIHCLSMRLTIDYYLLPPEKRKFPGSENLENPSLYHYALFSDNVLAASVVVNSTIMNAKDPSKNVFHLVTDKLNFGAMSMWFLLNPPGKATIHVENVDDYKWLNSSYCPVLRQLESATLKEFYFKAGHPNSLSSGASNLKYRNPKYLSMLNHLRFYLPQVYPKLDKILFLDDDIVVQKDLTGLWAVDLNGKVNGAVETCGQSFHRFDKYLNFSNPHIARNFDPNACGWAYGMNMFDLKVWKKKDITGIYHKWQNMNEDRVLWKLGTLPPGLITFYGLTHPLDKSWHVLGLGYNPSLDRSEIENAAVVHYNGNMKPWLEIAMTKYRSYWTKYVKYNHPYLQNCKLNE

SEQ ID NO: 205175 - protein, 77 aa, Glycine max
  Coding DNA Sequence Number=SeqID_88397
MLLPPRTRGNATGKSENEMQSFLKMEMDKNKGMFDNIMSEEVDMNEENQDEPGVTEENGEELGVYEHVDCFDAFNTS

SEQ ID NO: 205176 - protein, 50 aa, Glycine max
  Coding DNA Sequence Number=SeqID_88398
APNTLPMKGLFVIKFESNEVLLIPIALKVVSPLLLDSNSSRDSTNFLYGN

SEQ ID NO: 205177 - protein, 109 aa, Glycine max
  Coding DNA Sequence Number=SeqID_88399
MVFIVSPSLPLFASKTVHIRTFLNHLFYKINAIELSTKALQYPLLNKKQDRIGGGVGKLDPQAGVGMSIIFGHTGDKGQGRGHGRGGLRELEMKGRETKLVIVESHCHA

SEQ ID NO: 205178 - protein, 153 aa, Glycine max
  Coding DNA Sequence Number=SeqID_88400
  Gene Ontology: Mol. function=nucleic acid binding
MEIPNVNGLNIQDDDGDLEFLTDRIIHFQIMKERMTLVWRPKCGVEITEVKYGIFLFRFFFHLVVQRILKGRPWSFDKHLLILGVIKEGANPTTIPLFLVPFWIQMHNLPLGFMSQEVGQSIGNYIGTFLEYDEKNSSNLLRSFRHIRVLMDV

SEQ ID NO: 205179 - protein, 41 aa, Glycine max
  Coding DNA Sequence Number=SeqID_88401
MKLKVIRGNSVVTVEALEIQVFKCKLTINLFLCDLTNVNME

SEQ ID NO: 205180 - protein, 71 aa, Glycine max
  Coding DNA Sequence Number=SeqID_88402
MKEGNSISQRWHRREKMKLSSSEKKSLAVEMEGHVVHLEKSVHLTLAYASTFSRECIRITTNETRATLKSK

SEQ ID NO: 205181 - protein, 207 aa, Glycine max
  Coding DNA Sequence Number=SeqID_88403
  Gene Ontology: Mol. function=RNA-directed DNA polymerase activity; Biological process=RNA-dependent DNA replication
MGFNLTWRKWIKACLQSATISILVKASPTKDFVPTRGLRQGDPLAPLLFNIVAEGLTGMMQVATAKNLYRSFMVGKQKTYLRWKRRHELDNVVAVTEAQPSLRQTRTQAKGETTITPWEYPFRDSFVSYFSSTCESEQMLKRRTPNVKTKGRTSMDKWQRRSPQTRSPQCGCSHRSAGQFDTKTISGRRRKKKNDRVQARGLCNFRS

SEQ ID NO: 205182 - protein, 99 aa, Glycine max
  Coding DNA Sequence Number=SeqID_88404
MVVPKVSTENYGGSWWLLVVVGGEEEAWDIGEGFWKKEREMSAALSPSLVASKGVAAGVASGVSSGDAYGVAFGSGCGSWGVGASPPPAGEGWTLGQAT

SEQ ID NO: 205183 - protein, 57 aa, Glycine max
  Coding DNA Sequence Number=SeqID_88405
MSKFNSVMAEECTTVDVHSGTMMGLCVIVMEGNGGGARCGGDRIGWRSRTSKNFASQ

SEQ ID NO: 205184 - protein, 100 aa, Glycine max
  Coding DNA Sequence Number=SeqID_88406
MGLVGQGLLSPIWKLENLRRFWAQRTGRELSTLSAQIRLARNYVALSEQARLAQFHQMQSREVFGLSAIVAHSETPSANGWGLACLVRDASRSAYEVCLT

SEQ ID NO: 205185 - protein, 62 aa, Glycine max
  Coding DNA Sequence Number=SeqID_88407
MSYKIVNRVLIPTRSCFVFSYSNQKSEALISEAASETGSSTSSENFKAYHLLLLIGVAVEAI

SEQ ID NO: 205186 - protein, 154 aa, Glycine max
  Coding DNA Sequence Number=SeqID_88408
  Gene Ontology: Mol. function=oxidoreductase activity; Cellular component=integral to membrane; Biological process=electron transport
  Homolog annotation: Hit_ID=Q43071; Match level="QueryCoverage=84%, HitCoverage=39%, E-value=9e-12, Identity=50%"; Hit description =Cytochrome P-450
MYRRRGRGGGCELKELVNESVSDGDLPNLPYVRAIVKETLRMHTSSLFSFQRPSIPYTTHKLATTLFQLAPLLRSKYGLLLMTKMFECFKQSDKSAPQSQGIHLKFCKKIASQSSTVAKPMAFPGHTLLLEQKGVNLKSDPVMAHPHPSENALA

SEQ ID NO: 205187 - protein, 259 aa, Glycine max
  Coding DNA Sequence Number=SeqID_88409
  Homolog annotation: Hit_ID=Q8S901; Match level="QueryCoverage=99%, HitCoverage=100%, E-value=1e-102, Identity=75%"; Hit description =Syringolide-induced protein 14-1-1
MKSKILKALPKAVSAVTVTFQNHPFSPGRDHKSKPIVSMIPHEARRKTHDRGNNNDIDEIYSQEPTSPKISCMGQIKHKKKQIEKSKSKSKSMTKEARNVASKQTSSASRDIEVKNHVSTFQKMLLFHGTKPKSDGRKSNASAPGDINKDRALADAARAPRVSQMRRFSSGRDALGDFDWKVAQVAPDEEEIDYYSDHYRVDSDGDEEEQIIIPFSAPLLVGVGVGHGGVLNLKPRIEINLWKRRTMAPPRPLQLDRAN

SEQ ID NO: 205188 - protein, 161 aa, Glycine max
  Coding DNA Sequence Number=SeqID_88410
  Gene Ontology: Mol. function=pseudouridylate synthase activity; Biological process=RNA processing
  Homolog annotation: Hit_ID=Q1SRH6; Match level="QueryCoverage=67%, HitCoverage=24%, E-value=3e-19, Identity=69%"; Hit description =Pseudouridine synthase, RluD
  Pfam annotation: Domain name=S4; Domain location=74-119; Score=14.9; E_value=0.028; Accession=PF01479.15; Description=S4 domain
  Subcellular localization annotation: CTP_CleavageSite=35; ConfidenceScore=5.35e-01
MLPRCRIPSIPISIPNRTFSFSFLSATSYKFISATASAASGSAGDTDSDGEPKLNFSGVRLEEAVDSRIGSGKLRLDNWISSRINGIRRARVQSSIKSGLVHVNGRVVDKYLADAHKLEAFPCGNDSLVEIETKPVMLGFFVAIRDFKKPPLLMIRRYHDE

SEQ ID NO: 205189 - protein, 613 aa, Glycine max
  Coding DNA Sequence Number=SeqID_88411
  Gene Ontology: Mol. function=RNA-directed DNA polymerase activity; Cellular component=intracellular; Biological process=RNA-dependent DNA replication
  Homolog annotation: Hit_ID=Q1SRK0; Match level="QueryCoverage=85%, HitCoverage=98%, E-value=0.0, Identity=76%"; Hit description =Peptidase S8 and S53, subtilisin, kexin, sedolisin; Tetratricopeptide - like helical
  Pfam annotation: Domain name=PPR; Domain location=179-213; Score =18.0; E_value=0.034; Accession=PF01535.11; Description=PPR repeat
  Pfam annotation: Domain name=PPR; Domain location=214-248; Score =30.1; E_value=7.9e-06; Accession=PF01535.11; Description=PPR repeat
  Pfam annotation: Domain name=PPR; Domain location=249-282; Score =21.7; E_value=0.0027; Accession=PF01535.11; Description=PPR repeat
  Pfam annotation: Domain name=PPR; Domain location=283-317; Score =50.8; E_value=4.6e-12; Accession=PF01535.11; Description=PPR repeat
  Pfam annotation: Domain name=PPR; Domain location=318-352; Score =42.6; E_value=1.3e-09; Accession=PF01535.11; Description=PPR repeat
  Pfam annotation: Domain name=PPR; Domain location=353-387; Score =43.9; E_value=5.6e-10; Accession=PF01535.11; Description=PPR repeat
  Pfam annotation: Domain name=PPR; Domain location=388-422; Score =35.0; E_value=2.6e-07; Accession=PF01535.11; Description=PPR repeat
  Pfam annotation: Domain name=PPR; Domain location=423-457; Score =18.6; E_value=0.022; Accession=PF01535.11; Description=PPR repeat
  Pfam annotation: Domain name=PPR; Domain location=458-492; Score =30.0; E_value=8.6e-06; Accession=PF01535.11; Description=PPR repeat
  Pfam annotation: Domain name=PPR; Domain location=493-527; Score =19.4; E_value=0.013; Accession=PF01535.11; Description=PPR repeat
  Pfam annotation: Domain name=PPR; Domain location=529-563; Score =10.0; E_value=0.49; Accession=PF01535.11; Description=PPR repeat
  Pfam module annotation: Pfam domain module=PPR::PPR::PPR::PPR::PPR::PP R::PPR::PPR::PPR::PPR::PPR; Domain location=179-213::214-248::249 -282::283-317::318-352::353-387::388-422::423-457::458-492::493 -527::529-563
  Subcellular localization annotation: CTP_CleavageSite=63; ConfidenceScore=5.74e-01
MALVHKYLLLSRSPPPPTRFIASIRTPTSLQTSPLMAFIKPSARFRHSLSPLLSPTFKPYSSSASALVPELDIQPDTPQNPNLSPEETTLADKFHAAIKEHHRRNPTPNPNAPPPTPNLTIPDLSLAFSAISAAHPISPSVAHRVIEKCGGVRHGIPFLQSLAFFNWSSSLDGFPASPEPYNEMLDLAGKLRQFDLAWHVIDLMKSRGVEITVHTFSALVRRYVRAGLAAEAVHAFNRMEDYGCTPDMVAFSIVISSLCKKRRANEAQSFFDSLKHRFEPDVVVYTSLVHGWCRAGDISKAEEVFSDMKMAGIKPNVYTYSIVIDSLCRCGQITRAHDVFSEMIDAGCDPNAVTFNSLMRVHVKAGRTEKVLKVYNQMKRLGCPADTISYNFIIESHCRDENLEEAAKILNLMVKKGVAPNASTFNFIFGCIAKLHDVNGAHRMYARMKELNCQPNTLTYNILMRMFAESRSTDMVLKMKKEMDESQVEPNVNTYRILISMFCDMKHWNNAYKLMMEMVEEKCLRPNLSVYETVLELLRKAGQLKKHEELVDKMVARGMKCCMLGKCVPVVRGVANNLRHVQKRLRCSYKWEAVYGYLSLETCINSIFCTARE

SEQ ID NO: 205190 - protein, 285 aa, Glycine max
  Coding DNA Sequence Number=SeqID_88412
  Gene Ontology: Mol. function=pseudouridylate synthase activity; Cellular component=signal recognition particle, endoplasmic reticulum targeting; Biological process=RNA processing
  Homolog annotation: Hit_ID=Q1SRH6; Match level="QueryCoverage=97%, HitCoverage=57%, E-value=1e-117, Identity=79%"; Hit description =Pseudouridine synthase, RluD
  Pfam annotation: Domain name=PseudoU_synth_2; Domain location=41-174; Score=56.7; E_value=7.7e-14; Accession=PF00849.12; Description=RNA pseudouridylate synthase
MLVNGILHHCNLPNVEFSKEEEALSDTEDSDDEFNSYRSLASFCEGLNSRLSVASNSIRSGIVHRLDKGTSGLPVAKDEHSHMKLSEQFKQHTIKRIYVSLTAGLPTPVAGRVEVPVGRDPNNRIRMTAVAGPVNSRKARHAASRYKVIEILAGGSCSLVEWKLETGRTHQILHDTTLRKWFMIRTYAKYLGVPLLGDEVYGGTKNMVFSLLRPRTPISLHSKVVKMVSRLDRPCLHALTLGFQHPHTGEQVHFSCEPPADFAEILSQLRRIGSETVSFSKRSNL

SEQ ID NO: 205191 - protein, 402 aa, Glycine max
  Coding DNA Sequence Number=SeqID_88413
  Gene Ontology: Mol. function=electron carrier activity; Cellular component=nucleus; Biological process=intracellular signaling cascade
  Homolog annotation: Hit_ID=Q1SRH5; Match level="QueryCoverage=96%, HitCoverage=98%, E-value=1e-104, Identity=54%"; Hit description =Protein kinase C, phorbol ester/diacylglycerol binding; Thioredoxin domain 2; Thioredoxin fold
  Pfam annotation: Domain name=AhpC-TSA; Domain location=181-304; Score= -22.5; E_value=0.063; Accession=PF00578.11; Description=AhpCTSA family
  Pfam annotation: Domain name=C1_1; Domain location=356-399; Score =1.1; E_value=0.02; Accession=PF00130.12; Description=Phorbol estersdiacylglycerol binding
  Pfam annotation: Domain name=C1_3; Domain location=364-392; Score =22.4; E_value=0.0012; Accession=PF07649.3; Description=C1-like domain
  Pfam module annotation: Pfam domain module=AhpC-TSA::C1_1::C1_3; Domain location=181-304::356-399::364-392
MQTNAVKVSDLEGRVVGLLFAANWYPPCRGFTQILVGIYEELKSRVPQLEIVYVSSDENLDAFNSFYGNMPWLAIPFSDLETKKSLTRKYDVEAVPCLILLQPDDRKEHVTVRDGVELIYRYGIQAYPFSNERLEQLQKEDKVKRDNQTLTNLLANHHRDYVLSHTHTGLKKFYLNCMQRIMDPVPGDGCCSCTQVPVAWLVGKTIGLYFSAEWCVPCAKFTPKLISVYEKIKHELAGKGEEDFEVVLISSDRDQASFDSYYSTMPWLALPFGDPEIKNLVRHYNVQGIPWLVIIGPDGKTITVHGRSLINLYQENAYPFTNAKVEELEKQLEEEAKGLPALVYHEGHRHDLNLVSDGNGGGPFICCVCDEQGSSWAYQCLQCGYEVHPKCVRTVERHDNNV

SEQ ID NO: 205192 - protein, 384 aa, Glycine max
  Coding DNA Sequence Number=SeqID_88414
  Gene Ontology: Mol. function=transcription factor activity; Cellular component=nucleus; Biological process=regulation of transcription, DNA-dependent
  Homolog annotation: Hit_ID=Q2R3Q8; Match level="QueryCoverage=96%, HitCoverage=49%, E-value=1e-147, Identity=70%"; Hit description=GRAS family transcription factor containing protein
  Pfam annotation: Domain name=GRAS; Domain location=1-292; Score =396.8; E_value=3.2e-116; Accession=PF03514.5; Description=GRAS family transcription factor
MTLFLTLVITHILQEQDSGLQLVHLLLACAEAVAKEEYMLARRYLHHLNRVVTPLGDSMQRVAVCFTDSLSARLNSTLTPKPATPSKPLTPSNSLEVLKIYQIVYQACPYVKFAHFTANQAIFEAVEIEERVHVIDLDILQGYQWPAFMQALAARPAGAPFLRITGVGPLLDAVRETGRCLTELAHSLRIPFEFHAVGEQLEDLKPHMLNRRVGEALAVNAVNHLHRVPGNHLGNLLTMLRDQAPSIVTLVEQEASHNGPYFLGRFLEALHYYSAIFDSLDATFPAESAQRAKVEQYIFAPEIRNIVACEGAERFERHERLEKWRKIMEGKGFKGVALSPNAVTQSKILLGLYSCEGYRLTEDKGCLLLGWQDRAIIAASAWRC

SEQ ID NO: 205193 - protein, 41 aa, Glycine max
  Coding DNA Sequence Number=SeqID_88415
MTSSLRNEMLATLPNKDLATSTSETAQTARRNRLQATGVQF

SEQ ID NO: 205194 - protein, 46 aa, Glycine max
  Coding DNA Sequence Number=SeqID_88416
MALDIGIEEVLLGKNNIVLLAEAVVAVAVPMVVERAIVKCKECVLF

SEQ ID NO: 205195 - protein, 92 aa, Glycine max
  Coding DNA Sequence Number=SeqID_88417
MPKESKVVPCTCTPVAYNLFLQAICAVSPVEVARSSLDKVASHAGGLHATHSFRSELVIANDGLHGLCMHATLKRAPCRNYFQKGPISGISL

SEQ ID NO: 205196 - protein, 327 aa, Glycine max
  Coding DNA Sequence Number=SeqID_88418
  Pfam annotation: Domain name=WW; Domain location=270-300; Score=48.9; E_value=1.7e-11; Accession=PF00397.16; Description=WW domain
  Subcellular localization annotation: CTP_CleavageSite=67; ConfidenceScore=5.10e-01
MDNSQDQPLPPGVPSWPNYAFATPSAPYNFQQGTLSHYGFSSNAKPTEQHEENKSFNSNHVEITAVDGATVSASNYYGAQLTGSRDDIVVAAQDAVLREQEIAMQNVIRSQREGRTVDSPTKDNLDLFSERRDPNALKEHLLKMATEHRAEMAVKRGKAARAEGNTEIGNGYGVPGGGAYYDAPTLKTTAGSNAFSQPESILDRCSEQKPPAKELPEYLKQRLRARGILKDDTCTTDLYFQSVQNSNTYRLPVSEFQKGTATEVTENKKLPPGWVEAKDPGSGACYYYNESTGKSQWEKPQESYLTEQSPSSSHLPENWVEAMDETT

SEQ ID NO: 205197 - protein, 50 aa, Glycine max
  Coding DNA Sequence Number=SeqID_88419
MWMELAVPDKTVPSSTNRKEGSNFPNSALSSQHQLITWRAQLILPLKNIS

SEQ ID NO: 205198 - protein, 120 aa, Glycine max
  Coding DNA Sequence Number=SeqID_88420
  Gene Ontology: Mol. function=hydrolase activity, acting on ester bonds; Biological process=lipid metabolic process
  Homolog annotation: Hit_ID=Q1S8F8; Match level="QueryCoverage=67%, HitCoverage=96%, E-value=3e-32, Identity=73%"; Hit description =Lipolytic enzyme, G-D-S-L
  Subcellular localization annotation: CTP_CleavageSite=28; ConfidenceScore=5.13e-01
MALFIKFFNSSLTSLMLRFILLLVLSFRTKAVVKLPPNITFPAVIAFGDSIVDPGNNNMVKTLVKCDFPPYGKDFEGGIPTGRFCNGKIPSDLLEKQKHLQKSFVNRPSTQHSHHSILQD

SEQ ID NO: 205199 - protein, 93 aa, Glycine max
  Coding DNA Sequence Number=SeqID_88421
MELDMRYAIMKQDLMWIYITSHAHVGCGNFQDEINYSQSALQVEQLPTNFESTPTPNVESAPTPTPTTTQSASTPSVETNLYLYHCQLCLDHL

SEQ ID NO: 205200 - protein, 172 aa, Glycine max
  Coding DNA Sequence Number=SeqID_88422
  Gene Ontology: Mol. function=structural constituent of ribosome; Cellular component=intracellular; Biological process=translation
  Homolog annotation: Hit_ID=Q9FN19; Match level="QueryCoverage=81%, HitCoverage=47%, E-value=5e-67, Identity=62%"; Hit description =Arabidopsis thaliana genomic DNA, chromosome 5, TAC clone:K8K14
  Pfam annotation: Domain name=WD40; Domain location=132-169; Score =16.5; E_value=0.096; Accession=PF00400.22; Description=WD domain, G -beta repeat
  Pfam annotation: Domain name=WD40; Domain location=39-86; Score=41.7; E_value=2.5e-09; Accession=PF00400.22; Description=WD domain, G-beta repeat
  Pfam annotation: Domain name=WD40; Domain location=90-128; Score =52.9; E_value=1.1e-12; Accession=PF00400.22; Description=WD domain, G-beta repeat
  Pfam module annotation: Pfam domain module=WD40::WD40::WD40; Domain location=132-169::39-86::90-128
MNRISFVLFLFLLCFLSIFSQFIEKVLFWLVQIWSMKQDTYLHDLREHSKEIYTIRWSPTGPGTNNPNHKLVLASASFDSTVKLWDVELGKLIYSLDGHRHPVYSVAFSPNGDYLVSGSLDRSMHIWSLRDGKIVKTYTGNGGIFEVCWNKEGDKIAACFANNTVCVLDFRM

SEQ ID NO: 205201 - protein, 343 aa, Glycine max
  Coding DNA Sequence Number=SeqID_88423
  Gene Ontology: Mol. function=hydrolase activity, acting on ester bonds; Cellular component=cellular_component; Biological process =lipid metabolic process
  Homolog annotation: Hit_ID=Q1S8F6; Match level="QueryCoverage=97%, HitCoverage=91%, E-value=1e-102, Identity=54%"; Hit description =Lipolytic enzyme, G-D-S-L
  Pfam annotation: Domain name=Lipase_GDSL; Domain location=22-334; Score=181.4; E_value=2.2e-51; Accession=PF00657.12; Description=GDSL- like LipaseAcylhydrolase
MIFCHSAEAIVKLGGNETIPALILFGDSIVDTGTNNNLITLLKCNFPPYGRDFQGGIPTGRFSNGKVPADFIAEELGISEYITPYKSPSLQPGDLLKGVNFASGGSGYDSLTAQIVSVTPLSEQLEQFKEYIGKLKGNFGEAKTNFILSKSLVLVVSSSNDIANTYFASGVRKVTYDVSGYTDMLVQEASSFVKELYGLGARRIGVFGAPPLGCLPFVRTLFGGLERVCTEEINMASKLFNSKLSSELHNLNQSLPQAKVVYIRIYDSLLNIIQNPINYGFDVADRGCCGTGTVEAAFLCNPLDPTTCVDDSKYVFWDSYHPTQKTYQILVGEILNKYIISFS

SEQ ID NO: 205202 - protein, 91 aa, Glycine max
  Coding DNA Sequence Number=SeqID_88424
MTSIATQEGPPTTLNYDGVGTVLQIIVFPARHIHDLRISQQGKISSLTLHDDDDDDDGFSQYRTCTFMFSGHLINFFLCSDQQKKIFSIQS

SEQ ID NO: 205203 - protein, 139 aa, Glycine max
  Coding DNA Sequence Number=SeqID_88425
MHKALRANAPLPYPQLVTLFLRHFQIPLDDEPFVQVKRSFAIGAGAVTLFGYSKDRDGQWLKKDTLPLQDERTLSPPPQRDDSSALMNEVLSELRGLRTYVGERFDSLDGRFEGMDTRITQLEEDVTYLRRCFDLPPLS

SEQ ID NO: 205204 - protein, 118 aa, Glycine max
  Coding DNA Sequence Number=SeqID_88426
  Gene Ontology: Mol. function=identical protein binding; Biological process=negative regulation of enzyme activity
  Homolog annotation: Hit_ID=Q9LDM8; Match level="QueryCoverage=96%, HitCoverage=15%, E-value=8e-42, Identity=72%"; Hit description =Putative subtilisin precursor
MTELGSLATPYDYGAGAITTSEPWLVYETTTFDYLNYLCYNGLNITMVKVISGTVPDNFNCPKDSNSDLISNINYPSIAVNFTGKANVVVSRTVTSVGEEVKQCTSPLLKLSKEYLSH

SEQ ID NO: 205205 - protein, 86 aa, Glycine max
  Coding DNA Sequence Number=SeqID_88427
  Gene Ontology: Mol. function=identical protein binding; Biological process=negative regulation of enzyme activity
  Homolog annotation: Hit_ID=Q94KL9; Match level="QueryCoverage=81%, HitCoverage=9%, E-value=6e-18, Identity=64%"; Hit description =Subtilisin-like protein
MDASPVTHKFYYFTLGSTSYTISRNVPNNFSYPKDSSSHHISNINYPSIAISDLQGKRVVKVTRIVTNVGEEDETLYSPLVDAPNG

SEQ ID NO: 205206 - protein, 231 aa, Glycine max
  Coding DNA Sequence Number=SeqID_88428
  Gene Ontology: Mol. function=identical protein binding; Cellular component=cytoplasm; Biological process=negative regulation of enzyme activity
  Homolog annotation: Hit_ID=Q94KL9; Match level="QueryCoverage=99%, HitCoverage=52%, E-value=2e-47, Identity=54%"; Hit description =Subtilisin-like protein
  Pfam annotation: Domain name=Peptidase_S8; Domain location=13-226; Score=-75.3; E_value=0.0095; Accession=PF00082.12; Description =Subtilase family
MDPVPSRWKGTCMKSYDFNSSNCNRKIIGARYYPDPQGDSEYVTPRDKNGHGTHVASTAAGATVPGASYYGVAAGSAQSGSPKSRLAIYKVCFKYECPGSAVLTNGCDFSVGWFRSELKYDTIAIGAFHAVERVILVVASAGNNGPSLNTVVNDVPWIFTVTASSIDRDFKSNVVFGHKLIQPDIAAPGVNMQHGLATAQKVFQKEKSPPNSTSYRELPWHAHMFQDLQLP

SEQ ID NO: 205207 - protein, 205 aa, Glycine max
  Coding DNA Sequence Number=SeqID_88429
  Homolog annotation: Hit_ID=Q0GPI1; Match level="QueryCoverage=39%, HitCoverage=45%, E-value=2e-08, Identity=76%"; Hit description=BZIP transcription factor bZIP46
MEMKRFYTERPFWECERSTNSAATGVGVGDREKRVVMFVKDRGGRGSRSESEKSGKRLSKSTEELEREASLMSFQTCSMEEEEEEEEWGQQSHGDEAIAFSLTLKRTKYLCRVDKEVPAPALAAIDELSEQCRQSCFRSNVSSSSLSLRVAASLDNSEDGFDIDLRVLVAALTEGHRHRRRCVLLWLWKEVAGGTEALGLNNVDA

SEQ ID NO: 205208 - protein, 189 aa, Glycine max
  Coding DNA Sequence Number=SeqID_88430
  Gene Ontology: Mol. function=protein dimerization activity; Cellular component=nucleus; Biological process=regulation of transcription, DNA-dependent
  Homolog annotation: Hit_ID=Q0GPI1; Match level="QueryCoverage=96%, HitCoverage=89%, E-value=2e-35, Identity=57%"; Hit description=BZIP transcription factor bZIP46
  Pfam annotation: Domain name=bZIP_1; Domain location=89-152; Score =41.9; E_value=2.1e-09; Accession=PF00170.11; Description=bZIP transcription factor
  Pfam annotation: Domain name=bZIP_2; Domain location=89-143; Score =38.8; E_value=1.8e-08; Accession=PF07716.5; Description=Basic region leucine zipper
  Pfam module annotation: Pfam domain module=bZIP_1::bZIP_2; Domain location=89-152::89-143
  Subcellular localization annotation: CTP_CleavageSite=19; ConfidenceScore=5.31e-01
MASSPCDCWPHSSSSSSSSIEHVWNDIKLASLSNSSVDLDLNNNNHSVSVSSFLNQPLSTFLTLTSTSSSSSVFHKHDHSLLSVSDPNTLQDQRHTRVIKNRESAVRSRARKQAYRKGLEVEISRLTEENSRLKRQLKEENCVPGFKGKVSEKLRRLSCCSAVCAPLTLPEWPLRVEPLHLHFEKERNP

SEQ ID NO: 205209 - protein, 427 aa, Glycine max
  Coding DNA Sequence Number=SeqID_88431
  Gene Ontology: Mol. function=RNA binding; Cellular component =ribonucleoprotein complex; Biological process=RNA processing
  Homolog annotation: Hit_ID=Q1S8H3; Match level="QueryCoverage=99%, HitCoverage=96%, E-value=2e-72, Identity=38%"; Hit description=RNA -binding protein Lupus La
  Pfam annotation: Domain name=Extensin_2; Domain location=1-383; Score= -129.7; E_value=0.03; Accession=PF04554.4; Description=Extensin-like region
  Pfam annotation: Domain name=La; Domain location=368-421; Score=74.8; E_value=2.7e-19; Accession=PF05383.7; Description=La domain
  Pfam module annotation: Pfam domain module=Extensin_2::La; Domain location=1-383::368-421
  Subcellular localization annotation: CTP_CleavageSite=38; ConfidenceScore=5.64e-01
MVTTTVDSSSNHHSPTAADTSNNFPQKTMPSPWAQVVRGADAEPNDQSPPSSSSSSSLDSINSNGPAVQTSDIAVKPAWKKPEANGVAEVGPVMGAHSWPDLSESTKPTAKLTSDSSVKTAADEESTTTPQGPVTSDPPQKQATANAKPSPTPAMNYGMANRQRSMKQRGGANGNNVGSGPVQNNFSGTTPNLPPPPPPPPFPVLLMPPSTFAHGIPGAPVPTPRDPYRNNNWDARPQHGGFMPPMNEHRSPSHRGNAGHHPRGEGPYHNSYGNRRDQDRVGYANTRDAHVNQQRMPPRGLMRPPPPNPAPFMGPQPMRPLANPAGFPEYYYFPTLQFEPFGGMPFFTHAPPPAMFYPVAETPLTNTIANQIDYYFSDANLVKDEYLRSNMDEQGWVPISLIASFPRLTVMFVTLKAVVMVETEDRI

SEQ ID NO: 205210 - protein, 125 aa, Glycine max
  Coding DNA Sequence Number=SeqID_88432
  Gene Ontology: Cellular component=chloroplast
DGQLVRSSMDRTWTVVGVGGSPRVSSFGDPGEEDQAGPCEQLDALSPFNPLSEMWAKGKRIHGPTPSSPPRRNYEITPRTPSASRGRGPTIEPCSKKRNALAIRSQLSVPGSPVAGSSGTTRILS

SEQ ID NO: 205211 - protein, 55 aa, Glycine max
  Coding DNA Sequence Number=SeqID_88433
  Homolog annotation: Hit_ID=Q1SE38; Match level="QueryCoverage=91%, HitCoverage=11%, E-value=3e-08, Identity=56%"; Hit description =Transferase
MELTQGRDQETLLNELVIMEIDEAIQAWLTMEMQHVVNLERDIEFPRLALPNRSV

SEQ ID NO: 205212 - protein, 116 aa, Glycine max
  Coding DNA Sequence Number=SeqID_88434
  Homolog annotation: Hit_ID=Q9FYB7; Match level="QueryCoverage=34%, HitCoverage=14%, E-value=2e-09, Identity=72%"; Hit description =Splicing factor-like protein
MPRYDDKYGNTRLYVGHLSLRTRSWDLERAFRRYGYIHKVLQVKSSRTLELECLITSEVPDPTSILTVLSTTQPASATNVTSHTTSSPSTSPYLSNPQPTISSTIPDTQSLTTNID

SEQ ID NO: 205213 - protein, 86 aa, Glycine max
  Coding DNA Sequence Number=SeqID_88435
MKVGNDNIVQRLTLSQICGWCYRKDKQNLEAVCCHNSSNEFLEVSGSVNGSSRPVSDIASCCAIICRGRHYAVQKNDKFGFSKGNI

SEQ ID NO: 205214 - protein, 235 aa, Glycine max
  Coding DNA Sequence Number=SeqID_88436
  Gene Ontology: Mol. function=nucleic acid binding; Cellular component= intracellular; Biological process=DNA integration
  Homolog annotation: Hit_ID=Q1S9T9; Match level="QueryCoverage=86%, HitCoverage=20%, E-value=2e-46, Identity=42%"; Hit description =Peptidase S8 and S53, subtilisin, kexin, sedolisin; Integrase, catalytic region; Zinc finger, CCHC-type
  Pfam annotation: Domain name=zf-CCHC; Domain location=27-44; Score =14.6; E_value=0.0038; Accession=PF00098.13; Description=Zinc knuckle
MRDRSETRSSKSNKHKSKSRSQSQIKFKCFHCYKKGHYKKDFLERRGKDSMKSQESGDVDIAQIEKDWDTDSGCTFHVCPRCDYFESLILNEAGVVMLGNNKPCKVQGYTTQIEHGMMTIFINSVIIAKGIKMNCLYILDGSIVIAQVVVASQNEHDKTSLWHTRLGHVSEKGKAKSASFGIGLHATRRTFEYVHSDPRGLAWTMTHGGCSYFPSTIDDYSRRVLIIVLKIKVTL

SEQ ID NO: 205215 - protein, 379 aa, Glycine max
  Coding DNA Sequence Number=SeqID_88437
  Homolog annotation: Hit_ID=Q2HRX8; Match level="QueryCoverage=29%, HitCoverage=16%, E-value=3e-16, Identity=41%"; Hit description=IMP dehydrogenase/GMP reductase
  Pfam annotation: Domain name=DUF1723; Domain location=140-189; Score =37.8; E_value=3.8e-08; Accession=PF08330.1; Description=Protein of unknown function (DUF1723)
MVKTKGLGRALCRVGARGLGRGRDRDDTDSAEAEAIAAGDEPMVDAAAQDTGAETDAQDTDAETDGDEPMGFPGGPRDPSVLTEYADHVAGSVWSGQERPELKLCSHGRKVHNLGRPIPAIEDMVARTGLSPLIACSIDIGDRGFISSFVERWHRETSSFHLPEGEVSITLDDVVSLLHWPIIGTFHDFQPLRTDEAVVLLVELLMVSAETAVARDYLLHLLGCTLFANKSATHVHVSHLQAFRDLTLAGWYAWGAAGLVLMYDQLNDAIAESNVDLDYDEVSPCACRWIVTKKTVKKRVMCQLGYVQCIPAHPVHSWVSYDDVDDTWTHYSDHLEAAGDLCVVPSECAPDYMNCHIPHEAALASTHADPDANEPRHAV

SEQ ID NO: 205216 - protein, 100 aa, Glycine max
  Coding DNA Sequence Number=SeqID_88438
MGGSTTLSTTQSNNRNITTATEECLPRQWQRAEEEEETNNGAAEGEDNDGEQKVTNDGEEKEEETNNGTVDQLVGSHTIAEEGGRRIYGKKKSQLLGANF

SEQ ID NO: 205217 - protein, 71 aa, Glycine max
  Coding DNA Sequence Number=SeqID_88439
MAQSDGPTDIGARSGICVGVGGITGAEEGTGAVEEEGAGVSGGAEVVGTSDLLPMAFLGPLNVTVGSSRFQ

SEQ ID NO: 205218 - protein, 74 aa, Glycine max
  Coding DNA Sequence Number=SeqID_88440
MNVIAKRCSCVLHLRVWTPAKLLRIGVINFSNLQFWPDPKNGGRGGLLIAPPPSIWGPPKVVVKGVPQMLLPPL

SEQ ID NO: 205219 - protein, 112 aa, Glycine max
  Coding DNA Sequence Number=SeqID_88441
MSLKSWPILRTSISSNQLLPPISTVQQNETLANSHQPCALGVVLEQRSAVKFQQENKCSGDETVEIGHKYIENKHLLEKHALPKIWQEKWVKKRYVPTRNRGQTPPLTAATS

SEQ ID NO: 205220 - protein, 53 aa, Glycine max
  Coding DNA Sequence Number=SeqID_88442
  Gene Ontology: Cellular component=membrane; Biological process =protein modification process
  Homolog annotation: Hit_ID=Q9LSD8; Match level="QueryCoverage=83%, HitCoverage=37%, E-value=1e-13, Identity=66%"; Hit description =Membrane-anchored ubiquitin-fold protein 4 precursor
MPEEEVLELKFRLYDGSDIGPFRYSPASTIAMLKDRIFADWPREKCSRSLLRC

SEQ ID NO: 205221 - protein, 173 aa, Glycine max
  Coding DNA Sequence Number=SeqID_88443
  Homolog annotation: Hit_ID=Q1SJY5; Match level="QueryCoverage=40%, HitCoverage=6%, E-value=8e-11, Identity=49%"; Hit description =Integrase, catalytic region
MKVECPQLKRKIHFGDKKKKILMVIWDDPNNENNNNSNDEEANIYLMADTNEKVEAKTCFEFDSSSYSSSDDEEDMPYDISLVGRGQGLCWYLDNSYSQHMTGEKSMLLGLKPIEGGTITFGAMDKGKIIGIGKFGIPSLASIDNVLYVEGLKYNLLSISQFYGLYPSTKTNV

SEQ ID NO: 205222 - protein, 98 aa, Glycine max
  Coding DNA Sequence Number=SeqID_88444
MVGEKVNFPEVIFFYWLKAFKEKFHSEDKKNHVPYGMLFAQIMRNNGINVFVLEPSAGATQLKKHSKRKVEKEEPQLLLGQLEKVKEQPIYLESRATS

SEQ ID NO: 205223 - protein, 58 aa, Glycine max
  Coding DNA Sequence Number=SeqID_88445
MKKLQQERKPEDRTKERRRRPFIWGAGCPSKNAGCPSNPQDKIDLGYVDFWGIQCNGL

SEQ ID NO: 205224 - protein, 231 aa, Glycine max
  Coding DNA Sequence Number=SeqID_88446
  Gene Ontology: Mol. function=nucleic acid binding; Biological process= DNA integration
MEEEFHQFTRNDVWTLVPKPENKSIIGTTLVFRNNLYEQGKVEMYVKQPLGFKDHTLPNHVLKHKKGSIWSKIGTTFLGFKSNRIAKVYSFINIKYTKELIRKCKMKSAKPMKTPMHASNPLSSDELGYARDKVERKSTSGGCHYLGSCLISWANTNHQWVDIFTNPLSEDCFICIREHLNMTMSSSYSLSSICLTCVQVYRRKGKRVTKTKLFSFLLKNVCHHLFAMIEK

SEQ ID NO: 205225 - protein, 285 aa, Glycine max
  Coding DNA Sequence Number=SeqID_88447
MRKKDVVTKVDVNAKQVEIEELERIQSVVVHGDELFSTVDAARKTEVEMAFIPDDLDLMEKKALEKAMSSLSLKFLSMTLKHKSELTTLDGYAMRRFNKLKGCCSVEASFMMMNQGTSFVVQVEGTSTWVVVTENKRGYISCGSVQVEGTSTWLFKENKGGYIPCGSLLVKVFTRLKRISRTAGCLGTGCRHSLLHLCSLLEVELVKTKEALAQTLKDHTHDAKEARRWSLIGDYFYKKATRWEPLYPPTPPGSPAHLSSNSEDFGDDILKKLDEEIVKQKGDKK

SEQ ID NO: 205226 - protein, 349 aa, Glycine max
  Coding DNA Sequence Number=SeqID_88448
  Gene Ontology: Mol. function=nucleic acid binding; Cellular component= endoplasmic reticulum membrane; Biological process=DNA integration
  Homolog annotation: Hit_ID=Q1T010; Match level="QueryCoverage=98%, HitCoverage=27%, E-value=1e-106, Identity=51%"; Hit description =Peptidase S8 and S53, subtilisin, kexin, sedolisin; Integrase, catalytic region; Zinc ...
  Homolog annotation: Hit description=finger, CCHC-type; Peptidase aspartic, catalytic
MGKFAVRWVFKVKLKPNCSIAKHKARLVAKGFLQKQGIDYTEVYALVARMETIRLVIVVPLGFEIKGKEHNVYKLLKALYGLKKASRAWNRLIDNFLGKQGFVKCTVEFGVYEKEIQHKNLLFVCLYVDDLIIIGDVNEEIEQFKEKMKLEFDMIDLGILHYFLGFEFMHTQKGIFLHQRKYTGEVLKRFNMENCNTASILVMPNLKLTEELDEKSVDATLFKQIIGSLKFLCNSRPDISYGVGLFSRFMGNPRAPHMTGAKHILRYLKRTSDFGLLFPIGNDHNRSCIEAYSDSDWCGDKVERKSTSGYLFKYMDAPISWCSKKQSVVTLSSCEAEYIGSAEVACQSL

SEQ ID NO: 205227 - protein, 108 aa, Glycine max
  Coding DNA Sequence Number=SeqID_88449
MGSFLKFFQEGAVFYVICMHAPRKPPVELASLLSVNESPVAMAILPCIGNRQSNWRVPLGRLSALQQGWLRLLLAGVGQGNCHSYGRFSLSWSCQWYWRVRRGRRHQH

SEQ ID NO: 205228 - protein, 138 aa, Glycine max
  Coding DNA Sequence Number=SeqID_88450
  Subcellular localization annotation: CTP_CleavageSite=22; ConfidenceScore=5.50e-01
MAYSYGVTQQPSIAAYPGVGPSLNSVSTFTPPPMALINAYGPNISTIKFPVLDLFGVRLLRKSLHTSTHNLGMTMSYFMDLDVVLEPKLCVEGPIKLRTDGFQLYDGKGTEFVKQSNACDLQLSFREFVFPSYTRLFL

SEQ ID NO: 205229 - protein, 109 aa, Glycine max
  Coding DNA Sequence Number=SeqID_88451
MELVSSKRVVMGLGAGVQIQRMDRLMRMGGGIKEGGVGNLNRGGEWFEWERRLMEELHDLVNNTTISGQGENSWIWLEDQCSKFSDKSAYVALHKMRIGSQHIDILKKF

SEQ ID NO: 205230 - protein, 101 aa, Glycine max
  Coding DNA Sequence Number=SeqID_88452
TQKVEREEVVVEDSEMVQKMAGHSQAWSSSQSDNLLKILSLDFLSHLLMLGMTTHKIASAQRMLKQSVLLPLQQLQTCVDLPQCVQIFEKMTLVVLVARSD

SEQ ID NO: 205231 - protein, 319 aa, Glycine max
  Coding DNA Sequence Number=SeqID_88453
  Gene Ontology: Mol. function=DNA binding
  Homolog annotation: Hit_ID=Q1SFS3; Match level="QueryCoverage=61%, HitCoverage=35%, E-value=3e-14, Identity=24%"; Hit description =Lambda repressor-like, DNA-binding
MDQVQRQAFRKAYGKIWDLAMIELVPTIKEFEGNLGCLLGGRKLYLFFGFYPSMARVAKVVRILAQELDRVKQNRNGVVGIPRQHLEERAGALVDKGEWTSFIDVLALLVFGIVLFPNVDGLVDLAVIDVFLAYHHSKESSVIAVLADAYDTLDLRCEKSNAGIVCCTPTLYVWLVSHIFCDEGRPVCSLQGHRMCAKKEKANWEELLADMVEASVSWFPRWKEGGAGVLCFVYAYMFLVEVGIVGARYAAPTLFRQLSLSLTLPFSSSSFSIEAPSKASTFDHHFCPKSRKEGILGVVKCVATSGTSKIQVWVDFFLS

SEQ ID NO: 205232 - protein, 76 aa, Glycine max
  Coding DNA Sequence Number=SeqID_88454
MAHLDPGEVCEWSNLNNYQTPPAKQSEKFLDRKNILKRMRRVRDPASCTTETKCPRGITRQVRDLPRLSLAMMPET

SEQ ID NO: 205233 - protein, 199 aa, Glycine max
  Coding DNA Sequence Number=SeqID_88455
  Gene Ontology: Mol. function=nucleic acid binding; Cellular component= intracellular; Biological process=chromatin modification
  Homolog annotation: Hit_ID=Q1H8M0; Match level="QueryCoverage=99%, HitCoverage=100%, E-value=2e-87, Identity=79%"; Hit description=Cys2- His2 zinc finger protein
MTFIREEYDQVDDHGSQNNANNNTEIVTTPEGENMGEWLSLGLTGDINMPVEAAAEQNLSSRPLHNKEFSCNFCMRKFYSSQALGGHQNAHKREREAARSYHQSHHHRMGLAYTSLASRSLGIQPHSLVHKPNRERSAMVARFSSNDANNGVGIGSVASSWTPFMLEQAVDLYWPGSFRVDLPKQESSDVKKIDLDLRL

SEQ ID NO: 205234 - protein, 132 aa, Glycine max
  Coding DNA Sequence Number=SeqID_88456
MPRNATVIGVGCIGIVPSREGRLIYFPGGEFGGLSFREVPPLVCVGVGIGIFGWSRLCGKQILWVRPLWLSGQPLLDGCRIGRGHVGAKVTTWVSPSFFLAPPVPDLLLLVLAEAAYFLSLLQSSRPQKPNL

SEQ ID NO: 205235 - protein, 887 aa, Glycine max
  Coding DNA Sequence Number=SeqID_88457
  Gene Ontology: Mol. function=transmembrane receptor activity; Cellular component=exocyst; Biological process=exocytosis
  Homolog annotation: Hit_ID=Q9FFX6; Match level="QueryCoverage=70%, HitCoverage=89%, E-value=1e-161, Identity=48%"; Hit description =Putative leucine zipper protein
  Pfam annotation: Domain name=Exo70; Domain location=277-875; Score =369.1; E_value=6.9e-108; Accession=PF03081.6; Description=Exo70 exocyst complex subunit
MEMVNQTQNKLTTVQNEVVLDNSPDSQRLLSDNTSFEILPHLLHRRAWFLSAAAAVQTRAIRISELEFFRKFNRDRRIQRPRRQHQQSQTCHRRTQNQKRVLPQISIALSLASRVAGRFPGFGSDPKLRLYYYDPNPFVRVRGAHYAPPPTNMAIIKAQRGENNITVNVTSSSSSIMENHDNNLAENENSGTNETEETLPSSSSSITDHEEADPKPDDDVAAATTAEAESPSPKKDDEEAEEEKKEETAASPASPPPSLENVSEEIDQFLVTLKQKNDENAAEKMDFEIPGFFERYSDLVEKKIAKYDAKGKAKWGEVAEEDSWLLETANRISKLIMLMKDHHHVEPEEKEIDGGNGNGKDSLVNRVTSIHQRVMSYLEEDFRFLMEECRIPTELDPGGNNNNNNDTKGKQQQQVPSSEQEEVKDQEGEIDESFPGYSDETIASLSKIAGEMISGGYESECCQVYIISRRNAFEEVHKKLGLERISIDDMVLKVQWETLAGNMIPAWINTLKQCAAVYFPGERKLAEAVFASCPSVAAGLFGSLSRGVVIQLLNFAEGAAMTKRAAEKLFKLLDMYETLREIIPKVNGLFPEESVEELKTEMNIAKSRLGEAAISIFCDLENQIKQETARTAVPGGAVHPLTRYIMNYLSVAGDYKETLEQVFKDHSKIERADSTSRPHNENDGVPEKQASSPFAAQVLRVMDLLDSSLEGKARLYKDVAQNNFFMMNNGRYILQKIKGSSEMSQVMGDTWIRKKSSELRTYHKNYQRETWNRVLACLNPEGLNVNGKVQKPVLKERFKSFNSLFDEIHRTQSSWVVKDEQLQSELRVSISGVVVPAYRAFIGRFAQIFDPGRQTEKYIKYQPEDIETYIDELFDGKPHQSIARRRT

SEQ ID NO: 205236 - protein, 386 aa, Glycine max
  Coding DNA Sequence Number=SeqID_88458
  Homolog annotation: Hit_ID=Q9LSE0; Match level="QueryCoverage=64%, HitCoverage=84%, E-value=6e-50, Identity=50%"; Hit description =Genomic DNA, chromosome 3, P1 clone: MOJ10
MRYGGGRKRRMLLQPFLVLCATMTGLGLLMLATRPLDPPITMGKDFEAGVVGKETLRIRRIIEDHFVLNGASRIRDLPPEQFCCHGFVLGKTAEAGFGNEMYKVLTAAALSIMLNRTDDFEKPAQTNVLCSNWKEWKQPIICSVFLENIHSQMRIAAFDLFGDPQVLGSQPNVFGELLRVLISPSKEVEAAVNWVIGDEENPDISLHMQILMNRYAGPLSCHNQTNQCAFTPLLPPGWWDGLWQSPIQKDINRLAAYGIKLSGLGTVDYDSLQNYCSTRKNVERTVTFIILAQGIGHADLLYIVPIVLDVSNGRIDVTNFLDLPALGRRQSPYMILRLCGDLLMQAPLELVGLRSSSSMDSFASWKMNGSRMEKGKERGDATSRRR

SEQ ID NO: 205237 - protein, 133 aa, Glycine max
  Coding DNA Sequence Number=SeqID_88459
MYKDNWTQPWPMGSEIYPKVHENPRAFFSSSSPIFLEPLAHGSSDWSLPREDCITCIFGKQSSGPGHCDPLCEEAPLLPKLRDYFAELLRESGLAPLGILYLSTCVGFGYRFGKGCQQINAMEQKSTHIISKP

SEQ ID NO: 205238 - protein, 348 aa, Glycine max
  Coding DNA Sequence Number=SeqID_88460
FDDFKTELERRNLHKCLTNLVDGTIDVALVKEFYANLYSSEDPSPKQARVRGHLVKIDADSLNTFLETPVVLEEGETLPTYSRYCRPSGEDSQEGSDYLGLGEECSRFLQPGPYISHLRPYYGQSQSNSSRLGFPALITALCRARGVVSDSLIFKRLIPAINLAYIGKNCWNINDQTVAFRGARRAKARPVDIPSSSTAPAPTLASTSTAPLERKKSETLVKEKRGKKKSETLEGKQLCLATKREDFDDVFPTSVPDGLPQLRGIEHHIDLIPGASLPNRPAYRSNPQETKEIERKVSELLSKSWVRDSMSQCAVPVILVPKKDGSCRMCSDCRSINNITIKYRHQIP

SEQ ID NO: 205239 - protein, 349 aa, Glycine max
  Coding DNA Sequence Number=SeqID_88461
  Homolog annotation: Hit_ID=Q1UFF6; Match level="QueryCoverage=19%, HitCoverage=27%, E-value=4e-21, Identity=69%"; Hit description =Transposase, IS4
  Pfam annotation: Domain name=Transposase_11; Domain location=141-322; Score=-0.1; E_value=0.011; Accession=PF01609.11; Description =Transposase DDE domain
MVKVGTSYVPINVSFSPKVGPELPGINRDTRIYLFCEVIFRHSCPSCSATDGVVRNGKKHRRTSALASVAAAQLLGRAIGAGLFAITPAGERGMCCKAIKLGNARVFPVTTLANWSSTAVAAALELVDPPGCRNSIPDMEWIFIDGSHVRAHQHSAGIANQSISKSVGGNSSKIHLIVDSHGNPIDFMITDGTTHDIKVAPDLIATLDYQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 205240 - protein, 55 aa, Glycine max
  Coding DNA Sequence Number=SeqID_88462
MPILRLWEEDEENNSIRGFSLPIWLKLECNEAYLMLLCPLPYTSASDSRLRLLII

SEQ ID NO: 205241 - protein, 88 aa, Glycine max
  Coding DNA Sequence Number=SeqID_88463
MEKVLSQSRFDDDGEGLGRWGLIDGNPRCSDMMVVRTCGDMDRDLGWILMQSYPSRALDRRLQEDWAKNAREGPRVFMTLRVDFGPMG

SEQ ID NO: 205242 - protein, 103 aa, Glycine max
  Coding DNA Sequence Number=SeqID_88464
MKLIEKIGWVSLNSVFKKKLEFDLNMFRKFKDHFFKVKATSVIDYGLPLMHDGIEEPCFLFYWQSDPTRFKSFDERLMSYEERADKAILERLSSKTLRYNGRL

SEQ ID NO: 205243 - protein, 163 aa, Glycine max
  Coding DNA Sequence Number=SeqID_88465
MSPTCWEKRLFNVKGGNLDKFKGCGLVLLILDNVSISNSALGIGGSNSVGSIQQLLVEWEVVPIGDSSLEESPHEASNSVSSFFERLMGSSHVGEGSSQPCEGVKPFTTPLEEELIHVTTLLPSSSLVTTRRNGGGEVRVSARNKCRRGDEMPSSFAFVVGFE

SEQ ID NO: 205244 - protein, 120 aa, Glycine max
  Coding DNA Sequence Number=SeqID_88466
  Subcellular localization annotation: CTP_CleavageSite=28; ConfidenceScore=5.59e-01
YLALDGIYRPIGAAFPNNPTRRQRLVVRQGPGTTGLSPSLAPPSRGLGPGPPLRTLLQTTIRTPRATDFHGRRALGLMASGATCVQRLDGSRILQFTQVSHFATFFIDAERDIRCESHCM

SEQ ID NO: 205245 - protein, 204 aa, Glycine max
  Coding DNA Sequence Number=SeqID_88467
  Homolog annotation: Hit_ID=Q1S119; Match level="QueryCoverage=50%, HitCoverage=97%, E-value=5e-34, Identity=69%"; Hit description=Wound- induced WI12
MRIATEKGKKKDEEKRWWIEGERDVGKENLLRWERSLPMEVEALQGGGRSPLKIKGYVLSCSVTRIPRNQTGDGFPDPTGDAALPDAGQTAGAGSGRNNLAGIVDASDGEGGVEVLSDLSDHPISDGPGVDPGNVAGGVAALDDDGGAEGGDGLRNESEGVVGGGVAGEHAHQKLGVIQCNHQPRVAGISVRATCLRVSQFEKE

SEQ ID NO: 205246 - protein, 179 aa, Glycine max
  Coding DNA Sequence Number=SeqID_88468
  Homolog annotation: Hit_ID=Q1RXL9; Match level="QueryCoverage=98%, HitCoverage=64%, E-value=1e-57, Identity=69%"; Hit description =Armadillo-like helical
  Pfam annotation: Domain name=Arm; Domain location=68-109; Score=17.5; E_value=0.047; Accession=PF00514.13; Description=Armadillobeta -catenin-like repeat
ELTIEEEAERKVGWLLKTIFFVTAGVAGYHFFPYMGENLMQQSVSLLRVKDPLFKRMGASRLARFAVDDERRKKIVEMGGAQELLNMLSTAKDDRTRKEALHALDALSQSVLASTSLFCSLSIEISYFNVIDEALASLHHAGAISVIRSAPNSLEDAEVEGFKLSLMKRFQDLRYDVPS

SEQ ID NO: 205247 - protein, 674 aa, Glycine max
  Coding DNA Sequence Number=SeqID_88469
  Gene Ontology: Mol. function=protein binding; Cellular component =integral to membrane; Biological process=defense response to fungus
  Homolog annotation: Hit_ID=Q5VPE8; Match level="QueryCoverage=91%, HitCoverage=88%, E-value=1e-67, Identity=29%"; Hit description =Putative HcrVf3 protein
  Pfam annotation: Domain name=LRRNT_2; Domain location=66-104; Score =46.2; E_value=1.1e-10; Accession=PF08263.3; Description=Leucine rich repeat N-terminal domain
  Pfam annotation: Domain name=LRR_1; Domain location=110-132; Score =12.0; E_value=1.6; Accession=PF00560.23; Description=Leucine Rich Repeat
  Pfam annotation: Domain name=LRR_1; Domain location=134-156; Score =9.9; E_value=4.1; Accession=PF00560.23; Description=Leucine Rich Repeat
  Pfam annotation: Domain name=LRR_1; Domain location=158-181; Score =11.0; E_value=2.4; Accession=PF00560.23; Description=Leucine Rich Repeat
  Pfam annotation: Domain name=LRR_1; Domain location=183-203; Score =3.5; E_value=62; Accession=PF00560.23; Description=Leucine Rich Repeat
  Pfam annotation: Domain name=LRR_1; Domain location=209-231; Score =4.5; E_value=41; Accession=PF00560.23; Description=Leucine Rich Repeat
  Pfam annotation: Domain name=LRR_1; Domain location=236-259; Score =2.6; E_value=94; Accession=PF00560.23; Description=Leucine Rich Repeat
  Pfam annotation: Domain name=LRR_1; Domain location=261-282; Score =9.5; E_value=4.7; Accession=PF00560.23; Description=Leucine Rich Repeat
  Pfam annotation: Domain name=LRR_1; Domain location=286-308; Score =10.3; E_value=3.4; Accession=PF00560.23; Description=Leucine Rich Repeat
  Pfam annotation: Domain name=LRR_1; Domain location=314-334; Score =12.1; E_value=1.5; Accession=PF00560.23; Description=Leucine Rich Repeat
  Pfam annotation: Domain name=LRR_1; Domain location=338-360; Score =9.7; E_value=4.4; Accession=PF00560.23; Description=Leucine Rich Repeat
  Pfam annotation: Domain name=LRR_1; Domain location=362-384; Score =14.9; E_value=0.3; Accession=PF00560.23; Description=Leucine Rich Repeat
  Pfam annotation: Domain name=LRR_1; Domain location=386-409; Score =14.8; E_value=0.31; Accession=PF00560.23; Description=Leucine Rich Repeat
  Pfam annotation: Domain name=LRR_1; Domain location=411-434; Score =9.5; E_value=4.7; Accession=PF00560.23; Description=Leucine Rich Repeat
  Pfam annotation: Domain name=LRR_1; Domain location=459-484; Score =5.5; E_value=26; Accession=PF00560.23; Description=Leucine Rich Repeat
  Pfam annotation: Domain name=LRR_1; Domain location=554-576; Score =10.5; E_value=3.1; Accession=PF00560.23; Description=Leucine Rich Repeat
  Pfam annotation: Domain name=LRR_1; Domain location=578-600; Score =13.8; E_value=0.63; Accession=PF00560.23; Description=Leucine Rich Repeat
  Pfam annotation: Domain name=LRR_1; Domain location=602-625; Score =7.9; E_value=9.4; Accession=PF00560.23; Description=Leucine Rich Repeat
  Pfam module annotation: Pfam domain module=LRRNT_2::LRR_1::LRR_1::LRR_ 1::LRR_1::LRR_1::LRR_1::LRR_1::LRR_1::LRR_1::LRR_1::LRR_1::LRR_1::LRR_ 1::LRR_1::LRR_1::LRR_1::LRR_1; Domain location=66-104::110-132::134 -156::...
  Pfam module annotation: Domain location=158-181::183-203::209 -231::236-259::261-282::286-308::314-334::338-360::362-384::386 -409::411-434::459-484::554-576::578-600::602-625
MAAYITAPNHNIQLTTQGMTQTLRIGDHLYHVTDSDDYSPNYIIGLREELQVREQDFGNFQVEERMETDNQALLKLKHGFVDGSHILSSWSGEDCCKWKGISCNNLTGRHLTFLDVSFNDLQGEIPKCIGSLTQLIELKLPGNEFVGSVPRTLANLSNLQNLDLRDNNNLVANGLEWLSHLSNLRYLGLSNVNLSRVVDWPSSISRIPSLLELYLDVCRLPQVNPKSISHLNSSTSLQIISFTSNELDSSILSWVLNVSKVFTSLDLSHNSLHSVPDGFANITLCQVKRLSLSHNKLSGQLSDYLPESCSAQHDLEELDLSHNPFSSGPLPDFSWFSSLKRLSLEYTNVVGQLSISFDHLRSLEDLDVSHNQLSGPIPYTIGQLSNLTHLYLCSNKLNGSISEAHLSGLSRLKTLDVSRNSLSFNLDPNWVPPFQLGWLSASSCILGPQFPTWLKYQRKLRVLQISNTDNIIEGTLPTWVGHNLLDLIVFSLRGEIPQCLSRIAALSNMEFQRSFILYFRDGYSDDTSSLPSIEITVMLAWKGQNREFWKNLGLMTIIDLSDNHLTGGIPQSITKLVALIGLNLSGNNLTGFIPNDIGHMKMLETFDLSRNHLHGRMPKRNIGLCGPPLTNLCSEDVVPPYGIIDKSDSNEDEHELVDIGFYISLGLGFSAGFC

SEQ ID NO: 205248 - protein, 223 aa, Glycine max
  Coding DNA Sequence Number=SeqID_88470
  Subcellular localization annotation: CTP_CleavageSite=44; ConfidenceScore=5.55e-01
MSPIKKITIAPKCTEALSIVPNMSETRSQSRFPSVPNCFQSFASGSKISRREVLQCGLSIGNTMDESYLAANPRNVDVLVHFMGVKGEPCEIHNIDPDKFGVYCAIDNINSFVEDLSLPPCHPFIMWFRCRNVTNISFGMNLDWLHLLSMNQSIRVEEVYVSEEDVTCGGLSEGSSSNMDVIGVGVVHSNLDMEEIYEENGLHGKQFELDSDGKIRFEIRKLF

SEQ ID NO: 205249 - protein, 196 aa, Glycine max
  Coding DNA Sequence Number=SeqID_88471
MLAPLQRVLLGAPNIFAEPPFLFIVLLSFSLFRAASCLVGEGSSVERNGEGEGIGIERCGGRWRQTRYANGGICRRRTNDFRIKLIRKCFTDQLDPESLLRINLIRSLQIKLIHEWMYEIMSERADMDYENAESCGANEPHVDCSDAFKTSQCREDVLRSGEYRCRKKEFIRRDTGTRKCGCPFKLRCKPVVGGEG

SEQ ID NO: 205250 - protein, 194 aa, Glycine max
  Coding DNA Sequence Number=SeqID_88472
  Pfam annotation: Domain name=zf-C2H2; Domain location=37-59; Score =18.5; E_value=0.024; Accession=PF00096.16; Description=Zinc finger, C2H2 type
  Subcellular localization annotation: CTP_CleavageSite=23; ConfidenceScore=5.37e-01
MADPTVIYEFFKKQPSNSGGGKRAAAPSSATATTRSFQCHFCHRKFYTSQALGGHQNAHKLERAAARRSSTNANLDLNVNVVTAAAANGPLRLPVEPTEPKPRPMLEPTSSPTELFFHHHPPPYWLDVEPLQFHHHHTTPPLSSFHAAAAAAAAAAASSAPHQQVVLSGHNVNDASSDHVNLDLTLRFFFAVDV

SEQ ID NO: 205251 - protein, 34 aa, Glycine max
  Coding DNA Sequence Number=SeqID_88473
MEGERRFYLCNDLRVVFPQRHSDADEGKCHTKAA

SEQ ID NO: 205252 - protein, 67 aa, Glycine max
  Coding DNA Sequence Number=SeqID_88474
  Gene Ontology: Biological process=regulation of GTPase activity
  Homolog annotation: Hit_ID=Q1SSA3; Match level="QueryCoverage=85%, HitCoverage=31%, E-value=3e-14, Identity=60%"; Hit description=C2
  Pfam annotation: Domain name=C2; Domain location=8-67; Score=28.3; E _value=2.7e-05; Accession=PF00168.20; Description=C2 domain
MENILGLIKLRIKRGTNLKVCDTRTCDPYVFVTMAEQKLKTGVVKDSINPEWNEELTLYPIMSGNGW

SEQ ID NO: 205253 - protein, 200 aa, Glycine max
  Coding DNA Sequence Number=SeqID_88475
  Gene Ontology: Mol. function=DNA binding; Cellular component =mitochondrion; Biological process=DNA integration
  Homolog annotation: Hit_ID=Q1SIP9; Match level="QueryCoverage=99%, HitCoverage=24%, E-value=9e-56, Identity=51%"; Hit description =Integrase, catalytic region
MSDEFTALMKNGTWSLVPSQPHYNIIGNKWIFRLKRNPDASIARYKARLVAKGFHQCADIDFKGTFSPVVKPQTIKLVLCIAILKCWTLSQMDVNLALFIRTSQIMFANYIKLCTISSKLHGHDYGFINSKSDPSLFIFKKGDVLAYFLVYVDDLLLTGNDSTFLDKFKSALAKKISLKDLGTPSHFLDVELLPTSTGIF

SEQ ID NO: 205254 - protein, 53 aa, Glycine max
  Coding DNA Sequence Number=SeqID_88476
MEGGSVYLVTENNFFGLDIPAFPRVIVGWEEVTGARGATARDGVEDDVYTSEE

SEQ ID NO: 205255 - protein, 72 aa, Glycine max
  Coding DNA Sequence Number=SeqID_88477
  Gene Ontology: Mol. function=nucleic acid binding; Biological process= DNA integration
  Homolog annotation: Hit_ID=Q1T1E6; Match level="QueryCoverage=90%, HitCoverage=10%, E-value=4e-23, Identity=81%"; Hit description=Zinc finger, CCHC-type; Peptidase aspartic, catalytic
MPFSWSCKKQSTVARWSTKVEYRTIGSTTTIELLWLQQVLHKLGINISQPPTIFSDNIGATHLCASPSFIPG

SEQ ID NO: 205256 - protein, 436 aa, Glycine max
  Coding DNA Sequence Number=SeqID_88478
  Homolog annotation: Hit_ID=Q9LW21; Match level="QueryCoverage=97%, HitCoverage=53%, E-value=1e-20, Identity=28%"; Hit description =Arabidopsis thaliana genomic DNA, chromosome 3, P1 clone: MDJ14
MGLPQIPPNETAEKVALVGAALTSSPHFSDASPSAINSLNSVNTGGLAGCTLGSSFDDFPKNASLEISNVSDDTFYRGAMEVASNVHSLKIGSTDKSTPFAPKSGRNVHIPALRVVGFESGQTNTSTDGLADVSVVNLHSSVSTNFPANDNESASSLVRKRLLSPLSSILSPSHFKGDPLDIGCRNNETGSLVKNDNVRNSIAHDNKKANIGSKSSYTMSSWSLTNCLEQRIVPHSTESFFQSDGPLKENRGLLSQGSSPTAGIDHFSELSQVRPQNGITSISPKNVSSPLSLSPLGRKFSERIKTAGGCRNVVEEIKNCNITSRSIEQSLDNSNSRLMLNYKDDDSRVARKSFDDVEFLCKDFCPSSLDDIADMSWPLCQESAPTSHSMRFTRSLSGLSVRRSLVGSFEESLLSGRFLSGNNSKVWLYANYHTVN

SEQ ID NO: 205257 - protein, 357 aa, Glycine max
  Coding DNA Sequence Number=SeqID_88479
  Homolog annotation: Hit_ID=Q67UP1; Match level="QueryCoverage=77%, HitCoverage=43%, E-value=3e-18, Identity=31%"; Hit description =Hydroxyproline-rich glycoprotein-like
MTSLDKNQGDFKVSNRVSSYSAPILAEKKFDPAEKVRQLLASSAAKSNAYVLPTPVNIKETKTSSAPHISASGSLHNLWHSSPLDEKKNEKDVDSKLSEPTIPRAHSVLKESNSDTTYTQLPRPSADGLSPPQVDLFSATDTKKIKRQAFSGPLTNKPLSVKPVSGGFPRLPVPQPSSPKASPNASPPLVSSPRISELHELPRPPGNQSSKPRVGHSAPLVLKNPEAAMTNKFPSVVFSAASPLPTPPVSRSFSIPSSGQRVVALNVSNTKYLDTPQVSKVDKAVSPPLTPMSQRASNISDLASHSSEIQVSIVICIMVYLVSFILMGNKCEYEVFQWMQVGAKSLAHILRLSSAES

SEQ ID NO: 205258 - protein, 64 aa, Glycine max
  Coding DNA Sequence Number=SeqID_88480
MELPKFDNDEVRYVDVVKKKVWSPQEVDMEIYAWDETNNSMMMVGKDGFMEDLDNDSNFNMQYV

SEQ ID NO: 205259 - protein, 83 aa, Glycine max
  Coding DNA Sequence Number=SeqID_88481
  Gene Ontology: Mol. function=RNA-directed DNA polymerase activity; Biological process=RNA-dependent DNA replication
  Homolog annotation: Hit_ID=Q1STT2; Match level="QueryCoverage=94%, HitCoverage=17%, E-value=3e-17, Identity=51%"; Hit description =Lipocalin
MAQALSMNRGRGIRRMAWGKLSMRKEFGGMGFKNLYAFDLAMLRKQGWKLLTNPKALVSHIFKVRYSPKRGFLGGFIRSQPIL

SEQ ID NO: 205260 - protein, 151 aa, Glycine max
  Coding DNA Sequence Number=SeqID_88482
MFTVSTVLRSSRCSKQAIVAISHVLHVLLNGEMETLNVTIISKPNEGEFVEFNGGGKVLFVLGDGLVKCNFLQLAERGLHLFCTLGREKEGEGLFGVVGIGGESQGKECGNGLRSAKDIEGEGGGWVKEGKKRDRSDRQQERERERCEMGN

SEQ ID NO: 205261 - protein, 250 aa, Glycine max
  Coding DNA Sequence Number=SeqID_88483
MGCGISTLDVEDASLNQHSKGRRHAIVPSIVDKKKNFENGDEGDGALLHTNNDNNNNNNKDKDVVLVTKPLGSDEGKDGGSNGKMLKEKSFVERNNINKEEEKVFGNGQKEKHSGGYNKYCEKNNIEEEHEDQDNRLLVGPRSPSFREYCNDYDCGDQISIGDSNDYDSMESIKNGSEDSSINKNKPKNEESANSKKESDKKERMGRGFRNVINKGKVRGRRNFLNFACYNASNESHAEASFNKIVAKSA

SEQ ID NO: 205262 - protein, 52 aa, Glycine max
  Coding DNA Sequence Number=SeqID_88484
MTCMALTLAVLSGAAVDHFYEKRDVQPKPVADYTIPAPNVTQMVEYELQCPF

SEQ ID NO: 205263 - protein, 274 aa, Glycine max
  Coding DNA Sequence Number=SeqID_88485
  Gene Ontology: Mol. function=protein binding; Cellular component =nucleus; Biological process=multicellular organismal development
  Homolog annotation: Hit_ID=Q1RXM4; Match level="QueryCoverage=99%, HitCoverage=95%, E-value=1e-111, Identity=73%"; Hit description =BTB/POZ
  Pfam annotation: Domain name=BTB; Domain location=97-209; Score=68.4; E_value=2.2e-17; Accession=PF00651.21; Description=BTBPOZ domain
MPLILRPPRNTICGACYEGVRSIINMMSNVESEKVKAMANPNPNSSPVSRRNSKRRNNTNIEIIFPLQTLDDCIRWCSEQMEQFNQQKEDLVFLRGFVSAFKAQIHTDILVSPGRHGPPIPAHKSVLGARSEIFKNMLECDECKAAPSNSITIPDLNHEELESLLEFLYSGTLGVEKLEKHVYALSQAADKYVIPHLLKHCERYLLSSLSTSNALETLEIADTCSNHNLKETTLNFLVKNIEHMVPSPKFETFVHRSPHLTVQLVTRAFVNGAK

SEQ ID NO: 205264 - protein, 157 aa, Glycine max
  Coding DNA Sequence Number=SeqID_88486
  Gene Ontology: Mol. function=transcription regulator activity; Cellular component=nucleus; Biological process=regulation of transcription
  Homolog annotation: Hit_ID=Q10LR1; Match level="QueryCoverage=95%, HitCoverage=89%, E-value=1e-39, Identity=60%"; Hit description=BHLH transcription factor bHLH033, putative, expressed
MVSREQKRATLNEKLQLLRSITNSNALDKTSIIIDASKYIEELKEKVERLNQDVANAQTSSDQNTLPMVTVETLEKGFLINVFSAKSCPGLLVSILESFEEMGLHVLEARVTCKDTFRFHAVGGKNEEQGDEDIDAQAVKQAMGQAIKNWSQNADQK

SEQ ID NO: 205265 - protein, 51 aa, Glycine max
  Coding DNA Sequence Number=SeqID_88487
  Homolog annotation: Hit_ID=Q1RXM5; Match level="QueryCoverage=92%, HitCoverage=48%, E-value=1e-15, Identity=85%"; Hit description =Hypoxia induced protein conserved region
METVQSWVSKHKLASIGALWASGIGATLVAYSCKKSPMKPSLRLIHARYLP

SEQ ID NO: 205266 - protein, 158 aa, Glycine max
  Coding DNA Sequence Number=SeqID_88488
  Subcellular localization annotation: CTP_CleavageSite=82; ConfidenceScore=5.79e-01
MKNANGVAALEPKRNPLSDLTNTNSNPSKPQSLLSSSSSSATNTTRGTVGLNVSEPISSFCSRIHALNEKKRNAKKAIANPKTSTVRDKNDGVELGSLDLTNARPRVLTVRCRKKRREQDVSNDPQMQDYIVKQKAYFKEIDEFELAEEEVESVHELD

SEQ ID NO: 205267 - protein, 183 aa, Glycine max
  Coding DNA Sequence Number=SeqID_88489
  Gene Ontology: Mol. function=peroxidase activity; Cellular component =vacuole; Biological process=response to oxidative stress
  Homolog annotation: Hit_ID=Q1RXM7; Match level="QueryCoverage=96%, HitCoverage=72%, E-value=2e-68, Identity=60%"; Hit description=Haem peroxidase, plant/fungal/bacterial
  Pfam annotation: Domain name=peroxidase; Domain location=1-147; Score= 110.0; E_value=6.9e-30; Accession=PF00141.13; Description=Peroxidase
MTKRKGEKTAAPNNNSVRGFNVIDDIKTKVEKACPQVVSCADILALAARDSVVYERGHTIGLARCVTFRDHIYNDSDIDASFAKSLQSKCPRSGNDDLLEPLDLQTPTHFDNLYFQNLLDKKGLLHSDQKLFNGDSTNKLVKKYATNTAAFFKDFAKGMVKMSNIKPLTGSEGQIRINCRKVN

SEQ ID NO: 205268 - protein, 588 aa, Glycine max
  Coding DNA Sequence Number=SeqID_88490
  Gene Ontology: Mol. function=transporter activity; Cellular component= membrane; Biological process=oligopeptide transport
  Homolog annotation: Hit_ID=Q1RXN7; Match level="QueryCoverage=99%, HitCoverage=100%, E-value=0.0, Identity=87%"; Hit description=TGF -beta receptor, type I/II extracellular region
  Pfam annotation: Domain name=MFS_1; Domain location=34-511; Score= -5.4; E_value=0.00056; Accession=PF07690.6; Description=Major Facilitator Superfamily
  Pfam annotation: Domain name=PTR2; Domain location=96-495; Score =486.8; E_value=2.5e-143; Accession=PF00854.12; Description=POT family
  Pfam module annotation: Pfam domain module=MFS_1::PTR2; Domain location=34-511::96-495
MEAKADYTQDGTVDFRGQPAVSSKTGKWKACAFLVGYEAFERMAFYGVASNLVNYLTTQLHEDTVSSVRNVNNWSGSVWITPILGAYVADSYLGRFWTFTLSSLVYVLGMTLLTVAVSLKSLRPTCTNGICNKASTSQIAFFYTALYTMAIGAGGTKPNISTFGADQFDDFNPNEKELKASFFNWWMFTSFLGALIATLGLVYIQENLGWGLGYGIPTAGLLLSLVIFYIGTPIYRHKVSTTKTPARDIIRVPIAAFRNRKLQLPINPSDLYEHNLQHYVNSGKRQVYHTPTLRFLDKAAIKEVSAGSTRVPLTVSQVEGAKLIFGMALVWLVTLIPSTIWAQINTLFVKQGTTLDRNLGPHFKIPSASLGSFVTLSMLLSVPMYDRFFVPFMRQKTGHPRGITLLQRLGIGFSIQIIAIAIAYVVEVRRMHVIGANHVASPKDIVPMSIFWLLPQYVLIGIADVFNAIGLLEFFYDQSPEDMQSLGTTFFTSGIGVGNFLNSFLVTMVDKITGRGDKKSWIGDNLNDCHLDYYYGFLLVMSSVNMVVFLWVSSRYIYKRESIRVKEGLCVQMEGGNPTLDASLGLQV

SEQ ID NO: 205269 - protein, 80 aa, Glycine max
  Coding DNA Sequence Number=SeqID_88491
MRLPQEPSNEKPRGLARKSMAKINSEELCGAATMSSSSGERKETNHEYMAWELTITKKAQMHPYNTRSRSKMDNEEGVQE

SEQ ID NO: 205270 - protein, 230 aa, Glycine max
  Coding DNA Sequence Number=SeqID_88492
MARKARSLPFWPTCMTRLIGDVKRAAQELFAVHWLSTCGWVRTFFAKKVGPSVRYKVTARALRKERQIGTNSLLAWRGRPLIGSLTGRKEEPIFCSRAKDFQMILQGVHKAWDAVQRKDKELRGSSNGIIGGYRQWLRVRTQGLDWLPKLRAAREEEAEAPKESEEVQALMAELEKAQAVKEKFKSTTIKVRREYDELKDINMDTAEALERETKRALKEEDGRTKFRGAL

SEQ ID NO: 205271 - protein, 227 aa, Glycine max
  Coding DNA Sequence Number=SeqID_88493
  Gene Ontology: Mol. function=hydrolase activity; Biological process =metabolic process
  Homolog annotation: Hit_ID=Q652P6; Match level="QueryCoverage=58%, HitCoverage=35%, E-value=2e-07, Identity=27%"; Hit description =Putative genetic modifier
MSSYVIRVYQIKAIGAEYGEGFETFRADGPLKVDVDYLNEKLQDGFLQRIRYAMKPDEAYGLIFSWDNVVAGTRALKRKAWEQLAFEEGKDIPEGDMHKLLFYAGADYVLHKFFLSDKAENELNRLKLRFSQIYYDNLVRLEKPMDGLNDWLEAVYTARIPCAVVSSLDRRNMLEALERMGLSKYFQAIVTEEDGMESIAHRFLSAAVKYNTIITLRQVSRSIFTKL

SEQ ID NO: 205272 - protein, 254 aa, Glycine max
  Coding DNA Sequence Number=SeqID_88494
MTPRRHPVDLEKSNRALGFPTLITGLCQFYGVPIAPNKVIQPPITRAFIEKYYTSRKAQGEAPQQLGDTQPQAADAPPSPLESTSVHLRSQDPDTYAWPTPEQFGAMAGDWSDAQIGAGPTGTSGDGYGAKEDDDMADVMDFFLGGGGDRQASPLTRKDQYVHLHPFIEDSTFIDRDYVSLISSSRDSKADDTWRQTIVICHLCYPETIESDSMQRQASLLTETTLVSPSSSRDDKSDGTRKPVMVIYHLCQPE

SEQ ID NO: 205273 - protein, 560 aa, Glycine max
  Coding DNA Sequence Number=SeqID_88495
  Homolog annotation: Hit_ID=Q10LQ3; Match level="QueryCoverage=94%, HitCoverage=97%, E-value=5e-47, Identity=31%"; Hit description =Expressed protein
  Pfam annotation: Domain name=DUF827; Domain location=51-409; Score =169.9; E_value=6.6e-48; Accession=PF05701.2; Description=Plant protein of unknown function (DUF827)
MAESRDAAAAAADGVPGTPAIREVRPESGTHAGIGSGGIRRVNFRAEIDTSPPFGSVKEAVTRFGGSGPWIPYFNNIENFDLKKVEEQAAELEKDLIVKELETLDVLEELGATKRIVEDLKQQLQKEAMKCLATRDVNSYEEAGTPVIKEKDEENCGNIVNDEEQVMQIPSPCSMSSSPDMILMELKKAKLNLGKTINELGVIQSSIESLNKKMKKEKNFLERTREKLASKFAAESAQERVQEQTRLNPPAPHVEFTFGNPANNFNSDSGQCNGMAETRRPEPSKPLSVYEEYGFSVKTAEIRWLAAKKMEEAARAAEAIALAEIKALSNAQRSLGFVLPEPEKVTFAFGERSPLNPKAQIPKESTLKKVIDSKFQIDETKISKLTILKKLEEAAEEVLHSKQVLTDALNRIETANRKQHAAKEALRRWIPEDDMKEYSTINCNKFNQTGIYQDSLQDVTRSTTANNDPKPALRPTISMRDVLSRKQVPEGYATRKEMEEHTERQKVALSQMLQALREDLTLPPKTEKDGNNQKPYVAQRKKFGFIQISLPLAKPNKKRG

SEQ ID NO: 205274 - protein, 67 aa, Glycine max
  Coding DNA Sequence Number=SeqID_88496
MVCGTGLGIPDTQRVPDGYGDETINSNPSGIGYGYEDMLRSRDMRTQEDNRCEEVQWTKKKARCYQS

SEQ ID NO: 205275 - protein, 215 aa, Glycine max
  Coding DNA Sequence Number=SeqID_88497
MPSLAKSLFLCCRANYALRAKRILLFSEGALSEWPLGRGKLLPIDLESPMIPLDSYLRAPRRDMHRTFTLGTSFWRGTELKQRNWHKALTRQPDGHNDVALVKEFYAKLYDLEDKSPLQAYKGEVSLRTGHEDGYGLGLAHFRPNLTDGPIQLLSARLSCTYYSLGVARGEPQPEPEVTPESTPETTPTATPLVEITEDEDGTADTDYAADMAAA

SEQ ID NO: 205276 - protein, 249 aa, Glycine max
  Coding DNA Sequence Number=SeqID_88498
MEESMSPFLVRDFGAQNFKAIQRIHKAWETPLRKDQELRGIRNGIIGGYHEWLKVHIRGLDWLAKLKVVNEESFEAPKEDEEVQDLKNELGKAKLAKEKFKLAATHIWKGMCRDYGKRMQLPQEPLEQETKRARKGRELVACSRSKRSLSQRLCETETNMLAIITKYQEELSLATAHEHRVANEYAQVYAEKEARGRVIDSLHQEATMWMDRFALTLNGSQELPRLLAKAKAMADTYSAPEEIHGLLDY

SEQ ID NO: 205277 - protein, 77 aa, Glycine max
  Coding DNA Sequence Number=SeqID_88499
MSVLSSNKLNKCFMFKILVMKGCQWFYTEKQLVLMLKMMIQSLILVSVLSPHKCYLTSLENKLTTSSQIIMIMMKEN

SEQ ID NO: 205278 - protein, 111 aa, Glycine max
  Coding DNA Sequence Number=SeqID_88500
  Gene Ontology: Mol. function=protein serine/threonine kinase activity; Cellular component=cytoplasm; Biological process=protein amino acid phosphorylation
  Homolog annotation: Hit_ID=P15792; Match level="QueryCoverage=96%, HitCoverage=17%, E-value=8e-37, Identity=73%"; Hit description =Protein kinase PVPK-1
MADHAKSYYQLEVTFYPSPQNSFYSTTVYSEAKESFTNTKVNECASVDKSYESEEMENYYHINENRKTSICKASTGNDASDESNTSSLSSVMYKQHKANDKRWEAITATRA

SEQ ID NO: 205279 - protein, 75 aa, Glycine max
  Coding DNA Sequence Number=SeqID_88501
MDETASAAKEKKRMDTEAIEKIVDVKRKMDIDAIKNMPRLSRELVEHRLPIYEGKKPVKHAPRRFAPNVIEVTKA

SEQ ID NO: 205280 - protein, 95 aa, Glycine max
  Coding DNA Sequence Number=SeqID_88502
  Gene Ontology: Mol. function=protein serine/threonine kinase activity; Cellular component=cytoplasm; Biological process=protein amino acid phosphorylation
  Homolog annotation: Hit_ID=P15792; Match level="QueryCoverage=79%, HitCoverage=12%, E-value=2e-31, Identity=84%"; Hit description =Protein kinase PVPK-1
MEIMNKTKLANRKKLLRSQTEREILQSLDHPFLPTLYTHLEAKTFSCLVMEFFPGGDLHPLRQRQPEKYFSEHAVKSLEGKLHPFFGNKYQLRFS

SEQ ID NO: 205281 - protein, 154 aa, Glycine max
  Coding DNA Sequence Number=SeqID_88503
MRIRKALKSSYNLLPKEAGRMRMENNFFFLPLCICKGKAAYNIPPPYLRIAKSLWAMGHAEGSQIEPVDVEMRDRLEEMIHDLGKESFQQAHAPMYNTLESDSKKPLYPGCKKSLTLLSAVLSLVNAKAKYGWSNKSFTSLLQVGQEMLPEENT

SEQ ID NO: 205282 - protein, 131 aa, Glycine max
  Coding DNA Sequence Number=SeqID_88504
  Gene Ontology: Mol. function=RNA-directed DNA polymerase activity; Biological process=RNA-dependent DNA replication
  Homolog annotation: Hit_ID=Q1SP50; Match level="QueryCoverage=99%, HitCoverage=16%, E-value=4e-18, Identity=33%"; Hit description=RNA -directed DNA polymerase
MESLRGKEDDELIKEYNREKKNLTKFLLQEERFRKQCSKVHWLRGGDRNIKYFHVSVKARKIIKQISSFEDEDGRKVDSQKEICALTFNYLPDLFTASVGDYDSVANKISQKDNEMLIHPFTKEEFKEVVF

SEQ ID NO: 205283 - protein, 163 aa, Glycine max
  Coding DNA Sequence Number=SeqID_88505
DSLQNVANIIMSQWVDQCLNVMCHGVGFVAQTQCLGSKKEEIGFVKILAKALSVFVTMEWVPPLDPKVKVNFVVAMIEDVGTGLEVIFSNSKGETMASECRNMMQGIGSSLTLVAKNGNEVAQCLATMAYDYGERVWIEEVPNEASQCLQSDVVEIANVFLVQ

SEQ ID NO: 205284 - protein, 329 aa, Glycine max
  Coding DNA Sequence Number=SeqID_88506
  Gene Ontology: Mol. function=RNA-directed DNA polymerase activity; Cellular component=extracellular region; Biological process=RNA -dependent DNA replication
MVYSSSVVLDSRSSVWKGIWHAEAPVTCRSLAWRACRDELPVRSLLVQSGLVDNALCPICGRLPETVTHALLLCDDAKLVWFASPLGLRVESLRGVSTLSQWIDQYCVDTLDDEAMGVVCATMWALWHRRNAWVFHSKGMDCMQVLAKASSMFVVVPDGPDAWVLPSSPYVKVNFAAAVKDNVGTAMGMIFRDSFGTTRASGTNFLEDECFEPQIAEALCYKWALEQSGDLGFSEIIFETDCQKLYIQWNQLKQGKASDDSYLHSLLEECIMMIQGTGSSLRLVRPTANKVAQCLADVAFDYGEKVWMGVVPEEVSSHLQSDMANAKLP

SEQ ID NO: 205285 - protein, 384 aa, Glycine max
  Coding DNA Sequence Number=SeqID_88507
  Subcellular localization annotation: CTP_CleavageSite=34; ConfidenceScore=5.04e-01
MSDIPFRSLKSARKRAAFFVFSGKRDELAKRACCANHALSRAFLSQAQLVAASTELSELYSLSSQHLVKFLKNRRILPERNVELYHSEFDEFKIELERRNLHKRLANLHEGSIDVAVVKEFYANFYSPAYQAPKCAKIRGHLIKIDADNLNEFLQTPMLLEEGESLPTYSRFCRLRYDPREMEARLCIPGKGFILNTEGQPGKLLRKDLTTLAQTWSVFSYSNLAPTSRTSDLNTDIARLVYGLITRMDMNIGGLIFGKMTMIAQSNSSQLGFPALITTLCRSRGVGSDALTSYENLRPTIDLAYIIRNCWNANDQIVNFLEARKTKLRATDIPSSFTPIARILASSTSAPPPTLADLYAQSSQNSYAKFQSLFEGKILIIQSL

SEQ ID NO: 205286 - protein, 286 aa, Glycine max
  Coding DNA Sequence Number=SeqID_88508
  Gene Ontology: Mol. function=protein serine/threonine kinase activity; Cellular component=intracellular; Biological process =protein amino acid phosphorylation
  Homolog annotation: Hit_ID=Q2QB51; Match level="QueryCoverage=87%, HitCoverage=20%, E-value=1e-119, Identity=79%"; Hit description=Fused
  Pfam annotation: Domain name=Pkinase; Domain location=6-239; Score =292.6; E_value=7.3e-85; Accession=PF00069.15; Description=Protein kinase domain
  Pfam annotation: Domain name=Pkinase_Tyr; Domain location=6-239; Score=70.8; E_value=4.3e-18; Accession=PF07714.7; Description =Protein tyrosine kinase
  Pfam module annotation: Pfam domain module=Pkinase::Pkinase_Tyr; Domain location=6-239::6-239
MGVENYHVIELVGEGSFGKVYKGRRKHTGQTVAMKFIMKHGKTEKDIHNLRQEIEVICLIDILRKLKHGNIIQMLDSFESPQEFCVVTEFAQGELFEILEDDKCLPEEQVQAIAKQLVKALHYLHSNRIIHRDMKPQNILIGAGSIVKLCDFGFARAMSTNTVVLRSIKGTPLYMAPELVREQPYNHTVDLWSLGVILYELFVGQPPFYTNSVYALIRHIVKAPESRLTWPTLLEHPFVKESSDELEARELREINGSHMHSDEARVVEGKTIQTPTTGSATSSTAR

SEQ ID NO: 205287 - protein, 922 aa, Glycine max
  Coding DNA Sequence Number=SeqID_88509
  Gene Ontology: Mol. function=protein serine/threonine kinase activity; Biological process=protein amino acid phosphorylation
  Homolog annotation: Hit_ID=Q2QB51; Match level="QueryCoverage=77%, HitCoverage=54%, E-value=0.0, Identity=51%"; Hit description=Fused
MCSDQDVPESNQSLRILSNLVAAGAFSSSGLIDELIKELLVFTESVIAMKSSEVTDMMAKLLLPLARGGLLPALSQWFVTCVAFVVFMVGVVVAMTVRSIMFEEINMNEDTGEELAVVENIDCSDAFNTSQDALPWACIVVYDIGFVAVIVRSDTSTGKRGRTSFVLIGCERSVKYRVYKKGLVLTMTSTRKCGCPFKLRMKPDGKIILSDMTKSMVKSKDILLILKEQYANNCTTMKQVYNGFSITKILLDNGGSFTSSSYVSHWVEFVEIYSQVVTSNNDASGRVLYESSACITVMLSRVAQVLRSSPKISGQEKLNETAYRILEHSKTTGLVDHLCLCLATSGSSLITGSSNMLRAASEACKAVWMEVVHHEQDLLHKADSTKVVDAMTRAFLRSKTVLVAVYYCFHQGLESAMNCGLQLLSRCCLHNGIVPALLCGLPSSLPVTTVVSGGGDGTIVSEVFTVLSLCSSSVNKDTQSVEPSNAKCKLTNPSALVRHSCLLVAVIAQCLKSSGRNSAIFMLTTSPKKQFARLSVLAHQISSDDKIKASIEPQSASAMLALASILSLESGALVESPISEIAMPLIPRTSTLSDHLKFSSSNVNELDPCNISGKFSYWQGVRDGFVGLLDSRLKWGGPLAVQQLCASGTPLLLMGLLGNDVLNASHGNDHVNDRVGLSPIGVVWTISSLCHCLSGGALTYRQILIRNEHIKLFSNLICDVHMKLVKCWIGPGGGRAGVRDLINGVIDLLAFPFVALQNAPGLPSATASVSSGFLLNIGSPGQRVCMEDKGIVKAIEEDMGKYIKILVEVGVPGIILRCLDHMDLNDLGRPVAFMAKMVCHRPLAIQLVSKGLLDPNSMRKLFDCLAPKEVKLDALMIISDLARMDKGFYEYIKGASILEFLKDFLSHEDPNMRAKACSALGN

SEQ ID NO: 205288 - protein, 93 aa, Glycine max
  Coding DNA Sequence Number=SeqID_88510
  Homolog annotation: Hit_ID=Q1T4J9; Match level="QueryCoverage=36%, HitCoverage=5%, E-value=3e-13, Identity=88%"; Hit description=DNA -binding WRKY
MFQAHVGDFGLAKSIDFSYSKSMSAVAGSYGYIAPGKNKFTTLEKKLLSGMGCGRAEAEEIMGANGENMDRKWPKEIHAPELTIDALLLHLAL

SEQ ID NO: 205289 - protein, 88 aa, Glycine max
  Coding DNA Sequence Number=SeqID_88511
MEYVKQSGHHLAKTLYGTEVESTIDAKDPFLTKLWVVKATPKCKTLSWDFREVIAKAWLQKLNLRQHKQREAPSTILHGNAQQFMKSN

SEQ ID NO: 205290 - protein, 115 aa, Glycine max
  Coding DNA Sequence Number=SeqID_88512
  Homolog annotation: Hit_ID=Q2QB51; Match level="QueryCoverage=55%, HitCoverage=4%, E-value=1e-17, Identity=64%"; Hit description=Fused
MMRMKICNLKISELRGIFVWILVHVLISVHIKSTSLLKLISDCAVSALNPSRNDSGNESPLKIALFSLAKMCAHPLCRHFIRSSPLFPVIGRLQQSPESSIAKYASAIISKVAEP

SEQ ID NO: 205291 - protein, 215 aa, Glycine max
  Coding DNA Sequence Number=SeqID_88513
  Gene Ontology: Mol. function=DNA binding; Cellular component=nucleus; Biological process=regulation of transcription
  Homolog annotation: Hit_ID=Q9FY93; Match level="QueryCoverage=68%, HitCoverage=57%, E-value=1e-16, Identity=33%"; Hit description=NAM -like protein
  Pfam annotation: Domain name=NAM; Domain location=14-141; Score=30.5; E_value=2.4e-10; Accession=PF02365.6; Description=No apical meristem (NAM) protein
MEVLNPIEGKTYKLPVGYRFDPSDEILAGYYLRKRIMAQPLPNDLIQDCDVYQTVPWELPGGGNKYLNWQRFFFHDLRTCVFDNLNKREAGNGQWRTIEEAQDVELSNDQVVAKRNVLAFWEAKGNGFAKSNWLMHEFRLVSKSLPSMVSSVAVYRIFEKKEGRKGKKAKGSEGETSSSSSSEEEVMDEAPIVIDFTMESCIGTGPPSPATSENS

SEQ ID NO: 205292 - protein, 78 aa, Glycine max
  Coding DNA Sequence Number=SeqID_88514
MVSLIGLLLGAGRMKEMCKIFKRSAKGSLLGHFLAPGPTRKLRAEVTSSPGRARLLLEEASSSPGRAVTQPPPFISYK

SEQ ID NO: 205293 - protein, 83 aa, Glycine max
  Coding DNA Sequence Number=SeqID_88515
  Homolog annotation: Hit_ID=Q9FFI5; Match level="QueryCoverage=59%, HitCoverage=10%, E-value=8e-07, Identity=42%"; Hit description=NAM (No apical meristem)-like protein
  Pfam annotation: Domain name=NAM; Domain location=15-83; Score=-59.0; E_value=0.055; Accession=PF02365.6; Description=No apical meristem (NAM) protein
MEIINPITKEKTYVFPVGYKFDPNDDDLVSYYLRKKIIREQLPEKLIQESDVFGTEPWGLPGGHLHVIGMCITCFPPFDYINN

SEQ ID NO: 205294 - protein, 261 aa, Glycine max
  Coding DNA Sequence Number=SeqID_88516
  Gene Ontology: Mol. function=carbohydrate binding; Biological process= arginine biosynthetic process
  Homolog annotation: Hit_ID=Q7WP92; Match level="QueryCoverage=55%, HitCoverage=18%, E-value=2e-27, Identity=42%"; Hit description =Hypothetical protein vrgS
  Subcellular localization annotation: CTP_CleavageSite=22; ConfidenceScore=5.10e-01
PAAPAETVQNSAPAADPAVSPSASSAPAATAAVTPEKPREAEAQPAPPPEPVAQVYIKLQQGERVQVNGKPQALVPAANGFAALQLAPGNYTFAISGQGGTREQTLTISEEGVWLLDPHTERRAAGHGCAHRPARAAGAAGHVHAADAEPAVAALPQRENHAGGGAQRGAERDALRGVPAAGGAGPVADAPGPQPADISGSDGAADSADAAAGERGERGDAAGQQLPGVGVLRAVPGEQLRLHQPADGAGGDLLLVPPRGG

SEQ ID NO: 205295 - protein, 129 aa, Glycine max
  Coding DNA Sequence Number=SeqID_88517
  Gene Ontology: Mol. function=zinc ion binding
  Homolog annotation: Hit_ID=Q2R1H8; Match level="QueryCoverage=84%, HitCoverage=24%, E-value=8e-35, Identity=86%"; Hit description=Zinc finger, C3HC4 type family protein, expressed
  Pfam annotation: Domain name=zf-C3HC4; Domain location=34-80; Score =41.9; E_value=2.2e-09; Accession=PF00097.15; Description=Zinc finger, C3HC4 type (RING finger)
MADHSDSSPLVPPLPLADPSEIDLEAGPSEQIQCRICLETDGRDFIAPCKCKGTSKYVHRECLDHWRAIKSSDEKNCRQQANFSLEKKSSNVYGALWGVRKGLPLLTALRARLLIICVFMLPLIGNGVP

SEQ ID NO: 205296 - protein, 66 aa, Glycine max
  Coding DNA Sequence Number=SeqID_88518
MAQLQKQQNFCFVLLLFVALGIAYAREAFEVSFQQNYKIAWGKHHIFFLQHGREVQLSIDKTSVRA

SEQ ID NO: 205297 - protein, 125 aa, Glycine max
  Coding DNA Sequence Number=SeqID_88519
MILTFPLCLILVNYFGGNLPVVSGMQYICHCAASNSSHRIYYHLKLTCHLCGNSENNMSSIGARSAEIYVMEKRQKEKLKRMEVERVRRGEVSTEERKVASSSVGKNKVHPGSEQGVTSDNAFRA

SEQ ID NO: 205298 - protein, 106 aa, Glycine max
  Coding DNA Sequence Number=SeqID_88520
  Gene Ontology: Mol. function=zinc ion binding
  Homolog annotation: Hit_ID=Q2R1H8; Match level="QueryCoverage=98%, HitCoverage=38%, E-value=6e-34, Identity=60%"; Hit description=Zinc finger, C3HC4 type family protein, expressed
VCADCHLPGTLCMWTDCTTCFESCGTMATECGGCLGGAGEAGLPLLFIMALIVLGLFTVIGIFYSVLVATMEYVVEDVDGELTGSDWSPPALPPEHIQQLKTLGLL

SEQ ID NO: 205299 - protein, 195 aa, Glycine max
  Coding DNA Sequence Number=SeqID_88521
  Homolog annotation: Hit_ID=Q1STT2; Match level="QueryCoverage=62%, HitCoverage=30%, E-value=9e-09, Identity=39%"; Hit description =Lipocalin
  Subcellular localization annotation: CTP_CleavageSite=3; ConfidenceScore=5.04e-01
MVKQGVIGGLAMVILLMSGLNLGSNNNLNPFVSTTPIMVSLLLKNDILDSNFNQEDAQKIRSLTLLNITERDQLSRKYSTNGEYTVKSAYHAIMDHLLDNSHLKESHLLWPSLLLCSIWQNGSMPVPCTTNNVHLQLIMAQHHKFLLTKDISNGNFIKAKSATIQEHPKPEVAEAWALHQSINWIKRSTTPERDF

SEQ ID NO: 205300 - protein, 279 aa, Glycine max
  Coding DNA Sequence Number=SeqID_88522
  Homolog annotation: Hit_ID=Q6H5H5; Match level="QueryCoverage=35%, HitCoverage=17%, E-value=5e-14, Identity=57%"; Hit description=Emsy N terminus domain-containing protein-like
MMSIQFPSTGLTSQSQDQGVLQVPLQQKDLLKELLMIPGLEGKFGQGGLKTTTSMKLGSSASKEHQTEVQAQNRGVQIARKAKRVITRPSHLSDYGLHALVYDMNSANETWEWVNLKEISPEDIRWEGQDPGISGKGGRPGPGRGLKKSMPHGGAVTGSGRGRGMMKVQPKKDFTLSQKGAGRRLQMILRYSIQIPLSRRKMNRLLLMQLPGSEMCLRVKVPDVEPPFSQDQSMDQEKHWKKQQYNSSGVRVPDGSNGDKLPRETSAPSEYPHEVGNKA

SEQ ID NO: 205301 - protein, 141 aa, Glycine max
  Coding DNA Sequence Number=SeqID_88523
MEHNNNELSAYMTLSMFRHERIKTVKTEKNKNKNTTDVINGDGILLNAFQNLQLGKAFEQPLPSHALCMPARENKLIGIRVRVGVGIDGNLAIEGRFDFVVGERKEPKPKPKRRRALRGAIEEVENVVATAKEEDQTTRSK

SEQ ID NO: 205302 - protein, 99 aa, Glycine max
  Coding DNA Sequence Number=SeqID_88524
SLVVKDFLNTREGLSLCDSDFVKGFYKESGNSQAGCLGTGRRHRKNVWSAWANSILEGKSRLLLLLLRARPSEIRVIPPSRVVSVAGEVAAWKGKGLYG

SEQ ID NO: 205303 - protein, 71 aa, Glycine max
  Coding DNA Sequence Number=SeqID_88525
MESVKIESRERQSERLEVADQQLLPRNGSGKRAAGSTKKSKRGERDLEGVRSEAGSVCDNEHRQQLQPASS

SEQ ID NO: 205304 - protein, 194 aa, Glycine max
  Coding DNA Sequence Number=SeqID_88526
  Gene Ontology: Mol. function=nucleotidyltransferase activity; Cellular component=nucleus; Biological process=NAD biosynthetic process
  Homolog annotation: Hit_ID=Q9FM58; Match level="QueryCoverage=55%, HitCoverage=49%, E-value=5e-37, Identity=65%"; Hit description =Arabidopsis thaliana genomic DNA, chromosome 5, P1 clone:MDF20
  Pfam annotation: Domain name=CTP_transf_2; Domain location=1-167; Score=20.4; E_value=1.1e-05; Accession=PF01467.16; Description =Cytidylyltransferase
MEAKGQKNKDLLGSYIMGNIIKKLYTEQGLISAEHRIQLCHLAGKSSDLIMVDPWEASQSTYQRTLTVLSRVHNSVCETGLVSQESLKVMLLCGSDLLHSFSIPGFWIPDQVKTICKDYGVVCIPREGQDVEKTIFKDDILNENKDNIKVVNELVPNQISSTRVRDCIARGLSIKYLTADEVIDYIREQQLYLN

SEQ ID NO: 205305 - protein, 87 aa, Glycine max
  Coding DNA Sequence Number=SeqID_88527
  Homolog annotation: Hit_ID=Q5Z6I4; Match level="QueryCoverage=63%, HitCoverage=5%, E-value=6e-14, Identity=62%"; Hit description =Putative Osnop
MWVMLEGKLAQSSKSKLHLRIFLDNNNGVETIKEYLEKMEKEVGKKLNLRSPQRNSTSLATLGSPTLVIILRRGRGLDAITSSYRKI

SEQ ID NO: 205306 - protein, 81 aa, Glycine max
  Coding DNA Sequence Number=SeqID_88528
MSNASVEVVQGSRSVEVRDANVTKSVSANKDMTVVDYDVMTIMVKDRGRSSSGAGGYLVRLNKRQRSPYATLQLNIIYQTL

SEQ ID NO: 205307 - protein, 389 aa, Glycine max
  Coding DNA Sequence Number=SeqID_88529
  Gene Ontology: Mol. function=protein dimerization activity; Cellular component=nucleus; Biological process=regulation of transcription, DNA-dependent
  Homolog annotation: Hit_ID=Q8S7E7; Match level="QueryCoverage=87%, HitCoverage=34%, E-value=3e-57, Identity=46%"; Hit description =Putative transposase
HDFGKQSGGDTFVIEGLTNWNKKERLSSHVGGPNRAHNIAWRKHLTMSIDCIRFLLKQGLAFRGHDKSTNSANQGNFLELHRFLAEHNESINHVVLENAPENHQLIASKIQKDIVNAAALETTNAIITDLGDELVAIIVDEAHDISNKEQMDIALRYANKKGSIVERFFGMVHVKDTTALSLKMAIDELFCKHGLSISRIHGQGYDGASNMQGEFSGLKSLNQETRLKRAVDTRWGSHYATLINLILMYSSIIDVLEIIKEDGSNADQRAKANGLLHLLEDFDFAFTLHLMKNVLGISNELSQALQRKDQDIINAMNLVNITKLRLQTMRDNGWESLLQEITTWSVGVSQYCASELHKVGSEAGAAIVCVLLIESTSDEYDSFDVAVIV

SEQ ID NO: 205308 - protein, 58 aa, Glycine max
  Coding DNA Sequence Number=SeqID_88530
  Homolog annotation: Hit_ID=Q6ZKN1; Match level="QueryCoverage=77%, HitCoverage=6%, E-value=2e-16, Identity=93%"; Hit description =Putative CLC-f chloride channel protein
MWNWEVRNTVDEITEANIIMAVVNGGEFSARRGLSTVSIAKKQPATGALKPEERTIEN

SEQ ID NO: 205309 - protein, 77 aa, Glycine max
  Coding DNA Sequence Number=SeqID_88531
  Homolog annotation: Hit_ID=Q9FHG4; Match level="QueryCoverage=69%, HitCoverage=7%, E-value=2e-10, Identity=62%"; Hit description =Serine/threonine-specific kinase like protein
MEFIAMMNLKDDQLNPDSAERPSMRRVLQILNNEVAPLVVPKVKPTLTFSSDLPLPLTIEDIVSEADQESICEIKID

SEQ ID NO: 205310 - protein, 490 aa, Glycine max
  Coding DNA Sequence Number=SeqID_88532
  Homolog annotation: Hit_ID=Q8ZBN1; Match level="QueryCoverage=39%, HitCoverage=35%, E-value=1e-105, Identity=97%"; Hit description=CTP synthase
  Pfam annotation: Domain name=CTP_synth_N; Domain location=285-490; Score=452.6; E_value=5e-133; Accession=PF06418.4; Description=CTP synthase N-terminus
  Pfam annotation: Domain name=MazG; Domain location=169-239; Score =23.2; E_value=8.1e-06; Accession=PF03819.7; Description=MazG nucleotide pyrophosphohydrolase domain
  Pfam annotation: Domain name=MazG; Domain location=39-112; Score =147.7; E_value=3.1e-41; Accession=PF03819.7; Description=MazG nucleotide pyrophosphohydrolase domain
  Pfam module annotation: Pfam domain module=CTP_synth_N::MazG::MazG; Domain location=285-490::169-239::39-112
MAAFYLVVPGTFMTALNRLLTIMQTLRDPVRGCPWDRQQTFASIAPYTLEETYEVIDAIQREDFDDLRGELGDLLFQVVFYARMAEEQQRFNFDDICNAISDKLERRHPHIFGEAQVDSTAEVLKNWEAIKQRERAEKSQHSVLDDIPKALPALMRAYKIQKRCHSVGFDWDSLGPVLDKVHEEIDEVMHEAQQAVVDSDKLEEEIGDLLFATVNLSRHLGSKAETALQRANDKFERRFRQPANNLIQPLCAAQAVMRGGWCDSSIVAADDFGYTVFPSWLFHRIAAASLAAILEARGLNVTIMKLDPYINVDPGTMSPTQHGEVFVTDDGAETDLDLGHYERFIRTKMSRRNNFTTGRIYSEVLRKERRGDYLGATIQVIPHITNAIKERIIEGGEGHDVVLVEIGGTVGDIESLPFLEAIRQMAVDVGREHTMYMHLTLVPYMAAAGEVKTKPTQHSVKELLSIGIQPDVLICRSDRAVPANERAKIA

SEQ ID NO: 205311 - protein, 180 aa, Glycine max
  Coding DNA Sequence Number=SeqID_88533
MEEEEDLDEVDSTTEIEIELENLGEGGLVGMVAVVGGNKSESPMEEGTRRWHAVFDLAGLVVLEVDVRRGGSDLADGGGVGGAREREKKRKNETSHPGMIVESPTSSSSMPGGINSWDSKEDEGRGLVVGVLEALLEWERGWRKEKREVGHCRFWRRERWRKEKREVEVLEAFLEWATRH

SEQ ID NO: 205312 - protein, 622 aa, Glycine max
  Coding DNA Sequence Number=SeqID_88534
  Gene Ontology: Mol. function=sulfate porter activity; Cellular component=integral to membrane; Biological process=sulfate transport
  Homolog annotation: Hit_ID=O04722; Match level="QueryCoverage=91%, HitCoverage=91%, E-value=0.0, Identity=61%"; Hit description=Sulfate transporter 2.1
  Pfam annotation: Domain name=STAS; Domain location=496-615; Score =107.9; E_value=3e-29; Accession=PF01740.11; Description=STAS domain
  Pfam annotation: Domain name=Sulfate_transp; Domain location=184-473; Score=475.8; E_value=5.3e-140; Accession=PF00916.10; Description =Sulfate transporter family
  Pfam annotation: Domain name=Xan_ur_permease; Domain location=86-466; Score=-161.1; E_value=0.041; Accession=PF00860.11; Description =Permease family
  Pfam module annotation: Pfam domain module=STAS::Sulfate_transp::Xan _ur_permease; Domain location=496-615::184-473::86-466
RPFVALYKVLSNPKSFNFIALQFTAMETCKSEDLHMQVDIEKNAKDIRSQWVLNAPEPPSPWRVVADSVVFPILAWGRNYTATKFRKDLLAGLTIASLCIPQSIGYATLAHLDPQYGLYTSVVPPLIYAVMGTSREIAIGPVAVVSLLLSSMMEKLVDPATDPVGYTKLILLATLFAGIFQTSFGLLRLGFLVDFLSHAAIVGFVAGAAIVIGLQQLKGLLGITHFTTKTDIVSVMKAVWEAVHNPGKRKKKLFWLASISPLVSVVVSTLIVFITRADKNGVKIVKHVKGGLNPSSIHQLDFNNPYIGEVAKIGLVVAVVALTESIAVGRSFASIKGYQLDGNKEMMSIGLTNIIGSFTSCYVATGSFSRTAVNYAAGCETLVSNIVMAITVLISLQFLTKLLYYTPTAILASVILSALPGLIDLSEAYKIWKVDKIDFLACAGAFFGVLFASVEIGLLVAVVISFSKIILISIRPGTETLGKLPGTDLFCDVYQYPMAVKVPGVMIIRVKSALLCFANANFVRERIIKWVTEEESEDDKGNSRSTIQLLILDTSNLVNIDTAGITALEELHKSLSSHGKQLAIANPRWQVIHKLKVSNFVGKIRGRVFLTVEEAVGCKSRC

SEQ ID NO: 205313 - protein, 189 aa, Glycine max
  Coding DNA Sequence Number=SeqID_88535
  Gene Ontology: Mol. function=sulfate porter activity; Cellular component=integral to membrane; Biological process=sulfate transport
  Homolog annotation: Hit_ID=Q02920; Match level="QueryCoverage=85%, HitCoverage=30%, E-value=8e-73, Identity=97%"; Hit description=Early nodulin 70
MCWSSSNSEVVASNKTTLEEVLDIENNMAHQWVLNAPEPPSMLRQVVDNVKETLLPHPNPNTFSYLRNQPFSKRAFALLQNLFPILASLQNYNAQKLKCDLMAGLTLAIFAIPQCMGNATLARLSPEYGLFRHIGSRINVLKHDLVRYRNCPTSYLCHAGEFKGDSDRTWIRGFTATFLNDSNIESSYS

SEQ ID NO: 205314 - protein, 291 aa, Glycine max
  Coding DNA Sequence Number=SeqID_88536
  Gene Ontology: Mol. function=chitin binding; Cellular component =extracellular region; Biological process=chitin metabolic process
  Homolog annotation: Hit_ID=UPI00006A17C9; Match level="QueryCoverage =96%, HitCoverage=100%, E-value=2e-31, Identity=30%"; Hit description= UPI00006A17C9 related cluster
TTRPDLQRTTHLAIRGLHVLTFRELPVLSFRGLHALVFRGLHVLTLRGLHVPTLRGLHILNFRGLHIHDFRGLHVLTFRGLQALTFKGLHILTFRGLHVLTFRGLHVPTFRGLHVLNFRGFHALSFRGIHALSFRVLHVLTFRGLHAFAFRGLHILAITGSQDYTSPPSEGNTCSPEEDYTSSPSEGPHVIAFRGLHALPLEDYTTSPSEGYIGLYVLAFRGLHVLTFRGLHVLDFRGLHVLDFRGLQRTTHLAIKGLHVLTFRGLNVLTFRGLHALSFRGLHVLTFRGLH

SEQ ID NO: 205315 - protein, 198 aa, Glycine max
  Coding DNA Sequence Number=SeqID_88537
  Gene Ontology: Mol. function=kinase activity; Cellular component =microtubule associated complex; Biological process=proteolysis
  Homolog annotation: Hit_ID=Q105A0; Match level="QueryCoverage=49%, HitCoverage=13%, E-value=2e-44, Identity=87%"; Hit description =Isoamylase isoform 3
  Pfam annotation: Domain name=MORN; Domain location=2-24; Score=12.3; E_value=0.16; Accession=PF02493.10; Description=MORN repeat
  Pfam annotation: Domain name=MORN; Domain location=25-47; Score=11.7; E_value=0.19; Accession=PF02493.10; Description=MORN repeat
  Pfam annotation: Domain name=MORN; Domain location=48-70; Score=33.2; E_value=9.4e-07; Accession=PF02493.10; Description=MORN repeat
  Pfam annotation: Domain name=MORN; Domain location=71-93; Score=31.9; E_value=2.2e-06; Accession=PF02493.10; Description=MORN repeat
  Pfam module annotation: Pfam domain module=MORN::MORN::MORN::MORN; Domain location=2-24::25-47::48-70::71-93
RYEGDRLDGKYDGYGVETRAHESSLHGCYWQGLRHEFGVYRFYTGDVYAGEWSNGQSHGCGVHTCEDGSRYVGEFKWGVKHGHGHYHFSDSSVLIKDWTYKDRGKGHRFDSSIVLVDPYAKLVEGRRYFGDISMKLSKFLGTYDFDSLPFDWGENYKLPNISEKDLVIYEMNVWEFTSDESSGLDSNIRGSYLGMIEK

SEQ ID NO: 205316 - protein, 87 aa, Glycine max
  Coding DNA Sequence Number=SeqID_88538
MTYVPICDLIWSREEEKYVEDGRKCEKEEEAMVDSVQCSQIDGFLGDVINDITDDEEGNVSTDQTLLWNMRLLLELRDLPRLSEMHS

SEQ ID NO: 205317 - protein, 422 aa, Glycine max
  Coding DNA Sequence Number=SeqID_88539
  Gene Ontology: Mol. function=chromatin binding; Cellular component =chromatin; Biological process=chromatin assembly or disassembly
  Homolog annotation: Hit_ID=Q1SAV4; Match level="QueryCoverage=67%, HitCoverage=81%, E-value=4e-71, Identity=45%"; Hit description =Integrase, catalytic region
  Pfam annotation: Domain name=Chromo; Domain location=281-329; Score =25.4; E_value=0.0002; Accession=PF00385.14; Description='chromo' (CHRromatin Organisation MOdifier
MGWNWFKPKSKRSNSGMLLVPLKLYGEQFVWSHDAQQAFDELKNAVSIHLGMLQPHYTAHTITLLFMEIVGKHHGMPRSLVLDHDPLFISHFWKELFKLSGTKLRMSFNLVARQKCSSPYRQYLQAFLHNQPSSWGIPLIWDEWSYNTSRHSSMGVSPYEVTFDKKPPSIPQYIVGTSKIEAVDDFWPTRKLCLPVMVKLRPHRQTSTTDAPYTKLAKRFNGPFQILEQIGKVAYKLQLPEGSHIHHVFHCSILKAFHQLPIEASYPVVLLPIKVGNQPTITPLAILNTRWDHSTVEPRLMVLVQWAGLSPDDTSWEDWASLKATYHLEDKVLNLMNNGPIRQHFVLEDLHIASLPNLPTPDCKNSAIVSLDVSLQPSLEIFIMILGNIQVKHIPNSASIGVMKQNMKYGFNSSSTLETRKI

SEQ ID NO: 205318 - protein, 67 aa, Glycine max
  Coding DNA Sequence Number=SeqID_88540
MSQNFTDYLMMGIKYLEEVKRRLHATKQWSPDEIRGELAQVYFLLRLEGISSPRRARARLGEWLAYG

SEQ ID NO: 205319 - protein, 72 aa, Glycine max
  Coding DNA Sequence Number=SeqID_88541
MRGFTHQGLMEEGSLLFPLTSRLAWAFTLSVPLGFFVGLMHAKPTVRAKPISRSKPAVWAKSGVCANPPSRT

SEQ ID NO: 205320 - protein, 113 aa, Glycine max
  Coding DNA Sequence Number=SeqID_88542
  Homolog annotation: Hit_ID=Q9FJL0; Match level="QueryCoverage=78%, HitCoverage=7%, E-value=2e-17, Identity=51%"; Hit description =Chromosome condensation protein
MLSIPKLEALIKKGEESTVLIPKLEDNIPKLQKLLLDEEKVLEEITESSKVETEKYRSELAKVRAELEPWEKDLIEHNGKLEVACTEAKLLNDKLKVKDERDLLSLRKITTDT

SEQ ID NO: 205321 - protein, 92 aa, Glycine max
  Coding DNA Sequence Number=SeqID_88543
  Gene Ontology: Mol. function=ATP binding; Cellular component =chromosome; Biological process=DNA metabolic process
  Homolog annotation: Hit_ID=Q9FJL0; Match level="QueryCoverage=55%, HitCoverage=4%, E-value=3e-20, Identity=92%"; Hit description =Chromosome condensation protein
  Pfam annotation: Domain name=SMC_N; Domain location=2-92; Score= -99.6; E_value=0.00024; Accession=PF02463.9; Description=RecFRecNSMC N terminal domain
MVMRNFKSYAGEQRVGPFHKSFSVVVGPNGSGKSNVIDAKLFVFGKRAKQGRDWVGCESNLRLGKENENDGSDWFLSEEGRESTSVLGARFS

SEQ ID NO: 205322 - protein, 126 aa, Glycine max
  Coding DNA Sequence Number=SeqID_88544
MVTAKCVMDIGKGNLEMSAKTRVTPDIPPAPSPAVPPPDVSPLHTGQTSMPFTQPEKLLPMLHSLHHGQYLLMQSLQQPVMTPEAFLVQGGDTFGVAGDDAIDIVADDDYVADIRDAHRAWDPGPT

SEQ ID NO: 205323 - protein, 96 aa, Glycine max
  Coding DNA Sequence Number=SeqID_88545
CRRASSTEVGSSQICPKFGGVIYQGKFVPNLGELLSSNWAKCITTAKRCFSALSAKENLAEHQYQSSAKREISALSTAGALSQAKLEIGAKPEPTY

SEQ ID NO: 205324 - protein, 152 aa, Glycine max
  Coding DNA Sequence Number=SeqID_88546
  Gene Ontology: Mol. function=helicase activity; Biological process =viral genome replication
  Homolog annotation: Hit_ID=Q1SN45; Match level="QueryCoverage=97%, HitCoverage=11%, E-value=1e-25, Identity=36%"; Hit description=AAA ATPase
  Pfam annotation: Domain name=DUF889; Domain location=13-152; Score =37.7; E_value=4.6e-14; Accession=PF05970.5; Description=Eukaryotic protein of unknown function (DUF889)
MHNDKPFGGKVIVFCGDFHQILPVVPRDIGDGKLGEPNDGYGEITIPDEFLIKDFNDPIQSIIESTYPNLLQNYTNGDFLQQRAILTSTKDVVDSINDYVMSLISTDEKEYCSVDSVDKSDELLNPTFGVLTPEFLNSLKTSGIPNHKLKIK

SEQ ID NO: 205325 - protein, 69 aa, Glycine max
  Coding DNA Sequence Number=SeqID_88547
MRSVNHAASSGSCAQPEEDGLANCKNQTSPNLLILPEIEMESFACTQANKEQLTGLQVTKHAVIMYKGV

SEQ ID NO: 205326 - protein, 295 aa, Glycine max
  Coding DNA Sequence Number=SeqID_88548
  Gene Ontology: Mol. function=iron ion transporter activity; Biological process=high affinity iron ion transport
  Homolog annotation: Hit_ID=Q5DQI7; Match level="QueryCoverage=100%, HitCoverage=88%, E-value=1e-139, Identity=84%"; Hit description=EitA
  Pfam annotation: Domain name=Peripla_BP_2; Domain location=40-290; Score=41.0; E_value=4.1e-09; Accession=PF01497.9; Description =Periplasmic binding protein
MKKVICTLCLVFASVSSALATTYPLTIENCGYKETFTKPPERVVALGQNTAEILLLLGLQDKVIASAFWPTKVLPQLAAQNAKIKTLTVEIPTLESVLAQNPDFVPAQTPLLLGPESKVAKREDLITLGVNSYVSPGMCATKKAAGDMYGSRQQLWDMTFLYQEIQDFAKIFNVEDRGQAVIADFKKREAALRQEFGSSKKDLSFVFWFSSSSPSADAYVGGKNSPSGFIASVLGGHNAITSETEWPTVSWESIIAANPDVIVVSSLDRNRWALDKAEEKIKFLKSDPAVSQLDA

SEQ ID NO: 205327 - protein, 110 aa, Glycine max
  Coding DNA Sequence Number=SeqID_88549
MEFIRFGVVRPTAIGAIVGLLALPLIENLGLLALPQIFEDTESLSSFTSIFKLRNIKTPKWPYPQHNCNQMEEKQENIPSSNTHKRKSLSALDMTLFVSFGLLDTFSVTL

SEQ ID NO: 205328 - protein, 45 aa, Glycine max
  Coding DNA Sequence Number=SeqID_88550
MTTEEAVVRVAKVAGGAVGGNEDSKAVIDDRLRMSFDGNIVIMRK

SEQ ID NO: 205329 - protein, 87 aa, Glycine max
  Coding DNA Sequence Number=SeqID_88551
MVLKTCSTYYDASGIVKDLDNDNMLKFEYIIQVCFFWVDAIGCNLPFGSRLKWGELVIVLRKLFIRLLTWLWPWNLHNVRAKRQAIT

SEQ ID NO: 205330 - protein, 63 aa, Glycine max
  Coding DNA Sequence Number=SeqID_88552
MDCPSDMVERKGGALQWLAKMVARERFVGVIIWCRGCKYDLWNEINLTAQNYVHSRPIEILDH

SEQ ID NO: 205331 - protein, 81 aa, Glycine max
  Coding DNA Sequence Number=SeqID_88553
MSKEHEIVLVNVAAISLALMEFLDVRLELRQWILSCDIRFTTGFKMLCRDDEVMKAESEQQNHNAGVGIGEGMDLCKALLI

SEQ ID NO: 205332 - protein, 101 aa, Glycine max
  Coding DNA Sequence Number=SeqID_88554
MALARANIDEHNEATIAYFLSRLNHDIRDVVELQEYVELEDLLHKAVGHITSKCPTKSTMLMKEDGEITSKSLASEREQEEEIEEEALDYDLLLVMRLLGS

SEQ ID NO: 205333 - protein, 202 aa, Glycine max
  Coding DNA Sequence Number=SeqID_88555
  Gene Ontology: Mol. function=receptor activity; Cellular component =outer membrane-bounded periplasmic space; Biological process=amino acid transport
  Homolog annotation: Hit_ID=Q478G2; Match level="QueryCoverage=96%, HitCoverage=50%, E-value=1e-60, Identity=56%"; Hit description =Extracellular ligand-binding receptor precursor
MRASPALLHLAGGGERVVILRQHRARQLVGQLAVRALDDGAQVVVLDRVLIAIELEFAAHRLEISAAQGRAQRIGAQLAAGLPDRAVQQHGGVVALRGVQRGGAVVGFPEVLDELAVGRVVQVGRPLRRVMQAFDRRAHRRDRILVAREARRQQRDLLAQAGAVELLDEIHAHAAGQKEKHGIRLAGAQPRDLDAVVELAEL

SEQ ID NO: 205334 - protein, 120 aa, Glycine max
  Coding DNA Sequence Number=SeqID_88556
  Gene Ontology: Mol. function=carboxymethylenebutenolidase activity; Biological process=aromatic compound catabolic process
  Homolog annotation: Hit_ID=Q35RP5; Match level="QueryCoverage=95%, HitCoverage=27%, E-value=1e-30, Identity=60%"; Hit description =Carboxymethylenebutenolidase
  Pfam annotation: Domain name=DLH; Domain location=20-119; Score= -64.0; E_value=0.0071; Accession=PF01738.9; Description=Dienelactone hydrolase family
MTATITTREVTIASHDGKSFSAYLAVPASGHGPGLVLCQEIFGINDFMRRTAQALAEEGYVVLAPDLFWRQQPGIQLTDGPADMPRAFELYHRFDVELGVKDIAATLAALRALPEQQGGA

SEQ ID NO: 205335 - protein, 98 aa, Glycine max
  Coding DNA Sequence Number=SeqID_88557
MRLPGKESLLMGSPITINEILDVSISFLNDHLEETLGSTKIEEIYSKCINLAQVKVHGESGSWLKVCRMARHDTCRGLVWFKDKKGMPHIISMTQMQK

SEQ ID NO: 205336 - protein, 212 aa, Glycine max
  Coding DNA Sequence Number=SeqID_88558
  Homolog annotation: Hit_ID=Q5FAM5; Match level="QueryCoverage=39%, HitCoverage=48%, E-value=2e-15, Identity=46%"; Hit description =Putative Basic helix-loop-helix(BHLH) family protein
MAAVDASKERDEANLANLAMKKVQKVKLSELVDPSFGFESDQVVKRILTSVAGLAFRCVQGDNELSPSMDEVLEALNKFQNENYEFENLEKKDDLLVVQEEQDQELELVDVIFKYEKKELEGVELEKSNILLMGPTRSDATSLTHASFHVYITCLTSVSPSNRQVMLERITIRIIQAPHVTYLNRGRDEVVCNSCSFNDNGSFSAVSSSHRV

SEQ ID NO: 205337 - protein, 256 aa, Glycine max
  Coding DNA Sequence Number=SeqID_88559
MLKVHCKEAIKFCSEYIAKAKPVRVPGYWYDKKVGDGPKRNVRSWEGYDINKYSFYTKSQDYKSTMQNSGVSLRVESQHFATIHDDNPRLASMTYFAVIEDDDSTLDTCLTPFSTHMTNFNTEEVDDVHADCNDIMHMTTPPSFVPPPKSMPSPSMSNKIRKATQLRSLATRPVGMETPVVHMDPATRKADGPHRKQLRMYLGIVTRDKVDVTFVNWKEVPAAQKDLIWEDIKAEFNIPEPSDQRTKKKILKVVGE

SEQ ID NO: 205338 - protein, 94 aa, Glycine max
  Coding DNA Sequence Number=SeqID_88560
  Gene Ontology: Mol. function=ATP-dependent helicase activity; Cellular component=cytoplasm; Biological process=RNA metabolic process
  Homolog annotation: Hit_ID=Q1S896; Match level="QueryCoverage=73%, HitCoverage=14%, E-value=1e-13, Identity=60%"; Hit description =Helicase, C-terminal
MALVTGPFLGRIASHIDNIKSIGEKVMSLLICNISGFGVLDKADRLLNEDFEESLNEISQMIPRERRTFLFSATMTKKICVNLLINAQSDNFCS

SEQ ID NO: 205339 - protein, 114 aa, Glycine max
  Coding DNA Sequence Number=SeqID_88561
  Gene Ontology: Mol. function=protein dimerization activity; Cellular component=nucleus; Biological process=regulation of transcription, DNA-dependent
  Homolog annotation: Hit_ID=Q0GPE8; Match level="QueryCoverage=88%, HitCoverage=30%, E-value=1e-43, Identity=91%"; Hit description=BZIP transcription factor bZIP16
  Subcellular localization annotation: CTP_CleavageSite=73; ConfidenceScore=5.17e-01
MAMKGSLKKANIVDAVTAFSTCGGVTDDTLVRSQNLTPIQSTISATIDSQSSFCGTEVERVRSPVSANKPNVRDKQVKGVATTTGGSSREPSEEDDEAGPCEQSTNAIDMKRLR

SEQ ID NO: 205340 - protein, 90 aa, Glycine max
  Coding DNA Sequence Number=SeqID_88562
  Gene Ontology: Mol. function=protein dimerization activity; Cellular component=nucleus; Biological process=regulation of transcription, DNA-dependent
  Homolog annotation: Hit_ID=Q0GPE8; Match level="QueryCoverage=50%, HitCoverage=14%, E-value=2e-20, Identity=97%"; Hit description=BZIP transcription factor bZIP16
MESKWGGAPASIMAANFDDFKWIASMFDPGNDDVKPFSDAAFQNQERNDVAERTWKWNLKTTIETFFINLKHTGDKYDERPNLTNGHITN

SEQ ID NO: 205341 - protein, 53 aa, Glycine max
  Coding DNA Sequence Number=SeqID_88563
  Gene Ontology: Mol. function=protein dimerization activity; Cellular component=nucleus; Biological process=regulation of transcription, DNA-dependent
  Homolog annotation: Hit_ID=Q0GPE8; Match level="QueryCoverage=87%, HitCoverage=15%, E-value=9e-17, Identity=93%"; Hit description=BZIP transcription factor bZIP16
RTDVEGGVERLRLENANLFKQLTDASQQFRDADTNNRVLKSDVEALRAKVYVL

SEQ ID NO: 205342 - protein, 281 aa, Glycine max
  Coding DNA Sequence Number=SeqID_88564
  Gene Ontology: Mol. function=hydrolase activity
  Homolog annotation: Hit_ID=Q9HUJ4; Match level="QueryCoverage=31%, HitCoverage=43%, E-value=8e-37, Identity=82%"; Hit description =Adenosine diphosphate sugar pyrophosphatase
MAIGKLHEQQRLLDGSGFRRQCAFSCQARRRRWREAITQTSALQHRLQLVAAGQAVAEPFAEEQVQLVLLVRLVHVLVRIGVDGQQPARLLGTYDFGHARIVVDPHFQARRRQPGQAELLTHLQGGGVRTGFDHFQGQHTEQTLALAERNAPGRAIFSHVREQAHQAQVVGLAGGLQSDQVYTITLAQQVHTHKPRTSARLSASHCRASMLAALLMRPSRTACSASSKGSTCTRMSSPSSSRPGMPEAPLLSQRPTNRGTSSLQPPGDGRYWLIGQSAPRL

SEQ ID NO: 205343 - protein, 280 aa, Glycine max
  Coding DNA Sequence Number=SeqID_88565
  Homolog annotation: Hit_ID=Q47522; Match level="QueryCoverage=23%, HitCoverage=62%, E-value=4e-14, Identity=62%"; Hit description=LacZ protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGIRSRAMSVQDSPISIVASLGPWGPMEYGSLIYGLILIGAAIIRFGILCTKIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 205344 - protein, 54 aa, Glycine max
  Coding DNA Sequence Number=SeqID_88566
MKVASAQNMRKASSNSYNLLQKEYFTDPRPLEPERLKALRNQWAKYYLKVKNET

SEQ ID NO: 205345 - protein, 216 aa, Glycine max
  Coding DNA Sequence Number=SeqID_88567
  Homolog annotation: Hit_ID=Q1T493; Match level="QueryCoverage=94%, HitCoverage=40%, E-value=3e-20, Identity=31%"; Hit description =Nucleic acid-binding, OB-fold, subgroup
MDLKENCTYVMHNFKVLKRQVVSTEECVLGDIPFRKYRFARFADVVAGQFERGLLVDVIGVVEEVVFRQVSGKGRRVVFKLKDLSQQLLSCTLWDDYCLQFLKFLDDYEGDGPITVLLSHCRIKEAQGSYPASINNSFKASKLIINQPMMEIQEFNERLAELGIEARSGFKSHGEGSTQLSGSIQLSSKESFFGKAEAKTIADINTISEIMILYRF

SEQ ID NO: 205346 - protein, 111 aa, Glycine max
  Coding DNA Sequence Number=SeqID_88568
  Gene Ontology: Mol. function=transferase activity, transferring hexosyl groups; Biological process=carbohydrate biosynthetic process
  Homolog annotation: Hit_ID=Q5BMA3; Match level="QueryCoverage=75%, HitCoverage=13%, E-value=3e-37, Identity=83%"; Hit description =Secondary cell wall-related glycosyltransferase family 8
MTRWMTLKNLVPEDVETQCSDKIGCHNDEEEKKQMKTLLFGTEPPILYVLHYLGVKPWLCFRDYDCNWNANIFHEFATDVAQAKWWKVHDAMPELLQQFCLLKSKQKAQLE

SEQ ID NO: 205347 - protein, 57 aa, Glycine max
  Coding DNA Sequence Number=SeqID_88569
  Subcellular localization annotation: CTP_CleavageSite=29; ConfidenceScore=5.51e-01
MALELSTDTTKTITSSDSSSATSKVFFVSCVGPCGLNNLRRIGLECRRSNNQFNNVL

SEQ ID NO: 205348 - protein, 196 aa, Glycine max
  Coding DNA Sequence Number=SeqID_88570
  Gene Ontology: Mol. function=thioredoxin peroxidase activity; Cellular component=periplasmic space
  Homolog annotation: Hit_ID=Q8ZE42; Match level="QueryCoverage=50%, HitCoverage=59%, E-value=4e-44, Identity=89%"; Hit description =Probable thiol peroxidase
  Pfam annotation: Domain name=Redoxin; Domain location=1-122; Score =48.1; E_value=3e-11; Accession=PF08534.1; Description=Redoxin
  Subcellular localization annotation: CTP_CleavageSite=61; ConfidenceScore=5.05e-01
LNIFPSIDTGVCATSVRKFNQLASGLDNTVVLCISADLPFAQSRFCGAEGLSNVVTLSTLRGAEFKQAYGVEIAEGPLAGLTARAVVVLDGQDNVLYSELAPFLFFALGAAFAAAQAILAQLVGDGGMGNAQALRQLAGAGIGAIQTRQHRALETLADVVQRAVQHLVAQRHLHLELRQHDILRPQFVAFGLRQRA

SEQ ID NO: 205349 - protein, 47 aa, Glycine max
  Coding DNA Sequence Number=SeqID_88571
MAVVGAAGPLQLQVLHGGKQNVRVVAGWSSRRDEVVQAIAGALGFWR

SEQ ID NO: 205350 - protein, 307 aa, Glycine max
  Coding DNA Sequence Number=SeqID_88572
  Gene Ontology: Mol. function=transporter activity; Cellular component= integral to membrane; Biological process=transport
  Homolog annotation: Hit_ID=Q48CR4; Match level="QueryCoverage=61%, HitCoverage=75%, E-value=8e-39, Identity=50%"; Hit description=ABC transporter, permease protein
MADAAGAAVLLRLLAAAVCPSAADGNAGRPQHPAQRLLDGTDAAALPAQSAEYRAAVARRHAGDAGHRRDSRLLSGTPALQRTQHAAGAADVSAGLSGRGGGISGGDAGGPSGTAGANQPGAVPRALDAGLFVYRPAARSLGASQWRITWDVIVPGLQPALLSTGALCFATSMGAFGTAFTLGTDLAVLPLTIYGEFTNYANFATAAALSVPATAGHRAHRAVHDRAGGAVDAGRRDQQLLYRPAQRPDAEVGDPGMAALRRHLLAVTADCAGLPADHAADRRAGSVGIAKSAAALGGAHRRVPDAA

SEQ ID NO: 205351 - protein, 339 aa, Glycine max
  Coding DNA Sequence Number=SeqID_88573
  Gene Ontology: Mol. function=transporter activity; Cellular component= outer membrane-bounded periplasmic space; Biological process=transport
  Homolog annotation: Hit_ID=Q48CR3; Match level="QueryCoverage=93%, HitCoverage=94%, E-value=1e-140, Identity=74%"; Hit description=ABC transporter, periplasmic substrate-binding protein
  Pfam annotation: Domain name=SBP_bac_1; Domain location=13-283; Score= 15.4; E_value=0.021; Accession=PF01547.15; Description=Bacterial extracellular solute-binding protein
MLHKKVKIYAGAIALSASALFTSLTQAAETAICYNCPPEWADWGTQLKAIARDTGIQVPQDNKNSGQALAQLVAEQGNPVADVVYYGVSFGIQADSAGVVASYKPAHWDDIPAGMKDSNGKWVALHSGTMGFMVNVDALGGAPVPQSWDDLLKPEYKGMIGYLDPASAFVGYVAAVAVNQAKGGNMQDFTPALNWFKKLQANQPIVPKQTAYARLISGEIPILLDYDFNAYRARYKDHANVAFVIPKEGTVTVPYVISLVKNAPHAANGKKVIDYVLSDKGQAIWASAFLRPVRTGAMSAEAKKYFLPDSDYARAHTVDYQQMAAAQKTFSARYLSEIR

SEQ ID NO: 205352 - protein, 433 aa, Glycine max
  Coding DNA Sequence Number=SeqID_88574
  Gene Ontology: Mol. function=signal transducer activity; Cellular component=integral to membrane; Biological process=regulation of transcription, DNA-dependent
  Homolog annotation: Hit_ID=Q6D7R5; Match level="QueryCoverage=24%, HitCoverage=81%, E-value=6e-45, Identity=89%"; Hit description =Bacterioferritin comigratory protein
  Pfam annotation: Domain name=GGDEF; Domain location=6-160; Score =195.6; E_value=1.1e-55; Accession=PF00990.12; Description=GGDEF domain
DKIGRLKSEVQSDPMTSLLNRRGLSAVLDYFDTMQQSFAVLALDIDHFKRVNDNFGHDVGDEVIKQVARTLRQSARQTDVVCRNGGEEFLMLLPATAPDEARVIAERVRTSIAGGWIDPVGQITISIGIASWQPTHGSQEQILKQADDALYQAKNAGRNCVVIAGQEALASTVIEHDIVVVRGFKIVEHLLHFAIAANQEADAVNAVVGFPHKGFLTPDAKLLANLMIFIRQQGEVEQFFLDKARQFFRLVDHRPAWCSPASWLSGRNRPERAVPGTAKAPGGVYLRVISLHGMPARQSVWRNNPEPDSDGAVRVVVLRTADGKPAQTVRWHDSPGCARSSEYRAPAARRPGRASVKRSMICGESGTSTCTQTGRFNQGNGVPAAGEQHNKGELVAQHRQAAVFNIATTAADVAGNGIDDTRTINAQSGDHQM

SEQ ID NO: 205353 - protein, 171 aa, Glycine max
  Coding DNA Sequence Number=SeqID_88575
PLLKFSMCPVVGFGPWLGLGKPLVEILPPGQLRGFCPLLAWLGSAVLGYGPVLSFGLVGPLLPPVISFVARILPTLACAPLAKSVPRQNEREPTNGSLFWPNIVEEERDTGLIGEGRIKATRAESQWIVAARPLCHLQYPVAYLSRLQRILPAARWELRFKASRRANPPHE

SEQ ID NO: 205354 - protein, 234 aa, Glycine max
  Coding DNA Sequence Number=SeqID_88576
  Gene Ontology: Mol. function=transporter activity; Cellular component= integral to membrane; Biological process=transport
  Homolog annotation: Hit_ID=Q65R38; Match level="QueryCoverage=97%, HitCoverage=99%, E-value=4e-87, Identity=69%"; Hit description=GlpF protein
  Pfam annotation: Domain name=MIP; Domain location=2-226; Score=195.6; E_value=1.1e-55; Accession=PF00230.10; Description=Major intrinsic protein
MESMSKRLFAEFFGTFWLVFGGCGSAVLAAAFPQLGIGFLGVALAFGLTVVTMAYAVGHISGGHFNPAITVGLFAGGRFAAKDVIPYVIAQVIGGIAAAAVLYLIASGKAGFDATAGGFASNGYGEHSPGGYSLQSAIVIELVLTAFFLIVIHGVTDKRAPAGFAPLAIGLTLTLIHLISIPVTNTSVNPARSTGVAIFQGTWALQQLWVFWLVPLVGGIIGGLIYRCLLEDKK

SEQ ID NO: 205355 - protein, 226 aa, Glycine max
  Coding DNA Sequence Number=SeqID_88577
  Gene Ontology: Mol. function=methyltransferase activity; Cellular component=intracellular; Biological process=metabolic process
  Homolog annotation: Hit_ID=UPI00005F92F3; Match level="QueryCoverage =96%, HitCoverage=85%, E-value=1e-94, Identity=76%"; Hit description =COG0500: SAM-dependent methyltransferases
  Pfam annotation: Domain name=MTS; Domain location=7-147; Score=-51.2; E_value=5.4e-05; Accession=PF05175.4; Description=Methyltransferase small domain
  Pfam annotation: Domain name=MetW; Domain location=2-162; Score= -125.3; E_value=0.0092; Accession=PF07021.2; Description=Methionine biosynthesis protein MetW
  Pfam annotation: Domain name=Methyltransf_11; Domain location=20-116; Score=128.6; E_value=1.8e-35; Accession=PF08241.2; Description =Methyltransferase domain
  Pfam annotation: Domain name=Methyltransf_12; Domain location=20-114; Score=79.7; E_value=9e-21; Accession=PF08242.2; Description =Methyltransferase domain
  Pfam annotation: Domain name=Ubie_methyltran; Domain location=2-177; Score=-94.9; E_value=2.1e-05; Accession=PF01209.9; Description =ubiECOQ5 methyltransferase family
  Pfam module annotation: Pfam domain module=MTS::MetW::Methyltransf _11::Methyltransf_12::Ubie_methyltran; Domain location=7-147::2 -162::20-116::20-114::2-177
GKDLQRLAQLLEPHAGARLLDLGCGAGHASFTAAARVAQVVAYDLSAQMLAVVEQAAAEKGLNNIQLQQGVAESLPFEDAGFDLVISRYSAHHWHDVGQALREVRRVLKPGGRAIFMDVVSPGHPLLDIYLQTVEVLRDTSHVRNYAPGEWLTLLTEAGLVVREVTSDRLMLEFGSWVARMRTPAHFVTAIRALQQSVSQEVAAHFAIQPDGSFTSDIMMFEVTKG

SEQ ID NO: 205356 - protein, 83 aa, Glycine max
  Coding DNA Sequence Number=SeqID_88578
MWRKSKRGVFAQSVSFHDFFERLLQKAVASGGSNLARLGELGGKHLPYFAINRGGSEEEKGSAPYALLSLSNLLGKIVSVKKI

SEQ ID NO: 205357 - protein, 99 aa, Glycine max
  Coding DNA Sequence Number=SeqID_88579
MPLPGSLISLPGRATPAPKYKKTREGNVFCTQKLPPPPIIQKEKAYGTHGFRSPKLPLVAFCFHFWYSYSLQQGMALGLCCILKQWGMLHCPHSLAIHA

SEQ ID NO: 205358 - protein, 76 aa, Glycine max
  Coding DNA Sequence Number=SeqID_88580
MDLSFSRSPLLQNPNRAIGGGAQESTRNAIIANGERLIDYIEDIGIHVSYPNFVRGPLLDDMRPFFGPCEVLGTHH

SEQ ID NO: 205359 - protein, 95 aa, Glycine max
  Coding DNA Sequence Number=SeqID_88581
NWRCGMNRKLGYGAQLRANLDPTKGVGRLRQQDGGHGSRNPLRRRGGRCKTQGASPGGAVVGADLGGTGEARLIALCARTPKGNRPAHPGNGSAG

SEQ ID NO: 205360 - protein, 136 aa, Glycine max
  Coding DNA Sequence Number=SeqID_88582
  Gene Ontology: Mol. function=RNA-directed DNA polymerase activity; Cellular component=chromatin; Biological process=chromatin assembly or disassembly
  Homolog annotation: Hit_ID=Q1T2D5; Match level="QueryCoverage=98%, HitCoverage=10%, E-value=2e-40, Identity=53%"; Hit description=Chromo
MHHTHAIAELFTLQYSRLDGPQDQLLDIPVDMEPELAMILYTDRTVFDVPSGLPPSRTHNHSIPLVEGAGPVKVKPYRYPHSRKDQIEDGTWRFCTDYRALNAITIKDSFPIPTVDELIDELHEAVYFSKLDLRYL

SEQ ID NO: 205361 - protein, 95 aa, Glycine max
  Coding DNA Sequence Number=SeqID_88583
GESGGAAASSNDASEMTIREGDVGTASSSEQPRWVSPMEVELQASVATYPSAGGRRETRGMRVPRKEYARSRHQRLFEENVGKTGKDAIYELLSE

SEQ ID NO: 205362 - protein, 143 aa, Glycine max
  Coding DNA Sequence Number=SeqID_88584
MGKLDHLEERLRAIEGGEDYAFANLKKLFLEPNIITPPKFKVLDFDKYKGTTCPENHLKMYYRKMGAYAKDEELLIHSFARKPYWGSVSIMASDRMLLQNMCKKGARILQKNTPKVFYYEKMVGYTPSSFDDMVFTDEGSKWV

SEQ ID NO: 205363 - protein, 145 aa, Glycine max
  Coding DNA Sequence Number=SeqID_88585
GTYDYYQSSLELPDPSNLLLDLKEVIIISLGSGGTDGHAERIVSKGSRERNIVKVNNDIAETGESRKGMTISVGSLILAIAHGSYKRLWLDCCYLAQWIVSQLLFSLDLATFIAIAGSLATFFRDMVEEKANALTPTAPTPSPKA

SEQ ID NO: 205364 - protein, 310 aa, Glycine max
  Coding DNA Sequence Number=SeqID_88586
  Gene Ontology: Cellular component=membrane
  Homolog annotation: Hit_ID=Q48BH2; Match level="QueryCoverage=55%, HitCoverage=73%, E-value=6e-61, Identity=55%"; Hit description =Permease of the drug/metabolite transporter
  Pfam annotation: Domain name=DUF6; Domain location=125-243; Score =36.4; E_value=9.9e-08; Accession=PF00892.11; Description=Integral membrane protein DUF6
  Subcellular localization annotation: CTP_CleavageSite=13; ConfidenceScore=5.02e-01
GLFGLAGIAGALAASRSGAWADRGTGQRASGCALVLLTLSWLPIAFAQASLLLLVIGVIMLDFAVQTVHVINQSMLIAGKPAITSRLIGAYMCFYAAGSALGAIAATQLYAHWGWYAVCGGGALVSACALILWYGTRLHAIDPFILAGLRFTLCAIPALFFIKKPDVPWRYLIGYGLVFGIGLWGLVNLGIKTGLSAGIASLVLQFSAFFTLLLGSYVFKEQLSRYQIAGFVLACSGLMSIVFITDGSVTFAGLLLVLAGAIAWSIANIIMKKAGTKQVYPNTLLGYWIWNSLLKQYPVSTVAPLSLLVP

SEQ ID NO: 205365 - protein, 58 aa, Glycine max
  Coding DNA Sequence Number=SeqID_88587
MASWSWLSQTQGPKADCSKSGIGATLQSAQGRAIGGCDLQEGGAIRSCDLHRLVLMIY

SEQ ID NO: 205366 - protein, 279 aa, Glycine max
  Coding DNA Sequence Number=SeqID_88588
  Homolog annotation: Hit_ID=Q1STZ2; Match level="QueryCoverage=66%, HitCoverage=46%, E-value=4e-13, Identity=27%"; Hit description=IMP dehydrogenase/GMP reductase
MGSSQKPSFKKRFYQVKIKSLEVTSLRELGQLMGQLQRQAFRKAYGKIWDLARVEVSTESIASLAQYYDHPLRCFTFGDFQLSPMVEEFEEILGCPLGGRKPYLFSGFYPSLARISKIFQILAKELDHQKQMGWSGYRENVWRQKQESWQRSTLFSPIITTRKAPVVAMLADLYDTFDRGCEKSSARIVCCALALYVWLVSHLFLQEGRPVYPLQGHHSCVEKGKANWDQLLASMEGRLLIGSLARRKEESGLYLHAKDVQMFPGWEHGVVLIIIPSSP

SEQ ID NO: 205367 - protein, 113 aa, Glycine max
  Coding DNA Sequence Number=SeqID_88589
  Gene Ontology: Mol. function=methyltransferase activity; Cellular component=ribonucleoprotein complex; Biological process=porphyrin biosynthetic process
  Homolog annotation: Hit_ID=Q1SWY0; Match level="QueryCoverage=72%, HitCoverage=29%, E-value=2e-37, Identity=92%"; Hit description =Uroporphiryn-III C-methyltransferase
ITAASGIAAELGIPLTHRGIANSVRFLTGHSRKGGSDPLFVSENAADPDSTLVVYMGLATFPSLAQKLMHHGLSPQTPAAAIERGTTLHQRTELFLHMKKNEGGLAPVSYMET

SEQ ID NO: 205368 - protein, 90 aa, Glycine max
  Coding DNA Sequence Number=SeqID_88590
MLEGEGWMVKLICGSHNHALPKSFVENSYVDQLTKDEKIIIGGVTKSMMKLKDILLILKKHNANSYTTMKQEKETQRLRVTTKLTTTIAE

SEQ ID NO: 205369 - protein, 165 aa, Glycine max
  Coding DNA Sequence Number=SeqID_88591
  Pfam annotation: Domain name=zf-CCHC; Domain location=145-162; Score =36.6; E_value=8.7e-08; Accession=PF00098.13; Description=Zinc knuckle
MRISSFTNLRSNLTVKFAIKFESDGHVRTIDVTSPDNANIQGTRHSGDGGRSYGGGRGGGGGGYSDDDGYGGGDGYGGGGGYDGDRLVTTVVNRDIWLGTTAKEEVETGTTEAMGGGGKYGGSNGRRYDGGGGGGGGGGGGGGGGSCYSCGESGHFARDCPSSAR

SEQ ID NO: 205370 - protein, 606 aa, Glycine max
  Coding DNA Sequence Number=SeqID_88592
  Gene Ontology: Mol. function=nucleotide binding
  Homolog annotation: Hit_ID=Q1SWW2; Match level="QueryCoverage=94%, HitCoverage=98%, E-value=0.0, Identity=66%"; Hit description=Plant protein family, putative
  Pfam annotation: Domain name=DUF246; Domain location=192-534; Score =619.8; E_value=2.4e-183; Accession=PF03138.5; Description=Plant protein family
  Subcellular localization annotation: CTP_CleavageSite=77; ConfidenceScore=5.69e-01
MAKSKNNAKKLSYISVPSQIINSISSSSLQSLLDSPKKSSRNTNNNRFFIFFTNSTSTIIFRKQRLWFFTLFLFGFLGMLKFGLTLHTPFPPYPCATTTLLPQNMISTTPHSKSNLGAVLRENNDQKKDEVLLSHVELRAQGLEKVEGDEGVEKSEFWEKPDGLGYKPCLSFSRDYRRASEGVLKDRRKYLMVVVSGGLNQQRNQIVDAVVIARILGAALVVPILQVNVIWGDESEFGDIFDLEHFKRVLANDVRVVSALPSTHLMTKPVEGSPPLHVTPSWIRSRYLRRFNREGVLLLRSLDSRLSKDLPSDLQKLRCKVAFNALRFAQPIQELGDGIAERMQSKGPYLVLHLRMEKDVWVRTGCLPGLSPEFDEIVNNERIQRPELLTARSSMTYHERKMAGLCPLNAVEVTRLLKGLGAPKNARIYWAGGQPLGGKKALLPLIQEFPHFYSKEDLALPGELQPFANKASIMAAIDYIVSEKSDVFMPSHGGNMGHAIQGHRAFAGHKKYITPNKRHMLPYFHNSSLPEEEFNRIMKELHQDSLGQPELRTIKAGRDVTKFPIPECMMCNFDPFGTISGAFQGNHNSSEHKFLLHMISSTPHLA

SEQ ID NO: 205371 - protein, 574 aa, Glycine max
  Coding DNA Sequence Number=SeqID_88593
  Gene Ontology: Mol. function=transferase activity; Biological process= response to oxidative stress
  Homolog annotation: Hit_ID=Q1S9Y9; Match level="QueryCoverage=99%, HitCoverage=69%, E-value=0.0, Identity=84%"; Hit description=C2
  Pfam annotation: Domain name=C2; Domain location=162-256; Score=81.5; E_value=2.6e-21; Accession=PF00168.20; Description=C2 domain
  Pfam annotation: Domain name=C2; Domain location=3-80; Score=56.7; E _value=7.5e-14; Accession=PF00168.20; Description=C2 domain
  Pfam annotation: Domain name=PRT_C; Domain location=419-574; Score =424.2; E_value=1.9e-124; Accession=PF08372.1; Description=Plant phosphoribosyltransferase C-terminal
  Pfam module annotation: Pfam domain module=C2::C2::PRT_C; Domain location=162-256::3-80::419-574
MSLQAQDVIPSDRNRLPEVFVKAQMGSQVLRTKICPSRTTTPLWNEDLVFVAAEPFEEQLTITVEDRVNPSRDEVLGKIILPLTLFEKQLDHRPVHSRWFNLQKFGFGMMEADRRNELKFSSRIHLRISLEGGYHVLDESTLYSSDQRPTARQLWKQPIGVLEVGILGAKGLLPMKMRDGRGTLDAYCVAKYGQKWVRTRTILDTFSPKWNEQYTWEVYDPCTVITLGVFDNCHLGGGEKATAGTAARDSRIGKVRIRLSTLEAHRIYTHSYPLLVLHPHGVKKMGELQLAVRFTSLSLANMVYIYGQPLLPKLHYFRPFTVNLVESLRYQAMNIVAVRLGRAEPPLRKEVVEYMLDVDSHMWSMRRSKANFFRIMSLFSGFITMGQWFTQVCHWKNPITSILVNILFLILICYPELILPTLFLYMFLIGLWNYRFRPRHPPHMDTKLSWAEVVQPDELDEEFDTFPTSRPHDVVRMRYDRLRSVAGRIQTVVGDIATQGERFQSLLSWRDTRATSLFVVFSFCSAVVLYATPPKVVAMVAGLYYLRHPKFRSKLPSVPSNFFKRLPARTDSML

SEQ ID NO: 205372 - protein, 308 aa, Glycine max
  Coding DNA Sequence Number=SeqID_88594
  Gene Ontology: Mol. function=structural constituent of ribosome; Cellular component=intracellular; Biological process=translation
  Homolog annotation: Hit_ID=Q1S9B3; Match level="QueryCoverage=81%, HitCoverage=100%, E-value=2e-79, Identity=64%"; Hit description =Ribosomal protein L6E; Ribosomal protein L6, N-terminal
  Pfam annotation: Domain name=Ribosomal_L6e; Domain location=201-308; Score=242.1; E_value=1.2e-69; Accession=PF01159.9; Description =Ribosomal protein L6e
  Pfam annotation: Domain name=Ribosomal_L6e_N; Domain location=57-110; Score=100.4; E_value=5.3e-27; Accession=PF03868.5; Description =Ribosomal protein L6, N-terminal domain
  Pfam module annotation: Pfam domain module=Ribosomal_L6e::Ribosomal _L6e_N; Domain location=201-308::57-110
MGLLVHESIFTKPGPIETSTRCVFRRLYKPELGFCVTSLSLNTEAEGGEAERGDEAMAPKKPRTTSRNPDLVRGIGKYSRSQMYHKRGIWAIKAKNGGVLPLHDPKPKPEAPAQKPPKFYPADDVKKPLVNKHKPKPAKLRFGVGRKEVQIGIKHGKWDMRASITPGTVLILLAGRFKGKRVVFLKQLPSGLLLVTGPFKINGVPLRRVNQSYVIGTSTKVDISDVNVDKFDDKYFAKEAKKKKTKGEGEFFEAEKEEKNVLPQEKKDDQKTVDTALLKAIESVPELKSYLGARFSLKAGVKPHELVF

SEQ ID NO: 205373 - protein, 127 aa, Glycine max
  Coding DNA Sequence Number=SeqID_88595
  Gene Ontology: Mol. function=structural molecule activity
  Homolog annotation: Hit_ID=Q1SPB9; Match level="QueryCoverage=62%, HitCoverage=15%, E-value=9e-09, Identity=32%"; Hit description =Transposase
FHIDKNVKAKCKSLIDEKNVWDYVMDNWGTLVDCSSEQQFAESLQKFQVACSPWPMFIDYVNDTWIIPHKEKIITAWTNKGDQSGSQCFARMLQPYGINIGLKEHSNRVTPKAYTSKSPSRPLPPDS

SEQ ID NO: 205374 - protein, 144 aa, Glycine max
  Coding DNA Sequence Number=SeqID_88596
  Subcellular localization annotation: CTP_CleavageSite=66; ConfidenceScore=5.65e-01
MASLHSSFLLTSNFLSLTTPSSFPTHILFPVRLSTTHLRPLLLTTRHGFGRSPRHRDRGGREEALRWQHSPHCHQQRACQDCSRTCYSCVGLNFIGESNECGLWGGAGFHSHALIEPDYGSGCQCSEKKVADIERGSIRATILI

SEQ ID NO: 205375 - protein, 268 aa, Glycine max
  Coding DNA Sequence Number=SeqID_88597
  Gene Ontology: Mol. function=nucleic acid binding; Cellular component= ribonucleoprotein complex; Biological process=mRNA processing
  Homolog annotation: Hit_ID=Q1S9Z0; Match level="QueryCoverage=61%, HitCoverage=69%, E-value=1e-70, Identity=82%"; Hit description=RNA -binding region RNP-1
  Pfam annotation: Domain name=RRM_1; Domain location=172-243; Score =72.8; E_value=1.1e-18; Accession=PF00076.12; Description=RNA recognition motif. (a.k.a. RRM, R
  Pfam annotation: Domain name=RRM_1; Domain location=72-143; Score =97.7; E_value=3.6e-26; Accession=PF00076.12; Description=RNA recognition motif. (a.k.a. RRM, R
  Pfam module annotation: Pfam domain module=RRM_1::RRM_1; Domain location=172-243::72-143
  Subcellular localization annotation: CTP_CleavageSite=57; ConfidenceScore=5.83e-01
MASLHSSFLLTSNFLSLTTPSSSSTHVLFPMRLSTTHLRPLLLTTRHGFGRPPFAAVAEQAATATEASARRLYVGNIPRTVTNEELAKIVQEHGAVEKAEVMYDKYSGRSRRFAFVTMKTVEDATAVIEKLNGTEIGGREVKVNVTEKPLSTPDLPLLQAEESEFIDSPHKVYVGNLAKTVTTDTLKNFFSEKGKVLSAKVSRVPGTSKSSGYGFVTFSSEEDVEAAISSFNNSRMNFHVRSPIRKAYIRRKDMENIRLLVPILGCIS

SEQ ID NO: 205376 - protein, 328 aa, Glycine max
  Coding DNA Sequence Number=SeqID_88598
  Gene Ontology: Mol. function=protein serine/threonine kinase activity; Cellular component=membrane; Biological process=protein amino acid phosphorylation
  Homolog annotation: Hit_ID=Q39886; Match level="QueryCoverage=96%, HitCoverage=69%, E-value=1e-102, Identity=58%"; Hit description =Protein kinase
  Pfam annotation: Domain name=Pkinase; Domain location=50-303; Score =217.0; E_value=4.4e-62; Accession=PF00069.15; Description=Protein kinase domain
  Pfam annotation: Domain name=Pkinase_Tyr; Domain location=50-303; Score=202.6; E_value=8.9e-58; Accession=PF07714.7; Description =Protein tyrosine kinase
  Pfam module annotation: Pfam domain module=Pkinase::Pkinase_Tyr; Domain location=50-303::50-303
MGKLSIKLHDKCKNRKESSSWPLTNCFHHGGGRDDAIGIAQECNVDFSNLFIGRKFSQGAHSQIYHGVYKKEHVAVKFVKVRDNDVKGIPKSLLEAQFLREVIHLPRLHHQNVVKFIGAYKDTDFYYILTEYQQKGSLRVYLNKVESKPISLKRVIAFALDIARGMEYIHAQGIIHRDLKPENVLVDGEIRLKIADFGIACEASKFDSLRGTYRWMAPEMIKGKRYGRKVDVYSFGLILWELLSGTVPFEGMNPIQVAVAVADRNSRPIIPSHCPHVLSDLIKQCWELKAEKRPEFWQIVRVLEQLDQGCSFLSPKKLKQHHLSLRKW

SEQ ID NO: 205377 - protein, 337 aa, Glycine max
  Coding DNA Sequence Number=SeqID_88599
  Gene Ontology: Cellular component=nuclear chromosome; Biological process=chromosome organization and biogenesis (sensu Eukaryota)
  Homolog annotation: Hit_ID=Q9FQ19; Match level="QueryCoverage=98%, HitCoverage=45%, E-value=1e-35, Identity=32%"; Hit description =Sister chromatid cohesion 1 protein 3
  Pfam annotation: Domain name=Rad21_Rec8; Domain location=283-337; Score=81.6; E_value=2.4e-21; Accession=PF04824.7; Description =Conserved region of Rad21  Rec8 like protein
MRSALNNTRDILRKRRDVPSSSLGTWKLNNIRRKEHIFDQPLLTGIGKDLLDISKSEYVRSRSHLVIFEEDHADVRMGEETLSPTNEPPEESLAATNEPPEEPIAATNQPPEEPIAATDHPHEEPIATTDQTSEEAITATSPVTDMQVEHNRNVAVTPPATAQAPHEDDYTSPNRRDCFNMPSSHNISIASLNTNIASERMHTLDYAVSPGVHGLEAMQTPDSDTHDLMSSDKTDEFWFLKLDSTTPASSQGTSGSNKTLSERTKHAAQYFERLSSISPILEEPAGDLSLNKILKGKTKNIAARMFFEVLVLKTNGLLDVQQEEPYGDVSLKLVPML

SEQ ID NO: 205378 - protein, 251 aa, Glycine max
  Coding DNA Sequence Number=SeqID_88600
MVEGTCTVALHRKGKFNYETSSIYDDREAVTYHGQDINEWCFFDVVGLLKGEVYDRFKGNLKPFLDDNDAMELVTYAVKKNVKWVFMLNTFSKPDYIHEICFEEDGHCQGVNEEVTRHCNDEAVETVEDEVACNVDEDDYIGRSEPNSEHGMNHGLPSVNASLMKWNIDAEINVEVHEIDEDYLSEELLSESDLSDNDRSHITTKDAPLTIKVAPLIFKKDDMCKEYKFKLGMNLHLFKKRSHIGTLCIEW

SEQ ID NO: 205379 - protein, 72 aa, Glycine max
  Coding DNA Sequence Number=SeqID_88601
  Subcellular localization annotation: CTP_CleavageSite=45; ConfidenceScore=5.20e-01
MTLLLSNILPSDRSADLPLRKGSVHKTPSGPNRALGFQALVTGLCQSYRAPVPPASSCHRDIGKYAPPPTDF

SEQ ID NO: 205380 - protein, 247 aa, Glycine max
  Coding DNA Sequence Number=SeqID_88602
  Gene Ontology: Mol. function=transferase activity, transferring hexosyl groups; Cellular component=integral to membrane; Biological process=carbohydrate biosynthetic process
  Homolog annotation: Hit_ID=Q2QN55; Match level="QueryCoverage=83%, HitCoverage=37%, E-value=5e-42, Identity=40%"; Hit description =Glycosyl transferase family 8 protein, expressed
MCMKKLRDELTRALIEANDGNANEGGAMSFNELVKVLALKQDLKAFAFKTKAMLSQMEREVQSARKKESLNWHIASHGVPQSLHCLCLKLAEEYAVNAMARSRLPSPEHVSRLVDPTFHHIVLLTDNVLAASVVVTSTVENSANPGRLVFHVVTDKKTYTPMHTWFAINSINSAVVQVRGLHHCDWSKEVNAGVKEMQETNQLIWKHYYNNYKEKELDHSEEHDRYFEALRPSSLSLLNHLRIYIPE

SEQ ID NO: 205381 - protein, 125 aa, Glycine max
  Coding DNA Sequence Number=SeqID_88603
VEASGNRLPVCAIDYTEEWVTGNRLPDEPARTLQRTVEWILPTPTPYRLVEPAQVIEVTSSEEDPEEDLEELPLEPAEDALDFLEGDEDPLPEVDSPEEVMSASEADSTEDSGPREMATSGGSSS

SEQ ID NO: 205382 - protein, 242 aa, Glycine max
  Coding DNA Sequence Number=SeqID_88604
  Homolog annotation: Hit_ID=Q1RUD8; Match level="QueryCoverage=48%, HitCoverage=25%, E-value=1e-10, Identity=35%"; Hit description=IMP dehydrogenase/GMP reductase
PTVEEFEEILGCPLGGDASRLHGSSVVYSLFVYVDWDQHLAGIGGGTVNWFPRWKEGKEGVLFSCGSYPNILLIGTRGCINYNPALAIRQLGYPMRGAPTEESLSPFLVKDFGVQNFKVIQRVHKAWGSPLRKDKELWGIRNGIIGDYHEWLKVCTQGLDWLAKLKIINKENFEAPEEDEEVRALKTKLGKARLAKEKFKLVATDVQKECAGARREEHGCDKFREALWGSNSELKLRREERD

SEQ ID NO: 205383 - protein, 141 aa, Glycine max
  Coding DNA Sequence Number=SeqID_88605
MVMGDPISRLSFPACLHFSGENTETFSSLTSYQELRRSEFLIGGYVGARASLLSTTPPFAAMTQELVARGDTLRLSAPRHSVTPSVIDEQRPMWSSAPFPEMSAFSDGDFSSLTSYLELRRSEFLIGGYVGARALLLSAAP

SEQ ID NO: 205384 - protein, 87 aa, Glycine max
  Coding DNA Sequence Number=SeqID_88606
  Gene Ontology: Mol. function=hydrolase activity
  Homolog annotation: Hit_ID=O65755; Match level="QueryCoverage=80%, HitCoverage=38%, E-value=1e-30, Identity=90%"; Hit description =Putative deoxycytidylate deaminase
MKKLHINPPMVYQLEINGACKKLKQIELADCEIYASCEPCPMCFGAIHLSQIKWLVYGAKADAAIAIGFHDFIADALRGTGFYQKAT

SEQ ID NO: 205385 - protein, 282 aa, Glycine max
  Coding DNA Sequence Number=SeqID_88607
  Gene Ontology: Mol. function=nucleoside-triphosphatase activity; Biological process=defense response
  Homolog annotation: Hit_ID=Q1STU9; Match level="QueryCoverage=94%, HitCoverage=24%, E-value=5e-22, Identity=32%"; Hit description=H+ -transporting two-sector ATPase, alpha/beta subunit, central region; Disease resistance protein
MAGDVAVKDFNIKPIAEKVAKCCAGLPLLIVTVAKGLRKKHVVAWRDALIQLERLDHEDLREKVFPTLELSFNFLGDDQKSLLLFISSFGLSYIHIGELFSCCWRLGFYERMNTLAKERNIDYKLINDLRASSLLLEAEAEPEWVRMHDVSRQRYTEIKEWPMVDQLQKFHYIIIPGSYYDELPEKLELLVLGNYGDHHVKFPHNFFSGMRPLRTLLIGGMAFTPSLPPSLDFLTSLRSLILCDSNLGDIRIVAKLTNLEILSLEKSIIPRAAKRNRASNSS

SEQ ID NO: 205386 - protein, 102 aa, Glycine max
  Coding DNA Sequence Number=SeqID_88608
  Homolog annotation: Hit_ID=Q2HSD9; Match level="QueryCoverage=91%, HitCoverage=42%, E-value=9e-14, Identity=38%"; Hit description =Probable disease resistance protein at1g12280
MDTIVSVASPIVKREFGYIVSYEENLQRLETMAQRLEDTKASVQHSAAEAERKGEKMEDIVENWVKNANDAVAEANKLIEIDGNAEADVVWGYFPICGQEAS

SEQ ID NO: 205387 - protein, 51 aa, Glycine max
  Coding DNA Sequence Number=SeqID_88609
MDNHQHGNHSDPAQARIKKKGIRQHKVNYQAQNIDSNIPDSSEDESSESTQ

SEQ ID NO: 205388 - protein, 227 aa, Glycine max
  Coding DNA Sequence Number=SeqID_88610
  Gene Ontology: Mol. function=transporter activity; Cellular component= membrane; Biological process=transport
  Homolog annotation: Hit_ID=Q3PCF2; Match level="QueryCoverage=67%, HitCoverage=49%, E-value=8e-73, Identity=87%"; Hit description =Binding-protein-dependent transport systems inner membrane component precursor
MVSGAGLQAAGRGLRPLPPSHPAAGAGALLLLCRIGLAHDTRLNARSAARGLCPHGAGQGAGRADRPVPPRNAQRRDPDPHRDRHRIRDDGFRRRRHRDGLQHSRTRAAGRRWRARPRLPVDPGDHPADGRRLCADQPADRPLLCAERPEDPLPMSAASNPAQSGLPRRRLLRNPPHWTTVLAIIVLIAIVAMAVFAPLLANFEPTKLNAAMRLKPASETYWLGTEL

SEQ ID NO: 205389 - protein, 191 aa, Glycine max
  Coding DNA Sequence Number=SeqID_88611
  Homolog annotation: Hit_ID=Q1SFC5; Match level="QueryCoverage=60%, HitCoverage=15%, E-value=6e-14, Identity=39%"; Hit description =Asp/Glu racemase
REVGPAWFTDYFPAVDPDNEEEVNEIWSFYLNPQILSCRTGVQSNYLGLVGYQPNLVSRQFGLSQIRPKSLFEDPQDVIRGANLSEKTFKKFLKISLDENYNLHPFEFNHSHFCTMGLESGFTQPTVENIRSNLQARGKTIMTKKSAETSRADVRPKKPTGIQKKDDSTETTTTSKRSKHAGVELDEEKDA

SEQ ID NO: 205390 - protein, 156 aa, Glycine max
  Coding DNA Sequence Number=SeqID_88612
  Homolog annotation: Hit_ID=UPI000044A741; Match level="QueryCoverage =28%, HitCoverage=11%, E-value=4e-08, Identity=68%"; Hit description =PREDICTED: similar to Ac1147, partial
IIAIVGLQRGIPSKRESSARVDYVPALCTHRPSLLPIEWSGEVFGLRRRERFAARDVVNLRKDHCRCLTIRLTRELVYSSTVGREGMTTAPRAPGLLVLATNTNPGASCAKELKSVKCDSRGPGDGCPAGVVTTQHLHTMTLGNGISPALCIDERN

SEQ ID NO: 205391 - protein, 76 aa, Glycine max
  Coding DNA Sequence Number=SeqID_88613
MASSSPTKPTTPFSSPDTRRQSKSPPLFILWEDIAFLVDFPHCTVPLMLRSEAGIETNQTIGYLSCDLSSRPARYR

SEQ ID NO: 205392 - protein, 227 aa, Glycine max
  Coding DNA Sequence Number=SeqID_88614
  Gene Ontology: Mol. function=aspartic-type endopeptidase activity; Biological process=proteolysis
MVTRSTSKLINVINEDSDQNSDNTTEIGSVSEKNINLINSKHWKTPSKLYYQRPTAPDLLLEERGENNFKSFSANNIYEWNIDAQTEYNIMNTLQHMTMVATAYQTSHECSEETIIDILVAGFSGQLKGCAVKTDLNGKVITNDDDKEIPDAVNTLIFTIAQHFIGDPSLWKDRSAGLDMKEGSIPAALIYRIQYKVMNTCASRVLLQPQKGETTLFITDMTKANVY

SEQ ID NO: 205393 - protein, 87 aa, Glycine max
  Coding DNA Sequence Number=SeqID_88615
MPTFENDVPKGKLYKVSEFQQTLSTITKQKRKHKREYESVDPTVMWLRMPPDSWVTVTKGRVVDKSRVFATTYPQFVMRNSDLRSSC

SEQ ID NO: 205394 - protein, 142 aa, Glycine max
  Coding DNA Sequence Number=SeqID_88616
  Gene Ontology: Mol. function=RNA-directed DNA polymerase activity; Cellular component=intracellular; Biological process=RNA-dependent DNA replication
MTLSEKQALSARSNTRVDVRPSMVLQRCVETNLVLNWEKCHFMVQEGIVLGHKILARGIEVDQAKIDIIEKLPPPSNVKGIRSFLGYAGFYKRFIKDFSKIARLLSNLLNKDIVFKFDEECSAAFQNLKNKLAIAPVMIALD

SEQ ID NO: 205395 - protein, 135 aa, Glycine max
  Coding DNA Sequence Number=SeqID_88617
  Gene Ontology: Mol. function=DNA binding
  Homolog annotation: Hit_ID=Q1SWX1; Match level="QueryCoverage=96%, HitCoverage=28%, E-value=2e-11, Identity=33%"; Hit description=IMP dehydrogenase/GMP reductase
MEPIASLSQYYDQPLRCFTFEDFQLVPTVKEFEEILGCPLGGRKPYLFSGFYPSTTRVAKSEYQGSVWRKGQRPWQNQGEWASFIDILALLIFGGVLFPNMEGLVDLTAIDAFLAFHHGKESPVIAILAMHDTFD

SEQ ID NO: 205396 - protein, 108 aa, Glycine max
  Coding DNA Sequence Number=SeqID_88618
MAMEVYNGPPTSQEYGRFLEATLLRTRAHVEREAKDGNSFEGTILGSMLMLSWIVHLIMNLEISSFTSFKRKKKKGGEKVKNEECSHSRRCTHKTAAHHLRGRFSLNL

SEQ ID NO: 205397 - protein, 76 aa, Glycine max
  Coding DNA Sequence Number=SeqID_88619
MAGDASKFIHISPKNSEHVTYGDKNKGQEMGFNGAKVESNKVASTNIQRLSIVSRIIQGQANKIKKKIRSQKNFTG

SEQ ID NO: 205398 - protein, 84 aa, Glycine max
  Coding DNA Sequence Number=SeqID_88620
MDIPVSHEGKYFYLGACHSVWNSLETQANHLGRGELSVHDKSGGSIMFLTENFSYPVHVGGVPQIGCHASSTNSFLVESRKKNT

SEQ ID NO: 205399 - protein, 68 aa, Glycine max
  Coding DNA Sequence Number=SeqID_88621
MEKSEKKNFGEKKMKKAYITWDDNDMESFEDSENEEINLCLMAKSYESDEEALSTTCLVLVNYVIKAI

SEQ ID NO: 205400 - protein, 88 aa, Glycine max
  Coding DNA Sequence Number=SeqID_88622
  Gene Ontology: Mol. function=transition metal ion binding
MTTIIVKKTQKKAPQRRCCGIFRSFQGLSISLLMKKMQKTLHGIQMGETAMECLVILLIPPSGRRLIVCIRILAKRQEILGLDLPLME

SEQ ID NO: 205401 - protein, 218 aa, Glycine max
  Coding DNA Sequence Number=SeqID_88623
  Gene Ontology: Mol. function=RNA-directed DNA polymerase activity; Cellular component=signal recognition particle, endoplasmic reticulum targeting; Biological process=RNA-dependent DNA replication
MTHHSSSANGEGTSHKNPLSRILDELSSHKLWKETLERKEKGKERERKVPLATLSFQGYALYWWTSLVRERRIHGDPLVKYKNDLKSALRKRHISSYYEKELMDKLQRLRQGSMSVEEYRQQMELLILRVGLREEERTSTARFLSGLNMEVREKVELLQYKDQDDLVQLCIRVEQQLKRKSTSKSYGSRSYPKKDQGQGILRAAPSKPKDDKGKTIEK

SEQ ID NO: 205402 - protein, 77 aa, Glycine max
  Coding DNA Sequence Number=SeqID_88624
MAYPGNRRKPRWGTFDAADDVEEAVKTLGDEGVDVDKEPALGGEEHDVSGEQLGECDEKEAKEGGELGEQGGDGEAF

SEQ ID NO: 205403 - protein, 72 aa, Glycine max
  Coding DNA Sequence Number=SeqID_88625
  Subcellular localization annotation: CTP_CleavageSite=37; ConfidenceScore=5.12e-01
MAGSSYTRTSGKSVLSYEKKMQLPQEPLNKKPRGLARKSMAKTNFVELCGAATRNSSFEGKRETNYEYIAWS

SEQ ID NO: 205404 - protein, 176 aa, Glycine max
  Coding DNA Sequence Number=SeqID_88626
MTRTRGLGRVIGRLVGGDRHDDHDVADVPERRMPIVSARRQRVHQMTADTRDLAEDVADMADDVPDLAKEAPEMRADIDGADGAEGSDADDAEGFPGGPRDPSVLTSFADHVAHAVWSGHERPDLKLVSHGEEGDTDWGGQCLRSKDWLLPQGLSPLIDFSVVTGDPGLIFAFVER

SEQ ID NO: 205405 - protein, 125 aa, Glycine max
  Coding DNA Sequence Number=SeqID_88627
VAPTRHPVDPEKSNKDLGSPALVTGLCQSYRVPVPPARSCHRDIGITPARHPVDPERSNRVLGFPALITCLCQFYGVPVTPNKVIMPHINRAFIKKYCAPRQAQGETQQQPGDGQQQEQMHRRHL

SEQ ID NO: 205406 - protein, 162 aa, Glycine max
  Coding DNA Sequence Number=SeqID_88628
  Gene Ontology: Mol. function=RNA-directed DNA polymerase activity; Cellular component=signal recognition particle, endoplasmic reticulum targeting; Biological process=RNA-dependent DNA replication
MGPKSTLRLMRILGPSLASLAQSSWSLLSNALGGYRNDLKSALRKRHIPSYSERELMDKLQRLRQGSVSVEEYRQQMELLILRAGLRKEERTSIARFLSELNMEVRDKVELLPYKDLDDLIQLCISLEQQLKRKPTSKSYGSHSYPKKDKGYGILGAAPSKP

SEQ ID NO: 205407 - protein, 112 aa, Glycine max
  Coding DNA Sequence Number=SeqID_88629
  Gene Ontology: Mol. function=protein serine/threonine kinase activity; Cellular component=integral to membrane; Biological process=protein amino acid phosphorylation
  Homolog annotation: Hit_ID=Q9C8I9; Match level="QueryCoverage=93%, HitCoverage=15%, E-value=6e-29, Identity=55%"; Hit description =Receptor protein kinase, putative
  Pfam annotation: Domain name=Pkinase_Tyr; Domain location=22-112; Score=-170.9; E_value=0.055; Accession=PF07714.7; Description =Protein tyrosine kinase
MEYVDSKKQEFSYSEVQMITNNFERVVGKGGFGTVYYGCIGETRVAVKMLSHSTQGVRQFQTEANILTRVHHRCFTPLIGYCNEGTRTALIYEYMTNGDLAEKLSGFKYVYM

SEQ ID NO: 205408 - protein, 350 aa, Glycine max
  Coding DNA Sequence Number=SeqID_88630
  Homolog annotation: Hit_ID=Q1SKD7; Match level="QueryCoverage=64%, HitCoverage=58%, E-value=6e-18, Identity=26%"; Hit description =Ankyrin
MAPKKLSGKRSRRDATTEGTNAAPEFDSHRFRSADHQQCFEAIKGWSFHRERCVQLRDDEYTNFQEEIARRHWTSLVTPMAKFDPDIVLKFYANAWPTEEGVRDMRSWVRGQWIPFDTDALSQFLGDPLVLEEGQECEFSQRRNRADGFDEEAIAQLLCTPGQDFARTAAGRRLRIMRTSMTTLTQMWMTLLLSNVLPSDHNSDLPLPKCQLVYAILTRMSVHVAQLIADAIYLFAGMPPTRHHLDPDKSNRALGFPALITGLCQSFGVPVTPSKDADAPPPPHQADPAGSLGMERYLQRLVHQQAANHRGQFRDEVAWPGDWPEAQAEEACMDEEMTDLLGFLGGSGAT

SEQ ID NO: 205409 - protein, 134 aa, Glycine max
  Coding DNA Sequence Number=SeqID_88631
MASRKRKAATSRPQPYYDIHRFTSEDAWNRYADNVLGRNILPERNVKVFFTEFDEFRTELVRRNWHRTLTNLMEGSIDVALVKEFYANLYVPGDKPPNQVRVRGHLIKFDADSLNTFLETPVILEPGETLPTYS

SEQ ID NO: 205410 - protein, 109 aa, Glycine max
  Coding DNA Sequence Number=SeqID_88632
  Gene Ontology: Mol. function=transition metal ion binding; Biological process=electron transport
MSKNKVLKEHKGTFLSWFKETIFAYDNASETLRKLADGPKRNVITCQGYDINKYSFHTKTQDDKSTMQNSRWVDINISVQTDDFGFTLVDLKKPTYQNYPFIMVEEAKR

SEQ ID NO: 205411 - protein, 204 aa, Glycine max
  Coding DNA Sequence Number=SeqID_88633
MSKSPTFVDHPTFCYRDPRVWWHTETPDGNPQTPFAIQRPESSLACEDTLRLSASRHSETPSSIDKKRPMCPSTPFPEMSASSGRDYFSLTPLSQELRRSKSPAFVDHPTFCYRDPRVRWDAETPDGNPKTPFAIQRPESLLACEDTLRLSTPHYLETPGSIDKQRPMFSSAPFPEMLASSVRDYFSLTPLSQELRRSEFLITN

SEQ ID NO: 205412 - protein, 98 aa, Glycine max
  Coding DNA Sequence Number=SeqID_88634
  Subcellular localization annotation: CTP_CleavageSite=62; ConfidenceScore=5.34e-01
MSVIIDAISHRLIVDSRGQLAKISKTSGPPIKFRGDASSPALLLRVPVSFFSSPVDSACVVVSSSSSSPWFCAFRRHCQAFELIRTRHRLGVDDPHSL

SEQ ID NO: 205413 - protein, 128 aa, Glycine max
  Coding DNA Sequence Number=SeqID_88635
  Gene Ontology: Mol. function=chlorophyll binding; Cellular component =integral to membrane; Biological process=photosynthetic electron transport
  Homolog annotation: Hit_ID=O19928; Match level="QueryCoverage=98%, HitCoverage=33%, E-value=1e-41, Identity=67%"; Hit description =Photosystem II P680 chlorophyll A apoprotein
MHTALVAGWAGSMALYELAVFDPSDPVLDPMWRQGMFVIPFMTRLGITNSWGGWNITGGTITNPGIWSYEGVAGAHIVFSGLGGLFWFWRISCNRIVWSWNMGVRSLWTNWKDTIRKSRVGRGSNNPY

SEQ ID NO: 205414 - protein, 78 aa, Glycine max
  Coding DNA Sequence Number=SeqID_88636
MESYQCFETLDSNQMLPHQRILGQDIWDQEFDVIERERKDDKEGRIGVGDAPVAPGRGVRVAATEVDEPLRFLDDSAI

SEQ ID NO: 205415 - protein, 375 aa, Glycine max
  Coding DNA Sequence Number=SeqID_88637
  Gene Ontology: Mol. function=magnesium ion binding; Biological process=metabolic process
  Homolog annotation: Hit_ID=Q1T1D0; Match level="QueryCoverage=32%, HitCoverage=25%, E-value=1e-42, Identity=62%"; Hit description =Terpene synthase-like; Terpenoid synthase
  Pfam annotation: Domain name=Terpene_synth_C; Domain location=240 -367; Score=-44.1; E_value=0.0062; Accession=PF03936.6; Description =Terpene synthase family, metal binding domain
GSIRVSSSSATNKNKLEAHLWPHGMDGDSGLEGVESRGAGEMVGGGRGPSGPRARETALINDNGYKACTSQQISGLSPEMKQLSRNGAGSPRIRFARDSNSYKYSLTEAHCTRKSIEHCGASTGTMIRRCEDFDVKVEGLATDEAKMGRGEFHNGIFKMIHLGLGASGFSHCSMKAPMLSLGIRGLRQPSKSFINVNQHSNLVIERMVHALELPAHWKVPWFEVKWHVKQYKKEKHMDPNLLELAKLNFNLIHAKLQMEVKELSRSFLCAAGVAFEPKYKSERKWLTKVITFVPVIDDVYDIYTSFEELKPFTMAFERLPVKPEEGEDGVKSSCSLCMLVDSLFPSCKHLVHPFCVAFFCDPLLQFVFFAPLDDC

SEQ ID NO: 205416 - protein, 359 aa, Glycine max
  Coding DNA Sequence Number=SeqID_88638
  Homolog annotation: Hit_ID=Q5KS41; Match level="QueryCoverage=65%, HitCoverage=50%, E-value=6e-23, Identity=32%"; Hit description =FOLDED PETALS
  Pfam annotation: Domain name=DUF1298; Domain location=225-338; Score=- 66.9; E_value=0.00023; Accession=PF06974.4; Description=Protein of unknown function (DUF1298)
  Pfam annotation: Domain name=UPF0089; Domain location=12-250; Score= -104.2; E_value=0.0064; Accession=PF03007.7; Description =Uncharacterised protein family (UPF0089)
  Pfam module annotation: Pfam domain module=DUF1298::UPF0089; Domain location=225-338::12-250
MDQFYDEVQEPVSPHGHYFNSSVICSYVFGFLEMAVPIDDSQTIPLLEDVFLPINPRFSSIMVRDQAGKMRWKRVQVNPEEHVKVPRFPECNSAELYEQYFDDYVTRILNERTPQNKPLWEIHLIKYPTSSAAGTIIFKFHHSLGDGYSLMGALLSCLQRTDDPSLPLTFPSNSQHAKKNMFKLHSVISSLFSSMLDFGSSIIKTRMIEDDKTPIRSGYEGTKPKYFTLSNISLSLDHIKAIKSNLGVVASKTFYNTLGNCSVLISNMFGPMEQMALANHPVSGVYFAMSGGPQNVNVEIMSYVGELRITSKTLKGFIDEQKFKFCIEKAFDEIFKDAMEIYEIPKWDIYMEILISGGA

SEQ ID NO: 205417 - protein, 43 aa, Glycine max
  Coding DNA Sequence Number=SeqID_88639
MTRVVGGGSMKVVHGGGFDCFNIGLSTLILDKIDVKLNAVTYL

SEQ ID NO: 205418 - protein, 89 aa, Glycine max
  Coding DNA Sequence Number=SeqID_88640
  Homolog annotation: Hit_ID=Q10M67; Match level="QueryCoverage=85%, HitCoverage=9%, E-value=9e-09, Identity=43%"; Hit description =Expressed protein
  Pfam annotation: Domain name=DUF630; Domain location=1-60; Score =124.8; E_value=2.4e-34; Accession=PF04783.3; Description=Protein of unknown function (DUF630)
MGCGGSKVEDFPVVVLCRERKAFLKAASEQRYALAAAHVAYFHSLSEIGDALHKFAEQDLTTTTGSSSPEAKEDKQKRSDFEFFWKFHA

SEQ ID NO: 205419 - protein, 92 aa, Glycine max
  Coding DNA Sequence Number=SeqID_88641
  Gene Ontology: Mol. function=identical protein binding; Biological process=negative regulation of enzyme activity
  Homolog annotation: Hit_ID=Q9ZUF6; Match level="QueryCoverage=98%, HitCoverage=12%, E-value=6e-23, Identity=57%"; Hit description =Subtilisin-like serine protease, putative
MTIDASTLDSDFSTYATLRNGKHFAGISLYSGEGMGDEPVNLVYFSDRSNSSGNICMSGSLNPKSVHSKVVVCDRELNSRMEKGVVVRDAGG

SEQ ID NO: 205420 - protein, 106 aa, Glycine max
  Coding DNA Sequence Number=SeqID_88642
  Homolog annotation: Hit_ID=P93204; Match level="QueryCoverage=28%, HitCoverage=4%, E-value=1e-07, Identity=80%"; Hit description=SBT1 protein
MSTERHVNYRYDVLQTLQQCQQLLLCKLVIPSTHVASTAASSAVSNATLLGYAIGTAHGMASQARMAAYKVCWTGDCFASRSPLVAPPPPLSLTTLTTSPLEPSRR

SEQ ID NO: 205421 - protein, 131 aa, Glycine max
  Coding DNA Sequence Number=SeqID_88643
MARREKLWSFCTLLSSRGGGLDDMRRQIMVIPLTFSPFRHNRVRWHAETNYGHSAPFCHPEVAGPMTCGDKLWSFRTPFRHSDTVVSDGTQRQIMVILRPLSFRSSESSDKRAKTNYGHSAPFVIQKQRVE

SEQ ID NO: 205422 - protein, 76 aa, Glycine max
  Coding DNA Sequence Number=SeqID_88644
YDLDQRAKHNSKHSKTLRDWRLAHPAAKPNYESSIPEWIWGLAQDSALSAPTIKFSRERVALSVSTPLSPNHEVQF

SEQ ID NO: 205423 - protein, 74 aa, Glycine max
  Coding DNA Sequence Number=SeqID_88645
MCNVSWVTNRNGLKILIHDNEEQNTSIASNVVLTHAMDATKVTPPTPILFVPKEIMPRASINKSIKKVTSKKEP

SEQ ID NO: 205424 - protein, 318 aa, Glycine max
  Coding DNA Sequence Number=SeqID_88646
  Gene Ontology: Mol. function=structural constituent of ribosome; Cellular component=intracellular; Biological process=translation
  Homolog annotation: Hit_ID=Q0KIV9; Match level="QueryCoverage=48%, HitCoverage=58%, E-value=5e-49, Identity=63%"; Hit description =Ribosomal protein L7/L12 C-terminal domain containing protein
  Pfam annotation: Domain name=Ribosomal_L12; Domain location=209-276; Score=66.4; E_value=8.9e-17; Accession=PF00542.9; Description =Ribosomal protein L7L12 C-terminal domain
GIVNKVLRLAQDSVAALEVSMLDSKSVTRRVGDIGIRWEPPCRVLLLGVIQDGYGVFICCFAIKLGACSILSVELWGQPLHPTVVRLNASNLNVFSRHFGQPARKEEEDDVEEVEIDQKCLPADFDPATFDPNDHRGPPSERVFRLIDEIASLTVAEAGELGLILMKKMGVKEMPNVGFMKAGAGNLAGMAAKAPTAAKEEQKLEKTVFELKLESYEAASKIKIIKEVRGFTDLGLKEAKDLVEKTPSVIKKGISKEEGEQIIEKLKALGAKGCFAHSLDEFSLLKSFLVDIHTPKVPSIKQVDWRLPVAGWHCEGEH

SEQ ID NO: 205425 - protein, 322 aa, Glycine max
  Coding DNA Sequence Number=SeqID_88647
  Gene Ontology: Mol. function=magnesium ion binding; Cellular component=chloroplast; Biological process=metabolic process
  Homolog annotation: Hit_ID=Q1SDQ3; Match level="QueryCoverage=85%, HitCoverage=34%, E-value=1e-120, Identity=76%"; Hit description =Terpene synthase-like; Terpenoid synthase
  Pfam annotation: Domain name=Terpene_synth; Domain location=7-231; Score=218.4; E_value=1.6e-62; Accession=PF01397.11; Description =Terpene synthase, N-terminal domain
MLESQDWKSIMKYQRKNGSLFNSPATTAAVFQCHKNAECLGYLQSVLEKFENAVPTTYPLDIYARLCMIDSLERLGINHHFKEEIRSVLDEIFRYWMQGVEDIFLDPTTCAMAFRMLRLNGYDVSSDPFYQYSEDKFAESLKGYLKDVGAVIELYRASQAIIHPDESILVRQSLWTKHLLKQESSPYRLYADKLRSYVDLEIKDVLNFPYHANLERLLNRRSMEHYNTVETRILKASYRSCNLANQEILKLAVEDFNICQAIHIEELKQLSSFLIGHLWRGLVTLEAVSFRSVSTLLVWLMPHASVPELVPCLAIVAANTAI

SEQ ID NO: 205426 - protein, 104 aa, Glycine max
  Coding DNA Sequence Number=SeqID_88648
MEQICKSKEEAQRWSRFASQIKNNGEHSGKRSLLKETVNKRYLRKRMFERNWEAQKTELLKRFSPSDAAIPYEQLDALYQNGWVEDYVQKFEKLTNCQKFPNNN

SEQ ID NO: 205427 - protein, 89 aa, Glycine max
  Coding DNA Sequence Number=SeqID_88649
MDGILISSVVLLADSRFTRPDMGFHPTKLNFVPSDADEAPLDVSICLHAFGIVGCGSFSGVKSCEREDPFHPGLIIGDAGGFQSPTREP

SEQ ID NO: 205428 - protein, 141 aa, Glycine max
  Coding DNA Sequence Number=SeqID_88650
  Subcellular localization annotation: CTP_CleavageSite=63; ConfidenceScore=5.08e-01
MMKVYGKTFLQAECESNALFNVIMATDPTSPPQSDGQSKATSKRSRTTTRLRTLTLRTVDQPRPAVYVDPATGRASGPMREKFHSYLGVVAREKVPIIHNNWKDVPETLEDIVWNDILWSKHPLLAVEHVEISLGRKNSTF

SEQ ID NO: 205429 - protein, 126 aa, Glycine max
  Coding DNA Sequence Number=SeqID_88651
MTKEFGRASISRPRAKREISVLSTVVVLSQAQCMFGFQQVHRITQAISANRCLVCKGSLLNNKEKNKMKDCKNKSGEDVSFTSRISQSHTNSSQALKSVPASSSGLCRSSHSKISQNSLELGPFSL

SEQ ID NO: 205430 - protein, 67 aa, Glycine max
  Coding DNA Sequence Number=SeqID_88652
MTPGVHHVLEKYLKTVLDPKQHCLHVLPPNRQKQLKMSSLLVSHQQCQVLSMRNTKLQALDNFTASG

SEQ ID NO: 205431 - protein, 254 aa, Glycine max
  Coding DNA Sequence Number=SeqID_88653
MRINLICGKHADHVFMVTDHLHTTEKTHTMEHHHDAVNNGEQQHHHFAGSNNTQWSRKQQSEREDERNVEEEDELSSWNRRTGMRKRREAATPLDRLTSDVVRWIPYDDHRPFKEFKLISLFFGQIRWGPSIEIDDRWMQFFEYLESMGQICVALEQCAAEYMEWDSPRHPPVVHNDTFIELDPPQQPVAAMAMPEPHAPTPVDIDMPRYAVEGCQRIAERLEHLINMRMITTGTEAYTVAKECLRIARGVTEQ

SEQ ID NO: 205432 - protein, 326 aa, Glycine max
  Coding DNA Sequence Number=SeqID_88654
  Homolog annotation: Hit_ID=Q47522; Match level="QueryCoverage=17%, HitCoverage=77%, E-value=5e-18, Identity=73%"; Hit description=LacZ protein
MVKVGTSYVPINVSFRQKLAQGFPVLQWLLFLSAVPPVQLLTGWCVTAKAPPDISAGKCSGHAARRVPFAIQAAQLLGRAIGAGLFAITPAGERGMCCKAIKLGNASVFPEFDQKFTGQIAHTVQQVAGETRLKIPDTLAELNTMDVHQASTDPSILRTLESLAEEWAETVSGALDQAYRYRRPRGGARYQLLFPLVRVNFELGVIMLTHINCVALTARFPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTGK

SEQ ID NO: 205433 - protein, 86 aa, Glycine max
  Coding DNA Sequence Number=SeqID_88655
MRKVPKREGKRVILRIFQTPGSPRLASGSPGPPNDLGVKKGFRLSTLKGFSEIKEKKEKEEEKTRPRRFRIIIVTDSYIVLRSSTG

SEQ ID NO: 205434 - protein, 90 aa, Glycine max
  Coding DNA Sequence Number=SeqID_88656
MIESFQQQQEMGVIELCVEVDVVGASALNVANSLLSCGNNIVGNESKVQRFAINLDDDSDDDDYMISNSYVKDSLDEEEDIDDISDTDEE

SEQ ID NO: 205435 - protein, 158 aa, Glycine max
  Coding DNA Sequence Number=SeqID_88657
  Gene Ontology: Mol. function=nucleic acid binding; Cellular component= mitochondrion; Biological process=DNA integration
MGISHQGQAPRQWFERLQSTLVQFGFSASKCGPSLFVYKKHKNVVYLLAYINGNVITGSFSTLVQSFINQLNFTFALKQLGHLGYFLGIEVHRTASGSILLTHSKYICDLHKTNMADAKWISTPMAFAMKLSKSGGDHLSNSELYKLEVGALQYATIT

SEQ ID NO: 205436 - protein, 169 aa, Glycine max
  Coding DNA Sequence Number=SeqID_88658
  Gene Ontology: Mol. function=voltage-gated potassium channel activity; Cellular component=voltage-gated potassium channel complex; Biological process=potassium ion transport
  Homolog annotation: Hit_ID=Q9SE95; Match level="QueryCoverage=70%, HitCoverage=44%, E-value=1e-41, Identity=64%"; Hit description=FH protein interacting protein FIP2
  Pfam annotation: Domain name=K_tetra; Domain location=2-53; Score= -21.3; E_value=0.049; Accession=PF02214.13; Description=K+ channel tetramerisation domain
  Pfam annotation: Domain name=Pentapeptide; Domain location=83-122; Score=28.0; E_value=3.3e-05; Accession=PF00805.12; Description =Pentapeptide repeats (8 copies)
  Pfam module annotation: Pfam domain module=K_tetra::Pentapeptide; Domain location=2-53::83-122
MRWILSLVRDGKHFRHILNWLRDGVVPTLEESQYSELLREAEYYQLLGLIDGIHSVLNKKNEDDEFHTELTRTDIIKCIQSEKDLSYVDFSYACLKNVFFSRANLQCAKFRDVDAEGSIFHNATLRDCIHNFWPLNYFLLPREDVNLLRQIFVVLYWLVHAFRVQIYKV

SEQ ID NO: 205437 - protein, 142 aa, Glycine max
  Coding DNA Sequence Number=SeqID_88659
MEPRLFHSLDKCYQWRMAEGRNSTIWQASLNKFLWLLAKNPPWPLFNNTAVMKGRAAEEEGLKALGDVVGKGGSKQGSVSLGVEAEGCKKKPLISVLDHSSSRTAPNSSSHSSAPPSPPPTPSTLWRGWLKSRILQEKTTSK

SEQ ID NO: 205438 - protein, 89 aa, Glycine max
  Coding DNA Sequence Number=SeqID_88660
MVVLVLGRAWQLAPAMAMGVRSFVKNKVPITKLYSRGNKKITDSTDSQGSDMVGSAIFLFLLEYILTNWLSKAETGTADGKGICLKQGQ

SEQ ID NO: 205439 - protein, 139 aa, Glycine max
  Coding DNA Sequence Number=SeqID_88661
MKDLVFITENLGNLFSSPLFDTSIKIAYGLGLILGEPSTFFIHFPPVPTKSISAKPYRVQEDVPHVHIPTPPIVVAKPFSRTMNEFFERFLKLEEWISDKAKPALILKDAVMQHKPPPPLRSTTMVLIFLIKKLISYQA

SEQ ID NO: 205440 - protein, 94 aa, Glycine max
  Coding DNA Sequence Number=SeqID_88662
TSFGYCKDRNGQWLKKDALPPQDERTPSPPPQRDDSALMNEVLTELQGLRSYVGERFDSLDTHFAGMDIRLTQLEEDVGYIRQSFDLPPPPPPS

SEQ ID NO: 205441 - protein, 92 aa, Glycine max
  Coding DNA Sequence Number=SeqID_88663
MILKDELKACLRSKKSLSQQLSEMEGNMLAIIDKYKEELNLAVTHEHRPVDEYAKVSAEKEARGRVIDSLHREAMLWMDRFAFTLNGSQELP

SEQ ID NO: 205442 - protein, 69 aa, Glycine max
  Coding DNA Sequence Number=SeqID_88664
MRPQLPPPALPLKQTRAYPYGLPLNFTPPAVHENTDHAVPYTFEGQPPQPVGGAREEPREHAQGDVNSL

SEQ ID NO: 205443 - protein, 175 aa, Glycine max
  Coding DNA Sequence Number=SeqID_88665
  Gene Ontology: Mol. function=structural constituent of ribosome; Cellular component=ribonucleoprotein complex; Biological process =translation
  Homolog annotation: Hit_ID=Q7EYE3; Match level="QueryCoverage=71%, HitCoverage=66%, E-value=1e-45, Identity=63%"; Hit description =Putative ribosomal protein I
  Pfam annotation: Domain name=Ribosomal_L13; Domain location=28-128; Score=38.1; E_value=3e-08; Accession=PF00572.8; Description =Ribosomal protein L13
MKMVTAFNGNMKKAAAGLRRINLDGLRWRVFDAKGQVFGRLASQIATVVQGKDKPTYTPNRDDGDMYIGHLKQRTLKDQMAKDPTEVIRKAVLRMLPRNKLRDDRDRKLRIFPGSEHPFVDRPLEPYVMPPRSGREMRPRARRAMIRAQKKAEQQQQKANGMKKGKNGEAREESA

SEQ ID NO: 205444 - protein, 65 aa, Glycine max
  Coding DNA Sequence Number=SeqID_88666
MAIIWKKMAPKKLPAKRARKDAAGEGSSAAPQVDVEFDNHRFRSEEHQRCFEAIKGWSFLKERRV

SEQ ID NO: 205445 - protein, 66 aa, Glycine max
  Coding DNA Sequence Number=SeqID_88667
MWMYPPHELIDKRCTLYCSQYSNPQVDVPSTCTTKDVPSNVLGQRILRRGREESKEFLGVSPLNLL

SEQ ID NO: 205446 - protein, 159 aa, Glycine max
  Coding DNA Sequence Number=SeqID_88668
  Homolog annotation: Hit_ID=Q1SKD7; Match level="QueryCoverage=97%, HitCoverage=40%, E-value=3e-15, Identity=29%"; Hit description =Ankyrin
MAPKKLSAKRSRRDTAAEGTSAAPEFDSHRFRSAEHQQHFEAIKGWSFHKERRIQLRDDEYTDFQEEIARRRWTSLVTPMAKYDPDIVLEFYANAWPTEEGVRDMRSWVRGQWIPFDADALSQFLGDPLVLEEGQECEFSQRRNRADGFDEEAIAQLLC

SEQ ID NO: 205447 - protein, 162 aa, Glycine max
  Coding DNA Sequence Number=SeqID_88669
MILAATFPQKIQHMTSQDQPLMQVDILDFNMASNIISNRDSGELTLVINSIKTKVGHQTVHRNKGQVSMTKQRRWKRLLLISCKWDNWQSNWQTDRQAALEPTEKNPKDECKAVMTRSKMVSMNEGEKKIGEEKQQLVTEPEIDPVVELLSKTDVPSFSSIF

SEQ ID NO: 205448 - protein, 188 aa, Glycine max
  Coding DNA Sequence Number=SeqID_88670
  Gene Ontology: Mol. function=RNA-directed DNA polymerase activity; Cellular component=chromatin; Biological process=chromatin assembly or disassembly
  Homolog annotation: Hit_ID=Q1T2D5; Match level="QueryCoverage=88%, HitCoverage=10%, E-value=2e-48, Identity=51%"; Hit description=Chromo
  Pfam annotation: Domain name=Chromo; Domain location=144-188; Score =13.9; E_value=0.022; Accession=PF00385.14; Description='chromo' (CHRromatin Organisation MOdifier
  Pfam annotation: Domain name=rve; Domain location=1-147; Score=61.6; E_value=2.6e-15; Accession=PF00665.16; Description=Integrase core domain
  Pfam module annotation: Pfam domain module=Chromo::rve; Domain location=144-188::1-147
MDFITNLPSSHGYSTIMVIVDRLSKFGHFIALKAEFNSKLVANVFINNAAKIHGFPKSIVSDRDRVFINSFWQQLFKAQGTTLAMSSSYHPQSDGQTKILNKTLEMYLRCFVFDNPKLWYPMLAWAQYWYNSSYHHSLEFGPINQPEHVLDTRIIKRNGIEIQQILIQWESFDASEALWESLDQMASE

SEQ ID NO: 205449 - protein, 71 aa, Glycine max
  Coding DNA Sequence Number=SeqID_88671
MRTRSPLKARACSPLQARMCSPLMIDCPFEKGDNSCNLILSFANLSGNSLRVYVLFDLFTCPFWSDDNGAV

SEQ ID NO: 205450 - protein, 130 aa, Glycine max
  Coding DNA Sequence Number=SeqID_88672
  Pfam annotation: Domain name=Transposase_21; Domain location=4-122; Score=-128.0; E_value=0.0011; Accession=PF02992.5; Description =Transposase family tnp2
MGETLMEWSVIRLTARSGRRFMQKYMMLSMMISGPRQPRNGIDVYLSSLIKDLRKLQDEEVLVFDEFNKETTAIERPEHPGRVRAAGAGVTIKQYFGSAPRTSPSSSSMPPDDLQQLTQQIKDQLEESIT

SEQ ID NO: 205451 - protein, 126 aa, Glycine max
  Coding DNA Sequence Number=SeqID_88673
MAITESRDLSNMSLATLFRMLQEHEMELMRFNQHEENDKKKKGISLKASSSIQEGSDKEDSNEIDDDDDLSLFKKIERSEKKTFNDKKAKKAYITWDDNDMDSFEDSENEVVNVSLMAKNYESDEE

SEQ ID NO: 205452 - protein, 229 aa, Glycine max
  Coding DNA Sequence Number=SeqID_88674
  Homolog annotation: Hit_ID=UPI0000660921; Match level="QueryCoverage =95%, HitCoverage=94%, E-value=4e-10, Identity=29%"; Hit description =UPI0000660921 related cluster
VRITVRCFCVSSNLPSPDDEVQITVRCLRVSSDLPSPDDEDDHLGLCVSSDLPSLNDEGAENCETLRSPTKGADDYIGLCVSLDLPSPDDKGADNREVSPCVSDLPSPNYERSLTKGANDHVSLFVSSGFPSPNDEGADNHEGADDHLCLCVSSDLPSLDDEDVDNHEMSPRVIRIAACRLRMTRAWITMRCLRVSSDLPSLDDEDDHIGLCVSSDLPSLDDEGANNCE

SEQ ID NO: 205453 - protein, 184 aa, Glycine max
  Coding DNA Sequence Number=SeqID_88675
  Gene Ontology: Mol. function=lipoxygenase activity; Cellular component=cytoplasm; Biological process=electron transport
  Homolog annotation: Hit_ID=Q1SBD0; Match level="QueryCoverage=64%, HitCoverage=13%, E-value=2e-38, Identity=66%"; Hit description=Plant lipoxygenase; Lipase/lipooxygenase, PLAT/LH2
MSQFEGSLFGGIRNSAGGHGSNGDNVNNGGVSDGAPLPPKQRGSESGCNFFQWCPNDIDDIDLVIEWDKVYDYAYYNDLSDYDKGAQYACPSLGGSIEYPYPRRGRTGRPPTKSDSNSESRLNFVMSLDIYVPRDEQFIHLKLSYFLANALKSIAQVVKPELESLFDNTPKEFDSFEDVFKLYE

SEQ ID NO: 205454 - protein, 163 aa, Glycine max
  Coding DNA Sequence Number=SeqID_88676
GEFLLLKVLSDCATSRDSPTKLFELASQSRSSRMGDFDQAIWGLFKLQPDPIVLPSTCAYIDAIEVEIRSPLDKAEEAWLKVLVPYSMDAYIFWRGEAKLKIGDPAFRQNQSTMVVGPTIVDALLVLLHGDLNGESIALEERGLWVTKGQEERSMGKRCCDWS

SEQ ID NO: 205455 - protein, 65 aa, Glycine max
  Coding DNA Sequence Number=SeqID_88677
MVLAWSPRPYLPEDPFRDPDEAPPEVESAVLGHGHGSAMDMASRNWVRQISESVVGMFDMVFKRG

SEQ ID NO: 205456 - protein, 200 aa, Glycine max
  Coding DNA Sequence Number=SeqID_88678
  Gene Ontology: Mol. function=chromatin binding; Cellular component =chromatin; Biological process=chromatin assembly or disassembly
  Homolog annotation: Hit_ID=O22150; Match level="QueryCoverage=74%, HitCoverage=91%, E-value=1e-28, Identity=46%"; Hit description =Putative auxin-regulated protein
  Pfam annotation: Domain name=Auxin_inducible; Domain location=74-185; Score=157.7; E_value=3.1e-44; Accession=PF02519.5; Description=Auxin responsive protein
MSNIPTTLSEICLTQFRLAMSIADPWPFSRTHPASPKHMSKNRGFNLRRRLIRVSKWIFRKIRTRAPREYHCLGDSPPSPMVKLLTWGRKLTAGAKSRLKVASGSGYAQLGTDPDPSVPKGHLAVYVGQKDGELHRVLVPVIYFNHPLFGELLKQAEEEFGFHHEGGITIPCRFTEFERVKTRIASGSRRGTRPKRLAWR

SEQ ID NO: 205457 - protein, 121 aa, Glycine max
  Coding DNA Sequence Number=SeqID_88679
  Gene Ontology: Mol. function=RNA-directed DNA polymerase activity
  Subcellular localization annotation: CTP_CleavageSite=31; ConfidenceScore=5.05e-01
MMDTNNFSSYMMDIGNFSSFFWNSINIKLFYVNSKSGCLMFILVQKLRLLKKALKSWNKNSFRDVHSEVNEARQSLESIQQHIRSRIPLDDLLSQETKAQVDLQQALRYHDEFWKEKLRVN

SEQ ID NO: 205458 - protein, 245 aa, Glycine max
  Coding DNA Sequence Number=SeqID_88680
MVAIVVVSVIVTMVVGWNGSGGGNGVVVVAVALAVMGATNGGSGMVVVEIAKARCGGGGMVEATIVRCGGGDGGNGGGGDCGRMVARAMTVVVLVVRHNMASPASQVIINGEFVLDVPAKCEGSKSLNQYASDAILPRKGPVTRAMSKRLQEDWARAVEEGPRSLNQYASDAILPRKGPVTRAMSKSLQEDWARAAEEGPRVLIKARNMALPKDFFPRHGIGPVTRAMSKRLQEDWAKAAEEGPR

SEQ ID NO: 205459 - protein, 291 aa, Glycine max
  Coding DNA Sequence Number=SeqID_88681
  Gene Ontology: Mol. function=nucleic acid binding; Biological process= DNA integration
MFVKFLMALRDDFEGLHGIILYCSPIPSVDVVVVNELLVEEIRLKSNFGSDKGIISTPPSVFVAPFNKKIPSSVISGFSPFQKLYGCVPDYSSLKVFGSTNFVLCPQVKHSKLSYAICDFLGYGDGQTGYCCYDPTNQKLYVSRHVVFHEHLPFYSLSSNPRNPTRSSLTRIDPFSMDISDFNNSKVEKYRVDTSTPTGQDVPMTPSEPPMVVDPPPPHYPPHVHKNFLPYIRYLLETWSLFHQEKHGIGSRWVYKIKTKSDGSVEHFKARLVAKGFSQQYGMDYAQTFSP

SEQ ID NO: 205460 - protein, 326 aa, Glycine max
  Coding DNA Sequence Number=SeqID_88682
  Gene Ontology: Mol. function=RNA-directed DNA polymerase activity; Cellular component=chromatin; Biological process=RNA-dependent DNA replication
  Pfam annotation: Domain name=RVP_2; Domain location=133-266; Score= -15.0; E_value=1.5e-05; Accession=PF08284.2; Description=Retroviral aspartyl protease
MAYPEEHKVAFGMYTLVEKVEYWLENTCQCLEAEDVRNEKEMESLELKQGSMIVDEYAAKFKELVRYFPHYQGRNGESSKCVKFLNGLRPKVKQAMNYQGVRQFPLLGRIQRDFPYSKKEHNGGSLNDQTGRLKAMGRLFTLNGVEASKSKDLIQGKCFTSGNPLLVLFDSDVIHSFTSSSCVEKLKFFVSSFNGDLVVKTPTSGYVLTSDVCLNCPVEIFGRKLLIDHIGLPLTQIDVILGMGWLSSNHVLLNYFDKIVVLGDSEVSRDRMFISVNQVVTSLKEYSQVYMILCNLELKTKVSISDLLVVREFPEDISDLLPKRER

SEQ ID NO: 205461 - protein, 220 aa, Glycine max
  Coding DNA Sequence Number=SeqID_88683
MAEPSKKRKGSSSRSQRHSEAQDTPIPSTISSSSLFSSKEKRIRKGVPFEGTLDDDWKFDFFVYDACRLVCTNQADMSGRLLAGSLALESRILHYLIVHILLPRSSNLHRSFLIGAAVVASFGYRKERDGSWVKKGAQPNDDEGQLPVKGDSSLLQSILDRFDGLQTYVGERIVIIKKGEIVEAMTSKIILMMPKNQKLSKFQRIRLQESCLKESRFMNN

SEQ ID NO: 205462 - protein, 159 aa, Glycine max
  Coding DNA Sequence Number=SeqID_88684
  Subcellular localization annotation: CTP_CleavageSite=36; ConfidenceScore=5.06e-01
AKFDIGEATKVKTKVMSTVATRWRQFKSTLTSKFVFAKSEGQQTQDVVTKYGLDPEAWKQFEETRLTPNWEGIRKRAQSIQKHNDCPHILSRGGYDLLEKKLLDQKRKRIQEEALLSENAASLDEPPSPIKRHVKWKVARTRAVGNMTSESAQEIADKI

SEQ ID NO: 205463 - protein, 69 aa, Glycine max
  Coding DNA Sequence Number=SeqID_88685
MGDLEEVQEQMKADMSALKEQMASMMEAMLGMKRLIERNAATAVAASTVAEANPALPIAMHHPVPNMVG

SEQ ID NO: 205464 - protein, 88 aa, Glycine max
  Coding DNA Sequence Number=SeqID_88686
MATIVLSSRYGSKLAYDTGIWGESYRLFAAKFISWLVFFLTGFVVDLGMAFVDNWVVGKEEYQSQHGFLPLSHPLHLPQFSHSSKQDD

SEQ ID NO: 205465 - protein, 75 aa, Glycine max
  Coding DNA Sequence Number=SeqID_88687
MELYMQHMADQQAANHRGQFRATVAWPEDRPNFQARAGPTGNPGDEDGAQEDDHMVDVMDFFEEAQSLGRDRLKL

SEQ ID NO: 205466 - protein, 795 aa, Glycine max
  Coding DNA Sequence Number=SeqID_88688
  Gene Ontology: Mol. function=protein serine/threonine kinase activity; Cellular component=membrane; Biological process=protein amino acid phosphorylation
  Homolog annotation: Hit_ID=Q9SCZ4; Match level="QueryCoverage=94%, HitCoverage=87%, E-value=1e-175, Identity=44%"; Hit description =Receptor-protein kinase-like protein
  Pfam annotation: Domain name=Pkinase; Domain location=505-778; Score =164.8; E_value=2.2e-46; Accession=PF00069.15; Description=Protein kinase domain
  Pfam annotation: Domain name=Pkinase_Tyr; Domain location=505-778; Score=151.9; E_value=1.6e-42; Accession=PF07714.7; Description =Protein tyrosine kinase
  Pfam module annotation: Pfam domain module=Pkinase::Pkinase_Tyr; Domain location=505-778::505-778
MKESDIVESSRYAISLVLHLFLLLLLFFHLITCNPINVPNKILLNCGSNEGSTFNGVNWIGDVGSSFLPPEYDKSSSTLLISSIKSRAPKVPYSTARITHSPLTYSFPSSPGLKFIRIYFLSSSYLKKMNLSKAYFSVKAGPYTLVKLNLVFFTKDFLVNVGEENLKITFTPSPSISNAFAFVNGIEIFPVPHSIYFPSSMVPYLGHQEPFFINDEYALEILYRVSIASEYSADVENAFGTWLDDSNYISGSQSGSVLSITHRIVRMNFTTLTSKDYNYSAPEELYLTARTMGSNGDANMKYNLTWSFPVDSGFKYLVRLHFCEISTEVTQVHQKVFKVYINNETAEERMDVVALAGGPFTPLSRDFVVMVPSESGRRKDLWIALHPNLELKPTYADAMLNGIEIIKLSDSNLSLAAIFELRREQRKKKVPHVIIVAGAILGTILGLLTFFILIRRAWKKLKWGTSHILSSKSTRRSHKNIQPTVTSGHCRQFTLAEISIATSNFSEALVIGEGGFGKVYKGMMHDGVTPVAVKRSNPSSRQGFKEFQNEINVFSFCHLNLVSLLGYCQEGNELILVYEYMAHGPLCDHLYKKQKQPLPWIQRLKICVGAARGLHYLHTGTSQRVIHRDVKSANILLDQNWVAKVADFGLCRTVPSLYHSHVSTEVKGTLGYLDPEYYKRRKLTEKSDVYSFGVVLFEVLSGRPAVNPVAVEEESEKAGLAVWAMHCCQFGTIDQLVDPYLEGNIKPECLRAFVDIGIQCLADRSADRPTMGELLNSLERILLQDSLEEQEINAT

SEQ ID NO: 205467 - protein, 813 aa, Glycine max
  Coding DNA Sequence Number=SeqID_88689
  Gene Ontology: Mol. function=protein serine/threonine kinase activity; Cellular component=membrane; Biological process=protein amino acid phosphorylation
  Homolog annotation: Hit_ID=Q9SCZ4; Match level="QueryCoverage=96%, HitCoverage=96%, E-value=0.0, Identity=45%"; Hit description =Receptor-protein kinase-like protein
  Pfam annotation: Domain name=Pkinase; Domain location=497-767; Score =127.9; E_value=2.7e-35; Accession=PF00069.15; Description=Protein kinase domain
  Pfam annotation: Domain name=Pkinase_Tyr; Domain location=487-767; Score=96.0; E_value=1.1e-25; Accession=PF07714.7; Description =Protein tyrosine kinase
  Pfam module annotation: Pfam domain module=Pkinase::Pkinase_Tyr; Domain location=497-767::487-767
MMHRIMNTLTCSMYIFILYLLHLQLLVLADNASYVPSENIVLNCGSNVSNVVEYVDGRNWSGDIASPYMPSDADTKFLVARAPNTLQSIPEVPYMTARIFQSQFTYTFNVTPGPKFIRLHFYPASYLNLNLSNAFLSVSAANFTLLHNFSVSLNADYLNVNYFMKEFIVHVSGRVLELTFTPTYNASDAYAFVNGIEVVSMPLGLYSRGDDAPLPLVGHYPELVYIYNDSAMENICRLKVGGEQIPPKYDTGMFRTWDTDGAYILGSDTGIEPFNMSMPVLYDGNAPPYLAPADVYRTSRSMRTFEKGLVNLNYNMTWFFPVDSAEEQFDPIAWSGRPGVAIQRDYVVMVPKVNEAKQDLWLDLHPYKDSKPMMYYNSFSNGVEIFKLSNFDDRNLAGPNPSQSFVSGSDVKPHHVAQFKKSSEKLKFIIIGCGLGTVVLPILLCLVLFRLKVIRPRKVMSWCGLAVHTPNQIEKAKKSSFCSHFPIREIKVATNDFDEALLIGTGGFGSVYKGSFDGGATSVAIKRANPMSHQGVSEFETEILWLSQLRHANLVSLLGYCNEDGEMILVYDFMDNGTLYEHLHLRQRDQPPLSWIQRLEICIGVARGLHYLHTGTKHRIIHRDIKTTNILLDHNWVPKISDFGLSKAGYPSILITNVKGSIGYLDPECFQSHKLTEKSDLYSLGVVLLEILSTRPAVIVGEDDEHVNLAEWAMLCFENGNLEQIVDPNLKGNIVEECFELYLGFAMKCLAERGVERPSIGEVLQNLVLAMHLQKKGGVVPDGNVQRNDNSGLQGYSDLTPGVEFSEIMMPVG

SEQ ID NO: 205468 - protein, 177 aa, Glycine max
  Coding DNA Sequence Number=SeqID_88690
  Homolog annotation: Hit_ID=Q1SKD7; Match level="QueryCoverage=74%, HitCoverage=34%, E-value=4e-12, Identity=31%"; Hit description =Ankyrin
MAPRKLPSKRSRKDATEEGSSAAQPADTDFGRHRFRSAEHQQCFETIKGWSFLRERQVQLSDDKFLDFQEEIGRRCWAPLVTPVAKFNPEIVMEFYANAWPTEEGAQDMRSWVRGQWIPFDTDALSQFLGHPLILEEGQQCEFFQRRSQFSSFDEEAIAKLLCILGQDFTWTAARRR

SEQ ID NO: 205469 - protein, 237 aa, Glycine max
  Coding DNA Sequence Number=SeqID_88691
  Gene Ontology: Biological process=response to stress
  Homolog annotation: Hit_ID=Q2QQA6; Match level="QueryCoverage=96%, HitCoverage=97%, E-value=5e-48, Identity=45%"; Hit description =Universal stress protein family protein, expressed
  Pfam annotation: Domain name=Usp; Domain location=69-214; Score=83.9; E_value=4.9e-22; Accession=PF00582.16; Description=Universal stress protein family
MGKRGTRLPGFCLNRIRPHARVRSPPAQANNKHDTTTTSATKIDQKTENSCNACEEKFDDGAKPGSVIARKIMIVVDSSLEAKSAVQWALTHTVQDHDTIVLLHVMKPSNKQATDEQSSKEIAPRAYELASSFKNMCHGKRPEVQIEIAVIEGKEKGPKIVEEAKKQGVALLVLGQKKRSTTWRLLMMWAGHRVTGGVVEYCIQNAHCMAIAVRRKSKKSGGYMITTKRHKDFWLLA

SEQ ID NO: 205470 - protein, 174 aa, Glycine max
  Coding DNA Sequence Number=SeqID_88692
MTLATLFGKLQEHEMELLRLNQHEENDKKKKGIALKASSSIQEESDKEIDLNEDDDLSLFVKRFNKFMKPGHLRVDCPIFKKKMEKSEKKKFSEKKMKKAYITWEDNDMESSEDSENEEINLCLMAKSYESNEEVTSSNNLSVSFDELQDAFANLHKESIKLADFHLLRKQFQI

SEQ ID NO: 205471 - protein, 767 aa, Glycine max
  Coding DNA Sequence Number=SeqID_88693
  Gene Ontology: Mol. function=RNA-directed DNA polymerase activity; Cellular component=chromatin; Biological process=chromatin assembly or disassembly
  Pfam annotation: Domain name=Chromo; Domain location=680-730; Score =23.9; E_value=0.00059; Accession=PF00385.14; Description='chromo' (CHRromatin Organisation MOdifier
  Pfam annotation: Domain name=rve; Domain location=377-533; Score =115.7; E_value=1.3e-31; Accession=PF00665.16; Description=Integrase core domain
  Pfam module annotation: Pfam domain module=Chromo::rve; Domain location=680-730::377-533
MAYEDIPRTAFPTHHGHYEYRVMPFGLCNARSTFQATMKAYYLKHSKCLFGQRQLDYLGHVVSGNGVQPNPSKIQAIIDWPTPQSLKDLRAFLDLTGFYWKFVKGYAAIATPLTHLLCQDAFQWIPKSQDAFDKLKHAMTAAPMLALPEFSLPFALETDASGTAMGAVLQQQSHPITFFSKPFCPRLQHASTYVRELHAINVAVRKWRQYLLGHKFTIFTNHRSLHDLMSQVIQTPEQQFYLAKLLGFDYDIQYKAGTSNLKHALVSSSDFQKQKEAIQSRLKDHPYFTIINDFIFFKEAIWIDSRNPFIPSLLHEYHATPLGGHFGVKKTLHRLRSNFQWTTMVTDVKSFICQCNICQQVKHITCKSTGLLQPILPPTGVWEDLSMDLITHLPSSHEFTVVFVVVDRFSKGVHLGALPTHFTTFKVANLFLDIVCKLHGFPHSIISDRDLVFISSFWRELFRLSDTTLRMTTAYHPQSNGQTEVMNHTVKQYLRSFMHKQPVDWYKFLVLAEWAYNTSQHSGTGVTPYEVTYGKPPSSIPNYLLGSSRNDAVETMLRTREDIHDTLRRKLLKAQDTMKYFVDKKRRDVQYEVGQMVYVKLQPHSQLSLCTHRPHKLTKHYFGPFRIVEHIGSVAYRLQLPEGSRIHLVFHCSLLRPHHGPFELPTSPLPPDTLHNHPILEPLAILDSRMDLSTDPLTRFVLVQWVGLALEDSTWEKWDEVCNIHHLEDKVNFPGQDNVSTNKVAEDDIGPLPQRNITRPKHLEDYV

SEQ ID NO: 205472 - protein, 282 aa, Glycine max
  Coding DNA Sequence Number=SeqID_88694
TIHLAKKVDCSKLRSTTTTVNVNPATGRRLGPHKEKFHRYLGVVAREKIPIVHSNWNGKFDIPEGDNAKKKVMSTVPTRWREFKSSLTTKYVYANSEGQAKDDPSVKYGIDVATWAEFAKSHQTPNSQDILNMTIGRSEHPGHVRVARTAVTISQYFGHASRGSTSSSTSIMEQQLDEIMEPDTNPLGKDTSDLHADTMGLYVVAEQSTQLVALGKVYDTLATIHNVPYADDVVRAIGTFVGWPTHLVKPIFDEDSQKRLRIPVKSVEMDNVVAAIDLLGEL

SEQ ID NO: 205473 - protein, 168 aa, Glycine max
  Coding DNA Sequence Number=SeqID_88695
MVRWEPTKVHNDDGDQCDARQGLAWGRVQQCFKLAAHVDSVAVFGDGDSYCSPLKTKKKSTEDALRWTTVVEGKLQRKGIKKFVKQRQSHDIVQHKKGLHKKEKTKENRATKEHPPKQHGSCPNSRVMVAQKGRPLCAKCDLNGRQMHHHVLFKCAIWLSEKEACRSA

SEQ ID NO: 205474 - protein, 356 aa, Glycine max
  Coding DNA Sequence Number=SeqID_88696
  Homolog annotation: Hit_ID=Q00XP4; Match level="QueryCoverage=30%, HitCoverage=12%, E-value=1e-07, Identity=37%"; Hit description=[T] KOG0192 Tyrosine kinase specific for activated
  Pfam annotation: Domain name=DnaJ; Domain location=128-197; Score= -7.4; E_value=0.023; Accession=PF00226.21; Description=DnaJ domain
  Subcellular localization annotation: CTP_CleavageSite=34; ConfidenceScore=5.04e-01
MNYLQHQQLGVATDLDQSNNPVNPKSKLIQTGKSANLMSSDLISDFTFENPIRSNPPDYLAEEVQRLRKRRKAEKRLLDMQRRQKERIEEVRETQKKDEEVMNLKEQLRVEIQKGLNQLEMRCHDMPSLLRGLGIQVGGSFIPLPNEATYKRALLKFHPDRASKTDVRAQVEAEEKFKLISRLKEKFGMTSLVTLLLKWFGFNVDGHDRDVCNTCADKTQPVPAMVVMEVVASVVVVDVVAGVAADVVVDDGQSKRLRVDDANHDENGARGRETKRREMGLLAMEGDGADALLDVHGGDESGAKTREGVGVRADSQSRMTSTLAVISRVLVVISKVWVVMVDRFWGFWQVEAAMDD

SEQ ID NO: 205475 - protein, 438 aa, Glycine max
  Coding DNA Sequence Number=SeqID_88697
  Gene Ontology: Mol. function=amino acid binding; Biological process =metabolic process
  Homolog annotation: Hit_ID=Q9ZPQ8; Match level="QueryCoverage=99%, HitCoverage=97%, E-value=1e-167, Identity=69%"; Hit description =Putative uridylyl transferase
  Pfam annotation: Domain name=ACT; Domain location=116-188; Score =36.1; E_value=1.2e-07; Accession=PF01842.15; Description=ACT domain
  Pfam annotation: Domain name=ACT; Domain location=249-320; Score =21.1; E_value=0.004; Accession=PF01842.15; Description=ACT domain
  Pfam annotation: Domain name=ACT; Domain location=28-91; Score=29.2; E_value=1.4e-05; Accession=PF01842.15; Description=ACT domain
  Pfam annotation: Domain name=ACT; Domain location=327-393; Score =26.2; E_value=0.00011; Accession=PF01842.15; Description=ACT domain
  Pfam module annotation: Pfam domain module=ACT::ACT::ACT::ACT; Domain location=116-188::249-320::28-91::327-393
MDDEYEKLFRRMNPPRVVIDNEACKNATVIRVDSANKHGILLEVVQILTDLNLIITKAYISSDGGWFMDVFNVTGQDGNKVTDEAILDYIRKSLGPESCVTSPMRSVGVKQTMDHTAIELMGTDRPGLLSEVSAVLTNLKCNILNAEVWTHNTRAAAVMHVTDEETGSAISDPQRLSIIKELLCNVLGGGNKKRGAKTVVTDEATHTERRLHQMMFADRDYERVNDDDDFAEKQRPNVNVVNWSDKDYSVVTIQCKDRPKLLFDTVCTLTDMQYVVFHANIDAEGPEAYQEYYIKHIDGSPVKSDAERQRVIQCLAAAIERRVSEGLKLELCTTDRVGLLSDVTRIFRENSLTVTRAEVATKGGKAVNTFYVRGASGFPVDSKTIESIRQTIGNTILKVKGSPEEMKSVPQDSPTRSLFSGLFKSRSFVNFGLVKSYS

SEQ ID NO: 205476 - protein, 122 aa, Glycine max
  Coding DNA Sequence Number=SeqID_88698
MRLSTKRGPETGRAEKPKMDSGVEFPGFQIYSHKDEFAFRGSMMSRLQKRAPCPLQIKPTTTVIISSACNGAQNSVGAASTSSSTSSSLNSFFTSKDPIPLLSPLVVLESTSIREENTAKSH

SEQ ID NO: 205477 - protein, 102 aa, Glycine max
  Coding DNA Sequence Number=SeqID_88699
MTGVEEVTADSKASKVVVKGKAADPMKVCERLQKKSGKKVELISPLPKPPEENKEEEITTTRGEKGGGYSTFNIGAYITNDVFVTHMKLVFSTFQKQGWKQG

SEQ ID NO: 205478 - protein, 74 aa, Glycine max
  Coding DNA Sequence Number=SeqID_88700
MQIAETGMCVFFKTLYVQDGINITITYNSRSFIVIIEEIGIGSFKPARITIEREENGAAALAAHGGFNFPKSLV

SEQ ID NO: 205479 - protein, 95 aa, Glycine max
  Coding DNA Sequence Number=SeqID_88701
MFCEKTTSSARYKNRFSGTVVELHYPKTGFINTVFESKKIEKKNLTQGQHLQKRWKEVRSRSMEAEAENNDLKKEENNNDNNNNNNESNRKIGNS

SEQ ID NO: 205480 - protein, 96 aa, Glycine max
  Coding DNA Sequence Number=SeqID_88702
MVTSHSNEPGGEVASEMTFKKLIVESARGFLKILSGKQGRTMFLGLGQRIEWLIDSPMMLVNCFLMNFASTLLPQKIVPYYSWRIIMSRVCDPAFR

SEQ ID NO: 205481 - protein, 321 aa, Glycine max
  Coding DNA Sequence Number=SeqID_88703
  Gene Ontology: Mol. function=protein serine/threonine kinase activity; Cellular component=anchored to membrane; Biological process=protein amino acid phosphorylation
  Homolog annotation: Hit_ID=Q9SNY1; Match level="QueryCoverage=87%, HitCoverage=95%, E-value=1e-121, Identity=72%"; Hit description =SCUTL1
  Pfam annotation: Domain name=Thaumatin; Domain location=31-247; Score= 269.8; E_value=5.3e-78; Accession=PF00314.8; Description=Thaumatin family
  Subcellular localization annotation: CTP_CleavageSite=43; ConfidenceScore=5.02e-01
MGRLLLFLIIPSLVALSFLSEVQSASFKIVNKCRHTIWPGLLSGATSPPLPTTGFTLESGKSRTIKIPKSWSGRIWARTLCGQDSDGKFSCATADCGSGKVECVGGAKPPATLAEFTLNGADGLDFYDVSLVDGYNLPMLIVAKDGIRGGCSATGCLVDLNGGCPAELRVARSNGSRGSVACRSACEAFGDPRFCCSEAYSTPDTCGPSPYSLFFKHACPRAYSYAYDDKTSTYTCANANYLIIFCPFPYTSQKLLGARKDGAQLPLVNKTMMYLSRLQSGGSSPSAHGAKTHRINVHFEVRERGEKNLKFYNGLKEVGLS

SEQ ID NO: 205482 - protein, 61 aa, Glycine max
  Coding DNA Sequence Number=SeqID_88704
MGSHVIKECWPISKTLHVHLQYVTMGIPGNIYHRGILALLKYKTSKCVGKWFEETLQALRA

SEQ ID NO: 205483 - protein, 89 aa, Glycine max
  Coding DNA Sequence Number=SeqID_88705
MGATAAMIEEGVVVAGRVVDFPAGCMSHVTSLGNMVLKNYHMNFEQTLAKRKAGQPQKHSEQLHVLRILPSAGFIKCNFHISITQQALD

SEQ ID NO: 205484 - protein, 50 aa, Glycine max
  Coding DNA Sequence Number=SeqID_88706
MGLVFEILKIGTWVPVLVETYLVAASVSDILNIPIQVVVLKLFLHDSYVT

SEQ ID NO: 205485 - protein, 134 aa, Glycine max
  Coding DNA Sequence Number=SeqID_88707
MEFYIPLTHANLISIMRLLLWYADVCGSQDDVLLAFILMFHIYGLVFFGLGLLCVGVTTISMLKYDFEAKVDAIQKHKVSNYLCQVGPAEPEYVVLSHPLIVDAAVILVEDEETGQIPRAYVVRVDGFRLLENQ

SEQ ID NO: 205486 - protein, 162 aa, Glycine max
  Coding DNA Sequence Number=SeqID_88708
  Gene Ontology: Mol. function=RNA-directed DNA polymerase activity; Cellular component=intracellular; Biological process=RNA-dependent DNA replication
MVITRVVQEVEILESSLQPHDDPLFGFPGERVGIRMHRVVDKEKEQLLIIQVLDANANLFAWSMIDMPNIDPNYHYHQVSVCQDAKPIAQKKRKLGEERQKAIQEEVTKLLTTQFGQEVGYTTWLSNVVMVNKLNGNWRMCTGYTDLNKACPKDVYLLPTID

SEQ ID NO: 205487 - protein, 152 aa, Glycine max
  Coding DNA Sequence Number=SeqID_88709
MDLAFGKMQSALFMCEMRSKDKEWKLTIEKDVMSISIGCFMRDFQENTEAKVKRDENQWKDTNNEKYPHVVYEEHCKACSDAEQCDSTKGNIYDKIEDVFMFILKNLWFGFGISLRVVFVCSTTPCALTWSTFPFFSASIQSLANQFCLEYS

SEQ ID NO: 205488 - protein, 265 aa, Glycine max
  Coding DNA Sequence Number=SeqID_88710
MSLVLEASNFGDFQDKCSTSTTRSAWGSSMWSIIDEMLSEPIEIEFDQRMDAQASCSDNMEIVKKPNYCSLTKKKEYPQIALPDYSWVDDGVAVSLFKSSSIFADLRDKTHPQKKLQQQTLHQINTHPPRSLDALPLVLGKDFFNGFLGLKAEKRKEFVAALKDKVDKLKESLMRAEVEVDKGRTEYQTMMRGAHERHKFEIMGNAEFNILKDVDEGVIMSTNYIPKKTPHSNRPPTLSIDTMMINAASEKQEDRQPNDDEVNHQ

SEQ ID NO: 205489 - protein, 77 aa, Glycine max
  Coding DNA Sequence Number=SeqID_88711
MVVAIATTTIMVAKEEAVDKDGGGSNNHSGDNNDNKSHGQCYWLYHPWHHRVNERFDFKTLVMVAKVVIVDSSGGDC

SEQ ID NO: 205490 - protein, 76 aa, Glycine max
  Coding DNA Sequence Number=SeqID_88712
MVSRQLDLVHNGCLEGITDPMTLSGRSRSWCDLTRWIVILTTMTVDTKVRKKSTTNLGSHYAATVIVFNLNLNTLW

SEQ ID NO: 205491 - protein, 281 aa, Glycine max
  Coding DNA Sequence Number=SeqID_88713
  Homolog annotation: Hit_ID=Q47522; Match level="QueryCoverage=18%, HitCoverage=62%, E-value=1e-21, Identity=94%"; Hit description=LacZ protein
DLPSQVLQWLLFLSAVPPVQLLTGWCVTAKAPPDISAGKCSGRVPFAIQAAQLLGRAIGAGLFAITPAGERGMCCKAIKLGNARVFPVTTLANWSSTAVAAALELVDPPGCRNSINDDADYRIDEVEGIGTIDIKVVGEQMLYKMDKPLEKICRYARSYPNQKTKDEDELLVGDATVGELLEPMGHAKMRRRGKRSDALFGGARYQLLFPLVRVNFELGVIMVIAVSFGKPVVPAALMNRPTRGERRFAYWALAECILAYYVGTDEGVSEVLHVAEKKAAP

SEQ ID NO: 205492 - protein, 575 aa, Glycine max
  Coding DNA Sequence Number=SeqID_88714
  Gene Ontology: Mol. function=binding; Cellular component=nucleus; Biological process=mRNA editing
  Homolog annotation: Hit_ID=Q6ZIP5; Match level="QueryCoverage=89%, HitCoverage=85%, E-value=8e-82, Identity=29%"; Hit description =Pentatricopeptide (PPR) repeat-containing protein-like protein
  Pfam annotation: Domain name=PPR; Domain location=149-183; Score =32.4; E_value=1.6e-06; Accession=PF01535.11; Description=PPR repeat
  Pfam annotation: Domain name=PPR; Domain location=219-253; Score =23.8; E_value=0.0006; Accession=PF01535.11; Description=PPR repeat
  Pfam annotation: Domain name=PPR; Domain location=281-315; Score =45.3; E_value=2e-10; Accession=PF01535.11; Description=PPR repeat
  Pfam annotation: Domain name=PPR; Domain location=383-417; Score =32.4; E_value=1.6e-06; Accession=PF01535.11; Description=PPR repeat
  Pfam annotation: Domain name=PPR; Domain location=418-452; Score =16.7; E_value=0.079; Accession=PF01535.11; Description=PPR repeat
  Pfam annotation: Domain name=PPR; Domain location=87-121; Score=11.2; E_value=0.35; Accession=PF01535.11; Description=PPR repeat
  Pfam module annotation: Pfam domain module=PPR::PPR::PPR::PPR::PPR::PP R; Domain location=149-183::219-253::281-315::383-417::418-452::87-121
  Subcellular localization annotation: CTP_CleavageSite=53; ConfidenceScore=5.33e-01
MPMPMPSPSFQPLKSPHNLCIVKSLLSNPSLSDAVSSLDLLRLKGIRLPSHVLATLLRHCSKTRSYREGKFIHLHLKLTGFKRPPTLLANHLISMYFSCGDFAQARKVFDKMDDRNLYTWNNMISGYAKLGLMKQARSFFYQMPHKDHVSWNSMVAGYAHKGRFAEALRFYGQLRRLSVGYNEFSFASVLIVSVKLKDFELCRQIHGQVLVVGFLSNVVISSLIVDAYAKCGKMENARRLFDDMPVRDVRAWTTLVSGYAVWGDMESGAELFSQMPKSDSCSWTSLIRGYARNGMGYEALGVFKQMIKHQVRPDQFTLSTCLFACATIASLKHGRQIHAFLVLNNIKPNTIVVCAIVNMYSKCGSLETARRVFNFIGNKQDVVLWNTMILALAHYGYGIEAIMMLYNMLKIGVKPNKGTFVGILNACCHSGLVQEGLQLFKSMTSEHGVVPDQEHYTRLANLLGQARCFNESVKDLQMMDCKPGDHVCNSSIGVCRMHGNIDHGAEVAAFLIKLQPQSSAAYELLSRTYAALGKWELVHTFTVLDASHPLKETTYSALWALSYRMEGHAPLTCES

SEQ ID NO: 205493 - protein, 1224 aa, Glycine max
  Coding DNA Sequence Number=SeqID_88715
  Gene Ontology: Mol. function=protein translocase activity; Cellular component=chloroplast outer membrane; Biological process=protein targeting to chloroplast
  Homolog annotation: Hit_ID=Q9SLF3; Match level="QueryCoverage=96%, HitCoverage=97%, E-value=0.0, Identity=55%"; Hit description =Putative chloroplast outer membrane protein
  Pfam annotation: Domain name=AIG1; Domain location=591-777; Score =109.4; E_value=1e-29; Accession=PF04548.7; Description=AIG1 family
  Pfam annotation: Domain name=MMR_HSR1; Domain location=591-689; Score= 9.7; E_value=0.00013; Accession=PF01926.13; Description=GTPase of unknown function
  Pfam module annotation: Pfam domain module=AIG1::MMR_HSR1; Domain location=591-777::591-689
MNLGFLSDIEDFVMDYEADKFGANGEGESKRVGEVVSEESVAGSDQTKGLEAEYVFQEAMEPREQVHDQGSKLNSEDAVVDEQDDTETGSALTSALADGNTPDAVQEPDSFEQAVGADTDSGKLGEDEVIAKQDLEERDGQGNDYVPLDGVDSGVPGDGEICDESCGVGDDNLESSDGGDGKEESGLNSDREMLVLENGSMVDGNSGLVSEKAEIDDSEFMTPRENGGIVLDNGSTDEVDGVATEAIMKSESSEVIPAQGTDAGDLKECAPDPELGDDKIEVKLNASVDPSGEIQDDTSEEVHGNSAHMTLEHQDEVTRDMKDDSLGTNMSHKDRNGEEMSTDGIQNTEIRDCGNGYAEAGSSPPFLENSSNQPLSVQEASAAEPKEASNKDDQSQISDEEHRDHDNTSVVEEPESIQEKIIQVTGEQHVQPAADISSSSERSAGTVPTPVRPSSENSAAAGPTPVHPTGLGRAAPLLEPASRVVQQPRANGTVSNSQSQQMEDSSSGEAEEYDETREKLQMIRVKFLRLAHRLGQTPHNVVVAQVLYRLGLAEQLRGRNGGRVGAFSFDRASAMAEQLEAAGQEPLDFSCTIMVLGKTGVGKSATINSIFDEVKFNTSAFHMGTKKVQDVVGTVQGIKVRVIDTPGLLPSWADQRSNEKILQSVKHFIKKTPPDIVLYLDRLDMQSRDFSDMPLLRTITEIFGPSIWFNAIVVLTHAASAPPEGPNGTASSYDTFFTQRSHVVQQAIRQAAGDMRLMNPVSLVENHSACRTNRAGQRVLPNGQVWKPHLLLLSFASKILAEANALLKLQDSPPGKPYVARARAPPLPFLLSTLLQSRPQLKLPEEQFGDEDSLDDDLDESSESDDENEHDDLPPFKPLTKAQVEKLSKAHKKAYFDELEYREKLLMKKQLKEEKKRRKMLKKMAESAKDLPSDHSENVEEESGGAASVPVPMPDLALPASFDSDNPTHRYRYLDSSSNQWLVRPVLETHGWDHDVGYEGLNVERLFVLKEKIPLSFSGQVTKDKKDANVQMEISSSVKHGKGKATSLGFDLQTVGKDLAYTLRSETRFTNFRRNNATAGLSFTLLGDALSSGLKIEDKLVASKRFKLVVSGGAMTGRGDIAYGGSLEAQLRDKDYPLGRFLTTLGLSVMDWHGDLAVGYNVQSQIPVGRYTNLVARANLNNRGAGQISIRLNSSEQLQIALIGLIPLLKKLVGYHQQLQFGQY

SEQ ID NO: 205494 - protein, 101 aa, Glycine max
  Coding DNA Sequence Number=SeqID_88716
  Gene Ontology: Mol. function=amidase activity; Cellular component =cytosol; Biological process=translation
  Homolog annotation: Hit_ID=Q7G6E7; Match level="QueryCoverage=85%, HitCoverage=16%, E-value=1e-29, Identity=70%"; Hit description =Putative amidase
MVTISLGTETDGSIICPAHHNSVVGLKPTVGLTSRAGVIPVSPRQDTIGTVSDAVHVLDVIVGFDPRDHEATKSAAKLIPPNGYKQFLKIDGLKGKKLGNF

SEQ ID NO: 205495 - protein, 384 aa, Glycine max
  Coding DNA Sequence Number=SeqID_88717
  Gene Ontology: Mol. function=protein binding; Cellular component =integral to membrane
  Homolog annotation: Hit_ID=Q5Z9P4; Match level="QueryCoverage=89%, HitCoverage=98%, E-value=1e-103, Identity=55%"; Hit description =Permease-like
  Pfam annotation: Domain name=DUF6; Domain location=24-158; Score=3.2; E_value=0.043; Accession=PF00892.11; Description=Integral membrane protein DUF6
  Pfam annotation: Domain name=DUF803; Domain location=35-336; Score =607.0; E_value=1.7e-179; Accession=PF05653.4; Description=Protein of unknown function (DUF803)
  Pfam module annotation: Pfam domain module=DUF6::DUF803; Domain location=24-158::35-336
  Subcellular localization annotation: CTP_CleavageSite=66; ConfidenceScore=5.16e-01
VLFFHLQRPTPVQQFSVTKFDLSFFLSLAGMTETGVSDNFKGLILAMGSSAFIGSSFILKKKGLKRAAARGTRAGVGGYTYLLEPLWWAGMVTMIIGEIANFVAYIYAPAVLVTPLELTYPVCVAIAVLSHFLLKERLPKMGVLGCVSCIVGSIVIVIHAPQEQTPSSVQEIWDLATQPAFLFYVMATVSVVLALIVHFEPRYGQTNMLVYLGICSLVGSLTVVSIKAIGIAIKLTLDGISQIAYPQTWFFLTVATICVITQLNYLNRALDTFNATIVSPVYYVMFTTLTIIASAIMFKDWSGQDVSSIASEICGFITVLTGTIILHMTREQEESNMQTIKPDEVMVSSLFDAETSTWFIGEDLMKGVENEHLIRIHDSDYLER

SEQ ID NO: 205496 - protein, 82 aa, Glycine max
  Coding DNA Sequence Number=SeqID_88718
MIEENTRNKVNGGNEGEPNCDLSHGLISMIERMKFHGLPSEDHDLHLKKFLRLTNTVRSLTNVLDNIRLATFLFTLAGQTED

SEQ ID NO: 205497 - protein, 58 aa, Glycine max
  Coding DNA Sequence Number=SeqID_88719
MWVQAIGLFAQATCAPEFGLPRPFNQRLLVLHVGGERSELSRIGCWINGLSYLKKKGG

SEQ ID NO: 205498 - protein, 67 aa, Glycine max
  Coding DNA Sequence Number=SeqID_88720
MRNEYYDGKHCGDPTSLITIYVSQRALLRVSEREAHKCAFQRRKDARSRHQRLLVENVGKTEGNRSK

SEQ ID NO: 205499 - protein, 88 aa, Glycine max
  Coding DNA Sequence Number=SeqID_88721
MKLETLTVVKVVGFAGLLETPPHSRTLWQNSHVKSIIPVGSNDLSFRIIAIAIPIEWNDGVVVAVETHMVQVQIPAAKTAIVEDPSVL

SEQ ID NO: 205500 - protein, 67 aa, Glycine max
  Coding DNA Sequence Number=SeqID_88722
MDIPVSDSNHSAQHKFQSLSVTADHDPLLGLPLTPTKRQTFQDCDDELGISRISPAQLSFNKLKKHA

SEQ ID NO: 205501 - protein, 222 aa, Glycine max
  Coding DNA Sequence Number=SeqID_88723
  Gene Ontology: Mol. function=zinc ion binding; Biological process =proteolysis
  Homolog annotation: Hit_ID=Q1SPG0; Match level="QueryCoverage=28%, HitCoverage=16%, E-value=6e-18, Identity=64%"; Hit description=Zinc finger, SWIM-type
  Pfam annotation: Domain name=FAR1; Domain location=80-214; Score= -55.5; E_value=0.013; Accession=PF03101.5; Description=FAR1 family
MEEHSIRDCSNDGTFEDVHMEDDGVDLRMMSLVSKIKNMCRWNEDGLDDNECFENNVLDDNELKDEEDCDNEVLNDEGYQFYKWYARANDFSIRKSHALINKKGETLQQTFVCSKEGYRQDRGLSPQNRKHEYKNFTRCGCKVYIRVHVNELTDRCVNHHNNTIVFATALVTNETEETYMWLLEQFLKEMKGKHPSFVITDGDLAMRNAIRIVFPRTHHQFA

SEQ ID NO: 205502 - protein, 243 aa, Glycine max
  Coding DNA Sequence Number=SeqID_88724
  Homolog annotation: Hit_ID=Q8L7B7; Match level="QueryCoverage=29%, HitCoverage=9%, E-value=2e-17, Identity=52%"; Hit description =Subtilisin-like protein
MAALRGVALPTQGVGTLPRRESGWVHCKVVNDIHGFSTKKNKEYQEKLPLVVLRVVEIIYSKANSENVVVTGRIVACTIHQPGIDIFEAFDELTTSTLLRERDSGHNPSIGVESLYPCSAGLSLPSMLHSFPPIDALMVYDHRAESGASLGMLSSSSLYGGYGSFSMGDNGYGSMSSYATKLYGGYGRVKPDIVAYGRDIMGSKISAGCKSLSVTSVASPVVVGDAKLSGPNIYEKGAGRVDL

SEQ ID NO: 205503 - protein, 286 aa, Glycine max
  Coding DNA Sequence Number=SeqID_88725
MHTCVEGSKRQLPPWMMQKVGATATHVSDSNNAVETNCYIKKGDIIKTNATKKDHKSESSKRNSNLRAKCEVMGRKKLDQQDGSSDKVTQKKRKGDRSKDRDQRSSIKKRKKLEDPSHGCYDVSPVSDDAMDLTLEDLMAIAEQYVKDYENKDRKEISSRQHESKWQFQVTNETGHTLDSPCKNENSSKSGREDLSHFTSTTGELIATSTSQTGDPAQDMLDLFLGPLLRKTLEKEKSKSIVKNVEITHEFTRQSQDKLAGEEIVPLTKKRNTFKDKVAMFLDQDM

SEQ ID NO: 205504 - protein, 178 aa, Glycine max
  Coding DNA Sequence Number=SeqID_88726
  Gene Ontology: Mol. function=galactose transporter activity; Cellular component=1-2nm peptidoglycan-based cell wall; Biological process =galactose transport
  Homolog annotation: Hit_ID=Q8PPH4; Match level="QueryCoverage=100%, HitCoverage=42%, E-value=1e-63, Identity=75%"; Hit description =Glucose-galactose transporter
TDVGTGRCCGARPFPVPLTALHGFGGLDLRQRREQHGHRQHHQQCGHRQVRRMDLGGEFVEQRDLGDRVGGLHLLVQVADAMQHQGADQHRCEHAGDLVADAHQRDAACRSFNRAEDGDVGIDRRLQQGQPTADHEQPAQRAGVPALRREFTEECRAAGHHQQAQGEALLHAGAAQDP

SEQ ID NO: 205505 - protein, 302 aa, Glycine max
  Coding DNA Sequence Number=SeqID_88727
  Gene Ontology: Mol. function=protein binding; Cellular component =cytoplasm; Biological process=regulation of GTPase activity
  Homolog annotation: Hit_ID=Q9C6C3; Match level="QueryCoverage=89%, HitCoverage=36%, E-value=5e-76, Identity=52%"; Hit description=GCN4 -complementing protein, putative; 3111-9506
  Pfam annotation: Domain name=Ank; Domain location=209-241; Score =40.5; E_value=5.8e-09; Accession=PF00023.20; Description=Ankyrin repeat
  Pfam annotation: Domain name=Ank; Domain location=242-274; Score =25.9; E_value=0.00014; Accession=PF00023.20; Description=Ankyrin repeat
  Pfam annotation: Domain name=ArfGap; Domain location=15-138; Score =18.8; E_value=6.3e-07; Accession=PF01412.9; Description=Putative GTPase activating protein for Arf
  Pfam module annotation: Pfam domain module=Ank::Ank::ArfGap; Domain location=209-241::242-274::15-138
MPTGKIKVPTTQHSHNKQHQVRSLDRIRSVKIAVIPLSAIPLLESAAPLRYTGIDNYVRSITLDVRVWENTVLELFDNLGNAYCNSIWEGLLLLDHERVGEPNVPMKPCSADAFQHKEKYIQAKYVEKSLIIREEDIPENPSVSIRIWQAVQAVNVREVYRLIATSTSNLINTKYYDEAHHAADAKGHQHGPEACLKVEETTETERCFRGWSLLHLACHSGSALMVELLLQFGADVNMCDYHERTPLHHCITSGKNQLAKFLLRRGARPSVKDAGGLTVLERAMERGAITDEELFILLAECQ

SEQ ID NO: 205506 - protein, 87 aa, Glycine max
  Coding DNA Sequence Number=SeqID_88728
MRGFCFVRKKERIGDEVEDEKRGSRGFDESRIQPKKRSGADELGELVLDESQIQSNDPPKNRKIIQSNSADGGGGGRVNSLVNSNKI

SEQ ID NO: 205507 - protein, 221 aa, Glycine max
  Coding DNA Sequence Number=SeqID_88729
  Gene Ontology: Mol. function=protein binding; Cellular component =cytoplasm; Biological process=regulation of GTPase activity
  Homolog annotation: Hit_ID=Q9C6C3; Match level="QueryCoverage=86%, HitCoverage=26%, E-value=5e-67, Identity=66%"; Hit description=GCN4 -complementing protein, putative; 3111-9506
  Pfam annotation: Domain name=ACBP; Domain location=56-132; Score= -38.5; E_value=0.054; Accession=PF00887.9; Description=Acyl CoA binding protein
MKTPLIITKWPVISKFITTLRELASFKELLRSQVEHVLIDRLTEFMNLDLQGAKDSRRRFDKAVHSYDQSREKFVSLKKNTPEDVVAELEEVNSLMNIEVKKKYEFLESISAIMDAHLRYFKLGYDLLSQMEPYIHQVLTYAQQSKELANIEQDKLAKRIQEYRTQAELENIRASSNYTETVPGSDGTHVVGLNSYRSFEAGVQPATTKGEASNWPFLVNI

SEQ ID NO: 205508 - protein, 170 aa, Glycine max
  Coding DNA Sequence Number=SeqID_88730
  Gene Ontology: Mol. function=methyltransferase activity; Cellular component=intracellular; Biological process=protein kinase C activation
  Homolog annotation: Hit_ID=Q2HS71; Match level="QueryCoverage=97%, HitCoverage=45%, E-value=7e-37, Identity=36%"; Hit description =Methyltransferase small domain, putative
  Pfam annotation: Domain name=PPR; Domain location=35-69; Score=39.1; E_value=1.5e-08; Accession=PF01535.11; Description=PPR repeat
  Pfam annotation: Domain name=PPR; Domain location=70-104; Score=10.7; E_value=0.41; Accession=PF01535.11; Description=PPR repeat
  Pfam module annotation: Pfam domain module=PPR::PPR; Domain location =35-69::70-104
MNVALGTALVDMYAKCGCVDEALRVFENLQVKNVYTWTAIINGLAVHGDALGALNIFSCMLKSGIQPNEVTFVGVLAACSHGGFVEEGKRLFESMKYVYHFKPEMDHYGCMVDIWSSGPPNHSGNYALMANLYKMFQNWEVSAQVRKLIKGLRVEKTPRYSLTEVDDFNS

SEQ ID NO: 205509 - protein, 542 aa, Glycine max
  Coding DNA Sequence Number=SeqID_88731
  Gene Ontology: Mol. function=signal transducer activity; Cellular component=membrane; Biological process=response to light stimulus
  Homolog annotation: Hit_ID=Q7XIJ3; Match level="QueryCoverage=77%, HitCoverage=90%, E-value=8e-55, Identity=30%"; Hit description =Putative phototropic response protein family
  Pfam annotation: Domain name=NPH3; Domain location=200-435; Score =255.9; E_value=8.5e-74; Accession=PF03000.5; Description=NPH3 family
MPKPCDLKINIDGQQIFLLKEKVISKYCGGLKKILNHQKRRCHVKELGIRINDFPGGPKGFELVSMFCYNNGKIQITVANVSLLHCCAVYLGMTEEAFSNNLLQQTETFLERIYYWKWNDILASLKSCQLFYTYADGYGLLEKIISALAKFVQNSDSNLLTSSPSASSWSSSPESNFAKRFSFSSKKTTPEKIKSCLPRKAWWFDDLATLPPTIIEKLFQTIGAYKADNKDLILTRFLLHYLKIATQTKMVNCRNSNEYAALAETAAYGVISVGKETFSCRGLFWVLRIVSKFGLSRDCRTELEKLIGGMLEQATLDDLLVSGHDMGVYYDVNLVIRLVRLFVDINGSDGLSLQKVKRVGRLIDKYLREISPDQNLKISKFLGVAECLPDSARDCYDGVYKAIDIYLESHPTITFEERSRLCRCLNYSKLSFEACKDLAKNPRIPPRVAMQALISQQPKNSTSDRVTESPRMKHSQIVLYNEASRESFSQERRDMRLNIEKMQWGVIELAKLRKQTNVQMPQLFTHNVLLNPARASSSPRFC

SEQ ID NO: 205510 - protein, 58 aa, Glycine max
  Coding DNA Sequence Number=SeqID_88732
MDLENVLRSKGKVAIILLKSVDGAEEKQETDKGVAHSIAIGARSRENESGYFTNLCYC

SEQ ID NO: 205511 - protein, 139 aa, Glycine max
  Coding DNA Sequence Number=SeqID_88733
  Gene Ontology: Mol. function=DNA binding; Cellular component=nucleus; Biological process=response to DNA damage stimulus
  Homolog annotation: Hit_ID=Q682D3-2; Match level="QueryCoverage=70%, HitCoverage=35%, E-value=4e-26, Identity=59%"; Hit description =Isoform 2 of Q682D3
MPNSKMKVKARGNAVNEQLGEARDIEAGIKVEKEDQVVEASVAFGENGSDGGVDENVRFGGGRGPHKLEDVSDAKRNPVERRRKQERSHAAHSTQHLRATLVSLNPLFSLVHFSSHAPTRLPPTLSTLSSFFFLLVTSV

SEQ ID NO: 205512 - protein, 168 aa, Glycine max
  Coding DNA Sequence Number=SeqID_88734
MTNGLDNWKKELKSHEWNDGGIIMKMEILMLPMDFSGAYNIHFRGIKNNQFLQGNRRTPEKFVGKEAVITSQCLNGCQLLLCLGAFSHLNVVRPYRVMTAVLPVVVVGDGGCCSNGGSDGDGISVSIGGSNVSSSGGAGGGGVDGHVGRGANVACSCMLMKANTVTIK

SEQ ID NO: 205513 - protein, 136 aa, Glycine max
  Coding DNA Sequence Number=SeqID_88735
MARVKRTIQKGINLVGYIYNHSFALNTMRRFTNKSEFVRYGVTRCLIDEWLKSKAAKENKGKRATDTVHMPSFWAQNSSLSAIDYYANNHLVQSVESEDIHNITAALFTELYIQQHLHRPIAAEKEQSNELDNLKA

SEQ ID NO: 205514 - protein, 288 aa, Glycine max
  Coding DNA Sequence Number=SeqID_88736
  Homolog annotation: Hit_ID=Q47522; Match level="QueryCoverage=21%, HitCoverage=83%, E-value=1e-21, Identity=75%"; Hit description=LacZ protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPVTTLNSINNNKPIGTLGSSAAFLPTKRIQGRLPAGPSAVFRSYSRPLGIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 205515 - protein, 265 aa, Glycine max
  Coding DNA Sequence Number=SeqID_88737
FLNVPLIGTRGCISYNPVLSIRQLGYPMRGAPIEEEIAPVISRGFNETNVETLRKDKELRGSNNGPIGGYCKWLRTAKGEEVEAPEEDEEENAELRNVNIATTKALEQETERARREEHGRNKFRGALWGSNNELKLRREERDQSRVDSLILKDELKACLRSKRNLSQRLCETETNMLAIISKYQEELNLATAHEHQVVDEYAQVYIEKEARGRVIDALHQEATMWMDRFALTLKGSQELPRLLAKAKALVDIYSAPEEIHGLLSY

SEQ ID NO: 205516 - protein, 126 aa, Glycine max
  Coding DNA Sequence Number=SeqID_88738
MKIKKRTKERKEGFPIEDRKEVKRGKEATLDQRKEENRKSPKPDCHSESFLTGNIPPHMNKEEKTETPSFLSKNADLEKILLLEVDILPFILGYKEDYPWRKYIVSLRRGALVNDLFFFAKSMLSF

SEQ ID NO: 205517 - protein, 66 aa, Glycine max
  Coding DNA Sequence Number=SeqID_88739
MTLSLEYLPCDLMIKFAQYQGAVALSSPFGLSAHPTLGIASARLARQKNLAEHKYQGRMLSARSAR

SEQ ID NO: 205518 - protein, 77 aa, Glycine max
  Coding DNA Sequence Number=SeqID_88740
MNTHPPIEIPVAKQGRIAKPRWPPGNIRALGQGQLLNMILDDSIHLMLGTVIHIMSWGGIFCQKGRLRYTTQSSATS

SEQ ID NO: 205519 - protein, 92 aa, Glycine max
  Coding DNA Sequence Number=SeqID_88741
MAVSKLRNDAKGSSRRGVSTENNGGLWWLLVVVGDGEKAWNIRNGFGRKKGEEMAFFLNYLDYKAQKAQVSNSLGNRNLAHPPNIFSKIPTV

SEQ ID NO: 205520 - protein, 269 aa, Glycine max
  Coding DNA Sequence Number=SeqID_88742
MEKFIHTRALEDWDSSPPCMADIFKCMGKASRSALSAIARHLRLRSDFMIMCAHEKTVALCSVFNHLLDDAPLPANEVSSSVLVVTYSHASLQNGRGAIGGGKPPMNGEVEKGLLTLISSDTPGLQVCDPSGRWYLADSGSVPGDLLLITGKALTHATAGLCPAASYRASPDYFLSPNGGGRYFLELCDCRTSLAYRLMPQGNAILDCSPIAAAGHVIPQSYVRISVSQFMDDLAAEELIGSRCDNADSSTLIMTRQTKEDPNHEKWKC

SEQ ID NO: 205521 - protein, 34 aa, Glycine max
  Coding DNA Sequence Number=SeqID_88743
MGFFDHHLDMSKAYGRDRRVRMEVLALSLGPTED

SEQ ID NO: 205522 - protein, 355 aa, Glycine max
  Coding DNA Sequence Number=SeqID_88744
  Gene Ontology: Mol. function=nucleic acid binding; Cellular component= intracellular
  Homolog annotation: Hit_ID=Q6YS82; Match level="QueryCoverage=87%, HitCoverage=80%, E-value=1e-104, Identity=60%"; Hit description=RRM -containing RNA-binding protein-like
  Pfam annotation: Domain name=RRM_1; Domain location=15-94; Score =49.2; E_value=1.4e-11; Accession=PF00076.12; Description=RNA recognition motif. (a.k.a. RRM, R
  Pfam annotation: Domain name=zf-RanBP; Domain location=149-180; Score= 32.2; E_value=1.8e-06; Accession=PF00641.9; Description=Zn-finger in Ran binding protein and others
  Pfam annotation: Domain name=zf-RanBP; Domain location=213-242; Score= 23.7; E_value=0.00067; Accession=PF00641.9; Description=Zn-finger in Ran binding protein and others
  Pfam module annotation: Pfam domain module=RRM_1::zf-RanBP::zf-RanBP; Domain location=15-94::149-180::213-242
MASHPGNHAPSNGSVYVCNLPYGTDDNMLAEYFGTIGLIKKDKRTGRPKIWLYRDKETNEPKGDATVTYEDPHAAVAAVEWFNNKDFHGNTIGVFIAESKNKDDQAYNAAVEPGVTDNVGGLEETTKDVNGGSGRGRGQNDTSGKAWQQDGDWLCLNTSCSNVNFAFRGACNRCGTARPAGASGISGAGGRGKGRAAQESGGIGRPAGGGLFGPNDWPCPMCGNINWAKRTKCNICNTNKPGHNEGGVRGGRGGGYKELDEEEIEETRRRRREAEDDGELYDEFGNLKKKFRAKTQQAEAARGLPGSGRAGWEVEELGMAAYLELFILHDHLRTFPTCSITLVHFGIELHVILES

SEQ ID NO: 205523 - protein, 101 aa, Glycine max
  Coding DNA Sequence Number=SeqID_88745
  Subcellular localization annotation: CTP_CleavageSite=75; ConfidenceScore=5.16e-01
MWRILKISLQLKCSSPCGGPAASNGGLWRPPVVVGGGGGGVRISFSEMSLLKKIQLLVLSKLPPWVGIASSTLVSLSEFPSQVEIALSTLMSLSEMSQDVI

SEQ ID NO: 205524 - protein, 283 aa, Glycine max
  Coding DNA Sequence Number=SeqID_88746
  Gene Ontology: Mol. function=uracil DNA N-glycosylase activity; Cellular component=mitochondrion; Biological process=base-excision repair
  Homolog annotation: Hit_ID=Q9LIH6; Match level="QueryCoverage=97%, HitCoverage=85%, E-value=5e-75, Identity=53%"; Hit description =Uracil-DNA glycosylase-like protein
  Pfam annotation: Domain name=UDG; Domain location=131-280; Score =103.3; E_value=7e-28; Accession=PF03167.9; Description=Uracil DNA glycosylase superfamily
  Subcellular localization annotation: CTP_CleavageSite=34; ConfidenceScore=5.13e-01
MASAPSRTLTDFFQPASKRLKPTLPASCKSDDANASTLSVDQKLRMEYNKLLAKSKRNLKLCVERVSKSKESGLGGVKLEELLVEETWLEALPGELQKPYALTLSKFVESEISGGDGVIFPPTHLIFNALNSTPFHTVKAVILGQCHKLRTLVKKVKGKVFIGMQQKDPYHGPGQAMGLSFSVPEGIKVPSSLVNIFKELHQDLGCSIPTHGNLQKWAVQGVLLLNAVLTVRKHQANSHAKKGWEQFTDVVIKTISQKKEGVVFLLWGNSAREKSRYFHCVTI

SEQ ID NO: 205525 - protein, 85 aa, Glycine max
  Coding DNA Sequence Number=SeqID_88747
MSTRWSIPKAKTIIEGLVVSRLLGTFTRTVEGRARKSIGLGGIYIGIEGLLVNGDVFGDKDSIYFPYTTIIRRKKETMESGSMIN

SEQ ID NO: 205526 - protein, 64 aa, Glycine max
  Coding DNA Sequence Number=SeqID_88748
MKKLGSCNMLIECQYQMSGELEKLNVESYLVFEREYFLQDGRGMVPFVFENEAMSNGSANRSCR

SEQ ID NO: 205527 - protein, 840 aa, Glycine max
  Coding DNA Sequence Number=SeqID_88749
  Gene Ontology: Mol. function=RNA-directed DNA polymerase activity; Cellular component=extracellular region; Biological process=RNA -dependent DNA replication
  Homolog annotation: Hit_ID=Q1T5K4; Match level="QueryCoverage=53%, HitCoverage=48%, E-value=1e-101, Identity=38%"; Hit description=RNA -directed DNA polymerase
NAHERHAEMKGQEETNDNVTIPTETTAIHRPPGIAGQNQATNANQTSPSEMAENHRASGDEAHNQAPRSAGHDDHLDPADKHADRWVCVPDQGKDKQTLGTCTSDGRRENMHEKGKWEAERTVGVVGKGALCSEKPRDQEAEDTSSPSSSKVGQNNYYRLFYRKRRCRKQNATFPEDAMGQQVTPTPPNMQGSEHRPQRVREQKDHYLSSQQSALEEALLVNNKMQEAEKLWEMTKELGVTGGNGGGSSGQQLEGDSDVRWEAQPSVNSSGGILCIWSDKSFKLERKITGAGFIMLVGKWQQEAQTLNIINIYSLCDIQSKRVLWDNIKQLKSQNIGELWCILGDFNNIMAPQRESELITGGWIFGGGRSAMGWEKVHMGQAKWNSQEKYKRIEEELNKMEEESDDRQLTDQQVLARKKLQQDLWEAAQAHESLLRQKARAKWIKEGDCNSRFFHLMINASRRNNCLKGVLIDGSWIEEPAPVKEEVRRFFLQHFQESDYDKPRLDGIRFQTIGSHHKDMLVEHFQEKEVKRAVWNCGSDKSPGLDGLNFKFIKQFKHVIKPDFFRFLDEFYANGIFPKGSNASFIALIPKLVDPQVLNDFKPISLIGCTYKIVAKILANRLKKVMPFIIHERQSAFIEGRHMLHSVVTTNEVVEEAKRCQKPCIVFKVDYEKAYDFVSWEFLTYMMAEFLPQKGLRQGDPLSPLLYNIVAEALNGLMSQALEKRIYKGFLVGINRVEVSIHADDTIFFGEATMENVRAIKAILRAFELVSGLKINFATSSFGAFGVPDQWKIVAANYLNCSLMSFPFTYLGVPIGANPRRSQTWDPIISKVPKKVVDKL

SEQ ID NO: 205528 - protein, 68 aa, Glycine max
  Coding DNA Sequence Number=SeqID_88750
MCTSVTQQIRDTSTEEAQPLMPLSARPDGMRPPQGVDHGDGGTTRPRRSWPKEENMVRRRKMTMETFE

SEQ ID NO: 205529 - protein, 125 aa, Glycine max
  Coding DNA Sequence Number=SeqID_88751
  Subcellular localization annotation: CTP_CleavageSite=59; ConfidenceScore=5.16e-01
MDKSPHRFNRWQGGVNQYACLKTFRESFKLPKKRSELQNSISIVSVATYPSAGGRRVTRGMRVPRKEYARSRHQRLFEENVGKTGKDAIYELLSERFGSCIYARGRVFPFAPTYSSIWDEKIRPT

SEQ ID NO: 205530 - protein, 226 aa, Glycine max
  Coding DNA Sequence Number=SeqID_88752
  Gene Ontology: Mol. function=sequence-specific DNA binding; Cellular component=intracellular; Biological process=regulation of transcription, DNA-dependent
  Homolog annotation: Hit_ID=Q1XTC9; Match level="QueryCoverage=99%, HitCoverage=73%, E-value=1e-63, Identity=53%"; Hit description=Helix- turn-helix, AraC type
  Pfam annotation: Domain name=HTH_AraC; Domain location=121-173; Score= 4.7; E_value=0.96; Accession=PF00165.13; Description=Bacterial regulatory helix-turn-helix proteins, araC family
  Pfam annotation: Domain name=HTH_AraC; Domain location=179-223; Score= 43.2; E_value=9.1e-10; Accession=PF00165.13; Description=Bacterial regulatory helix-turn-helix proteins, araC family
  Pfam module annotation: Pfam domain module=HTH_AraC::HTH_AraC; Domain location=121-173::179-223
MYFIAPHQVLQFDDILLNKVRGFVLVVHPDFLHGYGLASSIREYGYFSYTVNEALHLSEKEEKTIFDIIANVEQEIDINMDSFTQDLLVSNLDLLLKYCDRYYNRQFLTRKKVNSDLLSKLELLLDDYFKNDKLTINGIPSVHSIADQLNLSANYLSDMLRVQTGQTTQQHIQNSLIEKAKGLLSTTSMSVSEIAYQLGFEHPQSFHRLFKSRTSLSPLEFRSSLN

SEQ ID NO: 205531 - protein, 307 aa, Glycine max
  Coding DNA Sequence Number=SeqID_88753
  Gene Ontology: Mol. function=drug transporter activity; Cellular component=membrane; Biological process=polysaccharide biosynthetic process
  Homolog annotation: Hit_ID=Q9X4C7; Match level="QueryCoverage=99%, HitCoverage=72%, E-value=8e-50, Identity=35%"; Hit description =Repeat unit exporter Wzx
MATFLLVLVLYCVLSIVGMAIMEEEWSADALVFICAAAIACLFSSIDLVNIYNEARLNARLNVIANVIGLAISLTVRFLISYYQLEPAWLAIPIVLATFIPFTIKLTLFLLYERRAPLPALRHVKKYSRYMLVSGMSLIFSAIAVALYTRVNQISVSYFLGVKEAGIFSVALTLSTAWVFLPSALLASFYPAFFAERNDQQAIVKAQKLHLLVIGVSAAVIMAIWLLSGWFIRDFYGEQYLDAVAPTLLLSLGAMCAVLSSVMDRFIIKYNGYRYLVKKTFAVLVICLLSSLLLVPHFGLTGAAMSV

SEQ ID NO: 205532 - protein, 103 aa, Glycine max
  Coding DNA Sequence Number=SeqID_88754
MAKRAFAKRDTQWLSARKNPEEDELLGSLSVPLQVIKRTASAHPLSERSALSQNPLMCAKGFRFAPSARARSSRERKVQVPESFERFCYVKICRDESSKRKPF

SEQ ID NO: 205533 - protein, 200 aa, Glycine max
  Coding DNA Sequence Number=SeqID_88755
  Gene Ontology: Mol. function=transcription factor activity; Cellular component=intracellular; Biological process=regulation of transcription, DNA-dependent
  Homolog annotation: Hit_ID=Q5PJY1; Match level="QueryCoverage=82%, HitCoverage=70%, E-value=3e-76, Identity=82%"; Hit description =Hypothetical 20.8 kDa protein in rbsr-rrsc intergenic region
  Pfam annotation: Domain name=FCD; Domain location=41-162; Score =105.0; E_value=2.2e-28; Accession=PF07729.2; Description=FCD domain
MVLPRPRIGTREMPQSNWNFLDQELLSWCMTEDNFHQVIDHFLEMRSSLEPQACLLAATLGTAEQKAQLNALMEEMVYLKKHFNRERWVEVDMAWHEHIYMMSANPFLTSFASLFHSVYHTYFSSITQDEVVKLDLHQAIVDAIQESDGQRALSACQALLAAPTHQQALDATILNTALPAIAQSLTAPHWQCSPPSSAIP

SEQ ID NO: 205534 - protein, 278 aa, Glycine max
  Coding DNA Sequence Number=SeqID_88756
  Gene Ontology: Mol. function=chitin binding; Cellular component =extracellular region; Biological process=chitin metabolic process
  Homolog annotation: Hit_ID=UPI000044A8F0; Match level="QueryCoverage =93%, HitCoverage=99%, E-value=8e-35, Identity=27%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
PSQRVNLLLSHKGEPLGTSTLTFGGLHVLPSRGLHVLTFRELHALAFRGLHVLAFRGLHVLTLGTRTLTFRGLHVLAIRGLHALAFRGLHILAFRGLHVLHFRGLDVLTFNGLHILAIRGLYALTFRGLHILAIRGLHTLTFRGPHVLAIRGRHALTFRGLHVVAIRGLGTLTFKVLHALAFRGLHVLAFRGLHVLHFRGLDVLAFRGQYVLAIRGLYALTLRGLHVLAIRGLHALTFRGLHVLTISGLHALTFRGLHILAIRGLHVLTFRGLHVLAI

SEQ ID NO: 205535 - protein, 218 aa, Glycine max
  Coding DNA Sequence Number=SeqID_88757
  Gene Ontology: Mol. function=RNA-directed DNA polymerase activity; Cellular component=membrane; Biological process=RNA-dependent DNA replication
MVAQHPQYGQILENSTLWKVGCGDKFKFWEDNWMGGVGKLIEKYLRLYTISSQQNQFIHHMGAFKESGWEWEFRWRRPLFDNELDMAISFLKDVESYRIQLQHTDQWVWLTDSNGQYSVRSAYNVMRENVVEEIQDGVFEELWKLKVPSKVATFAWRLLKDRLPTKESAGHLFFHCDKILPVWWESMSWTSGEGFRLSLQSIVYQYQGWVSKKLRITK

SEQ ID NO: 205536 - protein, 71 aa, Glycine max
  Coding DNA Sequence Number=SeqID_88758
MTTLDSECQQARWPLVDKWFGTIRFPRMSSDSPSLDDKGQYDRDCGAADKSEALAPTYPQFVMRNSDLRSS

SEQ ID NO: 205537 - protein, 387 aa, Glycine max
  Coding DNA Sequence Number=SeqID_88759
  Homolog annotation: Hit_ID=Q1T4J1; Match level="QueryCoverage=90%, HitCoverage=91%, E-value=8e-90, Identity=56%"; Hit description=C2
  Pfam annotation: Domain name=C2; Domain location=82-167; Score=51.6; E_value=2.6e-12; Accession=PF00168.20; Description=C2 domain
MVSNSSSLDVSSIYLLNVISSWHLMLVKLFLTKLLTEDLPKLFVRPKKIVLDFQKGKAVGPVAGGVKSGEMQEGNKDSVGELSVTLVDARKLSYIFYGKTDPYVILSLGNQVIRSKKNSQTTVIGPPGMPIWNQDFHMLVSNPRKQKLFIQVKDALGFADLTIGTGEYVVDSLYFMPLGLTSPMAAMRTIVVWFPSGDPYSQVTTQKNIVDLGSLKDTVPTDRIVVLQGGWGFLGKRSSGEILLRLTYKAYVEDEEDDKTEVDAIYTDISDDELSDSEANGTNGKDERDSVYETDKESFMDVLAALIVSEEFQGIVASETGFSKVLDNGSNVGSRVSNSQVPNVEPIPSSSDNSEGSGGSALLWLAVITSISLLIALNVGGSSLFNP

SEQ ID NO: 205538 - protein, 406 aa, Glycine max
  Coding DNA Sequence Number=SeqID_88760
  Gene Ontology: Mol. function=RNA polymerase II transcription factor activity; Cellular component=nucleus; Biological process =transcription from RNA polymerase II promoter
  Homolog annotation: Hit_ID=Q337J6; Match level="QueryCoverage=99%, HitCoverage=37%, E-value=3e-97, Identity=48%"; Hit description=FF domain containing protein, expressed
  Pfam annotation: Domain name=FF; Domain location=110-159; Score=44.6; E_value=3.4e-10; Accession=PF01846.10; Description=FF domain
  Pfam annotation: Domain name=FF; Domain location=177-227; Score=15.9; E_value=0.047; Accession=PF01846.10; Description=FF domain
  Pfam annotation: Domain name=FF; Domain location=245-294; Score=40.6; E_value=5.3e-09; Accession=PF01846.10; Description=FF domain
  Pfam annotation: Domain name=FF; Domain location=348-400; Score=22.5; E_value=0.0015; Accession=PF01846.10; Description=FF domain
  Pfam module annotation: Pfam domain module=FF::FF::FF::FF; Domain location=110-159::177-227::245-294::348-400
MVTLNAPAINTGGRDAAALKPSTLQNSSSALDLIKKKLQDSGTPITPSSIHAPSVQIGPESNGSKTVDSTAKGVQVDNNKDKQKDTNGDADVSDTSSDSEDEDNGPSKEECIIQFKEMLKERGVAPFSKWEKELPKIVFDPRFKAIPSYSARRSLFEHYVKTRAEEERKEKRAAQKAAIEGFKRLLDEASEDINYNTDFQTFRKKWGNDPRFEALDRKEQEHLLNERVLPLKKAAEEKAQAMRAAAAASFKSMLKERGDMSFNSRWARVKESLRDDPRYKSVRHEDREVLFNEYISELKAAEHAAERETKAKREEQDKLRERERELRKRKEREEQEMERVRLKIRRKEAVTSFQALLVETIKDPLASWTESKPKLEKDPQRRATNPDLDPSDTEKLFREHVKMLQE

SEQ ID NO: 205539 - protein, 306 aa, Glycine max
  Coding DNA Sequence Number=SeqID_88761
  Gene Ontology: Mol. function=aminoacyl-tRNA ligase activity; Cellular component=mitochondrion; Biological process=alanyl-tRNA aminoacylation
  Homolog annotation: Hit_ID=P36428; Match level="QueryCoverage=89%, HitCoverage=27%, E-value=1e-143, Identity=84%"; Hit description =Alanyl-tRNA synthetase, mitochondrial precursor
  Pfam annotation: Domain name=tRNA-synt_2c; Domain location=15-306; Score=227.7; E_value=2.5e-65; Accession=PF01411.9; Description=tRNA synthetases class II (A)
MPGAETHDVEWPAKRVRDTFFSFFQDKNHVNWKSSPVVPFNDPTLLFVNAGMNQFKPIFLGTADPNTGLSKLSRAFNTQKCIRAGSKHNDLDDVGKDTYHHTFFEMLGNWSFGDYFKVEAISWAWDLLTKVYKLPSDCIYATYFGGDDKSGLAPDLEARDIWLKFLPPGRVLPFGCKDNFWEMGDTGPCGPCTEIHFDRIGNRDAASLVNNDDPTCVEIWNLVFIQFNREADGSLKPLPAKHVDMGLGFERLTSILQDKMSNYDTDVFLPIFDVIQWRNVYMHGMERREDCLTYLYLHLYICIKKF

SEQ ID NO: 205540 - protein, 154 aa, Glycine max
  Coding DNA Sequence Number=SeqID_88762
MTWNNPAWVTGIFPGELQFSFSLSIAISFLKMRKKLVHYFAVLQKLLLIAIALKKHICENYCLSCHNNKLLDDNDALQHFGVRNNSQNLGGTRRGESTIFFMALIGAPDQTNHHAERLKSLLIQSVLITWINKVRIPGNITSTFTVVSTCNLSR

SEQ ID NO: 205541 - protein, 626 aa, Glycine max
  Coding DNA Sequence Number=SeqID_88763
  Gene Ontology: Mol. function=alanine-tRNA ligase activity; Cellular component=mitochondrion; Biological process=alanyl-tRNA aminoacylation
  Homolog annotation: Hit_ID=Q1T1K0; Match level="QueryCoverage=96%, HitCoverage=65%, E-value=0.0, Identity=78%"; Hit description =Phosphoesterase, DHHA1
  Pfam annotation: Domain name=tRNA-synt_2c; Domain location=1-284; Score=-26.7; E_value=2e-18; Accession=PF01411.9; Description=tRNA synthetases class II (A)
  Pfam annotation: Domain name=tRNA_SAD; Domain location=382-441; Score= 82.7; E_value=1.2e-21; Accession=PF07973.4; Description=Threonyl and Alanyl tRNA synthetase s
  Pfam module annotation: Pfam domain module=tRNA-synt_2c::tRNA_SAD; Domain location=1-284::382-441
MAYRVVADHIRTLSFAIADGSRPGNEGREYVLRRILRRAVRYGREVLKAKEGFFNGLVSIVVNVMGDVFPELKQQETHIRNVIEEEEESFGRTLIKGIEKFETAVRHVQGKILSGEASRICYFQSYLKLMAEEKGLVVDFKGFDSAMEAARERSRSAQTKQAGGAIVMEADATSALHKRGIVPTDDSFKYAWFKDHESVVKAIYTGSEFVDTVNTSDDIGVVLESTSFYAEQGGQIFDTGSLEGLHASFQVRNVQVYGGFVLHIGNGTGVSVGDKVVCKVDYGRRALIAPNHTCTHMLNFALREVLGDRVDQKGSIVLPEKLRFDFSHGKPVDADNLRRIESIVNEQIKAEFDVSAKEATLAEAKGINGLRAVFGEVYPDPVRVVSIGQKVEDLLADPKNEKWLSFSSELCGGTHISNTREAKAFALLSEEGIAKGIRRITAVTTDRAYDAMKVADEFDQQVDDAAKLEGSLLEEKVSSLKSNIETLSIPAAKKADIKTKIARLLDQVRKAQKLVAEENKRKALTITAEKAELAASNGKTFCISHVDVGLDVAAVREAVTKVMDQKGLSVMVFSTDESTNKAVVCAGVPEKGGQGKLDVADWLSNALGPLKGRCGKGKGGLATGQK

SEQ ID NO: 205542 - protein, 398 aa, Glycine max
  Coding DNA Sequence Number=SeqID_88764
  Gene Ontology: Mol. function=RNA-directed DNA polymerase activity; Cellular component=membrane; Biological process=RNA-dependent DNA replication
MQNVTTIKSMLRSFELASGLKINFAKSSFGAIGKSDQWQKAAAKYLNCRLLSLPFLVPSKIIAKLKAIQRRFLWGGEHDQRKIAWVDWKTVCLPKDKGGLGIKDLRTFNTALLGKWRWDIFHKQEELWAKIIYSKYGGWRTLEEGRSGCQDSLWWKDLDRWIADELPLMEKYPRLYQISCQQKQTIMQMGSNKNTGWEWRRSLFDCEVAMPDAFIGDISQQQIHSHTVDTWMWKPDPRGYYSTKSGYDMIWGGLMEANQNSDFVDLWSLKIPAKAAVFAWRLIRDRLPTKLNLRRRQSLSWVNIATTMPQNPRDHYMQHGIRAAEGKKYTRWKCWWIALTWTIWQHRNKIIFQNATFDENKMLDDAVLLIWTWIKTMEKDFAIHFNQWSSNIKDGFRS

SEQ ID NO: 205543 - protein, 289 aa, Glycine max
  Coding DNA Sequence Number=SeqID_88765
  Gene Ontology: Mol. function=sugar porter activity; Cellular component=integral to membrane; Biological process=transport
  Homolog annotation: Hit_ID=Q7CK77; Match level="QueryCoverage=71%, HitCoverage=51%, E-value=3e-81, Identity=77%"; Hit description =Putative permease, major facilitator superfamily
MRYITLWLVTCTACTARSRIRMPAISAHSDCLANAMGIHDSSSSTRPTVVQRRAAEQAEDRGQQLRVVQPGVLLIARQRAPQDQRHQDHQHAGDPVDGAPAAERRQCARDGARQQDAKQQAAHDDADGLAALFRVSQRGGQRHQDLRHHREQPGERGAEDHHRQRGGGGGDQHAPGGQQRHENDQPAALEHIAERHQQQQAGGVTELRGGNDKACLVDRQIEAGGDGFQQRLRVIVAGDRQAGSDGDQHDRCHEPETDPLCAGGGGGTELHPGGAALPYGAVGAQPPDR

SEQ ID NO: 205544 - protein, 89 aa, Glycine max
  Coding DNA Sequence Number=SeqID_88766
  Homolog annotation: Hit_ID=Q9LJD8; Match level="QueryCoverage=97%, HitCoverage=5%, E-value=4e-23, Identity=67%"; Hit description=MAP3K epsilon protein kinase
MSRQTTSSAFTKSKTLDNKYLVVALGWAGVVLGCRDLEQMLGDEIGKGAYGRVYKGLDLENGDFVAIKQVSLENIAQEDLNIIMESLET

SEQ ID NO: 205545 - protein, 82 aa, Glycine max
  Coding DNA Sequence Number=SeqID_88767
MKFEVLTQSLPEMLQFKEEQNPMAISTRTIPFMMDAIWKISHVLPPAGIAAVSLSMGIVPFSPSSSTLYRTTSFLILHLHEL

SEQ ID NO: 205546 - protein, 932 aa, Glycine max
  Coding DNA Sequence Number=SeqID_88768
  Gene Ontology: Mol. function=hydrolase activity, acting on acid anhydrides, catalyzing transmembrane movement of substances; Cellular component=integral to membrane; Biological process=calcium ion transport
  Homolog annotation: Hit_ID=Q9LIK7; Match level="QueryCoverage=74%, HitCoverage=88%, E-value=1e-153, Identity=59%"; Hit description =Putative calcium-transporting ATPase 13, plasma membrane-type (EC 3.6.3.8) (Ca(2+)-ATPase isoform 13)
  Pfam annotation: Domain name=Cation_ATPase_C; Domain location=789 -930; Score=51.2; E_value=3.4e-12; Accession=PF00689.11; Description =Cation transporting ATPase, C-terminus
  Pfam annotation: Domain name=E1-E2_ATPase; Domain location=292-508; Score=39.0; E_value=1.6e-11; Accession=PF00122.10; Description=E1-E2 ATPase
  Pfam annotation: Domain name=Hydrolase; Domain location=471-694; Score=28.4; E_value=2.5e-05; Accession=PF00702.16; Description =haloacid dehalogenase-like hydrolase
  Pfam annotation: Domain name=Hydrolase_3; Domain location=467-718; Score=-84.8; E_value=0.033; Accession=PF08282.2; Description =haloacid dehalogenase-like hydrolase
  Pfam module annotation: Pfam domain module=Cation_ATPase_C::E1-E2 _ATPase::Hydrolase::Hydrolase_3; Domain location=789-930::292 -508::471-694::467-718
MAYNTTDPKHGFDCVKYIVQQHPHGVAAWNCYYKVISRLENRDTRHYKFVRGMQGKFVDCVPPILISGHQFTICSHHQDAARKYLEAYKLLPENPLVNLCVGTALINLALGFRLQNKHQCVVQGLAFLYNNMRICENSQESLYNIARAFHHVGLVTLAAFYYEKVIAICEKDYPIPKLPNENPDSIETHKPGYCDLRREAAYNLHLIYKKSGALDLARQVLKDHCTLTRAPPSLSPKLEGVKELAQLLVTDLKRGISDNKDDIDHRKRVFGVNFNTVGRRDGTMEAASYLRLFSSLLSLPSATLTNKQFRKLSAKSNHIGVEVVRGDRRQSMSTFDVVVGDIVCLKIGDQVSADGVFLEGHSLKANESSMKGESEHTGTKVTDGFARMLVTSVGMNTAWGAMMGSMTKEIDEETPLQVRLNKLTSAICKVGLSVAALVFGVSMARYFSGCTRDEFGNREFVRRRTESDDVVNAVVGIVVAAVRIVVVAIPEGLPLAGAAEMILRMCSTYYDHTGKIIIIDDEERAQIENIVECMATKSLRCIAFAQKNLLCEKLEETELTLLGILGLKDPCRPGVGAAVESCTNAGVKIKMITGDNVHTARAIAFECGILDDELDYEDEAAVVEGFQFRNFSHEERMEKIDKIRVIARSSPFDKLLMVQCLKQKGHVVAVTGDDTNDAPALKEADIGLSMEIQGTEVAKESSDIVILDDDFSSVVTVLWWGRCVYTNIQKFIQFQLTVNVAALAINFVAAVSSGKVPLSAVQLLWVNLIMDTLGALALATEQPTSDLMKMPPVGRVEPLITRVTWRNLILQAVYQVFVLLVLQFQGRSIFGVNEKVKNTMIFNAFVLCQVFNEFNARKLEKKNIFEGLGKNKLFMVIVGLTVVLQLVMVEFLKKFANTERLTWEQWGVCVAIGALSWTIGLLVKCMPVVRNK

SEQ ID NO: 205547 - protein, 282 aa, Glycine max
  Coding DNA Sequence Number=SeqID_88769
  Gene Ontology: Mol. function=transferase activity, transferring phosphorus-containing groups; Cellular component=integral to membrane; Biological process=two-component signal transduction system (phosphorelay)
  Homolog annotation: Hit_ID=Q6D417; Match level="QueryCoverage=100%, HitCoverage=52%, E-value=9e-79, Identity=54%"; Hit description=Two -component sensor kinase
MRLKLSFQIKLFLCLVAFSCLLLTCIGAYTYYQLDAQLHRDLGARAQVQAREIALIPSLVDAVENNDAARIAALMKKIRASSDASYIVIGDNHARHLYHSEYEGRLGTPMIGGDNKEVLEGKSIISIRKGGIGVSLRSKAPILDENNRVIGIVSVGYLKSHIDNLNARTLTQIIGSIVLLLIALFVFSWLLSKNLKRQMFWLEPKEIALLVRQQKALLEAIYEGVIAIDPELRIITINHAARELLDLHQPAAGLLGRPIGDVIQAQPNFFAAAQLGQDTHDE

SEQ ID NO: 205548 - protein, 1236 aa, Glycine max
  Coding DNA Sequence Number=SeqID_88770
  Gene Ontology: Mol. function=protein serine/threonine kinase activity; Cellular component=plasma membrane; Biological process =plasma membrane organization and biogenesis
  Homolog annotation: Hit_ID=Q9LJD8; Match level="QueryCoverage=96%, HitCoverage=88%, E-value=0.0, Identity=65%"; Hit description=MAP3K epsilon protein kinase
  Pfam annotation: Domain name=Pkinase; Domain location=1-158; Score= -20.5; E_value=2.4e-07; Accession=PF00069.15; Description=Protein kinase domain
  Pfam annotation: Domain name=Pkinase_Tyr; Domain location=1-161; Score=-122.4; E_value=5.8e-05; Accession=PF07714.7; Description =Protein tyrosine kinase
  Pfam module annotation: Pfam domain module=Pkinase::Pkinase_Tyr; Domain location=1-158::1-161
MNKGKNCAKTLLGESQCSPKKWVGKWETIDNSGKVLVPLGLVKLADFGVATKLTEADVNTHSVVGTPYWMAPEVIEMAGVCAASDIWSVGCTVIELLTCVPPYYDLQPMPALFRIVQDEHPPIPDSLSPDITDFLLQCFKKDARQRPDAKTLLSHPWIQNFRRALQSSLRHSGTLRNIEDDSADAEVSGGYHKSAYENSSVEKEESAKEHTSVAADGSKAHEDNAADDVPPDQVLTLAIREKSFLQAGSNREVVNSESTGNHEISNAKDLHEVVKNGEVGSPQSRGMANKFGGKDNSVNNGNKSFAFGPRGQDNDFLKAMKMPTTVEGNELSRFSDPPGDAYLDDLFHPLDKQPGEVVAEASTSTSTSHMTKGYASAIDGGKNDLAKELRATIARKQWEKETEIGQANNGGNLLHRVMIGVLKDEVIDIDGLVFDEKLPGENLFPLQAVEFSKLVSSLKPEESEDVIVSACQKLIGIFHQRPEQKIVFVTQHGLLPLTDLLEVPKTHIPAVTSFAVPDRPREIRMEAAYFLQQLCQSSSLTLQMFIACRGIPVLVGFLEADYAKYREMVHLAIDGMWQVFKLQQSTPRNDFCRIAAKNGILLRLINTLYSLNESTRLASSSAGDGFSVDGSAQRPRSGILDPNHPSINQNETVLSSVDQQEPPKVRHAVPDHHLEPSSSNPRRSDANYPVDVDRPQSSNATADEKSSTQTSRESSASALKERGNMDRWKTDPSRADVESRQPCISTNRTSTDRLPKSTEPSSNGLSVTGATHQEQVRPLLSLLDKEPPSGRFSGQLEYVRQFSGLERHESVLPLLHATEKKTNGELDFLMAEFADVSQRGRENGNFDSSARVSHKVTPKKLGALGSSEGAASTSGIASQTASGVLSGSGVLNARPGSATSSGLLSHMVSSLNAEVAREYLEKVADLLLEFAQADTTVKSYMCSQSLLSRLFQMFNRVEPPILLKILKCINHLSTDPNCLENLQRAEAIKYLIPNLELKEGSLVSEIHHEVLNALFNLCKINKRRQEQAAENGIIPHLMQFITSNSPLKQYALPLLCDMAHASRNSREQLRAHGGLDVYLNLLEDELWSVTALDSIAVCLAHDNDNRKVEQALLKKDAVQKLVKFFQGCPEQHFVHILEPFLKIITKSARINTTLAVNGLTPLLIARLDHQDAIARLNLLRLIKAVYEHHPQPKKLIVENDLPEKLQNLIGERRDGQVLVKQMATSLLKALHINTVL

SEQ ID NO: 205549 - protein, 480 aa, Glycine max
  Coding DNA Sequence Number=SeqID_88771
  Gene Ontology: Cellular component=integral to membrane; Biological process=peroxisome organization and biogenesis
  Homolog annotation: Hit_ID=Q9FF99; Match level="QueryCoverage=95%, HitCoverage=95%, E-value=1e-158, Identity=58%"; Hit description =Amino acid transporter
  Pfam annotation: Domain name=Aa_trans; Domain location=25-476; Score =404.1; E_value=2.1e-118; Accession=PF01490.8; Description =Transmembrane amino acid transporter protein
  Pfam annotation: Domain name=Trp_Tyr_perm; Domain location=25-341; Score=-253.7; E_value=0.0051; Accession=PF03222.4; Description =Tryptophantyrosine permease family
  Pfam module annotation: Pfam domain module=Aa_trans::Trp_Tyr_perm; Domain location=25-476::25-341
MDVKTSLPIVTSAAGAYDDDGHAKRTGNLWSAVAHIITAVIGSGVLSLAWSTSQLGWIGGPVALLCFAIITYVSSSLLSDCYRTPDPVTGKRNYSYMAAVRVNLGKRKTWLAGFLQFLTLYGTSCAYVLTTANSLRAILKANCYHKEGHQAPCGYGDNLYMVMFGVVQIGMSFIPDLHNMVWVSVVAAIMSFTYSFIGLGLGIATVIVRNRDQKEKMIHRTVVALAENGRIMGSITGIPAANIANKLWLVFQALGDIAFAYPYALLLLEIQDTLESTPPENKTMKKASMVAIFMTTFFYLCCGCFGYAAFGNDTPGNLLTGFGFYEPYWLVAFANACIIIHLVGGYQMYSQPIYTAADRWCSRKFPNSVFANKFYRVQAPLFPGYELNLFRFCFRTAYVISTTGIAMLFPYFNQVLGVLGAINFWPLAIYFPVEMYLQQKNIGAWTRKWILLRTFSFACFLVTVMGLVGSIQGIISKKLG

SEQ ID NO: 205550 - protein, 90 aa, Glycine max
  Coding DNA Sequence Number=SeqID_88772
MKADAYLDGAAPTEKKNAQSRGDEEERASTMLKKNVQQQPHRRQLKNAQKKTKMNSSHGRKKERKRRRGRKKERLFALSVGCTSNNTGCT

SEQ ID NO: 205551 - protein, 186 aa, Glycine max
  Coding DNA Sequence Number=SeqID_88773
  Gene Ontology: Mol. function=nucleoside-triphosphatase activity; Cellular component=membrane; Biological process=cell division
  Homolog annotation: Hit_ID=Q6YUV9; Match level="QueryCoverage=98%, HitCoverage=38%, E-value=1e-63, Identity=69%"; Hit description =Transitional endoplasmic reticulum ATPase-like
AEKVVGWAKNHYLSSCLLPSIKGERLYLPRESLKIEGPGNYVTEAFSKPQGIVRRNLAKDEFESNFISAVVPPGEIGVKFDDIGALEDVKKALNELVILPMRRPELFSRGNLLRPCKGILLFGPPGTGKTLLAKALATEAGANFISITGSTLTSKWFGDAEKLTKALFSFASKLAPVIVFVDEVSV

SEQ ID NO: 205552 - protein, 108 aa, Glycine max
  Coding DNA Sequence Number=SeqID_88774
  Gene Ontology: Mol. function=nucleoside-triphosphatase activity; Cellular component=membrane
  Homolog annotation: Hit_ID=Q9LJM1; Match level="QueryCoverage=82%, HitCoverage=43%, E-value=7e-25, Identity=63%"; Hit description =Arabidopsis thaliana genomic DNA, chromosome 3, P1 clone: MMB12
MDAETSSQYMLTGQPLSLKHLTEGIKGDKTSEDDEINKLFSNVLSILPPKDENLLATFKKQLEEDKKIVTSRSNLNALRKVLEEHQLSCMDLLLVNTDSIILTKHRST

SEQ ID NO: 205553 - protein, 447 aa, Glycine max
  Coding DNA Sequence Number=SeqID_88775
  Gene Ontology: Cellular component=integral to membrane; Biological process=peroxisome organization and biogenesis
  Homolog annotation: Hit_ID=Q9FF99; Match level="QueryCoverage=99%, HitCoverage=96%, E-value=1e-148, Identity=56%"; Hit description =Amino acid transporter
  Pfam annotation: Domain name=Aa_trans; Domain location=10-439; Score =368.8; E_value=8.8e-108; Accession=PF01490.8; Description =Transmembrane amino acid transporter protein
MELMMNVVVSAGTVWTAVAHIVTGVIGSGVLSLAWSIAQLGWIGGPLTIVFFAAITLLSSFLLSNTYRSPDPELGPHRSSSYLDAVNLHKGEGNSRFCAVFVNVSLYGFGIAYVITAAISMRAIQKSNCSQDNGNEVTCGFGDGYFMLIFGAMQVLLSQIPNFHNIQWLSILAAIMSFAYAFIGMGLSVGQVTENGHAEGSIEGIPTSSGIEKLWLVAQALGDIAFSYPFSVILIEIQDTLKSPPPENVTMKRASTISVIVTTFFYLCCGCFGYAAFGNDTPGNLLTGFALYKKHWLVDFANACIVIHLVGAYQVYSQPLFANVENWLRFKFPDSEFVNRTYSLKLPLLPAFPLNFLRLTFRTAYVASTTGIAMIFPYFNQILGVLAGIIYYPLSIYFPVEMYLSLGNIEAWTAKWVMLRTFSIVGFLVGLFTLVGSIEGIVSAKLS

SEQ ID NO: 205554 - protein, 186 aa, Glycine max
  Coding DNA Sequence Number=SeqID_88776
  Gene Ontology: Mol. function=nucleoside-triphosphatase activity; Cellular component=membrane
  Homolog annotation: Hit_ID=Q9LJM1; Match level="QueryCoverage=54%, HitCoverage=49%, E-value=6e-37, Identity=71%"; Hit description =Arabidopsis thaliana genomic DNA, chromosome 3, P1 clone: MMB12
MWIYCRPLTKGQRGEVYEVNGDRVAVILDINEDRVNEGEVENLNEDHTKPPIYWIHVKDIENDLDAQSHDCYIAVEALCEVLHRKQPLIVYFPDSSQWLHKAVPKSHRNEFFHKVEEMFDRLSGPIVFICGQNKIQSGSKEKEEFTMILPNFGRVAKLDAVWVSYRLTKDKDDLMGTFIGTMQFMF

SEQ ID NO: 205555 - protein, 1376 aa, Glycine max
  Coding DNA Sequence Number=SeqID_88777
  Gene Ontology: Cellular component=protein complex
  Homolog annotation: Hit_ID=Q5Z876; Match level="QueryCoverage=97%, HitCoverage=74%, E-value=0.0, Identity=51%"; Hit description =Proteasome activator subunit 4-like
  Pfam annotation: Domain name=HEAT; Domain location=1060-1096; Score =14.6; E_value=0.35; Accession=PF02985.12; Description=HEAT repeat
  Pfam annotation: Domain name=HEAT; Domain location=1265-1301; Score =18.6; E_value=0.023; Accession=PF02985.12; Description=HEAT repeat
  Pfam annotation: Domain name=HEAT; Domain location=590-626; Score =10.1; E_value=2.5; Accession=PF02985.12; Description=HEAT repeat
  Pfam annotation: Domain name=HEAT; Domain location=773-809; Score =10.3; E_value=2.4; Accession=PF02985.12; Description=HEAT repeat
  Pfam module annotation: Pfam domain module=HEAT::HEAT::HEAT::HEAT; Domain location=1060-1096::1265-1301::590-626::773-809
HLGESERVFFVNSVLKLIDRGQYSKNEHLSETVAAATSILSYVEPSLVLPFVASRFQMALETMTATHQLKIAVMSVAFVGRSLFYTSVSVSSMKPIDLGGGDEAFIDLVGVSLSNALLGMDANDPPKTLATMQLIGSIFSNSGWMSSYAVYFPYFYTWNPAVFCLQSSSATGTFLVDDGPYYFCVLEILFGRLSQSLYNQALKKISKFVRTNILPGAVAEVGLLCCACVHSNPEEAVSQLVEPILLSVISSLKGTPRTGFGGGTFDASASSKVRSTISPALEASIDYQLKILSVGITYGGPALLHYKDQFKEAIFLAFDSPSWKVNGAADHLLRSLLGSQIHYYPIDQYKCVLSHPDAVALEEWISTKDFSTDERLIPKWHIPCDEEVHFANELLDIHFKSALDDLLKICQTKIHADQGDEKEHLKVTLLRIESSLQGLFSCLPDFVPDSRNGMVEDSNHMFLIAGATGCTVGSTALREKATEVVHAACKYVLEKKSDDSILLILIIRIIDALGNYGSLEYDEWSSHRQAWKLESAAIIEPPINFIVSSHSKAKKRPRWALIDKAFMHNTWRSSQASYHLYRTSGNFCPSDHVTMLMDDLLSLSLHSYETVRLLAGKSLVKLIKRWPSMISKCVITLTHNLQDLNAKEYAVLGSCSVLASQTVLKHLTTDPKSFSSFILAILSSSHHESLKAQKAINELFVKYNIQFSGVSRSFFRISDKENHTGGLGFSDLVSQIGSMSFDSTGLHWRYNLMANRVLLLLALASQNHPNSSSKILSETAGHFLKNLKSQLPQTRILAISALNTLLKESPYKLSHGEKSAVLEDLQGHVKSSLEGTLTPTFQEEGFFNETLTSLSHVHIITDSETASRGGQGDSSFQSLADKSITRFYFEFSASWPRTPSWISFLGSDTFYSNFARIFKRLVQECGMPVVLALKGAVDEFTIAKERSKQCVAAEALAGVLHSDIDGLSGTWESWLMPQLKNIILAQSVESVSEWASCIRYAVTGKGKYGTRVPLLRQKILDSLMTPLPPTVATTITAKRYTFLAAALIEISPQKMPVAEVQLHNTLLKEVLGNMCHSSAQVREALGVTLSILCSNIRLYHSSRHDNAQDERNNDVDSLMKDESWVQFLTERAAEAVVNIQIATQSDKVVNPVDTNSQNGHLDGDSQDCIKWMETSGRSSYLLDVLVGLLYPVICLQAKIKYISGGHPSPFELASGVDLGPNLHSKTLFVLFDSIIIQVGKETSNKDLSTLAKVAFELLKWMIVWEPHLQKAVSVILSAANDSNWRTRSATLTYLRTFMYREHAAAVLAGLMKGGDEDLARDFRDRAYREANIVQKRRKSRDCIGYNELAYEATSVRTGKHCGKVKGCVGYKGRGGE

SEQ ID NO: 205556 - protein, 761 aa, Glycine max
  Coding DNA Sequence Number=SeqID_88778
  Gene Ontology: Mol. function=nucleic acid binding
  Homolog annotation: Hit_ID=Q41042; Match level="QueryCoverage=88%, HitCoverage=87%, E-value=1e-65, Identity=58%"; Hit description=Pisum sativum L
  Pfam annotation: Domain name=RRM_1; Domain location=493-562; Score =86.4; E_value=8.7e-23; Accession=PF00076.12; Description=RNA recognition motif. (a.k.a. RRM, R
  Pfam annotation: Domain name=RRM_1; Domain location=593-667; Score =65.4; E_value=1.9e-16; Accession=PF00076.12; Description=RNA recognition motif. (a.k.a. RRM, R
  Pfam module annotation: Pfam domain module=RRM_1::RRM_1; Domain location=493-562::593-667
MGKSSKKSALKVDAVPAVVPPSKSAKKGGKRQAQDEIEKQLSAKKQKINEVAQKQKEAKVQKKESSSDDSSSESEDEKPAPKSAVLSKKIPAKNGAAPPKKGKLASSSSEDDSSDEDGVRAKKPQKMVAEKQKNGATVQKKKVESSSDDSSSESEAEKPAVKATVPSKKTPTKNGNLSTPAKKGKAASSSSSSDSSEDDSSDEDEVATKKQTKEVKVQKGKEESSSDDSSSESEDEKPAAKVAVPPKNQSAKNGTLSTPAEKGKPAASSSSSESSDDDSDEDEAPKSKVAPAAGKNVPASTKITQPSESSESDSDSSSDEDKNKKKPATAKLPALSVAPALKVESSDDESSESSDEDNDAKPAVTDVSKPSALAKKKVDSSDSDDSSSDEDKGKMDIDDDSSDESEEPQKKKTVKNPKESSDSSEEDSEDESEEEPSKTPQKRDRDVEMVDAASSGKKAVDDCYPLLFPFLLLLPVPKTPVTPKEETGASKTLFVGNLPFSVERADVEDFFKDAGEVVDVRFATDDTGKFKGFGHVEFATAAAAQKALGLNGQQLFNRELRLDLARERGAYTPNSSNWNNSSQKSGRGQSQTVFVRGFDTSLGEDEIRGSLQEHFGSCGDITRVSIPKDYESGAVKGFAYVDFSDVDSMGKALELHETELGGYTLTVDEAKPRDNQGSGGRGAGGRSGGGRFGGRSGGGGGGRFGGRGGGGRFGGSGGGGRFGGSGGGRFGGRGGGGRGRGNRPNLAAEGTGKKTKFADDE

SEQ ID NO: 205557 - protein, 415 aa, Glycine max
  Coding DNA Sequence Number=SeqID_88779
  Homolog annotation: Hit_ID=Q1T098; Match level="QueryCoverage=23%, HitCoverage=15%, E-value=3e-08, Identity=35%"; Hit description =Forkhead-associated
MACLYGGISSFCHFPPSTIDNTDYFWFHSLCSNPSKYFFRPRFSDQRYFQSLSPKTTVEEYASHGRIIRKHLLGLDLCRHTSSRNSFTVPDRRPSLCLNSTQLRAYSSESDGRNASEDKHVNVNDGANFDKGQKQQEKFGKDVKYSNAHARLGEQEQEEWLNNEKLSIESKRRESPFLTTRDKFKKEFMRRIIPWEKINISWDTFPYHIHENTKNLLVECAASHLRHNKLASSFGSRLTSSSGRILLQSIPGTELYRERLVRALAQDLQVPLLVLDNSILAPYDIDDDLSSDYESDEDNAESGEEGSLESENEDDNDATNEEEWASSTETKSDASDNEDAIAAAEAHLKKVKAAVIRKLVPYNVGEFEKIVSGESENSESSKSNDAKSSDQSGCQLRKGDRVKYIGPSVKVRDED

SEQ ID NO: 205558 - protein, 65 aa, Glycine max
  Coding DNA Sequence Number=SeqID_88780
MDKSLKEGEDEWRETERKSTKFYASNELWLSPLIQYHVQDSPLSVLRCHEACKTWRTCTKCDYIM

SEQ ID NO: 205559 - protein, 76 aa, Glycine max
  Coding DNA Sequence Number=SeqID_88781
MKEWEKAKKERKILDQGSEENKRNMQKGLWTRQYLNNTELSPKHVRILVKKTPRQFSLTVSKNYVGLSSSSQIEDT

SEQ ID NO: 205560 - protein, 214 aa, Glycine max
  Coding DNA Sequence Number=SeqID_88782
MLVNEQEAREQFCSQIGRFTDIEKETSICINRCVDLGRTALYIAAEDDSLVSHSSVPLPVDDFITRLDDLSMDYCPHYSPEYDSSPEKFLESIERFLYIHKGFRRANANALEPRALYLHSVLTHRSGSAAMLSLIYSEILKMLRLWSLLYFDAEIFFPHDALTLPTGYHKQKSKESDQAHIMTSGNLLVEIITEGINPTAAEPSSYRKATAPCP

SEQ ID NO: 205561 - protein, 89 aa, Glycine max
  Coding DNA Sequence Number=SeqID_88783
MAAAGQAGEEKLLSAYRHFSWRDRLSRSEKKNFSGISPFLLAGHAYVGSPAFGAGEIGVSPAFGAGRIGIFLSPITFPLQIGKSNLISQ

SEQ ID NO: 205562 - protein, 181 aa, Glycine max
  Coding DNA Sequence Number=SeqID_88784
MAAYFKTYSYPVMILSDLKHAFWPFQHDHTKTLFLRAATAANCVDRSDFVGESGSQIASAKAAQHRLDRGVWTSVRFGDMRRSLSACERLILLKNDANEFRDYSILLYHCGLYEQSLEYLTKYRDLKNSSRQESSSSNSLSSLEEDAVDNLMMRLNLVLMEQGWSRPSYARNFLGNNSEPW

SEQ ID NO: 205563 - protein, 845 aa, Glycine max
  Coding DNA Sequence Number=SeqID_88785
  Gene Ontology: Mol. function=RNA-directed DNA polymerase activity; Cellular component=chromatin; Biological process=chromatin assembly or disassembly
MEAKAATLETEVAGLRTAKHAMQLTAEENHEKLVVLLSKNNSDSNGESSPMKLSAILHGDTLDEFRKSVKKVELPMFAARIQPGIDEGDDLERLAVIRQDGMVDKYILEFETLTAQESRLPNDQFFGYFVHGLKDGIRGRVRSLHTLGPLFQSRMMKSGNSSGVRAWMEWTSRPSAKQCWGLFLPSASPSCYQTGSGIWVRLVNLEPTARGTPGIGLDPNLRATNTVWGPGTRCGGPFHPNQQCPDQQMRVMLVEDEDEEEGEANAMVEAKHQDGECSMLFLGTTMVVNEQKPQTLKVRAHINGVHVLVLVNSGATHNFISRKLVFKEPRGLPPKTSKENAINLLEEAGPVNVRSYRYPHHHKNEIEKPDNSWHMCFGYRVLNKVMVPDKFPIPIIEELLDELHGALFFSKLDLKSGHHQALYEYMLMPFGIMNAPSKFRSLMNEIFLPMLRRTMLAFFDDILVYISSWEVEYLGRIISSKGVAVDPAKVKSVMEWPEPKNVKGVQGFLGLTGYYRKFIRDYGQRAKPLTELTKREGAILTQNGRPIAYFSKALDERSLAKSAYVKELMAVALAIQHWPSYLLGRSDVKLLCIISDLQQGKNTRPGFVYKHDTLFYEGWLVLSSTSACIPKMLKESVQKFVMACDVCQCQKYLAAAPGGLSKYGHFIPLNHPYSAQMFAERFIREVELFKLQGTQLKMSTAYYPQMDGRTEVVNRCEESFLRCFVADQPKMKPPVLSRFLPCEVRVEAVRRELLDWDEAIKQLKYHLQRAQNRMKDQADRKRIDRQFEVGEWVFLKLHPHGQSTVGARINPPRYYGLLRYCRGLGLYLINYSSVVNSGLWKIARS

SEQ ID NO: 205564 - protein, 67 aa, Glycine max
  Coding DNA Sequence Number=SeqID_88786
MLRFLNKKPFSLSCEPLTHTLSQNAISLLKPTSPLSLEPLHWPFPPNGVADVDFGDLREFEKGEFGG

SEQ ID NO: 205565 - protein, 71 aa, Glycine max
  Coding DNA Sequence Number=SeqID_88787
MEEATWEEEFNIKSQFPHLRLEDKSHFEEGGIDRNGNMGQYTDGRPKVWMVYVRRYRGKKSNGGVANEITE

SEQ ID NO: 205566 - protein, 123 aa, Glycine max
  Coding DNA Sequence Number=SeqID_88788
MRNFWMVFQTIGQVALITMEEQATKKSMAPSKCERVWLVAEKEKKKNTQEKLTTLEVQLTSETNEVDKFKGELNVANTESALQFVKGFKAEIKQVKVIVRVVNFEEVGPFKEVADGKIVDVIE

SEQ ID NO: 205567 - protein, 155 aa, Glycine max
  Coding DNA Sequence Number=SeqID_88789
  Gene Ontology: Mol. function=enoyl-[acyl-carrier-protein] reductase (NADH) activity; Cellular component=chloroplast; Biological process =metabolic process
  Homolog annotation: Hit_ID=O04945; Match level="QueryCoverage=94%, HitCoverage=37%, E-value=1e-34, Identity=52%"; Hit description=Enoyl- ACP reductase precursor
  Subcellular localization annotation: CTP_CleavageSite=79; ConfidenceScore=5.29e-01
MAATSFSGMQFAMSRSCIPASQKIADAGAVVLGGKSKIGSWNKLASACHIASVQPFRRGFTSSSIKSVKSDTKALFEFSAQSADSGLSIDLKGKRAFIAGVADDNGYGWAIAKALAAAGAEILVGTWVPALNIFESSLRRGKFDISRMYDIKYCC

SEQ ID NO: 205568 - protein, 509 aa, Glycine max
  Coding DNA Sequence Number=SeqID_88790
  Gene Ontology: Mol. function=rhodopsin-like receptor activity; Cellular component=integral to membrane; Biological process=G -protein coupled receptor protein signaling pathway
  Homolog annotation: Hit_ID=Q336N0; Match level="QueryCoverage=72%, HitCoverage=97%, E-value=1e-132, Identity=63%"; Hit description=LrgB- like family protein, expressed
  Pfam annotation: Domain name=LrgB; Domain location=273-504; Score =41.6; E_value=6.6e-12; Accession=PF04172.6; Description=LrgB-like family
  Subcellular localization annotation: CTP_CleavageSite=70; ConfidenceScore=5.84e-01
MSISLPVSMATTIHSLPYSLLKLKPPSLTPSLFRRTLFPNSTLNAAPKRTVSSTTFSLTLTNGTCKTRHVAAKSSEADTGNTSTSLTQTVFGVLHLAVSLGLILAVDKFLKQAFVAAAIKFPSALFGMFCIFSVLIILDSTVPAAATAFVSFFEPAFMFIQRWLPLFYVPSLVVLPLAVKDIPAASGAKIGLILVGGWLATLCVAGYTAIAVRKAVKTELVDAEPMGKPAPFSSLEVWTWTAVLLISFVSALFYPTALGTSARTCLPFLLAATVLGYMVGSGLPSNVKKVFHPIICCALSADLTAFAFGYFSKSGLEPVLGYYLTKASSNPGAGDILMGFLGSVILSFSFSMFKQRKLVKRHAAEIFTSVIISTVFSLYSTALVGRLVQLEPSLTVSILPRCITVALALSIVSLFDGANSSLTAAVVVLTGLVGANFVQATLDKLSFRDPIARGIATASSAHGLGTAALSAKEPEALPFCAIAYALNGIFGSILCSIPAVRQSLLAIVG

SEQ ID NO: 205569 - protein, 94 aa, Glycine max
  Coding DNA Sequence Number=SeqID_88791
MQKRDKGQIGREGQKRWGEERDRGGRGRGKGKREGVEEVGVRGEERIEKEDDERGGEEKREKTKKGYEGAEEDTCKQDIICIQEELINNFMQTW

SEQ ID NO: 205570 - protein, 177 aa, Glycine max
  Coding DNA Sequence Number=SeqID_88792
MWLVREATKIIPLEGPMGGRRSKTGRNVIPGPGQCGGEGGGIGAREECGEDGMVVMATSLTLGKAGYGLLEAVNGHLKSVVNVKELGKLLDNIYISNIKLNVNIPKHLKWRRTVEQGPQRHYKEINNKANHKGKGNSGNNYRDREQVPKQLGSYAQTFTGVVNPNRPGRLDWFDSDK

SEQ ID NO: 205571 - protein, 141 aa, Glycine max
  Coding DNA Sequence Number=SeqID_88793
  Gene Ontology: Mol. function=DNA binding; Biological process=DNA integration
MHRGIKANPDRCSMVINMRSLSNVTKVQQLYGRINSLSIFLSKLDGPSHSFIAHEKARGFHGWKSHCQSGLSARDEGRRKSNIFSESCPARPRVVVPEVRKDGLGGIDHNQKIETLLPELFDHRLDGSTYSKNSTKIKLGW

SEQ ID NO: 205572 - protein, 76 aa, Glycine max
  Coding DNA Sequence Number=SeqID_88794
MSNHQRVASLGFWLIRQVCEVLIFSFSLSQSAGLASHPLSASLLRLSARKNLEKDKLYTRAKRGLIQLSTPLACSR

SEQ ID NO: 205573 - protein, 173 aa, Glycine max
  Coding DNA Sequence Number=SeqID_88795
MARKRAMEKKEIGSTSESGAKPLWGEWKGHDQGRYRREKEILDPTPLPVPREQTLREIEYLIKKGPLANYARKEKDQQDDMSWDIKEKRDPPPPPNTRNTTTPTHQQVMPFGLKNTGTTYQRLMDKVLAKLMGNTIKAYVDDIVVKTSNAIEHCVDLQCVFNTLCQYQLKLNT

SEQ ID NO: 205574 - protein, 227 aa, Glycine max
  Coding DNA Sequence Number=SeqID_88796
  Gene Ontology: Mol. function=protein dimerization activity; Cellular component=nucleus; Biological process=regulation of transcription, DNA-dependent
  Homolog annotation: Hit_ID=Q94KA8; Match level="QueryCoverage=90%, HitCoverage=45%, E-value=9e-88, Identity=80%"; Hit description=BZIP transcription factor 2
  Pfam annotation: Domain name=MAP7; Domain location=75-207; Score= -81.4; E_value=0.065; Accession=PF05672.2; Description=MAP7 (E-MAP -115) family
  Pfam annotation: Domain name=bZIP_1; Domain location=105-185; Score =71.9; E_value=2e-18; Accession=PF00170.11; Description=bZIP transcription factor
  Pfam annotation: Domain name=bZIP_2; Domain location=105-175; Score =18.6; E_value=0.0096; Accession=PF07716.5; Description=Basic region leucine zipper
  Pfam module annotation: Pfam domain module=MAP7::bZIP_1::bZIP_2; Domain location=75-207::105-185::105-175
  Subcellular localization annotation: CTP_CleavageSite=79; ConfidenceScore=5.38e-01
MFCCITDEPSQNGSPVHAPQNGVHNRSQTVVNQTMPILPISSTSASGAVPGPTTNLNIGMDYWGTPTSSTIPALHGKVPSAAVAGGMIAAGSRDGVQPQVWLQDERELKRQRRKQSNRESARRSRLRKQVIIVIFQIPFFALCTQAECDELAQRAEALKEENASLRSEVSRIRSEYEQLRSENAALKDRLGEIPGVTTPGKEDLRSGQNDQHVGCEYLLGHTFSATS

SEQ ID NO: 205575 - protein, 66 aa, Glycine max
  Coding DNA Sequence Number=SeqID_88797
MPDHLNGRFSLYFSDQAGGIFPPSQSFCLTKPKTTLLFYSPEVAESVKEDFGSIDILVHSLANGPE

SEQ ID NO: 205576 - protein, 1007 aa, Glycine max
  Coding DNA Sequence Number=SeqID_88798
  Gene Ontology: Mol. function=protein binding; Cellular component =membrane; Biological process=defense response
  Homolog annotation: Hit_ID=Q1T2T9; Match level="QueryCoverage=97%, HitCoverage=82%, E-value=0.0, Identity=42%"; Hit description=Disease resistance protein; AAA ATPase; Tumor Necrosis Factor
  Pfam annotation: Domain name=AAA; Domain location=59-248; Score= -32.9; E_value=0.065; Accession=PF00004.19; Description=ATPase family associated with various cellular activities (AAA)
  Pfam annotation: Domain name=LRR_1; Domain location=403-428; Score =4.9; E_value=34; Accession=PF00560.23; Description=Leucine Rich Repeat
  Pfam annotation: Domain name=LRR_1; Domain location=446-467; Score =3.4; E_value=66; Accession=PF00560.23; Description=Leucine Rich Repeat
  Pfam annotation: Domain name=LRR_1; Domain location=469-490; Score =3.8; E_value=54; Accession=PF00560.23; Description=Leucine Rich Repeat
  Pfam annotation: Domain name=LRR_1; Domain location=492-514; Score =12.4; E_value=1.4; Accession=PF00560.23; Description=Leucine Rich Repeat
  Pfam annotation: Domain name=LRR_1; Domain location=516-537; Score =2.2; E_value=1.1e+02; Accession=PF00560.23; Description=Leucine Rich Repeat
  Pfam annotation: Domain name=LRR_1; Domain location=539-560; Score =5.1; E_value=32; Accession=PF00560.23; Description=Leucine Rich Repeat
  Pfam annotation: Domain name=LRR_1; Domain location=586-608; Score =9.9; E_value=4; Accession=PF00560.23; Description=Leucine Rich Repeat
  Pfam annotation: Domain name=LRR_1; Domain location=663-684; Score =13.9; E_value=0.58; Accession=PF00560.23; Description=Leucine Rich Repeat
  Pfam annotation: Domain name=LRR_1; Domain location=686-707; Score =11.8; E_value=1.8; Accession=PF00560.23; Description=Leucine Rich Repeat
  Pfam annotation: Domain name=NACHT; Domain location=58-212; Score= -20.3; E_value=0.0022; Accession=PF05729.3; Description=NACHT domain
  Pfam annotation: Domain name=NB-ARC; Domain location=22-314; Score =144.9; E_value=2.1e-40; Accession=PF00931.13; Description=NB-ARC domain
  Pfam module annotation: Pfam domain module=AAA::LRR_1::LRR_1::LRR _1::LRR_1::LRR_1::LRR_1::LRR_1::LRR_1::LRR_1::NACHT::NB-ARC; Domain location=59-248::403-428::446-467::469-490::492-514::516-537::539 -560::586-608::...
  Pfam module annotation: Domain location=663-684::686-707::58-212::22 -314
MYIFWRDESKFIDDLVSRIFIKVSPKDLSRNEHIVGWEYRVEELKSLLELESHNITNCLLGIHGTGGIGKTTLVKALYDSIYKQFQGSCFLSNFRENSSQIQGIKHLQEGHLSEILEGSKILLKNIEKGIGTITSRLRLKRVVIVVDDVDDIEELKKLAEELDRFGPGSRIIITTRNKYLLDVGQVEKKYEVKMLNDQESLELFCQSAFRKSCPETNYEDLSNRAIRCCKGLPLALKVLGSHMVGKDLGGWKDALDRYGKSQHEGVQKVLRISYDSLPFNEKNIFLDIACFFNGWKLEYVKSVLDACDFSSGDGITTLVNKSLLTVDNECLGMHDLIQEMGREIVKEEAGDVVGECSRLWHHEDVFQVLVNDTGSSKIQGIMLDPPLREEIECTDIVFKKMKNLRILIVRQTIFSCEPCYLPNNLRVLEWTEYPSQSFPSDFYPSKLVRFNLSGSNLLVLENPFQRFEHLTYMEISHCRTVVEFPDVSRAKNLRELRLDRCQKLVSIHKSVGRLANLVFLSATHCNQLQSFVPTIYLPSLEYLSFGYCSRLAHFPEIERTMDKPLRIQMLYTAIQELPESIKKLTGLNYLHIEGCKGLQHLPSSLFVLPNFVTLRIGGCYLLRESFRRFEGSHSACPKLETLHFGMADLSDEDIHAIIYNFPNLKHLDVSFNHFVSLPAHIKQSTKLTSLDVSYCDKLQEIPELPSTVQKVYASECNSLTPETSNILWSQVRKEIRGLEVRMPKREIPEWFDYVNEGGYPVFKARGKFPAVALAFVFGDVKALPYLSSMGVHLHLFIEGEHRLCDRFIVVKNQALLCDIRVLFSFEKWEDVGVGIGNDWKTIQVFCETGCNSLRSWGVYVYRHETNMEDIQFLSQHSISSLVRSLHEERKKSDQSLKGREMFHLQMRNNEEMFYCMHKQRRRELLLISEKTSRRAMAPREGEGSSGLNIDDKEDKEADSMLELLAEITSDDGEETQEAGPSSEQRYEGLLDEDSRSACRSGKKLRRC

SEQ ID NO: 205577 - protein, 683 aa, Glycine max
  Coding DNA Sequence Number=SeqID_88799
  Gene Ontology: Mol. function=hydrolase activity, hydrolyzing O -glycosyl compounds; Cellular component=cellulose and pectin -containing cell wall; Biological process=polysaccharide catabolic process
  Homolog annotation: Hit_ID=Q9M995; Match level="QueryCoverage=94%, HitCoverage=97%, E-value=0.0, Identity=63%"; Hit description =Endoglucanase 5 precursor
  Pfam annotation: Domain name=Glyco_hydro_9; Domain location=52-544; Score=821.8; E_value=3.6e-244; Accession=PF00759.9; Description =Glycosyl hydrolase family 9
MHEAKENRTNKLYARSTVQTDAAYLELHRGASRYHRPSTLVRLGGSAPSGFNYGDALDKSLMFFEAQRSGKLPLPQRVKWRGDSGLQDGFQQGVDLVGGYYDAGDHVKFGLPMAYSVTMLAWGAIEFNKEIADLNQMGQALWAIKWGTDYFIKAHTQPNVLWGQVILTKPDLTIHGSSKVLLLWLNVKHAYGNVGDGVSDHYCWERAEDMTTSRGAYKIDEQHPGSDLAGETAAALAAAAIAFRPYNSSYSNLLLVHAKQLFTFADRFRGLYDDSISSAQQFYTSSGYSDELLWAATWLHQATGDEYYIKYVVDNAMYMGGTGWAVKEFSWDNKYAGVQILLSKVLLEGKAGAYAATLKQYQAKAEYFTCACLQKNDGYNVQKTPGGLLYVRDWNNMQYVSSAAFLLAVYSNYLSATKSQLNCPDGQTQPQELLNFVKSQADYILGKNPADVSYLVGYGAKYPLHVHHRGASIASIFALHYEVGCTQGFETWYNRAEPNPNVICGGLVGGPDKNDDFSDERSNYEQTEPTISGSAPLVGIFAKLQSLYGNHNIGEGYNHNESPVPQQKTPSTNPGKATVSKTSSESEGAAVEFLHSISSSWTVGGATYYRHRVIIKNTSSKPISDLKLVIKDLSGSLWGLSPTEEKDTYELPQWHKVLNPGSESIFVYVQGGPQAKVSIKSLH

SEQ ID NO: 205578 - protein, 158 aa, Glycine max
  Coding DNA Sequence Number=SeqID_88800
  Gene Ontology: Mol. function=enoyl-[acyl-carrier-protein] reductase (NADH) activity; Cellular component=chloroplast; Biological process =metabolic process
  Homolog annotation: Hit_ID=O04945; Match level="QueryCoverage=98%, HitCoverage=35%, E-value=4e-57, Identity=77%"; Hit description=Enoyl- ACP reductase precursor
MGGSSISLTYIASERIIPGYGGGMSSAKAALESDTRVLAFEAGRKRKIRVNTISAGPLRSRAAKAIGFIDMMIDYSSANAPLTERSISRFHFQSVIICTTELIFCLAEEVGYTAAFLASPLASAITGTVLYVDNGLNAMGVGVDSPIFKDLNIPKDQH

SEQ ID NO: 205579 - protein, 86 aa, Glycine max
  Coding DNA Sequence Number=SeqID_88801
MPGNTRLKPYTARMTKYKAKKKAKPILIFTKKSGLKLGSWAQKSTLSHSSLILLESSIQYPWRLGLHQYGALTNHGYGSTLVKNAR

SEQ ID NO: 205580 - protein, 91 aa, Glycine max
  Coding DNA Sequence Number=SeqID_88802
MPTPSFFINAIWTQWEHDDTLHVDCFYGFLHYCSAPVLEVPPRVDLVDLVSKDEGEDLEEDRSIKEDLSIDEKDPIAKLELKEVESFDDSY

SEQ ID NO: 205581 - protein, 522 aa, Glycine max
  Coding DNA Sequence Number=SeqID_88803
  Gene Ontology: Mol. function=nucleic acid binding; Cellular component= intracellular; Biological process=ubiquitin cycle
  Homolog annotation: Hit_ID=Q1RZ04; Match level="QueryCoverage=87%, HitCoverage=77%, E-value=1e-117, Identity=47%"; Hit description=Zinc finger, RING-type; Zinc finger, RanBP2-type; Zinc finger, C6HC- type
  Pfam annotation: Domain name=IBR; Domain location=183-247; Score =87.7; E_value=3.6e-23; Accession=PF01485.11; Description=IBR domain
  Pfam annotation: Domain name=IBR; Domain location=257-310; Score=2.1; E_value=0.011; Accession=PF01485.11; Description=IBR domain
  Pfam annotation: Domain name=zf-CCHC; Domain location=232-249; Score =6.2; E_value=0.093; Accession=PF00098.13; Description=Zinc knuckle
  Pfam module annotation: Pfam domain module=IBR::IBR::zf-CCHC; Domain location=183-247::257-310::232-249
MEKEDETTHEDDWIKGVEMNSIDHKITSKEQQHYTVLSESDIKRHQDADIKQVSCVLLISIVFSCLLLVHHEWSVLKVQEVWFDDEERVRKAVGLLKQHKPRVGFPNSKTLTCEICLDVVLCDKVRSASCDHLYCIDCWKKYVDTSINDGPNKCLKLRCPKPFCDAAVGGDMIRELASESQRNKYDQFLFRSYVENNKKVKWCPAPDCGYAVSYEADGVRSNSDVTCLCYHSFCWSCGEEAHSPVDCEIAKHWIMKNDYESSENSAWILANTKPCPKCKKPIEKIDGYVHMECMCGFQFCWLCLRKWSNCCYNCIHFPYKDIYKKEVKRNMVSDYLDDCTHYFESWTRTNLIRKDALNHLKHLMNGGHTKRLSMLYQRSEDDFEFIEAAWQQVIECIRVLKWIYTYRFYLPKSEQAKIEFLGYSQREAKTVLETLCYCTDKELSEFLHASEPKNTFDDFRLKLMKLTNVSKTYFENLVRALENGLTNVQVKKYGVSGLKRRLREIGESSTGMKKRNRNINLN

SEQ ID NO: 205582 - protein, 147 aa, Glycine max
  Coding DNA Sequence Number=SeqID_88804
  Homolog annotation: Hit_ID=Q9FN43; Match level="QueryCoverage=92%, HitCoverage=34%, E-value=3e-08, Identity=32%"; Hit description =Genomic DNA, chromosome 5, P1 clone:MYJ24
MSSPASSPPTLGYIQHPISKLDKLAGIAIKYGVEEVLRAEALSPAMSCLRKNGSLFYRKSPMSPQNLSRHKKSHSLANGTLDDIMAAREARKSDSDKWNGTLIRRSYKSEAKLQRIPELLLKQDNNCNGGFSFSPRSANGLAQRQKS

SEQ ID NO: 205583 - protein, 434 aa, Glycine max
  Coding DNA Sequence Number=SeqID_88805
  Homolog annotation: Hit_ID=Q1S8Q1; Match level="QueryCoverage=15%, HitCoverage=6%, E-value=3e-13, Identity=60%"; Hit description=PWWP; Regulation of nuclear pre-mRNA protein
  Pfam annotation: Domain name=Extensin_2; Domain location=100-393; Score=-126.3; E_value=0.022; Accession=PF04554.4; Description =Extensin-like region
LPGFLSSHAFEEDEDEYEDAIPINSCKETCDASPADPPHTLGESETSTVTPNDKRHCILKDVDGELEMEDVSGHPKDERPIFFDSYDEIDLQHQDSDRNLDPTSNISEEMSATPEGSPPMPLDSPPPPPPLPSSPPPPPPPLSPSPPPPPPPPMLQPPFPPLPPSAPQVSLVPQSSGPARPLLSQSLMPPQSSHQSSPQLGYQQSVPHDFSGTTNGNQIVPMVGNSFPGGHNNAVVKNEVFPQPTAYAPTAGCSSQEPSGFNPSRQLEYGQNDMYLNAQVPQPNHQFQQGNPPFAQRHAHPAPPQNPPNLYSYSNPTVQQHLPHSFHPPFPLPSLPDGRRQFVADEQWRVSSSEFKTNNQHGVWRGRNPSSCPGPPYGQEGHFRPSLERPPVSTVGFQRPISGNLPVAPIAGHGVPQMMPCRPDIPAVNSWRPT

SEQ ID NO: 205584 - protein, 130 aa, Glycine max
  Coding DNA Sequence Number=SeqID_88806
GYGNEYGTDEFGRIPTGTNFIVMPNNTNGNDNINAHNLDSGDGGNNDDNDDDNYSIGDSGGGRVDDGGCGDNDSSGDAYEGNSNGDGSGGNNSNDDGGGDNNSNDINDDRDDSNSDGNIGGGSGSDSSCY

SEQ ID NO: 205585 - protein, 69 aa, Glycine max
  Coding DNA Sequence Number=SeqID_88807
MGTNQTGKRFYQVKIKGLDATSIKELGQLMGPLQMQAFRKAKPYLFSGFLPSLSKIAVAVRDSARGLDR

SEQ ID NO: 205586 - protein, 303 aa, Glycine max
  Coding DNA Sequence Number=SeqID_88808
  Homolog annotation: Hit_ID=Q1S8Q1; Match level="QueryCoverage=91%, HitCoverage=26%, E-value=1e-116, Identity=78%"; Hit description =PWWP; Regulation of nuclear pre-mRNA protein
  Pfam annotation: Domain name=DUF618; Domain location=158-226; Score =3.7; E_value=0.0027; Accession=PF04818.4; Description=Protein of unknown function, DUF618
  Subcellular localization annotation: CTP_CleavageSite=44; ConfidenceScore=5.15e-01
MKHLIAAALAKRKQAHSQCLPSGFPNVQDGTPSPSAVQPYLPVSSNFVQADIQGVYEHTTLASPPTKELHSSSRNQLDADDIEERRVGSVQRGLGGSLSGGTEAAVAREAFEGMIETLSRTKESIGRATRLAIDCAKYGIANEVVELLIRKLETETSFHRKVDLFFLVDSITQCSHNQKGASYIPTVQAALPRLLGAAAPPGASARENRRQCLKVLRLWLERKIFPESVLRHYMDDIGVSNDDMTVSFSLRRPSRAERSVDDPIREMEGMLVDEYGSIFILTFIITESRMCLMEGCSHNQDSL

SEQ ID NO: 205587 - protein, 906 aa, Glycine max
  Coding DNA Sequence Number=SeqID_88809
  Gene Ontology: Mol. function=nucleic acid binding; Cellular component= intracellular; Biological process=RNA processing
  Homolog annotation: Hit_ID=Q6ETK6; Match level="QueryCoverage=88%, HitCoverage=84%, E-value=0.0, Identity=66%"; Hit description =Putative U2-associated SR140 protein
  Pfam annotation: Domain name=RRM_1; Domain location=125-199; Score =53.8; E_value=5.6e-13; Accession=PF00076.12; Description=RNA recognition motif. (a.k.a. RRM, R
  Pfam annotation: Domain name=Surp; Domain location=273-318; Score =58.5; E_value=2.1e-14; Accession=PF01805.10; Description=Surp module
  Pfam annotation: Domain name=cwf21; Domain location=753-796; Score =46.3; E_value=1e-10; Accession=PF08312.2; Description=cwf21
  Pfam module annotation: Pfam domain module=RRM_1::Surp::cwf21; Domain location=125-199::273-318::753-796
MFFIMNFSDIRFHKSNQLSKSNLYVPSFIPPPMATKGKESERKKEEEKPKEKEKGKSRNIDHFMEELKHEQEMRERRNQEREHWRDGRHTEHSISSRFDELPDDFDPSGKLPGSFDDGDPQTTNLYVGNLSPKVDENFLLRTFGRFGPIASVKIMWPRTEEERRRQRNCGFVAFMNRADGQAAKDEMQGVVVYEYELKIGWGKSVALPSQALPAPPPGHMAIRSKEGSTVILSGPSGPPVTTVPNQNSELVLTPNVPDIMVTPPEDDHLRHVIDTMALYVLDGGCAFEQAIMERGRGNPLFNFLFVLGSKEHTYYVWRLYSFAQGDTLQRWRTEPFIMITGSGRWIPPPLPMSKSPEHEKEPGPTHAGGRSRRVEPERTLTDAQRDEFEDMLRALTLERSQIKEAMGFSLDNADAAGEVVEVLTESLTLKETPIPTKIARLMLVSDILHNSSAPVRNASAYRTKFEATLPDIMESFNDLYRSIMGRITAEALKERVLKVLQVWADWFLFSDAYVNGLRATFLRPGNSGVIPFHSICGDAPEIEQKTASEDMVVGGKTNQDAALAMGRGAAMKELMSLPLAELERRCRHNGLSLVGGREMMVARLLSLEEAEKQKGFELDDELKYAHNQVSSGKYSSNQRETSAELDPVGLSAWNHYGDEDIQSQGRSSVPLAPTLPIPQPKLKAFTKKEKNDPVLPASKWAREDDESDDEQRSGKNLGLSYSSSGSENVDDGLVKADESESAADRSFSAHADSGMNEEQRQKLRRLEVALIEYGESLEERGIKNLEEIEKKVQLHRKRLQVEYGLSDSGEDGQGNRRTSERRDRHDVSRKRHRSRSPSSSPQPTLSGKDRDREHDLERDRDRQRDRSHDFDSERGRDRHREKSGSRERDDHDKDRSRDRDRRRRAK

SEQ ID NO: 205588 - protein, 87 aa, Glycine max
  Coding DNA Sequence Number=SeqID_88810
  Subcellular localization annotation: CTP_CleavageSite=43; ConfidenceScore=5.26e-01
MASLQDAPSHSKTHVSTTFAQPISLKLDTKNFLLWKQQVKETSLMSVIGYLFPFFLGRVEPKVEAVMKEETTVADLIVKRNQEEKTR

SEQ ID NO: 205589 - protein, 705 aa, Glycine max
  Coding DNA Sequence Number=SeqID_88811
  Homolog annotation: Hit_ID=Q1S8Q1; Match level="QueryCoverage=100%, HitCoverage=64%, E-value=0.0, Identity=55%"; Hit description=PWWP; Regulation of nuclear pre-mRNA protein
  Pfam annotation: Domain name=PWWP; Domain location=17-102; Score =21.1; E_value=6.7e-05; Accession=PF00855.8; Description=PWWP domain
MAPGRRRGANKAKANGHLSLGDLVLAKVKGFPAWPAKAPLLPSMVLECIQKEEDREVIYDIPNELDDQYMELNLFKAFVAPADIQAFTGEAKNKLSARLQGKTKYFAQAVKEISAAFDVMQKQKASGLADDTDDSHIGSEAPSNDGVVGNQKDAADAVVSNIEKNNIDMDNVCSNLEHYTQRIGENDSQDEKLSVSNHPNESSSVSSPMIKNKLAIGSETKKNANKSSFKGASNVNDFGQDDNGHSDLTNGTKPRKLDNGSRKKSEAAGGSNRNGGSSTGKFMKEGNCTGRGDLSRSGETLKAGKKRKNTFSVKLDSPDTLKSSDNGTTGEKDSNLMKVKTSHEVKNELQEISFDSEDADGKSSSMRKKTQLHAKHNVGGANESLHATKKLKRMDAKDDSTLGYTSKVLKRASPGSTVIEDKPFKKLESKKSTPNLKTEKSLPSRSQTGGAGSDDFVHELLPGTKHHSQVQQIMPDSAGIASDEKNERSSLRPKGDTNNVVIKQLERKRRAVCLFDDDDDDEPKTPVHGGAAKNMKSSSVSEFKKSNNVHSEKSDVVQMAQKNSSELEDTHLKEPSSQLHDDHLSIQQPLKEKDDEVIPVHVPHSPEKLDSKQFPSNVAKLSSVSPLKSPLLVPATKSNAERNKASKLSLKISSNATQKRADHGPSKSSHNLSSSQNQVVTHKKKLALSAEIFKTTPETLPQAVE

SEQ ID NO: 205590 - protein, 114 aa, Glycine max
  Coding DNA Sequence Number=SeqID_88812
  Gene Ontology: Mol. function=endopeptidase Clp activity; Cellular component=mitochondrion; Biological process=proteolysis
  Homolog annotation: Hit_ID=Q1S8Q4; Match level="QueryCoverage=87%, HitCoverage=42%, E-value=3e-35, Identity=74%"; Hit description =Peptidase S14, ClpP
MGTCGDGATGGIEVHVDGFGRVFGFEEEELRNDDVSGVVGDGPVDADNALLQKAREDVVCPLTSGRVLYHHWDQTVGATAFSVPSMEQQIPRKRFHNASHGSQYNAGLGIFVLL

SEQ ID NO: 205591 - protein, 88 aa, Glycine max
  Coding DNA Sequence Number=SeqID_88813
  Gene Ontology: Mol. function=sequence-specific DNA binding; Cellular component=intracellular
  Homolog annotation: Hit_ID=Q1SNM1; Match level="QueryCoverage=85%, HitCoverage=18%, E-value=2e-19, Identity=72%"; Hit description =Histone-fold/TFIID-TAF/NF-Y
  Pfam annotation: Domain name=CBFD_NFYB_HMF; Domain location=12-88; Score=16.2; E_value=0.005; Accession=PF00808.13; Description=Histone- like transcription factor (CBFNF-Y) and archaeal histone
MQKLEEVGSSVKARIKKIMQADEDVGKIALAVPVLVCCWLFVCHIHVVDIALECITAKALELFLQDLCDRTYEITLQRGAKTMNSLHL

SEQ ID NO: 205592 - protein, 92 aa, Glycine max
  Coding DNA Sequence Number=SeqID_88814
MEGEEDESLLLSLMLLVSDSNLRTAKEEQERLSPTSWNHCGKALHLRPAEAHVSDLRSKSYRCPCGRTCFTVALAYHHNVTIMNEEVVVVCF

SEQ ID NO: 205593 - protein, 257 aa, Glycine max
  Coding DNA Sequence Number=SeqID_88815
EPTEVIRGTQSDPSREDVKAEEAGKSTETSSSYDPDETEKLNKTQVADTIIENVETLEVNPEVHSCDVQDDTILASNASFQHQERYEETDPVQETNDFHEKHDAGETSSFIQIALEVNGAFKQMPNIFETETTEGNATSIGDTDINDGQNQDQCWEKSENDCNLEMLVEDITPESAEICKDALETRVALNEEVDENQSNSSNEENLFDNEHNIEESQIPCTSDWKSSPFKEEEVESSHSNLRESNQASVTMEDKEAN

SEQ ID NO: 205594 - protein, 51 aa, Glycine max
  Coding DNA Sequence Number=SeqID_88816
MKNDFMKVLPIFLMGCKYKVGAKLLANRLKNVLPKVIDDHQSAFLVERSLL

SEQ ID NO: 205595 - protein, 241 aa, Glycine max
  Coding DNA Sequence Number=SeqID_88817
  Homolog annotation: Hit_ID=Q1RTB4; Match level="QueryCoverage=45%, HitCoverage=23%, E-value=6e-09, Identity=35%"; Hit description=IMP dehydrogenase/GMP reductase
MEEKAEALASQEDTIGVWDCTFPNVDGLVGLATIDAFLAYHHCKESPVIAVLANTYDTLDLRCEKSSVKIVCCTPALYVWSSHVRQKGKGKLGGTLGKYGFPNVPLMGTMGGINYNPMLAIRQLGYPMRVEQKDRELRGSSNGVVGCYHKWLKARMQEITWLPNLKGPSGEEVEVPEESEEVQALKAELERTQVVKEKFKMIAIRVKKRCDELRDVKMAMAEALERETKRARKEEWGQNKF

SEQ ID NO: 205596 - protein, 160 aa, Glycine max
  Coding DNA Sequence Number=SeqID_88818
MQQQEDPMITIHQEFIWSFSKHEDGILSMEAEDDDDNNEVLARSPSAPNVNIPQHMPDLNLDEIDQHEEYNHFFNRESIPTKPKGILWVGMQFMIKDEYTFAIQEFGIKENVGYKTDKLDQSQLTVYCPNGCDWYCRVHFSKKAKIWEIKNTRRIYIFQV

SEQ ID NO: 205597 - protein, 99 aa, Glycine max
  Coding DNA Sequence Number=SeqID_88819
  Pfam annotation: Domain name=zf-CCHC; Domain location=80-97; Score =13.8; E_value=0.0053; Accession=PF00098.13; Description=Zinc knuckle
MAKQRKLKQVYGNWEESYKQLRRCPLAMNDSLPRTIIDCHTRPTIERGRLVPENRRNPCGLPKTSRIYTKMDVRERGQPKRCSICRTVGHSKNKCPNRP

SEQ ID NO: 205598 - protein, 93 aa, Glycine max
  Coding DNA Sequence Number=SeqID_88820
MASSSVKCSIGMPAGDPCGVLSSSTGVDTGDAYGLASAIIGSASGSVSGTNDSGGVHSPDLVEPPKLRMPHLLHEKKAELLARPPTQKTPPCS

SEQ ID NO: 205599 - protein, 313 aa, Glycine max
  Coding DNA Sequence Number=SeqID_88821
  Homolog annotation: Hit_ID=Q1SS72; Match level="QueryCoverage=36%, HitCoverage=7%, E-value=2e-07, Identity=33%"; Hit description =Integrase, catalytic region
MQQTLTHQTRDFLAPTMAKTITPLIEEEEAIKAILAKGTQEEKQNKICTHCGLNNHTIDECYRKHGYPPRHRFYKSQSSNINSVNAMKEESDTSTLNRNQDAQSEDDMQNLQRIGIVAMEEGVYKLKMSPIKLEYNPDSICPIISSVETRSHLKSFIANVESTLETNRRKLDPRTATSVFLGFKPNTKGFVTFNLKTISIFVSRNVISMKTIFHSLIRNSLLKQLENLLDKYIGQANIGISISHTHPQLLPVTLQRLKHWNLIILGFSLILMQSYPPRPLDRRLQEDWARDAGEGRPRVLIGLKVDFGSMGSV

SEQ ID NO: 205600 - protein, 66 aa, Glycine max
  Coding DNA Sequence Number=SeqID_88822
MSRNSIPIYNILRKVILEMQCLPPLGCTTIDIRANDSPLGCTTIDIRANGSPLGCTTIGIRANGLT

SEQ ID NO: 205601 - protein, 58 aa, Glycine max
  Coding DNA Sequence Number=SeqID_88823
MWLCSGNITIRESEVRKRGAQRVDTKCHCLEGCDALDKWWCNAVMRWRNDGDNDLRVQ

SEQ ID NO: 205602 - protein, 170 aa, Glycine max
  Coding DNA Sequence Number=SeqID_88824
KSKGERKDIELVEEEEPQIGADCSSATSNKSEIYKEEAANAAHKHKPKRVESVNADAEAFDDHWKVQIGHQSVSLKNKTGDSTVLKIGDSTKVVIKQDMKGGEHRYGFNNNKREKPEKVRVVDDETGNKHELFEVLRMPSRCVFFKFFMSFLHHSTSSCHSFPESLKYYS

SEQ ID NO: 205603 - protein, 79 aa, Glycine max
  Coding DNA Sequence Number=SeqID_88825
LHSRIWTFLLSGCNPWLVRAAHPCYQTGQGSQGHAMRPTGGVLNTESFDEGVEAIYGSWWESTIPCQCCSLEGYREDTT

SEQ ID NO: 205604 - protein, 144 aa, Glycine max
  Coding DNA Sequence Number=SeqID_88826
MATKTSYMLVNTSISSASTLGKQASMNEYVDHMAPLPKGFKIPYFTTFSDEDGKSTMRLSYFGTSLNSSLVRTFHQPELSIGIPFRDFDNELYLFLESMIVPMNQHETFQRVLSSLTCFLGNFPEGHSSHNYSKPSTLNCGVLK

SEQ ID NO: 205605 - protein, 41 aa, Glycine max
  Coding DNA Sequence Number=SeqID_88827
MERLWLSMLLEPKLWAFVYSSSERAHSKAFRALEFNMNLCL

SEQ ID NO: 205606 - protein, 416 aa, Glycine max
  Coding DNA Sequence Number=SeqID_88828
MVVCDGGSRLSVWVWLGVGRVGGALIGGGGCIGGSGIGVVVTLNKCIWACCKLRMRDSPRNKVDSIASLDDASCEVDSVGASSILAFGCITTMNRVDSTILNASVVASIALQEAVLKVLHKASIYVIKVEVLGRLYQAMPIHLLMRSPKGYAVVGAEPKCAPPWKIVLEEWNGPLRAQEIDKGHPEPLWHLGAEQHIQQKEYGHTRTTSIEGLQLLLHVDPSTGNLDVLIGERGFLVVTGGGLDGCGLGVGVASLLDELEPSEHGILMGSFGVEDLHPTLVQTTEVLLSGNKSSLADDGELGVFVQFFKDMEYLVFLEKFVDEGGIVDVIHSSQGLHVHEYVNVDWVWKLWVIEITVDSAKKQNVLYVETKTFQHINVKVVFNVNSRFSINLDGSGVCDDNGGGKGSVFTGVRHGE

SEQ ID NO: 205607 - protein, 140 aa, Glycine max
  Coding DNA Sequence Number=SeqID_88829
  Gene Ontology: Mol. function=nucleic acid binding; Biological process= DNA integration
MEDKNWVKSMQEELEQFQKNDIWNLVELPQGKKAMGAKWVFRNKLDAAGKIKQTNNEIYIHQTKYVKELIKTFKLEDAKEMKTHMHLMTCLGLDEESNKVDNSQYKAMIGSLLYLTASRPDYCLVLDYVPDFNKTQGKFT

SEQ ID NO: 205608 - protein, 115 aa, Glycine max
  Coding DNA Sequence Number=SeqID_88830
MYVVYVHGGAVTMMDIPGGENRVFLMRGNTCTWGHVARFGTPLRLKLVTIGGGEGEVVCAWQGDLDTYYLVFIRKSVAWTRLGYFVTNGTTLHLRVEVRCKVIKLESLRRLVRVS

SEQ ID NO: 205609 - protein, 259 aa, Glycine max
  Coding DNA Sequence Number=SeqID_88831
  Gene Ontology: Mol. function=DNA binding; Cellular component =membrane; Biological process=DNA integration
  Homolog annotation: Hit_ID=Q1SKC8; Match level="QueryCoverage=98%, HitCoverage=77%, E-value=7e-78, Identity=50%"; Hit description =Integrase, catalytic region
MEAIVMERGLLSRFSNLVFIGLRCAKMLIITSRGVTNVKEQVEAVAVQHVDAKTVIRFLKKNIFSNFGTPRTNGQAEVSNREVKKILENIVAQSRKDWSLKLDEALWAYRTAYKSPTGLTPFQLVYGKSCHLPIELEHKAFWALKFLNFNSNTIGKHRKLQLHELEELRVQAYENSKLYKQKVKIYHDKKLSKRNFQPDQQLKSKWSRPFITKEVMPHGAMISEDPTTKKTWTVNGSRIKHYLGGDFEKIIIVVQLQEA

SEQ ID NO: 205610 - protein, 176 aa, Glycine max
  Coding DNA Sequence Number=SeqID_88832
  Gene Ontology: Mol. function=chitin binding; Cellular component =extracellular region; Biological process=chitin metabolic process
  Homolog annotation: Hit_ID=UPI000044A8F0; Match level="QueryCoverage =96%, HitCoverage=99%, E-value=1e-24, Identity=28%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
GLQVLTFRGLHVLTFRGLHVLAFRGLHALTSRGQDALTFRGLHVLAIRGLHALTFRGLQVLAFKELHALAFRGLHVFAIRELHVLAFRGLDVPNFRGLHALAFRGLHVLAFKELHALTLRGLHLLDFRGLHVLAFRELHVLAFRERHVFAFRGLHALAFRGLHALTFRGLHVLVFR

SEQ ID NO: 205611 - protein, 150 aa, Glycine max
  Coding DNA Sequence Number=SeqID_88833
  Pfam annotation: Domain name=zf-CCHC; Domain location=78-95; Score =26.4; E_value=4.4e-05; Accession=PF00098.13; Description=Zinc knuckle
MELLRLHQHEENDKKKKGIALKASSSIQEESDQENDPDDDDNLSLFVKRFNKFLKVRGNHRRPNFKSKRRTETSSSSLKCFECNQPGHLRVDCPIFKKKMEKYEKKNLSEKKLKKAYITWDENDMESSEDSENEEINLCLMAKSYESDEE

SEQ ID NO: 205612 - protein, 94 aa, Glycine max
  Coding DNA Sequence Number=SeqID_88834
MTTIVWRTPKVEVEDDIRNREDALNALFWSSYMCKGIMVGRPNNTTAELLAHMTQVLETLVQDRDVEQIEYRGFPTFTKHNPPKFEGNFDPEGA

SEQ ID NO: 205613 - protein, 195 aa, Glycine max
  Coding DNA Sequence Number=SeqID_88835
MDNDAKRLYARCRPWRWRWPNEGILLTRFGDRSALRLDDHELSARYKGFQEKKKDLTNNVEGIAVERGKLTKVVVDLEVRLKELESRLKESELRATKEMEAIKELEEELTMYKKEAKFFAKDLELGLFYPFKDMNDGFFLDEEEIVVEEEAADEGRGAEERGDDAQPGPSTSVVIIVVSEETKGCLGFCKSVHQG

SEQ ID NO: 205614 - protein, 111 aa, Glycine max
  Coding DNA Sequence Number=SeqID_88836
MCKAGEKTLDLDIIGHLVMSNEKGQEVLVARGFANGGPSNNARKRHAREVLTAAHGRRNYESIKIVPPRLIFDDKDIDMSIIRNHDDPLLVKAFINNKEESQNLIAEVALL

SEQ ID NO: 205615 - protein, 206 aa, Glycine max
  Coding DNA Sequence Number=SeqID_88837
  Gene Ontology: Mol. function=RNA-directed DNA polymerase activity; Cellular component=mitochondrion; Biological process=RNA-dependent DNA replication
  Pfam annotation: Domain name=rve; Domain location=64-206; Score=5.0; E_value=0.0023; Accession=PF00665.16; Description=Integrase core domain
MRELHELICGLHIGGHSLATKVLHAGYYWPTLKTNTFDFTKRCRRCQEFVDILRTPLDNLHSLSSPWPFSIWVMDILEPLPKAPGVVKYLLVVIDYFTKWVEVRPLWEIMASEVEKFTWKHLICRKHEGRAQDNRRSLRHGQDQGRRYQTMSIKKIQYKGSTISLSTWRPRMASLRRSQKRSPSEKAWSQLGRLIQGHSKPRQRSI

SEQ ID NO: 205616 - protein, 69 aa, Glycine max
  Coding DNA Sequence Number=SeqID_88838
MSFENEKAATNKVKRGKWKADKDNVSLMLFAEVSSCHHEFNRHFPAYPPLCQRPFPARAVAGRRSDVRL

SEQ ID NO: 205617 - protein, 343 aa, Glycine max
  Coding DNA Sequence Number=SeqID_88839
  Gene Ontology: Mol. function=FMN binding; Cellular component =membrane; Biological process=thiamin biosynthetic process
  Homolog annotation: Hit_ID=UPI00005F9E24; Match level="QueryCoverage =91%, HitCoverage=91%, E-value=1e-139, Identity=75%"; Hit description= COG1477: Membrane-associated lipoprotein involved in thiamine biosynthesis
  Pfam annotation: Domain name=ApbE; Domain location=10-327; Score =418.8; E_value=7.7e-123; Accession=PF02424.6; Description=ApbE family
MASLFAKGALLSALCALLAACDDAASRPQIDIDGKTMGTFYSVKVSGDVAIGKQELQRQIDAVLERANDDISTYRADSVLSQFNRSAGLEPQPIPRGMADIVLMAQRIGRDTGGAMDITVGPLVNLWGFGPDKHPVKVPEQAQIDAAKQRTGLQHLKLISDNRGEWLQKDLPDMYVDLSTLGEGYGADELVRLMNRNGITNYLVSVGGAVSSRGVNGQGKPWRVAIQKPTDRENAVQALVDLHGYGISTAGSYRNYFEQNGQRYSHVIDPTTGRPINHRLVSATVIAPTALEADGWDTGLMVLGTEKALKLAEEKGLAVYLISKTDDGFSAVMTPQFKAFLVQ

SEQ ID NO: 205618 - protein, 60 aa, Glycine max
  Coding DNA Sequence Number=SeqID_88840
MEGGERREKHMKTVTERGRCCNNREHGRPAKVSLNPVSQPAHHGSGLGSPQVDPLNPQKL

SEQ ID NO: 205619 - protein, 80 aa, Glycine max; identical to SEQ ID NO: 148380
  Coding DNA Sequence Number=SeqID_88841

SEQ ID NO: 205620 - protein, 86 aa, Glycine max
  Coding DNA Sequence Number=SeqID_88842
MSTFLMWSLLIIGGFKELPGVDDSDDERSTDLRTNPLQEGGDDAILSRRGPITRAMARRLQEDWAKDAREDPRVLMNFSVDFGPMG

SEQ ID NO: 205621 - protein, 148 aa, Glycine max
  Coding DNA Sequence Number=SeqID_88843
  Homolog annotation: Hit_ID=P26585; Match level="QueryCoverage=34%, HitCoverage=34%, E-value=2e-17, Identity=84%"; Hit description =HMG1/2-like protein
MKGGKSKIEYKRADPKLAVNKKGATTKARKPIGKGKAMKVPNKPKRPLSAFYTRCPYLMKHLVHSEDSFDSFLSLIIHLDKSKSGSGTNTKKEPPVPKDGPMAHIAAQTFTFRELVVAPKNFRLECLLGEGGFERVYKGRLESTGWLL

SEQ ID NO: 205622 - protein, 71 aa, Glycine max
  Coding DNA Sequence Number=SeqID_88844
  Subcellular localization annotation: CTP_CleavageSite=31; ConfidenceScore=5.30e-01
MEHTSYKNKMDRRVPGRFSKGSQTQGPPLVSLASPKARQTQGPPLVSLTSPKARQIEGLSLEHRKPKVCHW

SEQ ID NO: 205623 - protein, 191 aa, Glycine max
  Coding DNA Sequence Number=SeqID_88845
MSRNFTDSLTMGVKFLEAVERRLYDIKQWSPDEIRRNRDDVGVLGRKKSKGPLSLRAMKQIAGLMSSSGRPFATDSQSPPSTPLAVQATVASPTPPTPYSLLVQEVSVLLPTAVIASVPLAAPIVAPASTTVTPLLSACVMTTSAPKISPPSSSASPITISTILASVLPSSYSRPIVFLDHVYPSRDIDST

SEQ ID NO: 205624 - protein, 121 aa, Glycine max
  Coding DNA Sequence Number=SeqID_88846
  Subcellular localization annotation: CTP_CleavageSite=76; ConfidenceScore=5.83e-01
MSKERTTTVHMAIGDGQVSTFSSSFPSRQTTPSTSPPSFSPATSPISSHGPSSSHALTPPRQAQTLHRLLNNHMVVTSLGRKKKNKERKKGMDHWKYPFKVVGSVPRGGEGKKEHRGRKKG

SEQ ID NO: 205625 - protein, 314 aa, Glycine max
  Coding DNA Sequence Number=SeqID_88847
  Gene Ontology: Mol. function=nucleic acid binding; Cellular component= intracellular; Biological process=regulation of transcription
  Homolog annotation: Hit_ID=Q1SVP5; Match level="QueryCoverage=99%, HitCoverage=90%, E-value=1e-64, Identity=48%"; Hit description=Zinc finger, C2H2-type
  Pfam annotation: Domain name=zf-C2H2; Domain location=55-77; Score =21.5; E_value=0.003; Accession=PF00096.16; Description=Zinc finger, C2H2 type
MEQGQCWTKKKKYSLNSTSLGSPTNPSYGDSWEEQAFAEDAANSLGGCIWPPRSYSCSFCRREFRSAQALGGHMNVHRRDRARLKQQPSSPHNEILCRHDLETQLHNKPVHQSSFASLGGYLYPSPVCGLAYKKTNPNSDPDFVASPSSSPSLSKALLAPSVNIGTFREETMIPLYDSSILHEISPASNNSSESWPNSAEDHRLYSCKFYPQADTKKASKEIMDSRYRDNKGNNDDIDGDMSLNSVVYRTYPSLQFESTKEPDHISCKKRKTDASSTLFSSQSSSVDRHHVKPKMFEFSPSSIEELDLELRLGN

SEQ ID NO: 205626 - protein, 131 aa, Glycine max
  Coding DNA Sequence Number=SeqID_88848
MNPRKQCKQKRTQNNHKPNWQARRLTISDKGNAVEERAKCEQLKNATNRKNAKLPSGAVRLIASQMNSFIQRFRKLLHRTTLTQLTLASSRHVSVSCFTSIKQNMEFLSGLKKREPSEIYSYSYDIDSLGN

SEQ ID NO: 205627 - protein, 176 aa, Glycine max
  Coding DNA Sequence Number=SeqID_88849
MSTTSSTASTEMKNGIIRPPLIIQFITAFNNDKNTIQLPAFYHTQWAPNYPEFVHLRYNGAIYEIRVRQHKDKVYLADGLQNFRKDLKIYESTSINFFACDHHSVFDIHFIPPLERQTCGRQRHSSRKHIWTLQLTQEMLDDPEPLKLPHCTEVPLKACGNHMTVLRRHGPPLQWK

SEQ ID NO: 205628 - protein, 63 aa, Glycine max
  Coding DNA Sequence Number=SeqID_88850
MHETQCGPLRVHRMNRKAWFEGRWLPPSSPRRAGLLPPEATAFWRNILEGPSGPGCYLHPHFY

SEQ ID NO: 205629 - protein, 484 aa, Glycine max
  Coding DNA Sequence Number=SeqID_88851
  Gene Ontology: Mol. function=[glutamate-ammonia-ligase] adenylyltransferase activity; Cellular component=intracellular; Biological process=regulation of transcription, DNA-dependent
  Homolog annotation: Hit_ID=Q7VYQ0; Match level="QueryCoverage=97%, HitCoverage=95%, E-value=1e-169, Identity=54%"; Hit description =Glutamate-ammonia-ligase adenylyltransferase
MAAQQRFGAAQQVVGLLAEGLADLLGQFALLVAFVRGGFFGGIGAVRLVHADHAEYVAEGLRDELAMRRQRGFEILRAHAEGGGQSGAQRRVARQEMGLFVFPVLQRVFGAAQEPVGILQAARVLRRNQAGDAFGVQGGQQSALLQCRHAAAADQLRQLHHEFDFADAAIAQLDIVGAVDAVAGGSPPLPVLADALAQGAQGGQGVEVEILAVDEGHAQAFQLTGLGGAVAALERLRRHQARLEPCVAFPFAALADQIVLQRVQAPGQRAGVAVGTQAQVGAEHLAVGVDLGQHRHHAAGQAAIELVVADAARAIGVAFLAVQHDQVDVGGHVQFGAAQLAHAHDQHFLGQAGGRVARHPVHLGQFGGHAAIGGGHRGIRQRRHRAHHFLERRLAGQVAHDQRAEDPLAQFAQHLAAQFHRQDVRRAGAGQLGLPVRQPFPPTRPGPDGHRDGGAGGRTRQGRGRTGRAWTWRSDGRRMDAFQV

SEQ ID NO: 205630 - protein, 416 aa, Glycine max
  Coding DNA Sequence Number=SeqID_88852
  Gene Ontology: Cellular component=integral to membrane
  Homolog annotation: Hit_ID=Q5P7S2; Match level="QueryCoverage=90%, HitCoverage=28%, E-value=4e-36, Identity=32%"; Hit description =Probable transmembrane protein
MDRVHGAAHQRAAHVDATRRALAFPAPLPLQAHIQIVIGDPQLGHVDEPVVFAGSLDAGVQRHLVGSQLGLFEYARQRHAQLLGMANDRQVGRAGTAGQRHALAVDEIARHALDADLRIAGAHRGRTRRRRPVHPARRHVGRERGELAMIELQPGAGADASLDRRRRQPGRPGQGFGVIQRGVELPAPVGRAGGIGREQAAIEFSAQVHFARQHRIAVGAQHEAMRQAAIAHQQIDIVQHQIRRLAQFVLPADPGATDLHLALPGQPAQRRMIQVRLVIAGIQVDALPRHPQAVGGVAAQGEVRLLHPQAQQRGRQGEQAAPGQHRRHRRQAQDRLRHVVIDLHRAEFELGVQALPIRPDGPDRDACAQRLAGVGFDLGAPLVHARQDPIAHAQEPDGHDAVHGQRHPEQAAEHFL

SEQ ID NO: 205631 - protein, 229 aa, Glycine max
  Coding DNA Sequence Number=SeqID_88853
  Homolog annotation: Hit_ID=Q1T493; Match level="QueryCoverage=83%, HitCoverage=43%, E-value=4e-19, Identity=27%"; Hit description =Nucleic acid-binding, OB-fold, subgroup
  Pfam annotation: Domain name=Rep_fac-A_C; Domain location=63-196; Score=-65.4; E_value=0.042; Accession=PF08646.1; Description =Replication factor-A C terminal domain
ERPIIILLTHARIKEAQGSYPASISNSFKASKLMINDLVLEIQEFRERKSNVSFFKQEFVCVTVSKITTIVMDNYSWCYLAWGQCYKKADMQTVPFTCLCGKENDQPVLRYRVEVMVNHKGEQTKFLIWDRESAQLIGQSADEVNRLKIEDRDVDLNASPQALDKLLGCFLAFKVKVQPRFGNFVVLKYSDESDLINVVLDMILDSEPCCKIENSILESTDPTELESMS

SEQ ID NO: 205632 - protein, 44 aa, Glycine max
  Coding DNA Sequence Number=SeqID_88854
MEMRNQPCMKKMCDLNQERTEVVVIVRVCNLNEDRHGYKKLPRR

SEQ ID NO: 205633 - protein, 129 aa, Glycine max
  Coding DNA Sequence Number=SeqID_88855
  Gene Ontology: Mol. function=lipid binding
  Homolog annotation: Hit_ID=Q8LG37; Match level="QueryCoverage=91%, HitCoverage=86%, E-value=1e-24, Identity=57%"; Hit description=AtPH1- like protein
  Subcellular localization annotation: CTP_CleavageSite=19; ConfidenceScore=5.41e-01
MMEPSYGSTPSALTGSPSRASTSRPSPPLVHPLARLAFLVQGILRHVLILSTRHHPHCHVSQSKARKTSSISQMPSSSPRALTPCTSSSIPRRRRRIGSTLLDVPLSSTPDSEIVDYYNNNSAKRYGLL

SEQ ID NO: 205634 - protein, 149 aa, Glycine max
  Coding DNA Sequence Number=SeqID_88856
  Gene Ontology: Mol. function=phospholipid binding; Cellular component= coated pit; Biological process=endocytosis
  Homolog annotation: Hit_ID=Q8LF20; Match level="QueryCoverage=98%, HitCoverage=25%, E-value=5e-46, Identity=59%"; Hit description =Putative clathrin assembly protein At2g25430
  Pfam annotation: Domain name=ANTH; Domain location=29-149; Score= -102.2; E_value=0.063; Accession=PF07651.6; Description=ANTH domain
  Pfam annotation: Domain name=ENTH; Domain location=29-138; Score= -20.9; E_value=0.002; Accession=PF01417.11; Description=ENTH domain
  Pfam module annotation: Pfam domain module=ANTH::ENTH; Domain location=29-149::29-138
MAPTMIRKVIEVVKDQTSIRIVKVASNMASEMEVTIVKAMSHEDDPVSDKYIRKILNLMSHSCGYIHTCVTAMSKRLGKMREWIVSLKALMLVNKLMNEGPPFFQQEILYATRKGTKLLNMSDFRDERLELMLFDRKSIVAAVNGGSDD

SEQ ID NO: 205635 - protein, 759 aa, Glycine max
  Coding DNA Sequence Number=SeqID_88857
  Gene Ontology: Mol. function=oxidoreductase activity, acting on CH-OH group of donors; Biological process=electron transport
  Homolog annotation: Hit_ID=Q9LW56; Match level="QueryCoverage=96%, HitCoverage=96%, E-value=0.0, Identity=58%"; Hit description =Similarity to long chain fatty alcohol oxidase
  Pfam annotation: Domain name=DAO; Domain location=252-613; Score= -51.2; E_value=0.015; Accession=PF01266.14; Description=FAD dependent oxidoreductase
  Pfam annotation: Domain name=GMC_oxred_C; Domain location=585-752; Score=-31.9; E_value=0.00051; Accession=PF05199.4; Description=GMC oxidoreductase
  Pfam annotation: Domain name=GMC_oxred_N; Domain location=298-531; Score=382.4; E_value=6.9e-112; Accession=PF00732.10; Description=GMC oxidoreductase
  Pfam module annotation: Pfam domain module=DAO::GMC_oxred_C::GMC _oxred_N; Domain location=252-613::585-752::298-531
MRKECHPLLRGGRGDNKYKHGFSTAEMESLTSICEVVLPPLPMDALKIRKEDHDDDDSSNKSLQSFLDISASRYPIPHEPGNYLLLSLYVAEMITKRSLIETVILIRVVLWLLATRLGTLLLCGFLCLGENWPYINKFSNISLEKREKIMQKWLKHRFLTPIRLTFACIKVLCLFVFFSWVDENGDNPAWKAIGYEVPADEKMTNTSNTRPLEKGIIETMNESDSTLQQSLANKGLNVTLDSKSNILKVKCDALVVGSGCGGGVAAAVLSSAGHKVVVLEKGNYFTPQDYSSLEGPSMNQLYETGGILASVDSRVLVLAGSTVGGGSAVNWSACIKTPHKVLKEWSESHKLPFFSSQEYLSAMENVCERIGVTENCSQEGFQNQVLRKGCQNLGLKVDYVPRNSSGNHYCSCGYGCPKGEKQGTQDTWLADAVERDAVIITGCKAERFLLESNRSGNGRKKKCLGVTAKTLNSRITMKLQIEAKVTISAGGALLTPPLLISSGLKNKNIGKNLHLHPVLMTWGYFPESNDSEFKGKVYEGGIITSVHKVPSPDSNSDSRAIIETPLLGPASFAALCPWESGQDFKERMLNYPRTSHLITIIRDMACGQVTTEGRISYKLNEVDKENMKAGLKQALRILIAAGAVEVGTHRSDGQRLKCDGIGENEVQEFLDSVCPMEGALSPGEKWNIYSSAHQMGSCRMGVSEKEGAVDENGETWEAEGLFVCDASVLPSAVGVNPMITVQSTAYCISNRIVDYLRRD

SEQ ID NO: 205636 - protein, 429 aa, Glycine max
  Coding DNA Sequence Number=SeqID_88858
  Homolog annotation: Hit_ID=Q1SKD7; Match level="QueryCoverage=50%, HitCoverage=62%, E-value=2e-09, Identity=24%"; Hit description =Ankyrin
MWVERHENICVKAKASATPNRASRETKTLGQELAGHRHVSGSNVKEVLLGGNLVSFEFMLINYSAIFSEVTVDPKPPFLCFCFHFGTLVHSPQVMAPKKLTTKRPRKDTLGEGSCAIQDFDIHRFRSAEHQQRFEAIKGWRRTQLISPMAKFNPEIVMEFYTNDWPTEEGIRDMHSWVRGQWVPFDTDAINQFLDHPLILEEGQQYEYRQWRDQANGFNEEAIAQLLCTPGQDFARTAAGRRVRIMCTSMTTLTQMWMTLLLNNVLPSDHNSNLPLPKYQLVYAILAGISVHVAQLIVDAIYIFAGMAPTRYPLDPEKSNRALGFPALITGLFQFYGVPVTPSKAADAPPPPRSAASARPLSEEHYLHHVVRQQAANHHGQVQLHECLYHLILSQQGVGPAGAPEVEDEAQEDEDMADLFDLLAGGGAM

SEQ ID NO: 205637 - protein, 78 aa, Glycine max
  Coding DNA Sequence Number=SeqID_88859
MGVRVSGHKLMREFNCFHSSFQLCLFSLAKVSHYLVPPGIGKTMLAKKMLTFYDGAKTIVASALPYYDIGFKGDSKPS

SEQ ID NO: 205638 - protein, 206 aa, Glycine max
  Coding DNA Sequence Number=SeqID_88860
MKIIEESMLIQDRIALSASHVLSTRITTILAKRNKRAQCKGCGAKIWLHLFNGNSLRTWEEVVEKFLKKYFLESKTIEGKVVPNRMTLQLVDRSLIIPYGVVEDVLTIHAYYKMCCGHRKWRLRDKCGGLESHLQLSVFLEEDEVKPVANLADPLSVFPEPRWGRARATLDDPPTVIPPLATTDKPSPSSSQPEQLLPMLQSLHHG

SEQ ID NO: 205639 - protein, 243 aa, Glycine max
  Coding DNA Sequence Number=SeqID_88861
  Gene Ontology: Mol. function=nucleoside-triphosphatase activity; Cellular component=membrane; Biological process=cobalt ion transport
  Homolog annotation: Hit_ID=UPI000068C7DE; Match level="QueryCoverage =88%, HitCoverage=69%, E-value=1e-85, Identity=69%"; Hit description =ABC transporter, ATP-binding protein
  Pfam annotation: Domain name=ABC_tran; Domain location=28-206; Score =156.8; E_value=5.7e-44; Accession=PF00005.17; Description=ABC transporter
MLLEINHVTKDYANHRALDDVSIQIPKGKIFGLLGPNGAGKTSLIRIINQITAPDSGEIWFNGETLGPQHIAQIGYLPEERGLYKKMKIGDQMLYLAQLKGLSKKEALLRIHDWCERLDILSWWDKKIEDLSKGMQQKVQFVATVIHQPQLIILDEPFSGFDPVNANIIKEQILRLNQEGATIIFSTHRMETVEELCDNIALINRSKKILDGSLNQLIEIVPSMSDIFIQKVTQVSPLSQNHA

SEQ ID NO: 205640 - protein, 88 aa, Glycine max
  Coding DNA Sequence Number=SeqID_88862
  Homolog annotation: Hit_ID=UPI00005EF165; Match level="QueryCoverage =86%, HitCoverage=77%, E-value=8e-18, Identity=56%"; Hit description =COG3514: Uncharacterized protein conserved in bacteria
MQRVLRGGAMSKVRFKRSELPPLTDKQQAELDALSRKQDSDIQCDDIAPLDDSFWQAAERGRFYRPVKTQASIRIDADILEWLKAPGK

SEQ ID NO: 205641 - protein, 143 aa, Glycine max
  Coding DNA Sequence Number=SeqID_88863
  Gene Ontology: Mol. function=RNA-directed DNA polymerase activity; Cellular component=integral to membrane; Biological process=RNA -dependent DNA replication
  Homolog annotation: Hit_ID=Q1SLB1; Match level="QueryCoverage=95%, HitCoverage=27%, E-value=6e-14, Identity=34%"; Hit description=RNA -directed DNA polymerase
MGFGGKLLVWMCNLLQSSSIFGLVNGSPTEEFLAQKGLRQGDLLAPFLFLVVAEGLCRLVREAKARGPFPIIDIGNGNLKIPFLQFGTMPFFLLQRGHDGNHHLKNLAKVLNCTVMTVSFAYMVLPVGVMLGRLVHGNQLLTR

SEQ ID NO: 205642 - protein, 84 aa, Glycine max
  Coding DNA Sequence Number=SeqID_88864
MLHLSNPKKKSLSLHGGALISVAYLAVIVNTNICSWVTHSDLHCAVTCTGKWHVSLTSTWPRDAIRVSVAFTMQSHALVICMQA

SEQ ID NO: 205643 - protein, 53 aa, Glycine max
  Coding DNA Sequence Number=SeqID_88865
MSCLCLRLLRVLFWHLKHMQGANGGGAIRQAVTCDLGVASESGDLAFMLVSPS

SEQ ID NO: 205644 - protein, 142 aa, Glycine max
  Coding DNA Sequence Number=SeqID_88866
MERKIVYFDHQHQTRIWVSLGEEEEKRKSFPCKWKILIVRIKKGFMRKIALTSALLKTYSPNGVVLKLIAQGGRGAIGACALQVAREKNLAVINGASSTPVLLHSSYFLFHRPSCLLLELASLLPSFACSSFLLGFVAVANW

SEQ ID NO: 205645 - protein, 214 aa, Glycine max
  Coding DNA Sequence Number=SeqID_88867
  Gene Ontology: Cellular component=nucleus; Biological process =regulation of transcription, DNA-dependent
  Homolog annotation: Hit_ID=Q1SAU7; Match level="QueryCoverage=96%, HitCoverage=24%, E-value=1e-48, Identity=50%"; Hit description =Paired amphipathic helix
  Pfam annotation: Domain name=PAH; Domain location=1-32; Score=6.9; E _value=0.96; Accession=PF02671.11; Description=Paired amphipathic helix repeat
  Pfam annotation: Domain name=PAH; Domain location=181-212; Score =16.9; E_value=0.07; Accession=PF02671.11; Description=Paired amphipathic helix repeat
  Pfam module annotation: Pfam domain module=PAH::PAH; Domain location =1-32::181-212
MEAKSIAEVYKEVAALFQDHVDLLREFTHFLPDTSGTANNSLLHDRTTIRQMHVEKLVTKLTLNLSLRQKERNIASHGDRDLGADHPDPELDRCLIRADKDQRRRDEKEKDSRDYDHDGISHKRKSGCRAEDSGAEPLHDTDENFGMHRISYACEDKSSLKSMYSPVLGYLDKVKDKLRNPEDYQEFLKCLNIYSKEIIARHELQSLVWFIHLI

SEQ ID NO: 205646 - protein, 55 aa, Glycine max
  Coding DNA Sequence Number=SeqID_88868
  Gene Ontology: Cellular component=nucleus; Biological process =regulation of transcription, DNA-dependent
  Homolog annotation: Hit_ID=Q1EP20; Match level="QueryCoverage=78%, HitCoverage=3%, E-value=2e-13, Identity=81%"; Hit description =Transcriptional repressor protein-related
MTSGGGQKLTTNDALAYLRAVKDIFQDKREKYDDFLEVMKDFKAQRCHSKSEGAV

SEQ ID NO: 205647 - protein, 39 aa, Glycine max
  Coding DNA Sequence Number=SeqID_88869
MTHGRPIGDQVQGQRTHLVAHDPGNLNKTSASSEGSKIP

SEQ ID NO: 205648 - protein, 169 aa, Glycine max
  Coding DNA Sequence Number=SeqID_88870
  Homolog annotation: Hit_ID=Q2HRE1; Match level="QueryCoverage=79%, HitCoverage=42%, E-value=4e-16, Identity=46%"; Hit description =Lipopolysaccharide-modifying protein
  Pfam annotation: Domain name=DUF821; Domain location=3-163; Score= -189.6; E_value=2.3e-09; Accession=PF05686.3; Description=Arabidopsis thaliana protein of unknown function (DUF821)
MFLKIKIGMLVYLPRIGFENHKRGSTNQTCQVNALIDIRCTLKVLLGQHIKLARCMASDFIQEEVKMDYVYDYIFHLLNSYAKLFRYKPSISANATELCVESMVCGAEGSVKKFMMESLVKVPANTDPCTMPAPFDPPTLYSTLQRKESSIQQVESFEKSCWDNQTITS

SEQ ID NO: 205649 - protein, 51 aa, Glycine max
  Coding DNA Sequence Number=SeqID_88871
MPKIITHKWKFGNLLEAPNTLPMKSLFVTKLESNEVLLSPIALKVVWPLAS

SEQ ID NO: 205650 - protein, 379 aa, Glycine max
  Coding DNA Sequence Number=SeqID_88872
  Gene Ontology: Mol. function=transferase activity; Cellular component= fatty acid synthase complex; Biological process=fatty acid biosynthetic process
  Homolog annotation: Hit_ID=UPI000038DDD6; Match level="QueryCoverage =99%, HitCoverage=24%, E-value=9e-89, Identity=45%"; Hit description =COG3321: Polyketide synthase modules and related proteins
  Pfam annotation: Domain name=Acyl_transf_1; Domain location=63-379; Score=214.4; E_value=2.6e-61; Accession=PF00698.11; Description=Acyl transferase domain
MHDFLVENKDVNLGDVAYTLQVGRQPFAHSTVVVGQDRETLLEKLNQPSANISTLTKGDKAVVFMFPGQGNQYINMARELYATYPKFREVMDRCCRYLDPILGVNLLSIIFQGDEGLRKNRINETQFTQPALFIVEYSLAQLWMSWGIKPDAMIGHSVGEYVAACIAGVFSLEDALRAVALRGKLVQALPAGAMLAVLMDEESLRQRLQGDKLEIAAVNYPGLCVVAGDLDEIEVFQRQLEDNNVFCKHLDTSHGFHSYMMEPALPAFKEVIDGIELHAPKIPFVSTVSGDWITDALATDSDYWVRHVRNPVLFSHAFKTLMSEEHQHYIFLEVGPGRSLESAAKQHFKADESALIYSSLPTAKDVELTGEYLLTSLGC

SEQ ID NO: 205651 - protein, 70 aa, Glycine max
  Coding DNA Sequence Number=SeqID_88873
  Subcellular localization annotation: CTP_CleavageSite=46; ConfidenceScore=5.19e-01
MAAKSTKPSTFGKRTTPKINKASISANGPHFSWLAISLALPSKYFRAAILLKEGRKPEKKYGFLPPKRAS

SEQ ID NO: 205652 - protein, 107 aa, Glycine max
  Coding DNA Sequence Number=SeqID_88874
  Subcellular localization annotation: CTP_CleavageSite=65; ConfidenceScore=5.21e-01
MLIAAIVTALASIIFFMLIMAFIIVAIFSFMVSISAFTFSCTSSALPITLALAQIFNMVHDIFVKVKLEVTGTSTALNVFGSRRSSDVTRSIFCPNFLQDGYFHTST

SEQ ID NO: 205653 - protein, 80 aa, Glycine max
  Coding DNA Sequence Number=SeqID_88875
MSGPERKASFEHSNIFKVTAPEARPGQLRTGAHRRQKGRADRCTPEADRSTQPKDWVICAPAAFLGCGSRFSGSLSGIEP

SEQ ID NO: 205654 - protein, 154 aa, Glycine max
  Coding DNA Sequence Number=SeqID_88876
MDNSESLFHSENYNGHLLHQPFIDAGQQYFFQSLQLKNDGDAYTVLMCNEQYSCVDPVELLCNINRILDGILNLLQSTITPTHDAILYYKGKWNIPRQGGFLGYSFTRTNPIRFDISSGCSMDKLKDILKQDAPMGVFPYGIHESQVVKRLFFR

SEQ ID NO: 205655 - protein, 279 aa, Glycine max
  Coding DNA Sequence Number=SeqID_88877
  Gene Ontology: Mol. function=DNA binding
  Homolog annotation: Hit_ID=Q1RUD8; Match level="QueryCoverage=58%, HitCoverage=38%, E-value=5e-16, Identity=32%"; Hit description=IMP dehydrogenase/GMP reductase
IPDLARVEVSMEPIASLSQYYDQPLRCFTFEDFQLVPTVKEFEEILGCPLGGRKPYLFSGFYPSTTRVAKYQGSVWRKGKRPWQIKANGLSFIDILALLIFRVVLFPNMEGLVDLAAIDAFLAFHHGKESPVVAILAMYDTFDRGCEKSSARIVCCALALYVWLVSHLFLQEGRPVYPLQGHRSCVEKGKANWDQLLASMEGRLLIGSLARRKEESGFYLHAKDKCHQTKASRLSSHGVSVTTTRGYSKEFARHGMRREERTDSLGEAVMGASAAIISG

SEQ ID NO: 205656 - protein, 55 aa, Glycine max
  Coding DNA Sequence Number=SeqID_88878
GHYQSRPRAGHYQSRPAAGRYQTRPRQGRYPAAVSCVALCHVSRAPWKRLPGGAL

SEQ ID NO: 205657 - protein, 259 aa, Glycine max
  Coding DNA Sequence Number=SeqID_88879
  Homolog annotation: Hit_ID=Q1STZ2; Match level="QueryCoverage=40%, HitCoverage=22%, E-value=3e-11, Identity=35%"; Hit description=IMP dehydrogenase/GMP reductase
MGSSQKPSLKKRFYQVKIKSLEVTSLRELGQLMGQLQRQAFRKAYGKIWDLARVEVSMEPIASLSQYYDQPLRCFTFEDFQLVPTVKEFEEILGCPLGGRKPYLFSGFYPSTTRVAKSEYQGSVWRKGQRPWKIKANGCPNVPLMGTREEGRIRILSSCEGCPNVPLMGTRVTTTRGYSKEFARHGMQREERTESLGEATVRDDEVKASEESDEVQALKAELERAWVVEEKFKVAIVSSSSEEVKGIITGQGHDLERTS

SEQ ID NO: 205658 - protein, 73 aa, Glycine max
  Coding DNA Sequence Number=SeqID_88880
MVKLPIISPKHPIPMKSCEKEVYPNMKFEVPQRRGALHDSENCFLSRFGAEMVCKGWSFDGASMVRKMKGIAT

SEQ ID NO: 205659 - protein, 76 aa, Glycine max
  Coding DNA Sequence Number=SeqID_88881
MVISFHSDVRFRIEAHDISRGSKLKNGSSQEIQIVITFHSDVRFRHIIYRDAPNEHEGSGPIQTAVTFDMDYNCGR

SEQ ID NO: 205660 - protein, 61 aa, Glycine max
  Coding DNA Sequence Number=SeqID_88882
MRMSATRCFHLPACLWYCGVLTIGSCVAYLPNGIRVASQTHSIQASLLGTLEDFKVPHVNH

SEQ ID NO: 205661 - protein, 73 aa, Glycine max
  Coding DNA Sequence Number=SeqID_88883
MKQAGVGEAIIDGVGVGIGGIQMLGHDLQGNRLVTPLAIEAKGSRYVALIAPDVDKSSSLNRFVAWLEREASA

SEQ ID NO: 205662 - protein, 260 aa, Glycine max
  Coding DNA Sequence Number=SeqID_88884
  Gene Ontology: Biological process=cell redox homeostasis
LLAVIPGWSLYQDKQVSFSAGCIKENRLTAPLGSASTNDYYARAEQQRHFWRDWHDGQQWDRVQSELLQRYQAQFGESVKYYAIDQGNWPPMAISQHWHNGVWYFFTLGMSIRPMPQVDYLFDELAPQYRRVELAMAVDGEVMTEANAVQMASALAEFAHLPWARLTWIGEGHTLASEVAPVGFESFLLANGLAGENAQLRLPKRDGDRPNLLWATPITEAERLFAQADDRGGQQLLQRLLAQGSDHVFRPRQEVVESAP

SEQ ID NO: 205663 - protein, 119 aa, Glycine max
  Coding DNA Sequence Number=SeqID_88885
  Gene Ontology: Mol. function=transition metal ion binding; Biological process=aromatic compound metabolic process
MFSKILSPLPTIEKAFNGSQEHESASIPLTSQQVLEQVEDINTIFGKTQKKEKSKTCIWKKRSISFDLSYWFDLDVKHCIDVMHVEKNVCDNVISVLLKIQRKTKYGLNTCQDLVEMGI

SEQ ID NO: 205664 - protein, 305 aa, Glycine max
  Coding DNA Sequence Number=SeqID_88886
  Gene Ontology: Mol. function=ATP binding
  Homolog annotation: Hit_ID=Q8PB17; Match level="QueryCoverage=81%, HitCoverage=54%, E-value=4e-81, Identity=61%"; Hit description=Heat shock protein
MGDVGGAAADIDDHRLVPLAAFGVVMHGRRGRFLEEIDLVEAGLGGGLAQDVQRLVVAGRTDRTAELHRTAKQGRAQRLAELGAGGQADVFENVRGDTGDGLLRTRVQVVAQHRLRALHQVAFVFLEIGFQRVIAVDRVLQQVAGAAFLAGAGFHPFPAQRAQGFAAQCLWRAFLAGGTGCARGAVDHLLQLVFLAVIELEVVRIGHHAGEIHAGAELLGIAEADRQQFSLMHDGGGGVAGTEVDAEAHGEFRGRSGAAHSVAVRRRLQVPAGVLFWSGSSGQPGARPEKGRGSRPVTMAAVDSL

SEQ ID NO: 205665 - protein, 60 aa, Glycine max
  Coding DNA Sequence Number=SeqID_88887
MAEMRCWADPTQPYPITYCKSAAHNRENAQNTARTKHSTQRRPAAINGSDTRTRTRPAAQ

SEQ ID NO: 205666 - protein, 261 aa, Glycine max
  Coding DNA Sequence Number=SeqID_88888
  Gene Ontology: Mol. function=nucleic acid binding; Biological process= transport
  Homolog annotation: Hit_ID=Q8H6Q8; Match level="QueryCoverage=45%, HitCoverage=3%, E-value=2e-22, Identity=45%"; Hit description=CTV.20
  Pfam annotation: Domain name=MP; Domain location=80-250; Score=41.5; E_value=3e-09; Accession=PF01107.9; Description=Viral movement protein (MP)
  Subcellular localization annotation: CTP_CleavageSite=25; ConfidenceScore=5.33e-01
MRAKILENIIIMSRLLRSFSRISFRSNSSSSSSSRNSNLLNDQDNQTQEVAPKHNLFDEEVRFKDINQNMDDWNIPEIPQDQLYVPETIKDKHNFDYIIKTVENNIPLGQDVGEEFHLLSKNSIYEHSRKYKYLHIGCVQVAIKPLIDMGIDAAVLMCLRDIRHNQFEDSLIGTVETSLGQGPIYFNCYPNKTVSLMDRNILDSLFLNIHFHGLDMKEGSIPAALIYRIQYKIMNTCASRVLLKPQKGETTLFITDMMKAN

SEQ ID NO: 205667 - protein, 110 aa, Glycine max
  Coding DNA Sequence Number=SeqID_88889
FAKRNLQWLSARKHPEEDELSSLLSAPLQICAKRTSTNKATYLSLKSDLQGEFGTFLEKLCMHKGSRERKPRGEGDILTTCVFAVFHLVLLFVVKEVSGLWKAKSSVGSS

SEQ ID NO: 205668 - protein, 139 aa, Glycine max
  Coding DNA Sequence Number=SeqID_88890
MEAMKDQMTTMMEAMMSMRKMMEVNTTAVTATSTATEVDSTHPVLDMVGQGGEALGSTGGPHFVQVQSKHPFLPYGLPPNYASPNVAHTLDKNVNNSAPIHLPNTLGSLSIAHNHNYNPYILWWEDYLLSWWKGKNSMI

SEQ ID NO: 205669 - protein, 108 aa, Glycine max
  Coding DNA Sequence Number=SeqID_88891
MENEQFPIEQTWRSTQEHRSLEQTTDELYSHSSERSYNAQWNALEIPHDKHMLHSSCILGKMEAGFVADLGVAFVDDWVFLADRVVGNENGWYWLSIDIVELVGNMAM

SEQ ID NO: 205670 - protein, 251 aa, Glycine max
  Coding DNA Sequence Number=SeqID_88892
  Gene Ontology: Mol. function=RNA-directed DNA polymerase activity; Biological process=RNA-dependent DNA replication
GGHVPLQSSCEDFRAWSDSCMLTHLPTYDAQYTWTNGRRGSSCIDMRLDRSIGNDECLAFLQSIAYCTLTKLHFDHHRLLACCLGGLAATVFWMSYLGSWQRLKALKLAQKSWNHTVFGDVHNNLNKVLVDVDSIQRLIESNPDDDALRDQEINAQMGVVQFFNSGHIFPNWNSNLVVLIPKVSDCLCTASEAVNMLRYKAFRGNLMMKFDDVLSWGISLLVKKGVLQPLTGPKGTQTPSYSLFADDITVY

SEQ ID NO: 205671 - protein, 192 aa, Glycine max
  Coding DNA Sequence Number=SeqID_88893
  Gene Ontology: Mol. function=RNA-directed DNA polymerase activity; Biological process=RNA-dependent DNA replication
MANWLRIPQSLQQLYPTLMNEIQQVVIPISQLEDQIVWCPATSGMVTVSRCDYCKAHLESSEHLFLTCPFAKHIWQWLSQTFRKPPDLSSPKDLIASISHSISRQAQNVMISAIIKSLCFLWRTQNLARFHNGSRSMQFNISLIYDEGNVCVDRLANLDLTVSGFNWRNSIPIVIKEQFYRDRLGLPSYKFD

SEQ ID NO: 205672 - protein, 239 aa, Glycine max
  Coding DNA Sequence Number=SeqID_88894
  Gene Ontology: Mol. function=transcription regulator activity; Cellular component=nucleus; Biological process=regulation of transcription
  Homolog annotation: Hit_ID=Q1SJ81; Match level="QueryCoverage=93%, HitCoverage=62%, E-value=6e-59, Identity=57%"; Hit description =Aldehyde dehydrogenase; Helix-loop-helix DNA-binding
  Pfam annotation: Domain name=HLH; Domain location=164-212; Score =41.8; E_value=2.4e-09; Accession=PF00010.16; Description=Helix-loop -helix DNA-binding domain
  Subcellular localization annotation: CTP_CleavageSite=59; ConfidenceScore=5.21e-01
MAGFATMKGVGNYGAVNGSNGELSPCINRLKNQVSFSPRNASSLGMLSQISELGSEDIEATSPDDDTKHGGNDTQHYGPGFPFGSWNDTPQLSENISGLKRGRSGNEKMFSDVQNGELANQVNMLSHHLSLPKTSAEMITMEKLLQFPDSVPCKIRAKRGCATHPRSIAERVRRTRISERMRKLQELVPHMDKQTNTADMLDLAVEYIKDLQKQFKTLSEKRANCKCISMPKADTNQIA

SEQ ID NO: 205673 - protein, 109 aa, Glycine max
  Coding DNA Sequence Number=SeqID_88895
MVGAYGLGDLSPQQVGYTPTLGGQSSYMPSYEPPHTHTIALTVGRQVHTTPSMGNSGPTWTDARTTAPTTIDPNVIADVIQKYFGVQLKPIVKPMYKKPYPKWVHKMTP

SEQ ID NO: 205674 - protein, 84 aa, Glycine max
  Coding DNA Sequence Number=SeqID_88896
MLPFDFRCVTETYGLCINIFFWFSGMSWNFTNCLMMGAKHLTRTKERSHVIKQRSPDEIRRKMQGSCMQTCENRMYAVGRTTTC

SEQ ID NO: 205675 - protein, 150 aa, Glycine max
  Coding DNA Sequence Number=SeqID_88897
MGEVEEIQEKMKADMEAIKEKMATMMEAMMSVKKIMEANAVAIAATSVVAKVNPTSPSGLKQMNHPTSNMVGKDLGKTHEIPHHNLADFEPWLEYATEGQVVGGIPLENTSEGPQYHPQPQPSCSTAVKNPHDYGRNGKGGSSKGKAQGH

SEQ ID NO: 205676 - protein, 109 aa, Glycine max
  Coding DNA Sequence Number=SeqID_88898
MDWFFRILHPFVTRTEETAAPRHPPPLHHKEFVKPPIPEVSVATDLPTHSVVHCEGCQGMAQDLGAIVEDLERVINLRMVTEGTDLHDIMTRCLRRARGDTADGSLRPR

SEQ ID NO: 205677 - protein, 78 aa, Glycine max
  Coding DNA Sequence Number=SeqID_88899
MCVPSTLPSSSSTASMADIAIMTRFLLLRRPTDWGPILEDYTSDDNEEEDPSEDLSNVKESSGIKEDPSEDSSFFLEA

SEQ ID NO: 205678 - protein, 142 aa, Glycine max
  Coding DNA Sequence Number=SeqID_88900
MAIHIEAIPGVEEQTMNENERNVAKKKRSKYINFPIDSLGISKLENKIKCILLGKKNKNAQYKYDEGATLIVDHKEDRFHPTIEVSNPTWDYSVDEPHQPLEKLHSFPEAPSLGSIQIGKGLYPWRMLKGRVILSILENDMC

SEQ ID NO: 205679 - protein, 64 aa, Glycine max
  Coding DNA Sequence Number=SeqID_88901
  Subcellular localization annotation: CTP_CleavageSite=44; ConfidenceScore=5.26e-01
MRLHYHQASRRPSKTTHQPPLPMSPLTQDGVARFKGASSKEVKRAGVATNVYSRKTLEKLKRGL

SEQ ID NO: 205680 - protein, 216 aa, Glycine max
  Coding DNA Sequence Number=SeqID_88902
  Gene Ontology: Mol. function=nucleic acid binding; Biological process= DNA integration
MKKTTKQAQPQEHFQTRNSDQATHIQQWTQETNQSLQGEHWETMPCVDHEDPYTHLSTFCELCGTMGILEGEEEALYFRLFIFSLTGKAKAWLQSHPNQSLMSWSVVEEKFLNRFFPPSRNISAKYDISTFGQGPEEPFCEAWERFKSLLIKCLNHGFEDVAQLSIFCNSLRPETKMIMDVVVGRTMMSVDAEQATRIIDAFASTDHLAQHNRQLV

SEQ ID NO: 205681 - protein, 102 aa, Glycine max
  Coding DNA Sequence Number=SeqID_88903
MSDIFRCDFCGGDHPNGQCSLQEEVNYMTNQGRLGNFNFQQTLNQILRSTTRQLLQVEGFLGKVLMINGLQRNKWLEASWMWVFLILMCKQGKTIFWLHGNL

SEQ ID NO: 205682 - protein, 240 aa, Glycine max
  Coding DNA Sequence Number=SeqID_88904
  Subcellular localization annotation: CTP_CleavageSite=37; ConfidenceScore=5.44e-01
MKMNMNLGSLISSQISLIAQSNSSQLGFSTLITTLFKAGGVTSDSLTFESLNSATNLAYIKKNCWNLDEPSVTFPGTQKSRARRSEAPSTLAAPAPPTLAPSTSAVPSPSAAPVLPGPSTQSSEPFMSMLQSLHQGQLLIMQSLQDMEPQPDQEDDILEASEPTPLEPFIFETDPVAATPQVTPEPSTIVLDMSSSQPESSAPVPDLPLSQDSPSGTTALDLNEHAMDSAQDHDFYFHAF

SEQ ID NO: 205683 - protein, 164 aa, Glycine max
  Coding DNA Sequence Number=SeqID_88905
  Gene Ontology: Mol. function=nucleic acid binding; Biological process= DNA integration
  Homolog annotation: Hit_ID=Q1T010; Match level="QueryCoverage=72%, HitCoverage=8%, E-value=6e-31, Identity=53%"; Hit description =Peptidase S8 and S53, subtilisin, kexin, sedolisin; Integrase, catalytic region; Zinc ...
  Homolog annotation: Hit description=finger, CCHC-type; Peptidase aspartic, catalytic
MASPNSIVQGSLPVFDGKLFDNRRIKMFAIFGFQDVAEIFNKISKATTSKEAWDILEKTYEDGEQNKKIKLQTLRRKYELLTMEDKESVADYFDRIQELVNAMRACKEIISYQQVVDKILRTFPPRFHHVVVAIEESKDLDIMQIEELQHSLEAHKMRIDNCEI

SEQ ID NO: 205684 - protein, 260 aa, Glycine max
  Coding DNA Sequence Number=SeqID_88906
  Gene Ontology: Mol. function=acyltransferase activity; Cellular component=endoplasmic reticulum; Biological process=metabolic process
  Homolog annotation: Hit_ID=Q2Z1Y8; Match level="QueryCoverage=71%, HitCoverage=47%, E-value=2e-86, Identity=85%"; Hit description=1 -acyl-sn-glycerol-3-phosphate acyltransferase
  Pfam annotation: Domain name=Acyltransferase; Domain location=2-143; Score=19.3; E_value=7.1e-05; Accession=PF01553.11; Description =Acyltransferase
MGKEHALVISNHRSDIDWLVGWVSAQRSGCLGSTLAVMKKSSKFLPVIGWSMWFSEYLFLERSWAKDESTLKSGIQRLSDFPLPFWLALFVEGTRFTQAKLLAAQEYATSTGLPVPRNVLIPRTKGFVSAVSHMRSFVPAIYDVTVAIPKSSPAPTMLRLFKGQPSVICRSRKLILTRAACRSLPDWAKEQEGRFTDGFEDCRSFTSVSICSFVNERSPGEDCWPWTSLMAVEFYGFFTSPARCPSFPFSSTTSFTVCAY

SEQ ID NO: 205685 - protein, 57 aa, Glycine max
  Coding DNA Sequence Number=SeqID_88907
MVLVLKEQWEAKAARRRRDLERREEERKRFAMREDAIELRLQKWVKNREPFDVSLRR

SEQ ID NO: 205686 - protein, 73 aa, Glycine max
  Coding DNA Sequence Number=SeqID_88908
IALSSHSAWLQLEGGGHMIENASHGAPKKAITTHGSKLEGGGHMNENATHRAPKRLRMENCAKQSLRMAPNSK

SEQ ID NO: 205687 - protein, 126 aa, Glycine max
  Coding DNA Sequence Number=SeqID_88909
  Gene Ontology: Mol. function=electron transporter, transferring electrons within the cyclic electron transport pathway of photosynthesis activity; Cellular component=plasma membrane light -harvesting complex; Biological ...
  Gene Ontology: Cellular component=process=photosynthesis, light reaction
  Homolog annotation: Hit_ID=Q9TM47; Match level="QueryCoverage=99%, HitCoverage=52%, E-value=3e-46, Identity=57%"; Hit description =Photosystem II D2 protein (Photosystem Q(A) protein)
  Pfam annotation: Domain name=Photo_RC; Domain location=1-126; Score= -58.9; E_value=0.00087; Accession=PF00124.9; Description =Photosynthetic reaction centre protei
MDWQVLIWKAATFLTAAVSTPANSLAHSLLLLWGPEAQGDFTPLSGWFFAPSFGVAAIFRFILFFQGFHNWTLNPFHMMGVAGVSGAALLCAIHGATVENTLFEDGDGANTFRAFNPTQAEETYSM

SEQ ID NO: 205688 - protein, 71 aa, Glycine max
  Coding DNA Sequence Number=SeqID_88910
MNTEDINNYMQCALFEKTRNKVIVNLSTVNFSAVGLIEKLNNDLHKNVRHDPTLTVEMEQDYESEELDSHI

SEQ ID NO: 205689 - protein, 127 aa, Glycine max
  Coding DNA Sequence Number=SeqID_88911
MAAEWRRKRERRRLFKEKMSLEEAHHHRRPWIRAWRKKEMNEGRGREEHEILCSKRALKSESNIYKDNWTQPWPVGSEIYHEVHENPRAFFSSSSLILLEPLAHGSSDWSLPREDCIRYTLALMGIG

SEQ ID NO: 205690 - protein, 100 aa, Glycine max
  Coding DNA Sequence Number=SeqID_88912
MGCTHGPEIYPKAHKNPRAFSCISGPIYLEFSIQCPCGVGLHHRGCTVVSIFPLCNHSKGRMAHFMIEFTILKVFVVDIHPYKPFLVKWVNWFPPILCDT

SEQ ID NO: 205691 - protein, 67 aa, Glycine max
  Coding DNA Sequence Number=SeqID_88913
MKYRSLLQKDMIKPMLLRLKLPRLQMKLLSSEQHNKQEEIPKVSPTVSNVAKDDEVIPTGPSELASK

SEQ ID NO: 205692 - protein, 159 aa, Glycine max
  Coding DNA Sequence Number=SeqID_88914
MVELTLPGDSTAEVAKVRAGSQSAPLFADNKPDTSEKRRQMHPSLSRKFSSYVLPTPVHEFPRPLTSFPSNSRLLGLVGHSSPLVSRGQKVSTANNLVASSAASPLPMPPQPMALSFSIPSSGTRVAALHMPRTLESSLDFTLNCLSLDKDKMEMRIRT

SEQ ID NO: 205693 - protein, 112 aa, Glycine max
  Coding DNA Sequence Number=SeqID_88915
MEPHGDHCSKKERSEIPWLATWSATISRVYCATSIGTIRELGPVSQTSERLISCVLGEAVKGVKSCWGDFGDNGVGGLTLGKAVYGLLEAVGGGLPSVMFHHDGGKSDQNDR

SEQ ID NO: 205694 - protein, 227 aa, Glycine max
  Coding DNA Sequence Number=SeqID_88916
MNVGYLISHQMSLIAQHDTSRLGFPALIIALCKTRGVQPDSRSLESLSPAINLAYIKKNCWNLDDPTVTFRGPRKARGKRSEAPSTSAPSEAPTPSSSLVPPSSSTQILVIPPTPLQMPLPAPSSTRPLDFLITPQMLHSMMQRDQPSSSGGGGASAADELDTEEPLAPAHVEEETTPDQTPQPCPAPAHIPEDAAPVAESEQLIQDSSAAPTLDLNEDQPQEEKDV

SEQ ID NO: 205695 - protein, 50 aa, Glycine max
  Coding DNA Sequence Number=SeqID_88917
MAGQNWKKVMLMGLEGVQLNEGLWKKMVRMHKTGVFESHMLDQFNLSNGR

SEQ ID NO: 205696 - protein, 121 aa, Glycine max
  Coding DNA Sequence Number=SeqID_88918
DLDKLVQLCIRVEQQLKRKPSSKSYGSHSYLRKDQAHGILGDSSIDIAIVKEFYANLYDLKDKSPKQVRVRGHLVKFDEDTLNTFLKTPIILEEGDVEAKLHGESKVIQRCFDDNNDDNKR

SEQ ID NO: 205697 - protein, 242 aa, Glycine max
  Coding DNA Sequence Number=SeqID_88919
  Gene Ontology: Mol. function=RNA-directed DNA polymerase activity; Cellular component=intracellular; Biological process=RNA-dependent DNA replication
LGIYEPVEHNNPALSPNYESPVYEAEEEEDDEIPKELARLLEYEKKTIRPHEEVVEVINLGTEEDKKEVKIGASLEATVKRRVIELLKEYVDVFAWSYQDMPGLDPRIVEHRLPLKPECPPVKQKLRRTRPDMALKIKEEVQKQIDAGFLVTSEYPQWLANIVPVPKRDGKVRMCVDYRDLNKASPKDDFPLPHIDVLVDSAAKSKVFSFMDGFSGYNQIKMAVEDREKTSFNTPWGTFCYR

SEQ ID NO: 205698 - protein, 79 aa, Glycine max
  Coding DNA Sequence Number=SeqID_88920
MAAARHPTPKRDPSTSERGPDHQMQIDCRDLRLDRNPEYAQLGPRGPLTAYARSEPAIPVLMKASNIVFASSRTETCVE

SEQ ID NO: 205699 - protein, 141 aa, Glycine max
  Coding DNA Sequence Number=SeqID_88921
  Homolog annotation: Hit_ID=Q8KKU1; Match level="QueryCoverage=99%, HitCoverage=38%, E-value=2e-63, Identity=82%"; Hit description =Hypothetical conserved protein
MPALGGASADPLRFLDFLIREPVRTILLHRSGIPVVVPDPTRYAVHKLIVASRRHTDGQGSAKREKDLRQAALLFEALQQTRRSADLALVYNEAWERGPAWQEAIRVGAGMLPEPDADRLKAVLIDGAKKNREDVELPFGE

SEQ ID NO: 205700 - protein, 286 aa, Glycine max
  Coding DNA Sequence Number=SeqID_88922
  Gene Ontology: Mol. function=monooxygenase activity; Cellular component=intracellular
  Homolog annotation: Hit_ID=Q4KAL2; Match level="QueryCoverage=87%, HitCoverage=57%, E-value=1e-67, Identity=51%"; Hit description =Monooxygenase, NtaA/SnaA/SoxA family
  Subcellular localization annotation: CTP_CleavageSite=17; ConfidenceScore=5.00e-01
MPGQSGRATARRAVLPRCGTPRRAGVPGLRVPAGCLVPGRAGADARAGLQQPGSDAADGGAGAGYAAYRPGDDSRDLVQSALRGGAPAAIAGLDQRRTHGLEHRHRVGRQPEFRRCTNAAFGAALSQGARVHRSLARVMAQLSAGGGAGGPRVRAVRGCHAYRADRASRRVFQRPGSPECAWSRPRPHSPVPGGRVRLGARLRRPRGGCGVRRYARYRMRRGVAPGLAAAGARPWPRARGHTGAAGVEPVSGGVAGPGPGFASRGPRGPRPGTPAPVLFNGAGPGS

SEQ ID NO: 205701 - protein, 54 aa, Glycine max
  Coding DNA Sequence Number=SeqID_88923
PRRAPDPVAPRGAVGESGCLGNAAPIGREADGGRRCVPVGCGTVRAGPPIDSGH

SEQ ID NO: 205702 - protein, 76 aa, Glycine max
  Coding DNA Sequence Number=SeqID_88924
MPGEKDSVGDSLDITLVALFQKQTRYPSGISLTPQCNPLHEPTRWDGSEADIFHQLKVFQIVRRNMKKIIKIVVAS

SEQ ID NO: 205703 - protein, 123 aa, Glycine max
  Coding DNA Sequence Number=SeqID_88925
MATAKWALKHPVYGIVILRLGIYTNRPNVSKLCSFINSMNSSILISDDVPKWQNSTRFWNKTKDSIQMINDGTYEFGDPTVMWLRMPPDSWVMVTKGGVVDKSRAFAPTYPQFVIRNLDLRSS

SEQ ID NO: 205704 - protein, 101 aa, Glycine max
  Coding DNA Sequence Number=SeqID_88926
  Subcellular localization annotation: CTP_CleavageSite=44; ConfidenceScore=5.59e-01
MAKPSSPANLASAIICFFASKKFPHRLKASPGRFARQNPSPHPSVMVHVHGFFKVLTIGSCVAYLPNGIRVASQTHSIQASLLGTLEDFKVPHVNHVSRPS

SEQ ID NO: 205705 - protein, 121 aa, Glycine max
  Coding DNA Sequence Number=SeqID_88927
MEILGSSSGTSNDGERDDHNDSRHITNVLQWKNGGLHTFKLCGFGLHQRKDRSGSEKRQNAKTEANEEDEGETLAVTAIPTRPNFPSAQQYHYSANNCPSHPIIDKGIPKEATRHVCLPHA

SEQ ID NO: 205706 - protein, 196 aa, Glycine max
  Coding DNA Sequence Number=SeqID_88928
MKADLEAMKEQMATMVEAMMSMKKIMEANAVTVAATSTVAKVNLMPPSDLNQMNHPTSDMHAFPPYGSTPKEDVNNSAPILIESQQPQSDQTHVSQTMGETHEMPHHNLADFEPCLGYATEGEGVGGIPMSNTLEGPQFRPRPQPLHFAVGRAPPAMAEKGKLDHIEERIKDIEGGEDYAFDNLEELFLVPKHGHS

SEQ ID NO: 205707 - protein, 57 aa, Glycine max
  Coding DNA Sequence Number=SeqID_88929
MHIQEVNSRGVGGVSIARYRPSQCYCGISPCACLGAQYFLDESSISKGPDGPLMEVT

SEQ ID NO: 205708 - protein, 166 aa, Glycine max
  Coding DNA Sequence Number=SeqID_88930
MLYSTTLILAGLSCISSHAVSTDTHHDVPADFANATSTQGDEFGSATTYTAYSATPLVKTPAGYGPESSGTQTASTMNSFEWLESTATMTSTAADNLTPYSNYPAEYPVSSTDVKFETEFKSVATYTASDLQTTSTFSAPEPTSSLSIPSTSRGGPVPAFVPFSEG

SEQ ID NO: 205709 - protein, 71 aa, Glycine max
  Coding DNA Sequence Number=SeqID_88931
MAGLRLSKDMEFDVTPLALHKVVIKAGMLGNDRNLVGDECDVRRVEGRDQVGVRKNTPSMSECGHVLPEDL

SEQ ID NO: 205710 - protein, 79 aa, Glycine max
  Coding DNA Sequence Number=SeqID_88932
MASKNRKALATPSQVQYDRSRFTSPKTWERYTDIVVRVRGHLVKFDEDTLNTFLKTPVIIEDGETLSAYSRFALLRPDP

SEQ ID NO: 205711 - protein, 361 aa, Glycine max
  Coding DNA Sequence Number=SeqID_88933
  Gene Ontology: Mol. function=hydrogen ion transporting ATP synthase activity, rotational mechanism; Cellular component=proton -transporting two-sector ATPase complex; Biological process=ATP synthesis coupled proton transport
  Homolog annotation: Hit_ID=Q8RZF8; Match level="QueryCoverage=88%, HitCoverage=81%, E-value=1e-115, Identity=58%"; Hit description =Lustrin A-like
  Pfam annotation: Domain name=DUF231; Domain location=201-358; Score =242.0; E_value=1.3e-69; Accession=PF03005.6; Description=Arabidopsis proteins of unknown function
MEWSFSISVVLFLTLLIQIHGSGYLDHKQARGFVENYGCNLFQGSWVYDDSYPLYETSQCPFIEREFDCQNNGRPDKFYLKYRWQPVGCNLTRFNGEDFLTRLRGKSIMFVGDSLGLNQWQSLTCMLHIAVPQAPYSLARNGDVSIFTFPTYDVKVMLSRNALLVDIVGESIGRVLKLDSIQAGQTWKGIDVMIFDSWHWWIHTGRKQPWDLIQVGNRTYRDMDRLGSYEIALNTWAKWVDYNIDPTRTRVFFQGVSPDHQNPAQWGEPRANLCEGKTRPILGFRYPGGPLPAELVLEKVLRAMQKPVYLPDITTLSQLRIDGHPSVYGSGGHLDPDCSHWCLAGVPDTWNELQYASLVKN

SEQ ID NO: 205712 - protein, 106 aa, Glycine max
  Coding DNA Sequence Number=SeqID_88934
MDEDQWMYDSIMSEEVEMNVENEEDADIKVDCFDAFNTFEVFVQFVVVDINTDVRGRVSFLLIACERSEEYRPKKHNLVRTCTDSRKCGCLFKLRAKPVSGGDDWM

SEQ ID NO: 205713 - protein, 96 aa, Glycine max
  Coding DNA Sequence Number=SeqID_88935
MTEKEMITIIVDTLPVFYYEKMVGYAPSSFADLVFASEMINVGLKRGKSDHHALGENEGETHVVTVIPIRPSFPPTQQCHYSANNNPSPYPPPNYP
